United States Patent
Altermann et al.

(10) Patent No.: US 9,441,016 B2
(45) Date of Patent: Sep. 13, 2016

(54) **COMPLETE GENOME SEQUENCE OF THE METHANOGEN *METHANOBREVIBACTER RUMINANTIUM***

(75) Inventors: Eric Heinz Altermann, Palmerston North (NZ); Graeme Trevor Attwood, Ashhurst (NZ); Gregory Cook, Dunedin (NZ); Debjit Dey, Palmerston North (NZ); Scott A. Ferguson, Cambridge (GB); Petrus Hendricus Janssen, Palmerston North (NZ); William John Kelly, Ashhurst (NZ); Zhanhao Kong, Shanghai (CN); Suzanne Lambie, Palmerston North (NZ); Sinead Christine Leahy, Palmerston North (NZ); Dong Li, Palmerston North (NZ); Duncan McMillan, Dunedin (NZ); Sharla McTavish, Loughborough (GB); Diana Pacheco, Palmerston North (NZ); Robert Starr Ronimus, Palmerston North (NZ); Carrie Sang, Palmerston North (NZ); Carl Yeoman, Champaign, IL (US)

(73) Assignee: Pastoral Greenhouse Gas Research Ltd., Wellington (NZ)

( * ) Notice: Subject to any disclaimer, the term of this patent is extended or adjusted under 35 U.S.C. 154(b) by 269 days.

(21) Appl. No.: 13/392,075

(22) PCT Filed: Aug. 27, 2010

(86) PCT No.: PCT/NZ2010/000169
§ 371 (c)(1),
(2), (4) Date: May 7, 2012

(87) PCT Pub. No.: WO2011/025394
PCT Pub. Date: Mar. 3, 2011

(65) Prior Publication Data
US 2013/0217612 A1    Aug. 22, 2013

Related U.S. Application Data

(60) Provisional application No. 61/237,296, filed on Aug. 27, 2009.

(30) Foreign Application Priority Data

Aug. 27, 2009  (NZ) ......................................... 579292

(51) Int. Cl.
| C12N 15/31 | (2006.01) |
| C07K 14/195 | (2006.01) |
| C07K 16/12 | (2006.01) |
| C12N 15/74 | (2006.01) |

(52) U.S. Cl.
CPC ......... *C07K 14/195* (2013.01); *C07K 16/1267* (2013.01); *C12N 15/74* (2013.01); *G01N 2333/195* (2013.01)

(58) Field of Classification Search
None
See application file for complete search history.

(56) References Cited

U.S. PATENT DOCUMENTS

| 2003/0219467 A1 | 11/2003 | Miner et al. |
| 2010/0048595 A1 | 2/2010 | Gordon et al. |
| 2010/0172874 A1 | 7/2010 | Turnbaugh et al. |
| 2010/0184624 A1 | 7/2010 | Samuel et al. |

FOREIGN PATENT DOCUMENTS

| WO | 9511041 | 4/1995 |
| WO | 9700086 | 1/1997 |
| WO | 03038109 | 5/2003 |
| WO | 2006102350 | 9/2006 |
| WO | 2008076696 | 6/2008 |
| WO | 2008151032 | 12/2008 |
| WO | WO 2009041832 A2 * | 4/2009 |
| WO | 2010002890 | 1/2010 |
| WO | 2010030997 | 3/2010 |

OTHER PUBLICATIONS

Samuel et al., "Genomic and metabolic adaptations of Methanobrevibacter smithii to the human gut" PNAS 104:10643-10648 (2007).*
Accession No. ABQ87469, cell division control protein Cdc6 from M. smithii, accessed Jun. 22, 2013.*
Accession No. ABQ87418, 3-hexulose 6-phosphate synthase/formaldehyde activating enzyme from M. smithii, accessed Jun. 22, 2013.*

(Continued)

*Primary Examiner* — Julie Ha
*Assistant Examiner* — Kristina M Hellman
(74) *Attorney, Agent, or Firm* — Loeb & Loeb LLP

(57) ABSTRACT

The present invention includes the complete genome sequence for the methanogen, *Methanobrevibacter ruminantium*, including polynucleotides which encode *M. ruminantium* polypeptides or peptides, as well as polynucleotides from non-coding regions. Also included are the encoded *M. ruminantium* polypeptides and peptides, and antibodies directed to these peptides or polypeptides, in addition to expression vectors and host cells for producing these peptides, polypeptides, polynucleotides, and antibodies. The invention further includes methods and compositions for detecting, targeting, and inhibiting microbial cells, especially methanogen cells such as *M. ruminantium* cells, using one or more of the disclosed peptides, polypeptides, polynucleotides, antibodies, expression vectors, and host cells.

13 Claims, 42 Drawing Sheets

(56) References Cited

OTHER PUBLICATIONS

Attwood et al., "Analysis of the Methanobrevibacter ruminantium draft genome: understanding methanogen biology to inhibit their action in the rumen," Austral. J. Exper. Agricult. 48:83-88 (2008).*
Attwood, et al., "Analysis of the methanobrevibacter ruminatium draft genome: understanding methanogen biology to inhibit their action in the rumen," Austr. J. Exper. Agri. 48:83-88 (published online Jan. 2, 2008).*
UnitProt Accession No. D3E1E0 accessed Aug. 2, 2014 at URL: uniprot.org/uniprot/D3E1E0.*
Attwood, et al., "Analysis of the methanobrevibacter ruminatium draft genome: understanding methanogen biology to inhibit the ir action in the rumen," Austr. J. Exper. Agri. 48:83-88 (published online Jan. 2, 2008).*
Accession No. A5UMS1, M. smithii, accessed Jan. 17, 2014 at http://www.uniprot.org/uniprot/A5UMS1.*
Attwood G T et al: "Analysis of the Methanobrevibacter Ruminantium Draft Genome: Understanding Methanogen Biology to Inhibit Their Action in the Rumen", Australian Journal of Experimental Agriculture, Jan. 2, 2008, 48(2):83-88.
Frick W.R. et al. "The Genome Sequence of Methanosphaera Stadtmanae Reveals Why This Human Intestinal Archaeon is Restricted to Methanol and H2 for Methane Formation and ATP Synthesis," Journal of Bacteriology, Jan. 2006, 188(2):642-658.
Samuel B.S. et al. "Genomic and Metabolic Adaptations of Methanobrevibacter Smithii to the Human Gut,".PNAS, Jun. 19, 2007, 104(25):10643-10648.
Smith D.R. et al. "Complete Genome Sequence of Methanobacterium Thermoautotrophicum Delta H: Functional Analysis and Comparative Genomics," Journal of Bacteriology, Nov. 1997, 179(22):7135-7155.
International Preliminary Patentability Report corresponding to related PCT Application No. PCT/NZ2010/000169; Mailed Feb. 28, 2008; and Written Opinion of the ISA mailed Dec. 2, 2010.

Anderson, I. "Genomic Characterization of Methanomicrobiales Reveals Three Classes of Methanogens", Lawrence Berkeley National Laboratory, Oct. 6, 2009, pp. 1-33.
Attwood, G. "Methanogen genomics to discover targets for methane mitigation technologies and options for alternative H2 utilisation in the rumen", Australian Journal of Experimental Agriculture, 2008, pp. 28-37, vol. 48, Csiro Publishing.
Balch, W.E. et al., "Methanogens: Reevaluation of a Unique Biological Group", Microbiological Reviews, Jun. 1979, pp. 260-296, vol. 43, No. 2.
Balch, W.E. et al., "New Approach to the Cultivation of Methanogenic Bacteria: 2-Mercaptoethanesulfonic Acid (HS-CoM)-Dependent Grouth of Methanobacterium ruminantium in a Pressurized Atmosphere", Applied and Environmental Microbiology, Dec. 1979, pp. 781-791, vol. 32, No. 6.
Bambini, S. et al., "The use of genomics in microbial vaccine development", Drug Discovery Today, Mar. 2009, pp. 252-260, vol. 14, Nos. 5/6, Elsevier Ltd.
Dumitru R. et al., "Targeting Methanopterin Biosynthesis to Inhibit Methanogenesis", Applied and Enviornmental Microbiology, Dec. 2003, pp. 7236-7241; vol. 69, No. 12.
Leahy, S. et al., "The Genome Sequence of the Rumen Methanogen Methanobrevibacter ruminantium Reveals New Possibilities for Controlling Ruminant Methane Emissions", PLos One, Jan. 2010, pp. 1-16, vol. 5, No. 1.
Luo, H. et al., "Differential Expression of Methanogenesis Genes of Methanothermaobacter thermoautotrophicus (Formerly Methanobacterium thermoautotrophicum) in Pure Culure and in Cocultures with Fatty Acid-Oxidizing Syntrophs", Mar. 2002, pp. 1173-1179, vol. 68, No. 3.
Luo, Y. et al., "Pseudomurein endoisopeptidases PeiW and PeiP, two moderately related members of a novel family of proteases produced in Methanothermobacter strains", FEMS Microbiology Letters, 2008, pp. 47-51, Elsevier Science B.V.
Smith, P.H. et al., "Isolation and Characterization of *Methanobacterium ruminantium* N. SP", Journal of Bacteriology, 1958, pp. 713-718, vol. 75, No. 6.

* cited by examiner

Supplementary Figure. [A] Consensus sequence of forty-four C-terminal regions (200 amino acids) from adhesin-like proteins of *M. ruminantium* M

Fig 18

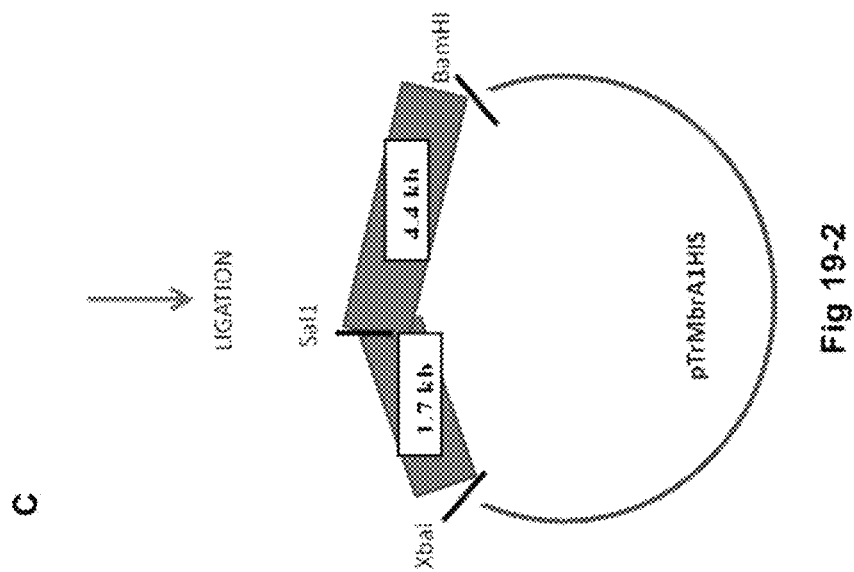

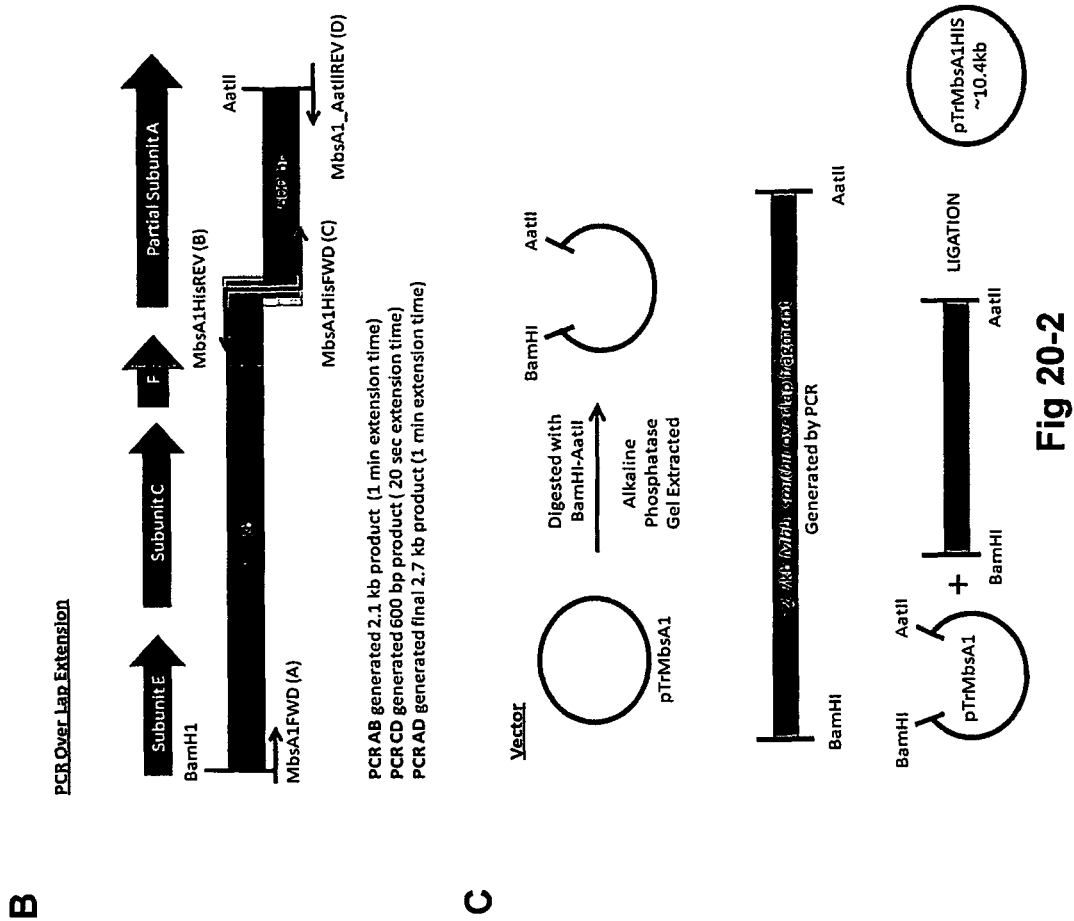

Mbb. ruminantium A₁Aₒ-ATP synthase

| Gene | Subunit | Size (Kda) | Amino Acids (bp) |
|---|---|---|---|
| atpH | H | 11.1 | 104 |
| atpI | i | 73.7 | 667 |
| atpK | k | 15.5 | 161 |
| atpE | E | 22.4 | 208 |
| atpC | C | 42.6 | 384 |
| atpF | F | 11.2 | 105 |
| atpA | A | 64.0 | 584 |
| atpB | B | 51.1 | 462 |
| atpD | D | 26.3 | 231 |

COMPLETE GENOME SEQUENCE OF THE METHANOGEN *METHANOBREVIBACTER RUMINANTIUM*

RELATED APPLICATIONS

This is a national phase application of PCT/NZ2010/000169, filed 27 Aug. 2010, which claims the benefit of U.S. Provisional Patent Application 61/237,296 filed 27 Aug. 2009 and New Zealand Provisional Patent Application 579292 filed 27 Aug. 2009, which are hereby incorporated by reference herein, in their entirety.

FIELD OF THE INVENTION

The present invention encompasses the complete genome sequence for the methanogen, *Methanobrevibacter ruminantium*. The invention encompasses polynucleotides which encode *M. ruminantium* polypeptides or peptides, as well as polynucleotides from non-coding and intergenic regions. Also encompassed are the encoded *M. ruminantium* polypeptides and peptides, and antibodies directed to these peptides or polypeptides. The invention also encompasses expression vectors and host cells for producing these peptides, polypeptides, polynucleotides, and antibodies. The invention further encompasses methods and compositions for detecting, targeting, and inhibiting microbial cells, especially methanogen cells such as *M. ruminantium* cells, using one or more of the disclosed peptides, polypeptides, polynucleotides, antibodies, expression vectors, and host cells.

BACKGROUND OF THE INVENTION

Global surface temperatures are predicted to increase between 1.1° C. to 6.4° C. during the twenty-first century primarily due to increased levels of greenhouse gases (GHGs) in the atmosphere (Solomon et al., 2007). Methane ($CH_4$) is a particularly potent GHG, having a global warming potential 21 times that of carbon dioxide ($CO_2$) (IPCC, 2007) and accounts for 16% of total global GHG emissions (Scheehle & Kruger, 2006). Methane from agriculture represents around 40% of the emissions produced by human-related activities; the single largest source of which is from enteric fermentation in livestock, mainly from ruminant animals (Steinfeld et al., 2006). The worldwide demand for meat and milk is predicted to double by 2050 (Food and Agriculture Organization of the United Nations (FAO), 2008) and ruminant-based agricultural activities are expected to continue to be an important contributor to global $CH_4$ emissions. Therefore, reducing $CH_4$ emissions from ruminants will be important in meeting international commitments under the Kyoto Protocol and also in ensuring the long-term sustainability of ruminant-based agriculture. Moreover, as $CH_4$ production in the rumen accounts for 2-12% of the ingested energy (Johnson & Johnson, 1995), it is predicted that reducing $CH_4$ emissions from ruminants will also make more energy available to the animal and therefore enhance their productivity. Ruminant animals are particularly important to agriculture in New Zealand (NZ), producing a third of NZ's commodity exports (Statistics New Zealand, 2008) and making up a large proportion of the internationally traded lamb and milk products (Leslie et al., 2008). Consequently, NZ has an unusual GHG emission profile, with ruminant $CH_4$ emissions accounting for 31% of NZ's total GHG emissions (Ministry for the Environment, 2007).

Methane is formed in the fore-stomach (reticulorumen, or more commonly known as the rumen) by methanogens, a subgroup of the Archaea. During normal rumen function, plant material is broken down by fibre-degrading microorganisms and fermented mainly to volatile fatty acids (VFAs), ammonia, hydrogen ($H_2$) and $CO_2$. Rumen methanogens principally use $H_2$ to reduce $CO_2$ to $CH_4$ in a series of reactions that are coupled to ATP synthesis. The rumen harbours a variety of different methanogen species, but analyses of archaeal small subunit ribosomal RNA genes from rumen samples of ruminants on differing diets around the world suggest the majority fall into three main groups: *Methanobrevibacter*, *Methanomicrobium* and a large, as yet uncultured, group of rumen archaea referred to as rumen cluster C (Janssen & Kirs, 2008). Sequences affiliated with *Methanobrevibacter* dominate, on average accounting for 61.6% of rumen archaea, with sequences associated with *M. gottschalkii* (33.6%) and *M. ruminantium* (27.3%) being most prominent.

Attempts have been made to inhibit the action of methanogens in the rumen using a variety of interventions but most have failed, or met with only limited success, due to low efficacy, poor selectivity, toxicity of compounds against the host, or build up of resistance to anti-methanogen compounds (McAllister & Newbold, 2008). Currently there are few practical methane reduction technologies available for housed ruminant animals, and no effective technologies for grazing animals. Methane interventions should ideally target features that are conserved across all rumen methanogens, so that no unaffected methanogens can fill the vacated niche. Interventions should also be specific for methanogens only, such that other rumen microbes continue their normal digestive functions. Whole genome sequencing allows the definition of gene targets that are both conserved and specific to rumen methanogens. It is not yet possible to obtain genome sequences of all methanogen groups present in the rumen as some are yet to be cultivated, and a rumen methanogen "metagenome" is prevented by the inability of current sequencing technologies to reassemble complete genomes from complex microbial ecosystems. Therefore, sequencing the genomes of individual rumen methanogens currently in culture is a critical step in developing $CH_4$ mitigation technologies for ruminant animals.

SUMMARY OF THE INVENTION

Here we report the genome sequence of *M. ruminantium* M1T (DSM 1093), the first rumen methanogen genome to be completely sequenced. We have included a particular emphasis on identifying targets for enteric methane mitigation technologies focusing on vaccine development and anti-methanogen drug leads.

The invention thus features the complete genome sequence for the methanogen, *Methanobrevibacter ruminantium*. The invention features, in particular, isolated peptides, polypeptides, and polynucleotides of *M. ruminantium*, as well as expression vectors, host cells, and antibodies, and methods of use thereof, as described in detail herein.

The invention specifically features an isolated peptide comprising, for example, at least a fragment of one amino acid sequence selected from the group consisting of SEQ ID NO: 5867-7584. In a particular aspect, the peptide comprises at least a fragment of an amino acid sequence of any one of SEQ ID NO: 5867-7584. In a further aspect, the peptide comprises at least a fragment of an amino acid sequence of any one of SEQ ID NO: 5867-7584. In another aspect, the peptide is a fragment, for example, comprising at least one amino acid sequence encompassing an extracellular domain of any one of SEQ ID NO: 5867-7584.

The invention specifically features an isolated polypeptide comprising, for example, at least one amino acid sequence selected from the group consisting of SEQ ID NO: 5867-7584. In a particular aspect, the polypeptide comprises the amino acid sequence of any one of SEQ ID NO: 5867-7584. In a further aspect, the polypeptide comprises the amino acid sequence of any one of SEQ ID NO: 5867-7584. In another aspect, the polypeptide is a fragment, for example, comprising at least one amino acid sequence encompassing an extracellular domain of any one of SEQ ID NO: 5867-7584.

The invention additionally features an isolated polynucleotide comprising a coding sequence for at least one peptide. In one aspect, the polynucleotide comprises a coding sequence for at least a fragment of an amino acid sequence selected from the group consisting of SEQ ID NO: 5867-7584. In a particular aspect, the polynucleotide comprises a coding sequence for at least a fragment of any one of SEQ ID NO: 5867-7584. In a further aspect, the polynucleotide comprises a coding sequence for at least a fragment of any one of SEQ ID NO: 5867-7584. In another aspect, the polynucleotide comprises a fragment of a coding sequence, for example, least one amino acid sequence encompassing an extracellular domain of any one of SEQ ID NO: 5867-7584.

The invention additionally features an isolated polynucleotide comprising a coding sequence for at least one polypeptide. In one aspect, the polynucleotide comprises a coding sequence for at least one amino acid sequence selected from the group consisting of SEQ ID NO: 5867-7584. In a particular aspect, the polynucleotide comprises a coding sequence for any one of SEQ ID NO: 5867-7584. In a further aspect, the polynucleotide comprises a coding sequence for any one of SEQ ID NO: 5867-7584. In another aspect, the polynucleotide comprises a fragment of a coding sequence, for example, least one amino acid sequence encompassing an extracellular domain of any one of SEQ ID NO: 5867-7584.

In an additional aspect, the invention features an isolated polynucleotide comprising, for example, a nucleic acid sequence selected from the group consisting of SEQ ID NO: 1-1718. In a particular aspect, the polynucleotide comprises the nucleic acid sequence of SEQ ID NO: 1-1718. In another aspect, the polynucleotide is a fragment or an oligonucleotide comprising, for example, the nucleic acid sequence encompassing an extracellular domain as encoded by any one of SEQ ID NO: 1-1718. In addition, the invention encompasses an isolated polynucleotide, or fragment thereof, which hybridizes to any one of the nucleic acid sequences of SEQ ID NO: 1-1718. The invention further encompasses an isolated polynucleotide comprising the complement, reverse complement, reverse sequence, or fragments thereof, of any one of the nucleic acid sequences.

The invention features an expression vector comprising a polynucleotide of the invention. In one aspect, the expression vector comprises a coding sequence for at least a fragment of an amino acid sequence selected from the group consisting of SEQ ID NO: 5867-7584. In a particular aspect, the expression vector comprises a coding sequence for at least a fragment of at least one of SEQ ID NO: 5867-7584. In a further aspect, the expression vector comprises a coding sequence for at least one amino acid sequence of at least one of SEQ ID NO: 5867-7584. In another aspect, the expression vector comprises a coding sequence for at least one amino acid sequence encompassing an extracellular domain of any one of SEQ ID NO: 5867-7584.

The invention also features a host cell, for example, a microbial host cell, comprising at least one expression vector.

The invention specifically features an antibody directed to a peptide, polypeptide, or polynucleotide as disclosed herein. In certain aspects, the antibody is directed to an amino acid sequence selected from the group consisting of SEQ ID NO: 5867-7584. In alternate aspects, the antibody is directed to at least a fragment of a polypeptide sequence selected from the group consisting of SEQ ID NO: 5867-7584. In a particular aspect, the antibody binds to at least a fragment of the peptide sequence of any one of SEQ ID NO: 5867-7584. In a further aspect, the antibody binds to at least a fragment of the polypeptide sequence of any one of SEQ ID NO: 5867-7584. In an alternate aspect, the antibody binds to at least a fragment of a peptide or polypeptide encompassing an extracellular domain of any one of SEQ ID NO: 5867-7584. In another aspect, the antibody includes one or more fusions or conjugates with at least one cell inhibitor, for example, anti-methanogenesis compounds (e.g., bromoethanesulphonic acid), antibodies and antibody fragments, lytic enzymes, peptide nucleic acids, antimicrobial peptides, and other antibiotics as described in detail herein.

The invention additionally features modified peptides or polypeptides, e.g., for at least one of SEQ ID NO: 5867-7584, including biologically active alterations, fragments, variants, and derivatives, described herein. Also featured are polynucleotides encoding these modified peptides or polypeptides, as well as alterations, fragments, variants, and derivatives of the disclosed polynucleotides; antibodies raised using these modified peptides, polypeptides, or polynucleotides; expression vectors comprising these polynucleotides; and host cells comprising these vectors. Further featured are modified antibodies, including biologically active alterations, fragments, variants, and derivatives, described herein. In specific aspects, the compositions and methods of the invention employ these modified peptides, polypeptides, polynucleotides, antibodies, or corresponding expression vectors or host cells.

The invention features a composition comprising an isolated peptide or polypeptide, e.g., at least one of SEQ ID NO: 5867-7584. Also featured is a composition comprising an isolated polynucleotide, e.g., at least one of SEQ ID NO: 1-1718. The invention additionally features a composition comprising an antibody, e.g., directed to a peptide, polypeptide, or polynucleotide sequence disclosed herein. Further featured is a composition that includes an expression vector, or host cell comprising an expression vector, in accordance with the invention. The composition can include any one of the biologically active alterations, fragments, variants, and derivatives described herein. The compositions can include at least one cell inhibitor (e.g., as a fusion or conjugate), and can be formulated, for example, as pharmaceutical compositions, in particular, vaccine compositions.

The invention also features a composition of the invention as part of a kit for targeting and/or inhibiting microbial cells, especially methanogen cells, in accordance with the disclosed methods. The kits comprise: a) at least one composition as set out herein; and b) optionally, instructions for use, for example, in targeting cells or inhibiting cell growth or replication for methanogens or other microbes.

The invention also features a method for producing a peptide or polypeptide, e.g., at least a fragment of any one of SEQ ID NO: 5867-7584, the method comprising: a) culturing an expression vector or host cell comprising an expression vector, which comprises at least part of a coding sequence for at least one peptide or polypeptide under conditions suitable for the expression of the peptide or polypeptide; and b) recovering the peptide or polypeptide from the culture. In particular aspects, the peptide or polypeptide comprises at least one amino acid sequence selected from the group consisting of SEQ ID NO: 5867-7584, or modified sequences thereof.

The invention also features a method for producing an antibody, e.g., directed to at least a fragment of any one of SEQ ID NO: 5867-7584, the method comprising: a) culturing an expression vector or host cell comprising an expression vector, which comprises at least part of a coding sequence for at least one antibody or antibody fragment under conditions suitable for the expression of the antibody or antibody fragment; and b) recovering the amino acid sequence from the culture. In particular aspects, the antibody or antibody fragment is directed to at least one amino acid sequence selected from the group consisting of SEQ ID NO: 5867-7584, or modified sequences thereof. In an alternate aspect, the antibody is produced by administration to a host animal, as described in detail herein.

The invention additionally features a method for producing an antibody, e.g., directed to at least a fragment of any one of SEQ ID NO: 5867-7584, which comprises a fusion or conjugate with at least one cell inhibitor. Such method comprises: a) culturing an expression vector or host cell comprising an expression vector, which comprises a coding sequence for at least one antibody or antibody fragment under conditions suitable for the expression of the antibody or antibody fragment; b) forming a fusion or conjugate to the antibody or antibody fragment (e.g., by expression of the fused sequence or chemical conjugation to the cell inhibitor); and c) recovering the fusion or conjugate.

In particular aspects, the antibody is directed to at least a fragment of any one of SEQ ID NO: 5867-7584, or modified sequences thereof. In further aspects, the inhibitor is selected from anti-methanogenesis compounds (e.g., bromoethanesulphonic acid), antibodies and antibody fragments, lytic enzymes, peptide nucleic acids, antimicrobial peptides, and other antibiotics as described in detail herein. In an alternate aspect, the antibody is produced by administration to a host animal and then conjugated, as described in detail herein.

In addition, the invention features a method of inhibiting (e.g., inhibiting growth or replication) of a microbial cell, in particular, a methanogen cell, comprising: contacting the cell with antibody or antibody fragment, e.g., directed to at least a fragment of any one of SEQ ID NO: 5867-7584, or an antibody fusion or conjugate, or any modified antibody. As another method, the cell is inhibited by administration of a vaccine composition as described in detail herein.

The invention further features a method of inhibiting (e.g., inhibiting growth or replication) of a microbial cell, in particular, a methanogen cell, comprising: a) optionally, producing or isolating at least one antibody as disclosed herein; and b) contacting the cell with the antibody. In a particular aspect, the antibody is directed to at least a fragment of any one of SEQ ID NO: 5867-7584, or a modified sequence thereof. In certain aspects, the antibody further comprises at least one cell inhibitor, attached, for example, as a fusion or conjugate. In other aspects, the antibody is administered to a subject as a composition, e.g., a vaccine composition.

Additionally, the invention features a method of inhibiting (e.g., inhibiting growth or replication) of a microbial cell, in particular, a methanogen cell, comprising: a) optionally, producing or isolating at least one peptide or polypeptide as disclosed herein; and b) administering the peptide or polypeptide to a subject to induce an immune response thereto. In a particular aspect, the peptide or polypeptide comprises at least one amino acid sequence selected from the group consisting of SEQ ID NO: 5867-7584, or a modified sequence thereof. In other aspects, the peptide or polypeptide is administered to a subject as a composition, e.g., a vaccine composition.

The invention furthermore features a method of detecting and/or measuring the levels of a polypeptide, in particular, a cell surface polypeptide, or corresponding peptides or polynucleotides, comprising: 1) contacting a sample from a subject with an antibody directed to the polypeptide (e.g., at least a fragment of any one of SEQ ID NO: 5867-7584, or a modified sequence thereof), or a corresponding peptide or polynucleotide (e.g., at least a fragment of one of SEQ ID NO: 1-1718, or a modified sequence thereof); and 2) determining the presence or levels of the antibody complex formed with the corresponding polypeptide, peptide, or polynucleotide in the sample. Such methods can also be used for detecting and/or measuring the levels of a microbial cell, in particular, a methanogen cell.

The invention also features a method of detecting and/or measuring the levels of a polynucleotide, in particular, a polynucleotide encoding a cell surface component, comprising: 1) contacting a sample from a subject with a complementary polynucleotide (e.g., a sequence complementary to at least a fragment of any one of SEQ ID NO: 1-1718, or a modified sequence thereof); and 2) determining the presence or levels of the hybridization complex formed with the polynucleotide in the sample. Such methods can also be used for detecting and/or measuring the levels of a microbial cell, in particular, a methanogen cell.

In particular aspects, the methods of the invention utilize in vivo or in vitro expression components. In other aspects, the methods employ peptides, polypeptides, polynucleotides, or antibodies produced by recombinant, synthetic, or semi-synthetic means, or by endogenous means.

Other aspects and embodiments of the invention are described herein below.

BRIEF DESCRIPTION OF THE DRAWINGS

This invention is described with reference to specific embodiments thereof and with reference to the figures.

Figure 3:
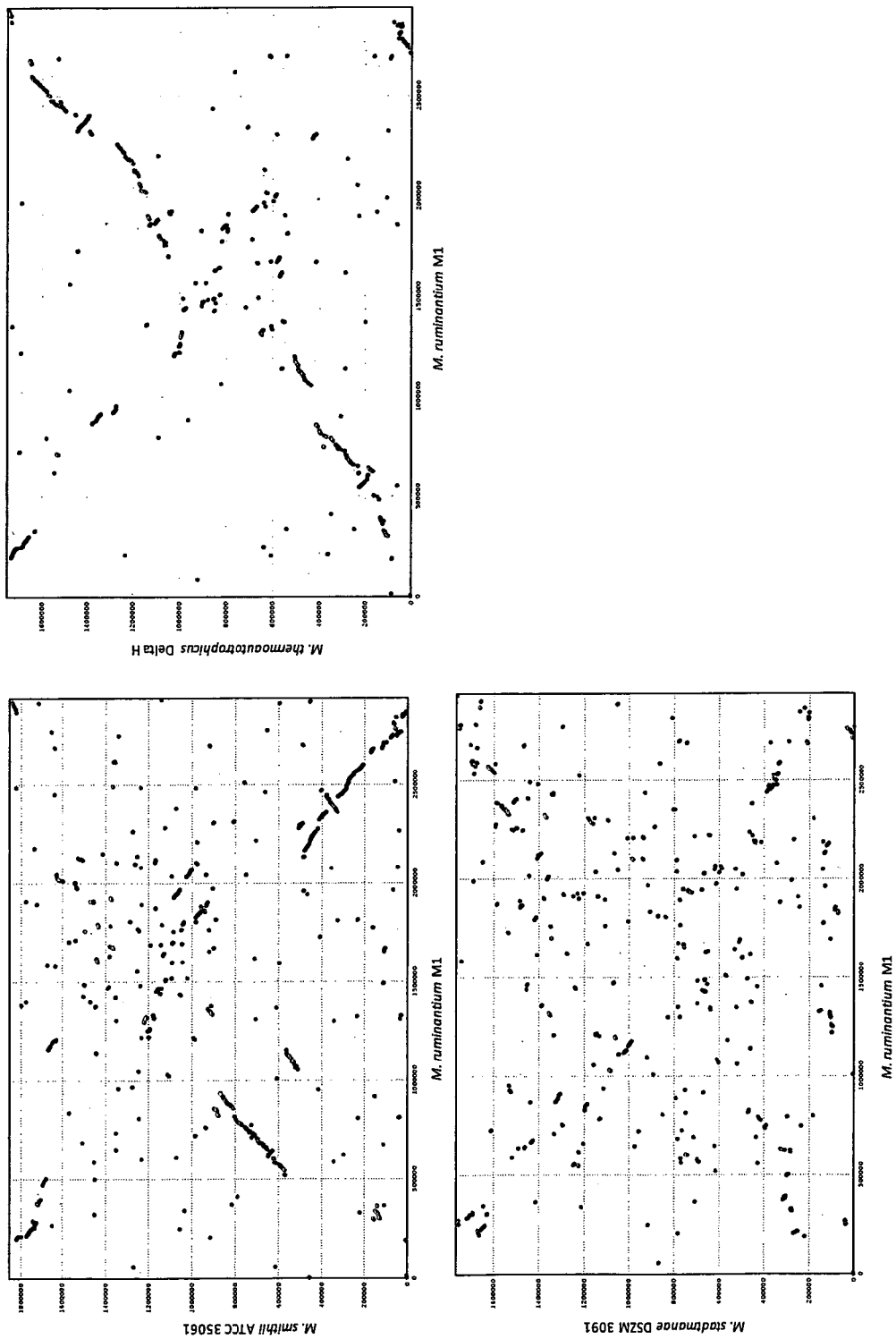

FIG. 3: PROmer alignments (Delcher et al., 2003) of *M. ruminantium* M1 against complete Methanobacteriales genomes. Whenever the two sequences agree, a shaded line or dot is plotted. The forward matches are displayed in the lighter shade, while the reverse matches are plotted in the darker shade. Where the two sequences were perfectly identical, a single lighter line would extend from the bottom left to the top right. An X-shape pattern is visible is all three synteny plots indicating moderately diverged Methanobacteriales genomes. It has been proposed that the X-pattern is generated by symmetric chromosomal inversions around the origin of replication (Emanuelsson, 2007). Units displayed in base-pairs.

Figure 4:
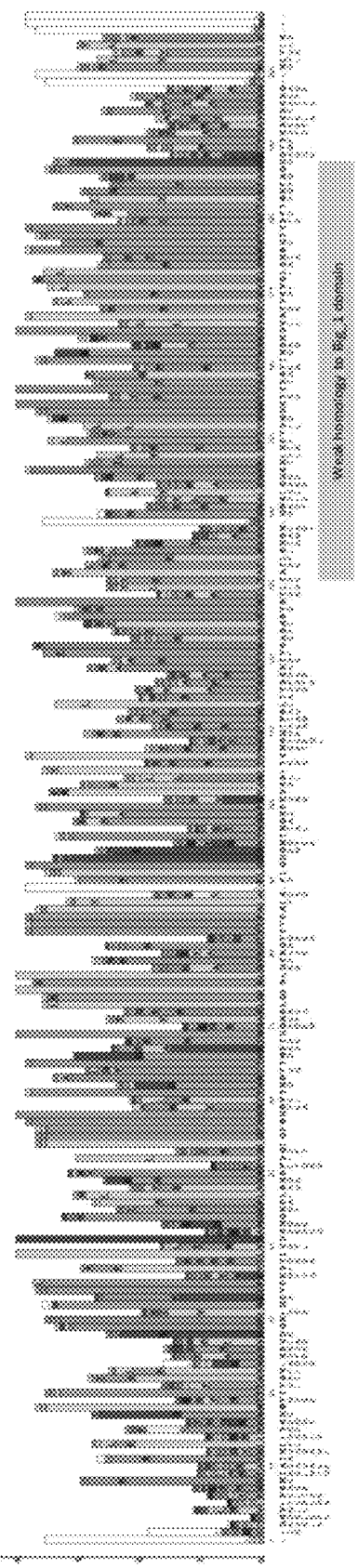

FIG. 4: Consensus sequence of forty-four C-terminal regions (200 amino acids) from adhesin-like proteins of *M. ruminantium* M1 (A). LogoBar display of this consensus. In both figures region of homology to Big_1 domain (PfamO2369) is highlighted in grey (B).

Figure 5:
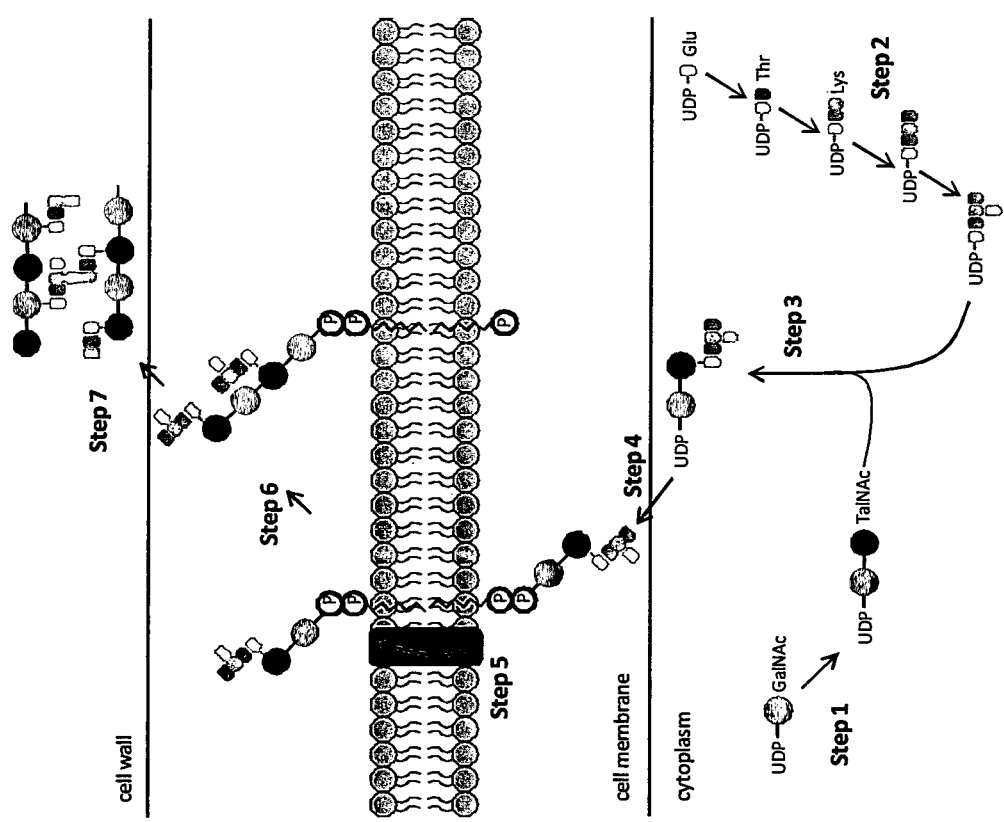

FIG. 5: Proposed biosynthetic pathway for pseudomurein in M1 (Kandler and König H, 1998; König et al., 1994). The disaccharide backbone of *M. ruminantium* M1 pseudomurein consists of N-acetylgalactosamine (GalNAc) and N-acetyltalosaminuronic acid (TalNAc) in a β(1-3) linkage. TalNac has not been detected as a monomer and it is believed to be formed during the synthesis of the disaccharide probably by epimerization and oxidation of UDP-GalNAc (Step 1). Synthesis of the pentapeptide involved in crosslinking is believed to start with UDP-glutamic acid followed by stepwise addition of L-amino acids (Step 2). The amino acids found in the pentapeptide are usually alanine, lysine (Lys) and glutamic acid (Glu), but *M. ruminantium* M1 is reported to contain threonine (Thr) instead of alanine (Kandler and König, 1978). The UDP activated pentapetide is linked to the disaccharide to give a UDP-disaccharide pentapeptide (Step 3) which is subsequently translocated to the membrane via covalent bond formation with a membrane embedded undecaprenyl phosphate (Step 4). Following their intracellular biosynthesis the pseudomurein repeating units must be exported and assembled. Homologs of the *E. coli* peptidoglycan lipid II flippase (MurJ) have been reported for pseudomurein producing methanogens (Ruiz, 2008; Step 5), but there are no genes similar to the penicillin binding proteins that carry out the transglycosylation (Step 6) and transpeptidation reactions in bacterial peptidoglycan assembly. Peptide crosslinking of pseudomurein requires removal of a terminal residue of one peptide and linkage from a glutamic acid to the lysine of an adjacent peptide (Step 7), and is probably carried out by transglutaminases. None of the enzymes involved in pseudomurein biosynthesis have been characterized, but analysis of the genome sequence has suggested candidates to carry out several of the steps. Several of these have homologs only in those methanogens with pseudomurein-containing cell walls. Two other transmembrane proteins of unknown function (mru1585 and mru1635) are also only found in pseudomurein-containing species.

Figure 6:
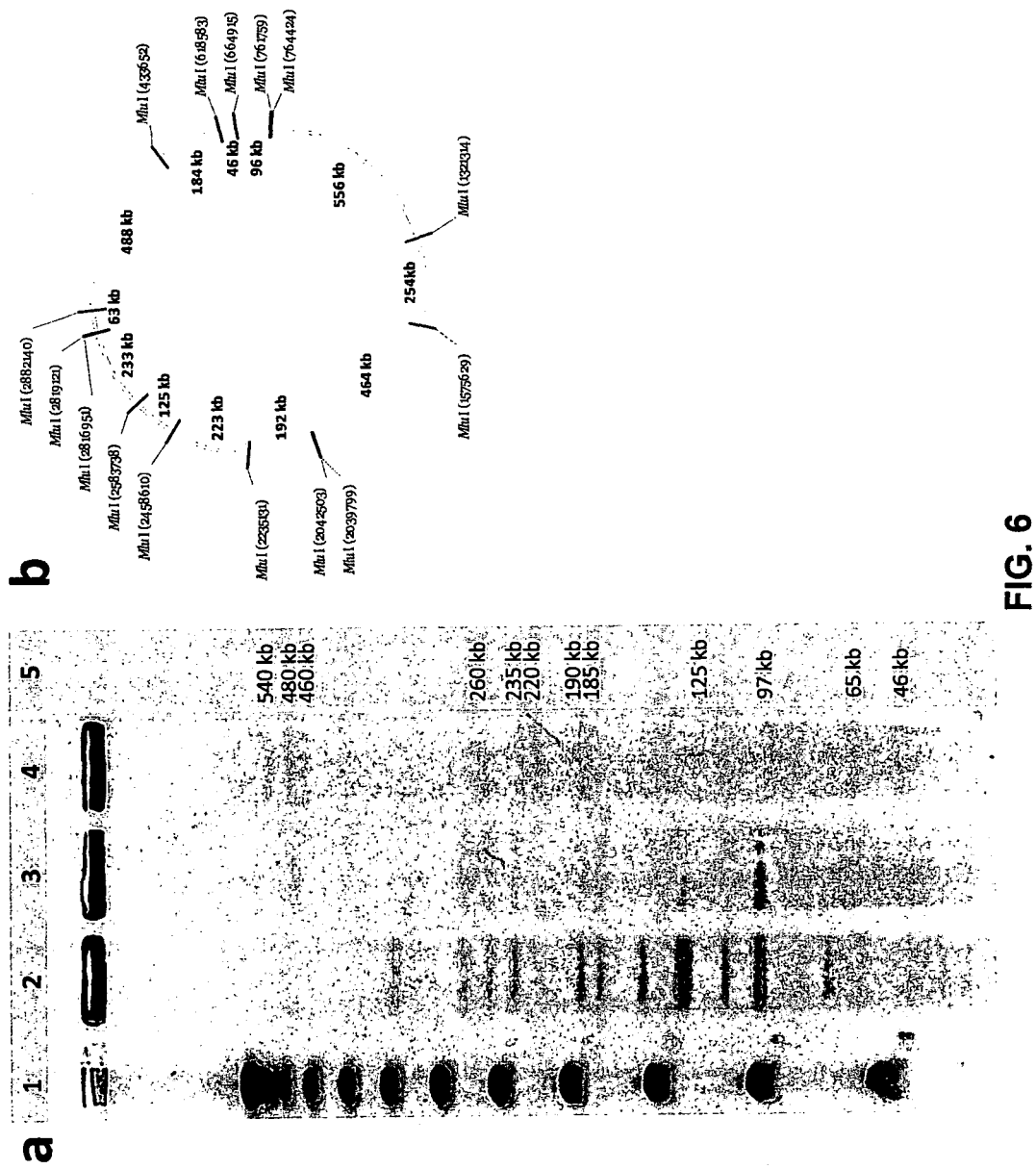

FIG. 6: (a) PFGE of genomic DNA from M1. Lane 1, λ ladder (New England Biolabs); Lane 2, ApaI/BssHII double digest; Lane 3, ApaI digest; Lane 4, MluI digest; Lane 5, Sizes of MluI fragments. The bands in the λ ladder are multiples of 48.5 kb. (b) In silico restriction map of the M1 chromosome showing the position and fragment size of the MluI digest.

Figure 7:
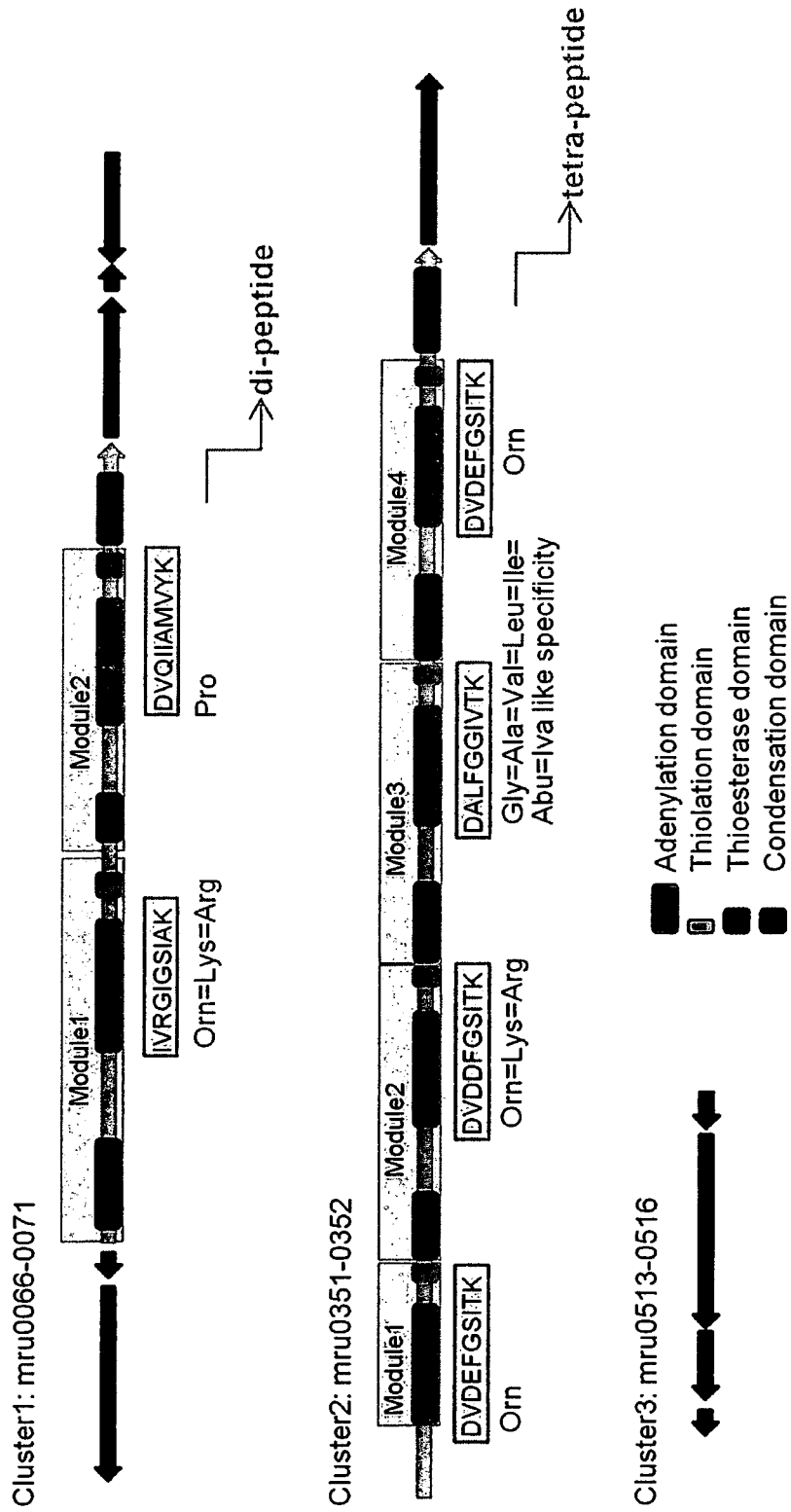

FIG. 7: Gene organisation of three clusters proposed to be involved in secondary metabolite metabolism in M1. Cluster1. Mru0068 is predicted to encode two non-ribosomal peptide synthetase (NRPS) modules, each containing condensation, adenylation and thiolation domains. The presence of a condensation domain in the first module is often associated with NRPSs that make N-acylated peptides (Steller et al., 1999). The second module is followed by a terminal thioester reductase domain which is thought to release the peptide from the final thiolation domain. Mru0068 is surrounded by genes that encode two serine phosphatases (mru0066, mru0071), an anti-sigma factor antagonist (mru0067) and a MatE efflux family protein (mru0069) which are likely to be involved in environment sensing, regulating NRPS expression and export of the NRP, respectively. Cluster2. The second NRPS gene (mru0351) contains 4 modules and a C-terminal thioester reductase domain. Immediately downstream of mru0351 is another MatE efflux family protein (mru0352), presumably involved in the efflux of the NRP. Cluster3. A small cluster of genes elsewhere in the genome (mru0513-0516) appears to encode NRPS-associated functions. The cluster includes a 4'-phosphopantetheinyl transferase (mru0514) which primes NRPSs by adding a phosphopantetheinyl group to a conserved serine within the thiolation domain, an acyltransferase (mru0512) possibly involved in NRP acylation, a serine phosphatase (mru0515), an anti-sigma factor antagonist (mru0513), and an anti-sigma regulatory factor serine/threonine protein kinase (mru0516) that may function in sensing the environment and NRPS regulation. Although the products of each NRPS are unknown, an analysis of adenylation domain amino acid sequences by NRPS predictor (Rausch et al., 2005) predicts 10 residues which are important for substrate binding and catalysis.

Figure 8:
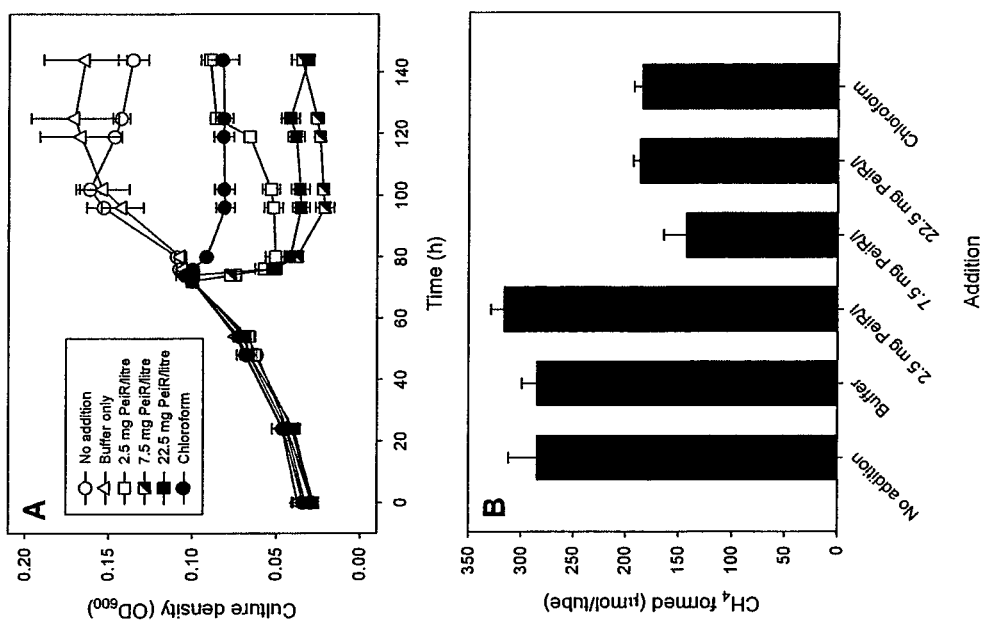

FIG. 8: Effect of the lytic enzyme PeiR on M1 growth in vitro. (A) Addition of PeiR to growing cultures at 73 h resulted in a dramatic drop in culture density, indicative of cell lysis. At a low concentration of PeiR (final concentration of 2.5 mg per liter), the cultures were able to recover, indicated by the increase in culture density after 100 h, and (B) by production of methane at levels similar to that of cultures receiving no PeiR. Addition of higher concentrations of PeiR (7.5 and 22.5 mg per liter) resulted in a lasting effect, with (A) no subsequent recovery of growth and (B) a reduced methane yield. Chloroform, a known potent inhibitor of methanogens, resulted in a similarly reduced methane yield (B), but the decrease in culture density was less (A), as expected since it halts metabolism rather than lysing cells. PeiR was added to 10 ml cultures in 0.1 ml of buffer. The buffer alone had no effect. The symbols (A) and solid bars (B) are means of 3 replicates, and the thin vertical bars represent one standard error on either side of the mean.

Figure 9:
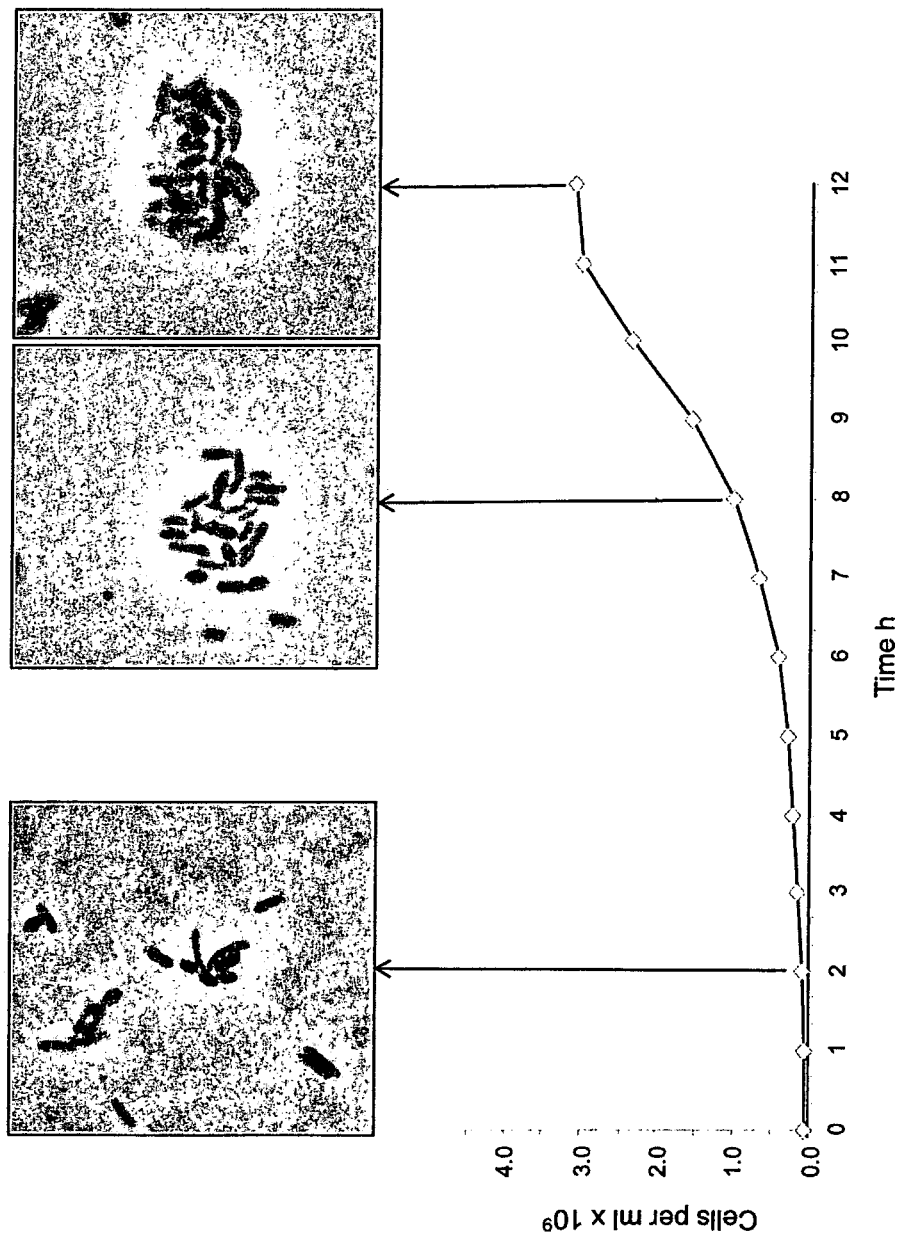

FIG. 9: Observation of interspecies interactions between *M. ruminantium* M1 and *B. proteoclasticus* B316$^T$. Graph displays growth rate of M1 in co-culture with B316. Microscopic images taken at 2, 8 and 12 h post inoculation of B316 (lighter, rod-shaped organism) into BY+ (+0.2% xylan) media containing a mid-exponential M1 culture (darker, short ovoid rod-shaped organism). Growth as determined by Thoma slide enumeration, is shown along with sampling time.

Figure 10:
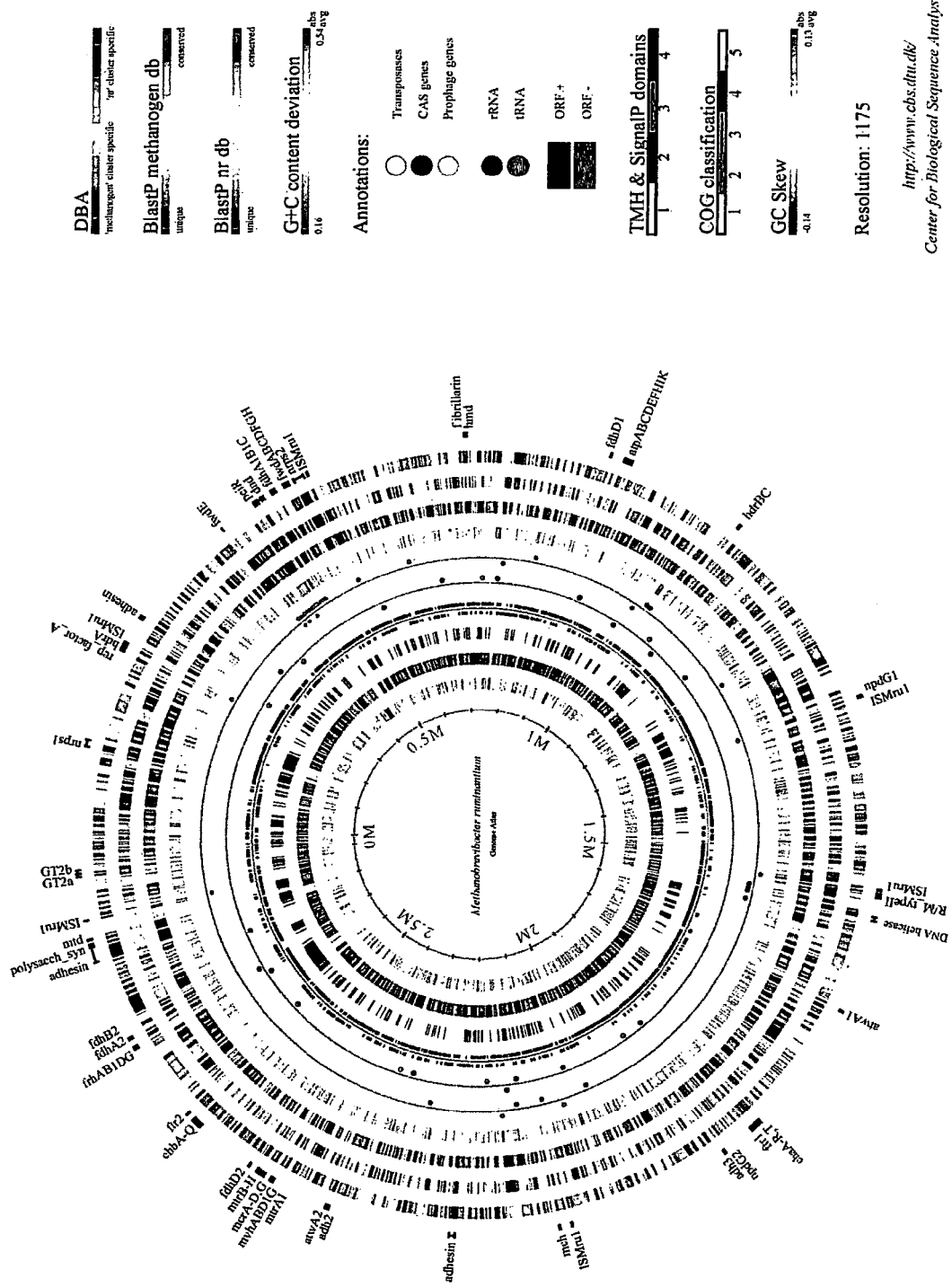

FIG. 10: Genome atlas of *M. ruminantium* M1. The circle was created using Genewiz (Jensen et al., 1999) and in house developed software. The right-hand legend describes the single circles in the top-down-outermost-innermost direction. Outermost 1$^{st}$ ring: Differential Blast Analysis between the non-redundant (nr) database (Ring 3) and a custom methanogen database (Ring 2). Regions in medium-dark shading indicate protein sequences highly conserved between *M. ruminantium* and at methanogens but not found in the nr database. Regions in darker shading indicate protein sequences conserved between *M. ruminantium* and the nr database but not present in other methanogens genomes. $2^{nd}$ ring: gapped BlastP results using a custom methanogen database consisting of publicly accessible genome project sequences (Table 10), $3^{rd}$ ring: gapped BlastP results using the non-redundant database minus published methanogen genome project sequences. In both rings, regions in medium-dark shading represent unique proteins in *M. ruminantium*, whereas highly conserved features are shown in darker shading. The degree of colour saturation corresponds to the level of similarity. $4^{th}$ ring: G+C content deviation: medium shading highlights low-GC regions, light shading high-GC islands. Annotation rings 5 and 6 indicate absolute position of functional features as indicated. $7^{th}$ ring: ORF orientation. ORFs in sense orientation (ORF+) are shown in dark shading; ORFs oriented in antisense direction (ORF−) are shown in medium-dark shading. $8^{th}$ ring: prediction of membrane bound and cell surface proteins. White: no transmembrane helices (TMH) were identified, Black: ORFs with at least one TMH, Medium-dark shading: ORFs predicted to encompass a Signal Peptide sequence and Medium shading: ORFs predicted to incorporate both TMH and SignalP domains. $9^{th}$ ring: COG classification. COG families were assembled into 5 major groups: information storage and processing (light shading); cellular processes and signalling (medium shading); metabolism (light-medium shading); poorly characterized (dark shading); and ORFs with uncharacterized COGs or no COG assignment (grey). $10^{th}$ ring: GC-skew. Innermost ring: genome size (Mb). Selected features representing single ORFs are shown outside of circle 1 with bars indicating their absolute size. Origin and terminus of DNA replication are identified in light-medium shading and dark-medium shading, respectively.

Figure 11:
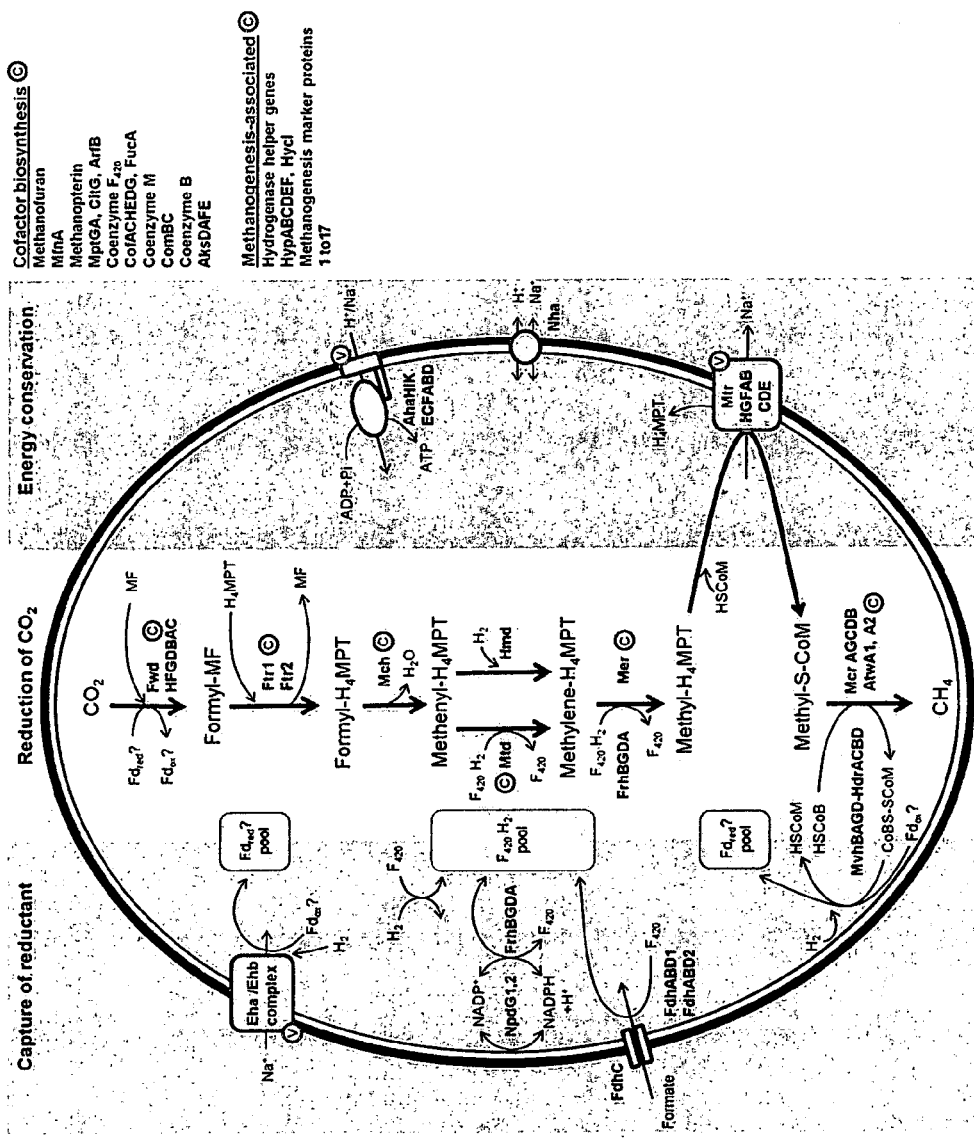

FIG. 11: Methanogenesis pathway. The predicted pathway of methane formation in M1 based on the scheme of Thauer et al. (Thauer et al., 2008) for methanogens without cytochromes. The pathway is divided into three partitions; capture of reductant (left side, medium shaded background), reduction of $CO_2$ (centre, lighter shaded background) and energy conservation (right side, darker shaded background). The main reactions are indicated by thick arrows and enzymes catalysing each step are coloured green. Cofactor participation is indicated with thin arrows. Membrane located proteins are coloured light brown and potential vaccine and chemogenomic targets are labelled with a circled V or C respectively. Small upwards arrows signify up-regulated genes during co-culture with *Butyrivibrio proteoclasticus*. Full gene names and corresponding locus tag numbers can be found in Table 9, below. $H_4MPT$; tetrahydromethanopterin; MF, methanofuran; $F_{420}$, co-factor $F_{420}$ oxidised; $F_{420}H_2$, co-factor $F_{420}$ reduced; $Fed_{(ox)}$?, unknown oxidised ferredoxin; $Fed_{(red)}$?, unknown reduced ferredoxin; HSCoM, reduced coenzyme M; HSCoB, reduced coenzyme B, CoBS-SCoM, coenzyme B-coenzyme M heterodisulphide; NADP+, nicotinamide adenosine dinucleotide phosphate non-reduced; NADPH, nicotinamide adenosine dinucleotide phosphate reduced.

Figure 12:
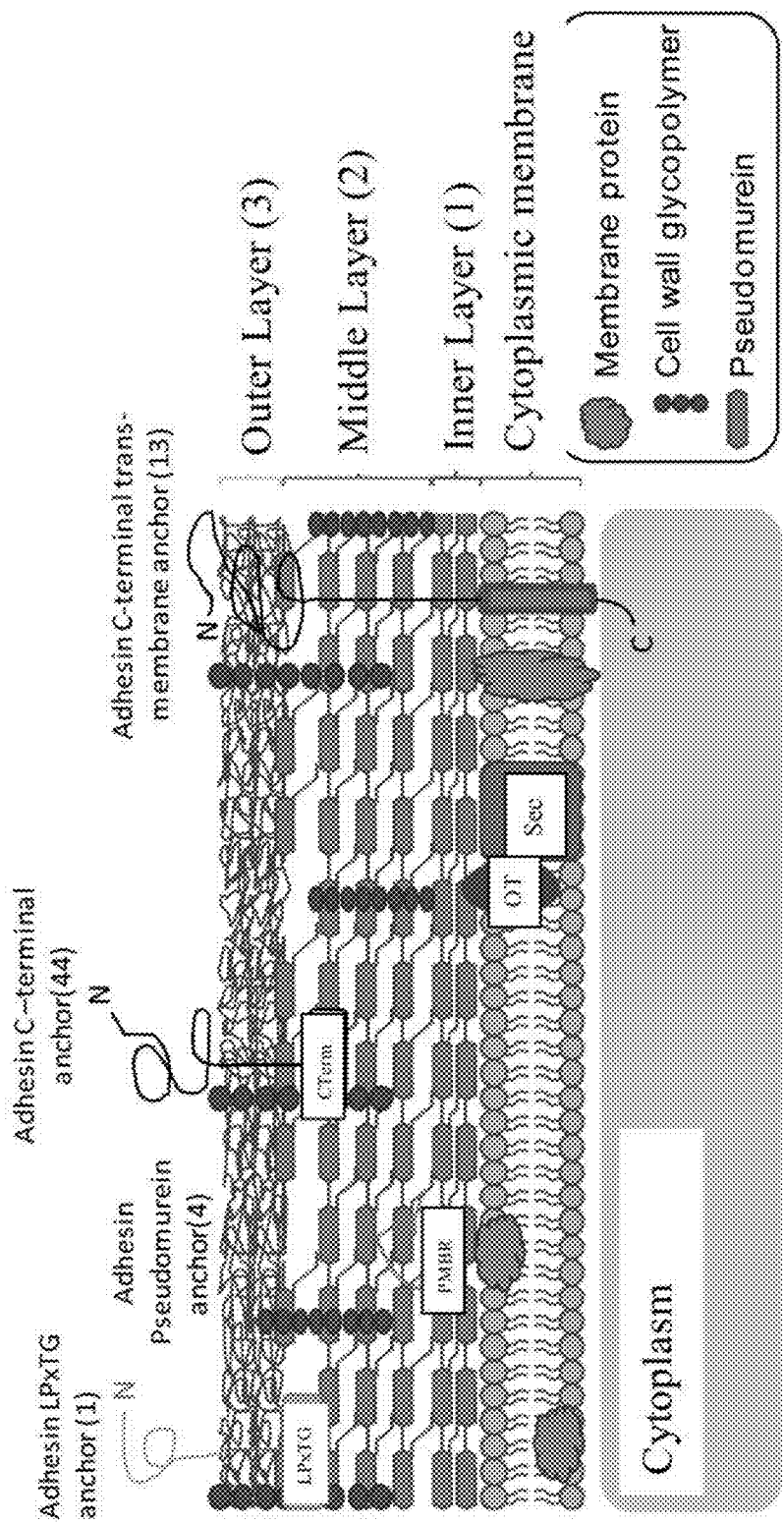

FIG. 12: Cell envelope topography of M1. Ultrastructural studies of M1 (Zeikus & Bowen, 1975; Miller, 2001) show that the cell wall is composed of three layers and is comparable to the organization seen in Gram positive bacteria (Graham & Beveridge, 1994). The three layers can be described as: (1) a thin electron-dense inner layer composed of compacted newly synthesised pseudomurein, (2) a thicker less-electron-dense middle layer which is also composed of pseudomurein, and (3) a rough irregular outer layer that is distal to the pseudomurein layers and assumed to be composed of cell wall glycopolymers, wall associated proteins and possibly other components. Representative adhesin-like proteins with different cell-anchoring domains are shown. The number of these proteins predicted in the M1 genome is shown in brackets. OT, oligosaccharyl transferase; Sec, Sec protein secretion pathway; PMBR, pseudomurein binding repeat (PF09373); M1-C, M1 adhesin-like protein conserved C-terminal domain.

Figure 13:
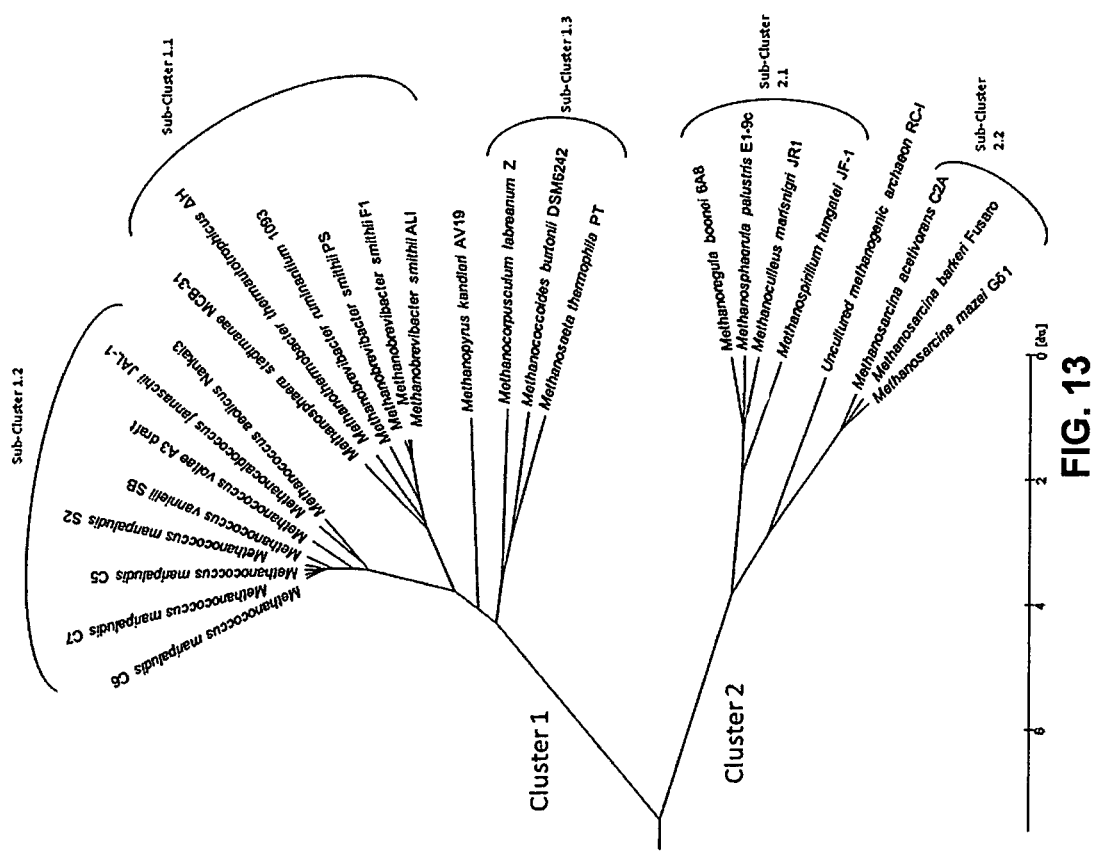

FIG. 13: Functional Genome Distribution (FGD) of 26 methanogen genomes. Publicly available complete genomes were downloaded in GenBank format were possible. Publicly available draft phase genomes were downloaded in FASTA format, concatenated using a universal spacer-stop-spacer sequence (TTAGTTAGTTAG; SEQ ID NO: 7585) and automatically annotated using GAMOLA. Predicted ORFeomes of all genomes were subjected to an FGD analysis and the resulting distance matrix was imported into MEGA4 (Samuel et al., 2007). The functional distribution was visualised using the UPGMA method (Boekhorst et al., 2005). The optimal tree with the sum of branch length=49.7 is shown. The tree is drawn to scale, with branch lengths in the same units as those of the functional distances used to infer the distribution tree. Accession numbers for individual genomes can be found in Table 10, below.

Figure 14:
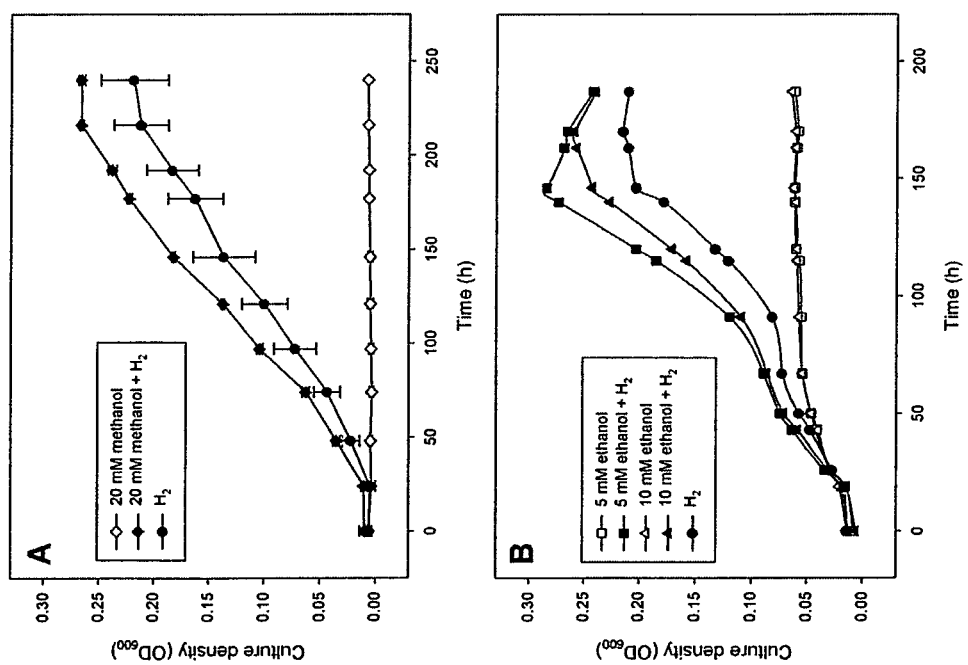

FIG. 14: Stimulation of growth of M1 by alcohols. The inclusion of (A) 20 mM methanol or (B) 5 or 10 mM ethanol when M1 was grown on H2 resulted in an increase in culture density (measured as OD600 nm) compared to cultures grown on H2 alone. H2 was added once only, at the time of inoculation, by gassing the cultures with H2+CO2 (4:1) to 180 kPa overpressure. Higher concentrations of ethanol (20 mM) resulted in some inhibition of growth (not shown), and there was no stimulation by isopropanol (5 to 20 mM; not shown). No growth occurred when cultures were supplemented with methanol (A), ethanol (B), or isopropanol (not shown) when no H2 was added, and no methane was formed by those cultures. The symbols in panel are means of 4 replicates, and the thin vertical bars in panel (A) represent one standard error on either side of the mean. Error bars are omitted from panel (B) for the sake of clarity.

Figure 15:
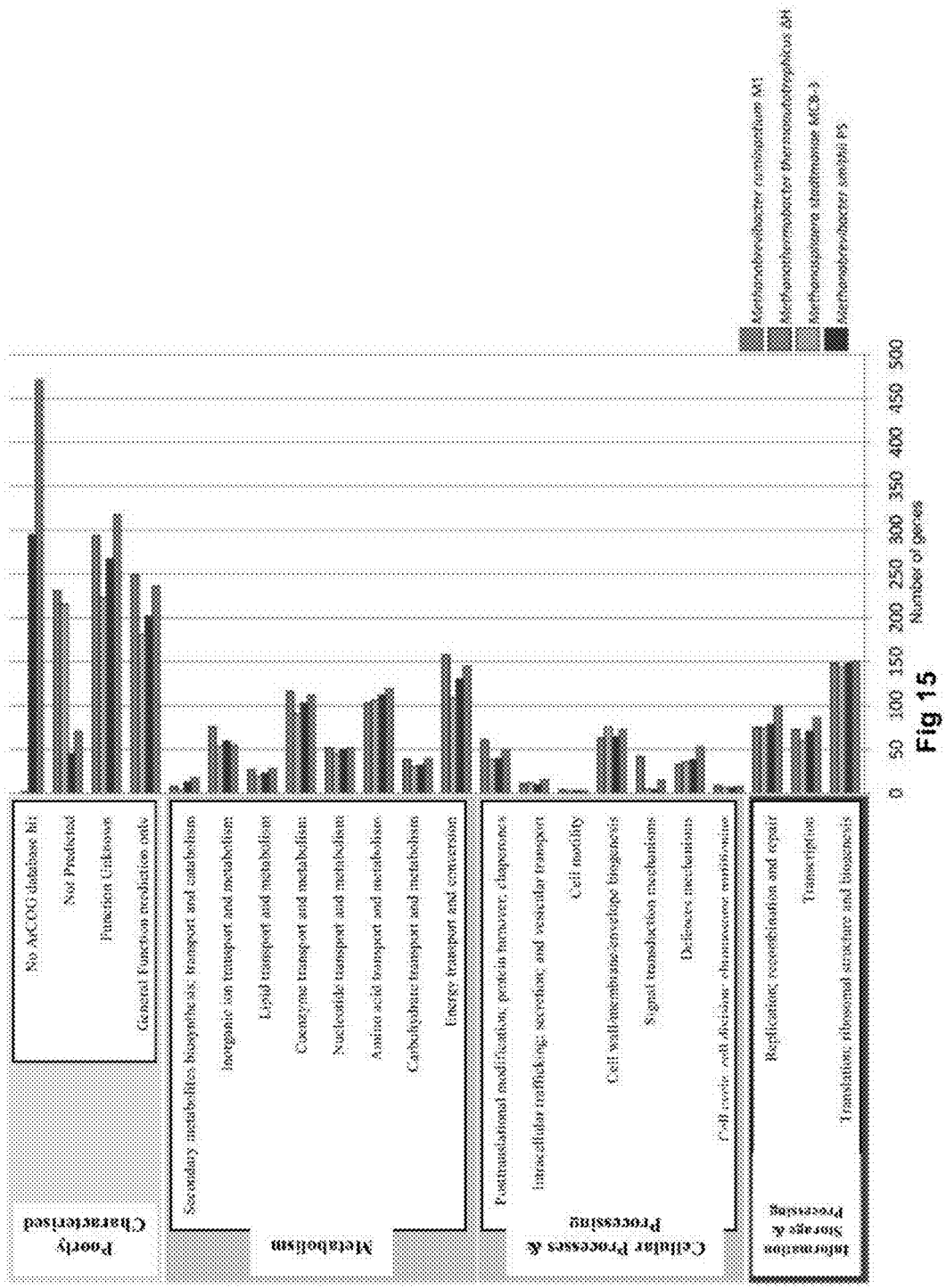

FIG. 15: Distribution of genes in the predicted ORFeomes of members of the Methanobacteriales classified according to functional categories in the archaeal COG database (Makarova et al., 2007).

Figure 16:
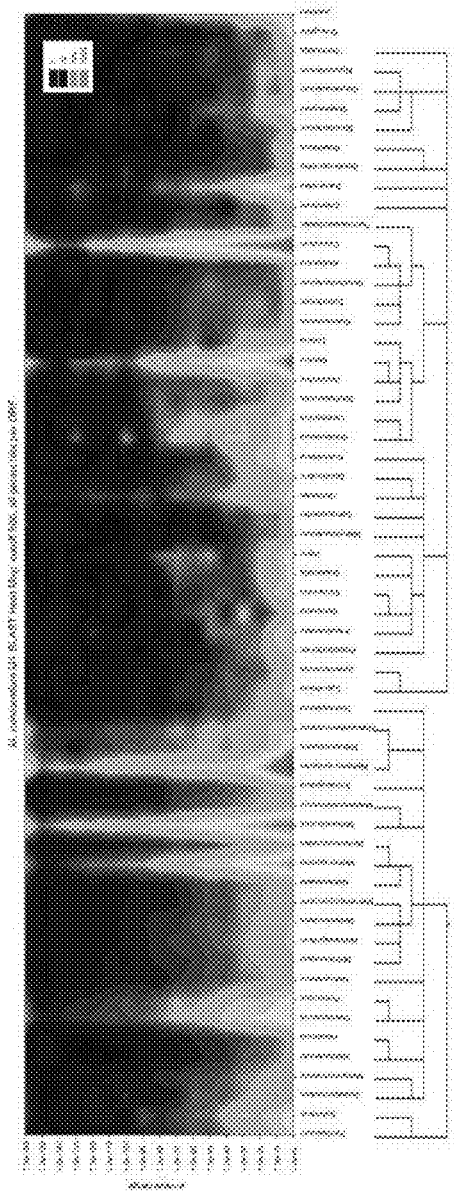
Figure 16:
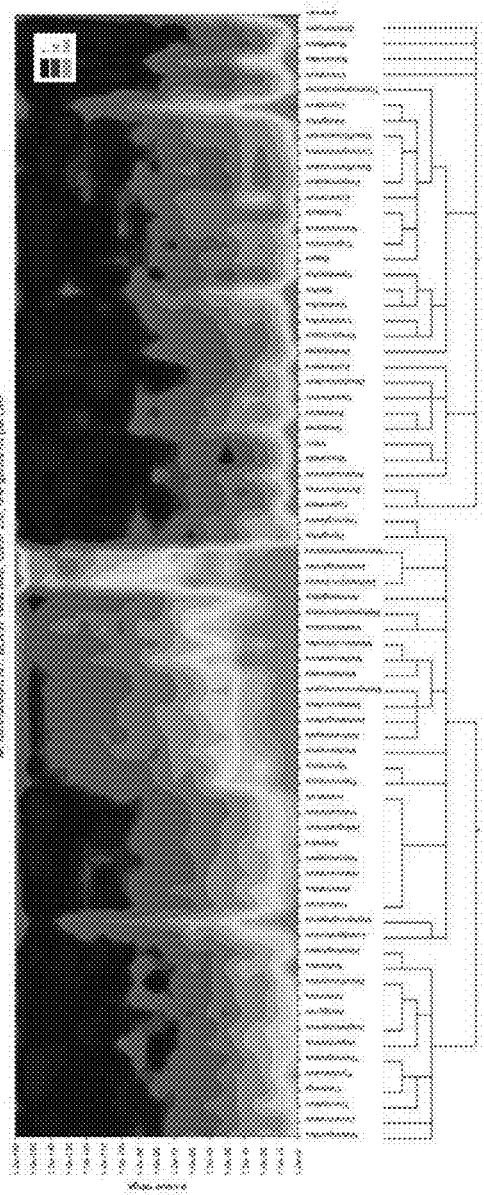

FIG. 16: BLAST Heat Map depicting BLAST-result distribution across the *M. ruminantium* M1. ORFeome. In both figures, the X-axis (horizontal axis) shows all genera with at least 500 and 250 Blast hits throughout the ORFeome, respectively. Genera are phylogenetically sorted based on a semi-dynamically re-parsed phylogenetic tree obtained from the Ribosomal Database Project II (RDP II) (hypertext transfer protocol://rdp.cme.msu.edu/hierarchy/hierarchy_browser.jsp), selecting NCBI taxonomy, level 10 genera display list and set to include archaeal sequences. Bacterial or archaeal genera not covered within the RDPII data were entered and parsed from a separate data file, where appropriate. Phylogenetic distribution and grouping of genera is indicated using an ASCII based tree-abstraction. The Y-axis indicates e-value ranges, and the Z-axis (colour coded) represents the frequency of hits for each genus in each e-value range in log-scale. Respective Log-colour-scales of frequencies are indicated in each figure, whereby warmer colours indicate higher frequencies. Figure (a) allows all BLAST hits per genus per ORF, accepting multiple genus hits per ORF. Figure (b) employs a frequency cutoff of one hit per genus per ORF, effectively limiting the hit rate to the best Blast hit found in each given ORF and genus.

Figure 17:
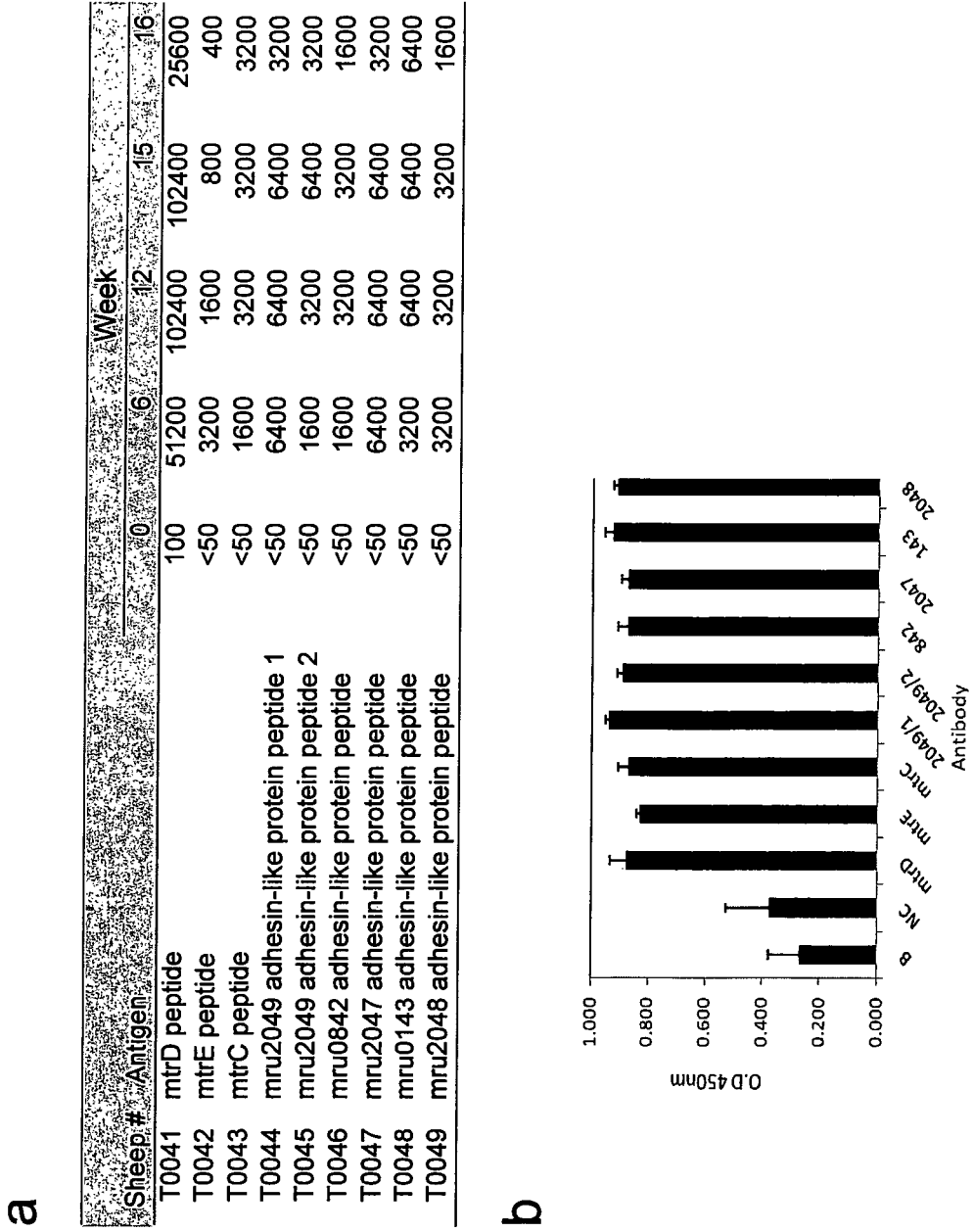
Figures 1, 19:
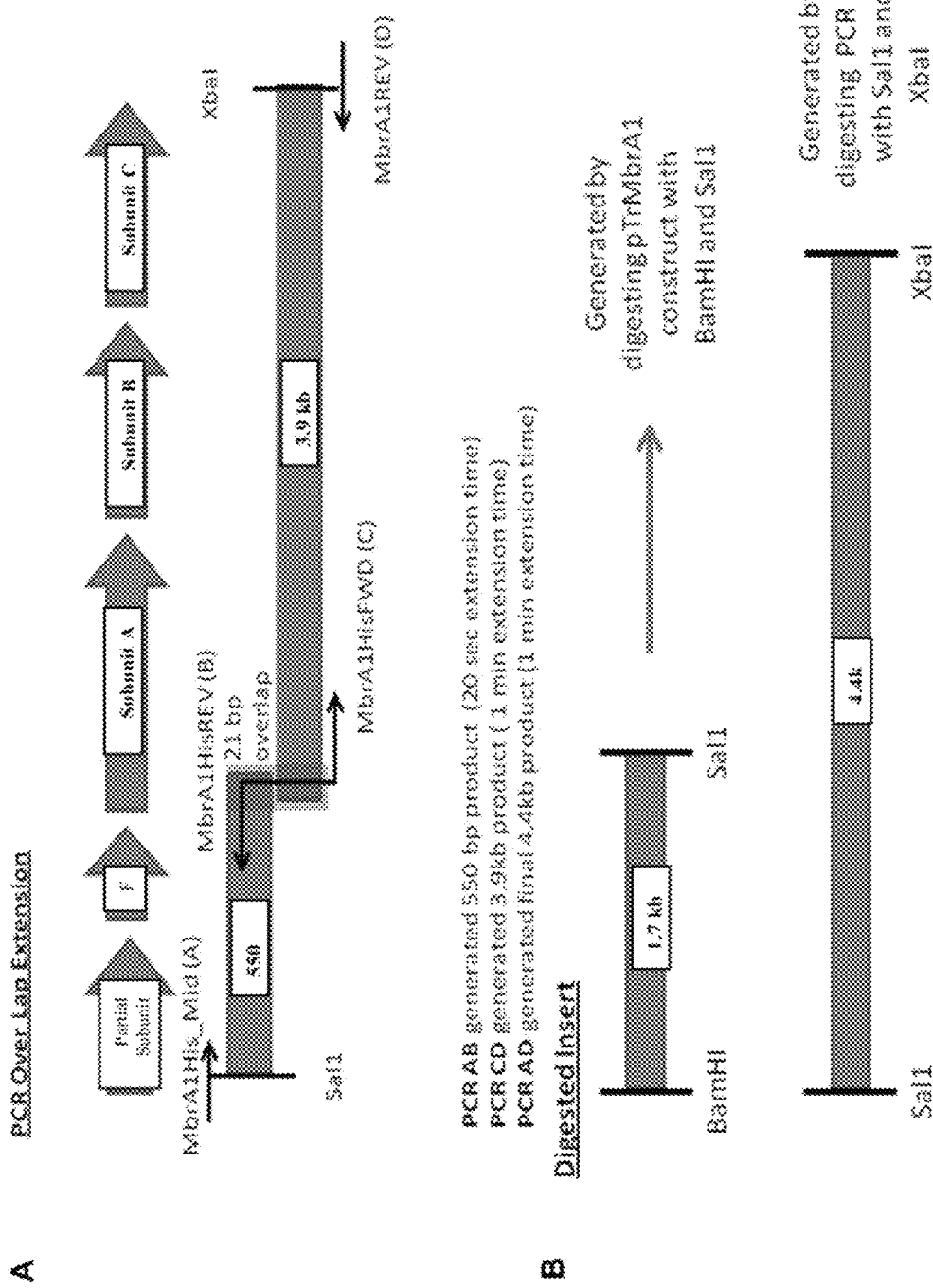
Figures 1, 20:
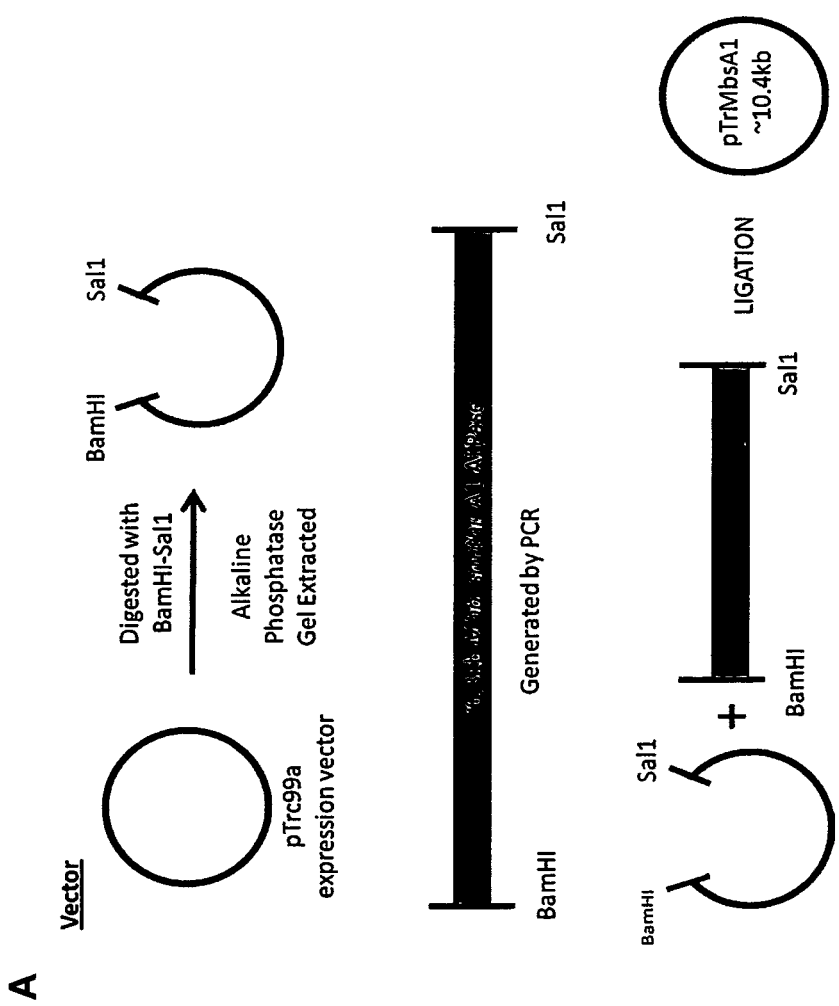
Figure 21:
Figure 22:
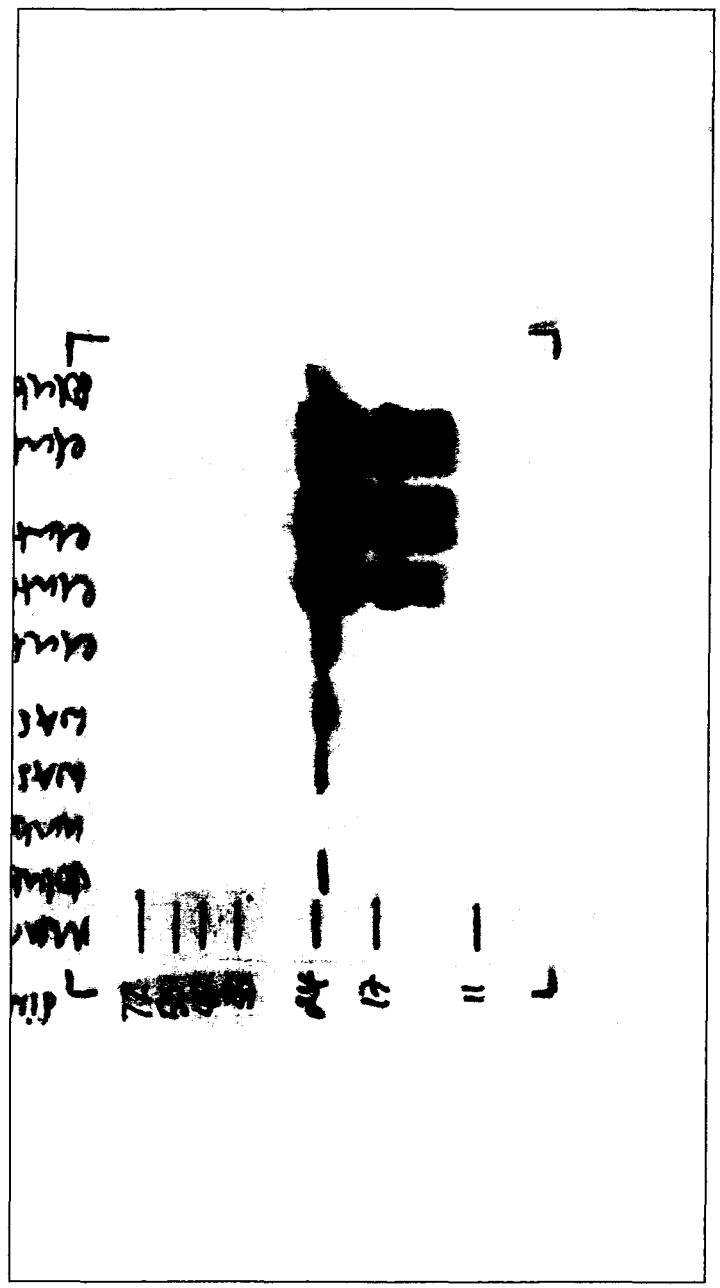
Figure 23:
Figure 33:
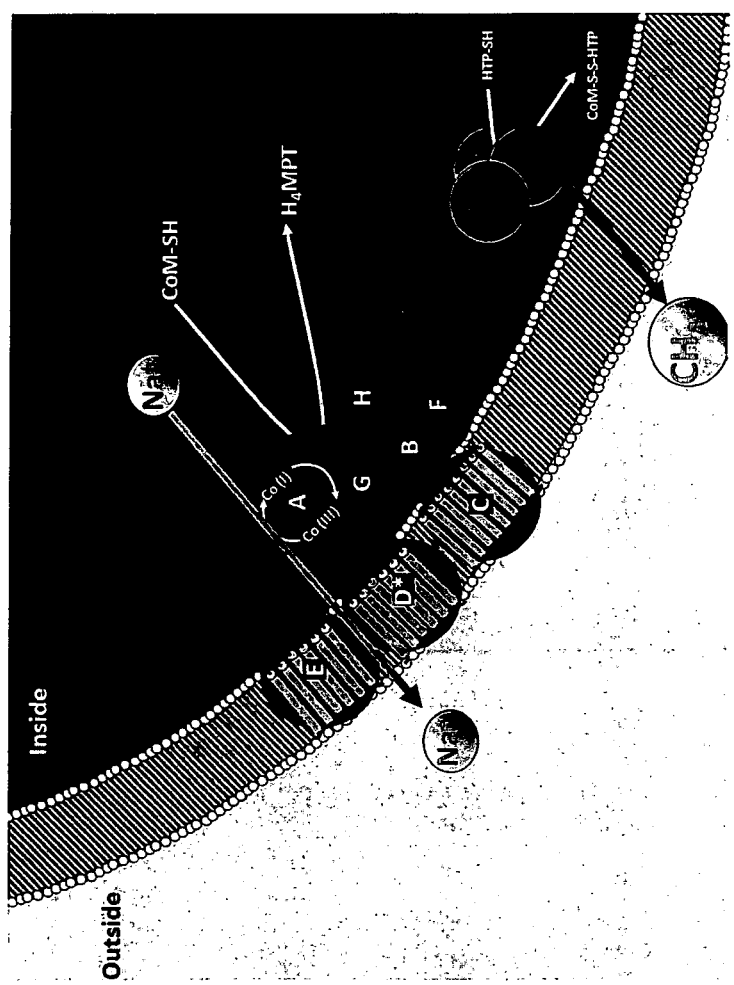

FIG. 17: Sheep antibody responses to vaccination with peptides designed against *M. ruminantium* $H_4MPT$ methyltransferase subunits (MtrCDE) and surface proteins and binding of antibodies to immobilised *M. ruminantium* cells. (a) Vaccination with peptides designed against M1 genes. (b) Binding of antibodies to immobilised M1 cells. In the antibody-binding experiment a negative control (NC) serum from a sheep which had not had colostrum as a lamb was included, as was a sample without added serum which served as a blank, B.

FIG. 18: NRPS alignment. ClustalW (Larkin et al., 2007) alignment of non-ribosomal peptide synthetetases from *M. ruminantium* M1 (mru00068) and *Syntrophomonas wolfei* subsp. *wolfei* str. Goettingen (swol1094). Alignment was visualised using Jalview (Waterhouse et al., 2009). Conserved residues are shown in medium shading. Domain organisation of *M. ruminantium* M1 is displayed via boxes (box marked with rounded brackets=condensation domain; box marked with pointed brackets=adenylation domain; box marked with triangle=phosphopantetheine attachment site; box marked with double arrow=thioester reductase domain).

FIG. 19: *Mbb. ruminantium* $A_1A_o$ ATP synthase PCR cloning and introduction of a hexa-histidine tag at the N-terminal of subunit A by PCR overlap expression; (A) PCR overlap extension; (B) digested insert; (C) ligation.

FIG. 20: *M. smithii* $A_1A_o$ ATP synthase PCR cloning and introduction of a hexa-histidine tag by PCR overlap expression. (A) Cloning; (B) PCR overlap extension; (C) digested insert and ligation.

FIG. 21: (A) pTrMbrA1HIS clone which contains the genes encoding for the *M. ruminantium* A1-ATPase in the *E. coli* expression vector pTrc99a, and includes a Hexa-Histidine tag on the N-terminal of Subunit A. (B) pTrMbrA1A0HIS9 clone.

FIG. 22: Western blot analysis of pTrMbrA1HIS expression. Lane 1: Pre-stain Protein Marker; Lane 2: Soluble Material 10 μg; Lane 3: Unbound Material 10 μg; Lane 4: Wash 1, 10 μg; Lane 5: Wash 2, 10 μg; Lane 6: Elutant 1, 10 μg (150 mM Imidazole); Lane 7: Elutant 2, 10 μg (150 mM Imidazole); Lane 8: Elutant 2, 20 μg; Lane 9: Elutant 2, 20 μg, Denatured 95° C. 5 min; Lane 10: Soluble Material 10 μg, Denatured 95° C. 5 min.

FIG. 23: Western blot analysis of pTrMbsA1HIS expression. Lane 1: Pre-stain Protein Marker; Lane 2: C41-pLysRARE/pTrMbsA1HIS starting material; Lane 3: pTrMbsA1HIS unbound material; Lane 4: pTrMbsA1HIS Wash 1, 40 mM imidazole; Lane 5: pTrMbsA1HIS Wash 2, 40 mM imidazole; Lane 6: pTrMbsA1HIS Elutant 1, 150 mM imidazole; Lane 7: pTrMbsA1HIS Elutant 2, 150 mM imidazole; Lane 8: pTrMbsA1HIS Elutant 3, 400 mM imidazole.

FIG. 24: Growth of *E. coli* strains BL21 (A), DK8 (B) and C41 (C) harbouring pTRMbbr-$A_1A_O$ at 37° C., showing the effect of induced expression of the *Mbb. ruminantium* $A_1A_O$-ATP synthase. (D) Localization of the *Mbb. ruminantium* $A_1A_O$-ATPase in DK8 by SDS-PAGE and western analysis. Samples were resolved on a 14% polyacrylamide gel in the presence of 0.1% sodium dodecyl sulfate (SDS) and either stained with Coomassie Brilliant blue or transferred for western analysis to a polyvinylidene difluoride membrane in the presence of 0.02% SDS and then immunoblotted using a penta-His antibody conjugate to detect the hexa-histidine tag on the A-subunit. Lane 1, protein molecular weight ladder; Lane 2, His-tagged TA2.A1 $F_1F_O$ ATPase purification (positive control); Lane 3, cell lysate; Lane 4, cytoplasmic fraction; Lane 5, membrane fraction.

FIG. 25: Purification (A and B) of the *Mbb. ruminantium* $A_1A_O$-ATPase.

FIG. 26: Subunits of the *Mbb. ruminantium* $A_1A_O$-ATPase.

FIG. 27: Extraction of the $A_1A_O$-ATPase K-subunit monomer.

FIG. 28: $Na^+$ binding motif in the $A_1A_O$-ATPase K-subunit.

FIG. 29: *Mbb. ruminantium* purified $A_1A_o$ ATP synthase activity. (A) Kinetics of ATP hydrolysis by purified *Mbb. ruminantium* $A_1A_o$ ATP synthase. Background ATPase activity generated by thermal hydrolysis of ATP or contaminant ATP in buffer or enzyme has been subtracted (these totaled <5% of the final value shown). (B) Influence of $Mg^{2+}$ on the kinetics of ATP hydrolysis by purified recombinant *Mbb. ruminantium* $A_1A_o$ ATP synthase. Background ATPase activity generated by thermal hydrolysis of ATP or contaminant ATP in buffer or enzyme has been subtracted (these totaled <5% of the final value shown). (C) ATPase activity over a pH range in the presence and absence of $Na^+$. Background ATPase activity generated by thermal hydrolysis of ATP or contaminant ATP in buffer or enzyme has been subtracted from the activities displayed (these totaled <5% of the final value shown). (D) Stability of the purified and membrane-bound (in DK8 membranes) *Mbb. ruminantium* $A_1A_o$ ATP synthase. Background ATPase activity generated by thermal hydrolysis of ATP or contaminant ATP in buffer or enzyme has been subtracted (these totaled <5% of the final value shown).

FIG. 30: *Mbb. ruminantium* soluble and membrane-bound $A_1A_o$ ATP synthase activity. (A and B) Effects of TBT and DCCD on ATPase activity. *E. coli* DK8 (Δatp) inverted membranes containing the recombinant $A_1A_O$-ATPase were used to determine the effects of the inhibitors TBT (200 μM) and DCCD (250 μM) at different pH values. ATPase activity was measured in presence of 130 mM $Na^+$ (A) and in absence of $Na^+$ (B). Background ATPase activity generated by thermal hydrolysis of ATP or contaminant ATP in buffer or enzyme has been subtracted (these totaled <5% of the final value shown). (C) Tributylin Inhibition of ATP Hydrolysis by Purified Recombinant *Mbb. ruminantium* $A_1A_o$ ATP synthase. Background ATPase activity generated by thermal hydrolysis of ATP or contaminant ATP in buffer or enzyme has been subtracted (these totaled <5% of the final value shown). (D) Amiloride Inhibition of ATP Hydrolysis of the *Mbb. ruminantium* $A_1A_o$ ATP synthase. Background ATPase activity generated by thermal hydrolysis of ATP or contaminant ATP in buffer or enzyme has been subtracted (these totaled <5% of the final value shown).

FIG. 31: *Mbb. ruminantium* membrane-bound $A_1A_o$ ATP synthase activity. (A) Tributylin Inhibition of ATP Hydrolysis by the *Mbb. ruminantium* $A_1A_o$ ATP synthase in DK8 and Native Membranes. Background ATPase activity generated by thermal hydrolysis of ATP or contaminant ATP in buffer or enzyme has been subtracted (these totaled <5% of the final value shown). (B) Amiloride Inhibition of ATP Hydrolysis of Purified Recombinant *Mbb. ruminantium* $A_1A_o$ ATP synthase in DK8 and Native Membranes. Background ATPase activity generated by thermal hydrolysis of ATP or contaminant ATP in buffer or enzyme has been subtracted (these totaled <5% of the final value shown).

FIG. 32: ATP synthesis in *E. coli* DK8 inverted membrane vesicles. Closed squares with no DCCD; closed triangles, a 20 min preincubation with 250 μM TBT.

FIG. 33: Model of the membrane-associated sodium ion-translocating methyltransferase complex from methanogenic archaea.

Figure 34:
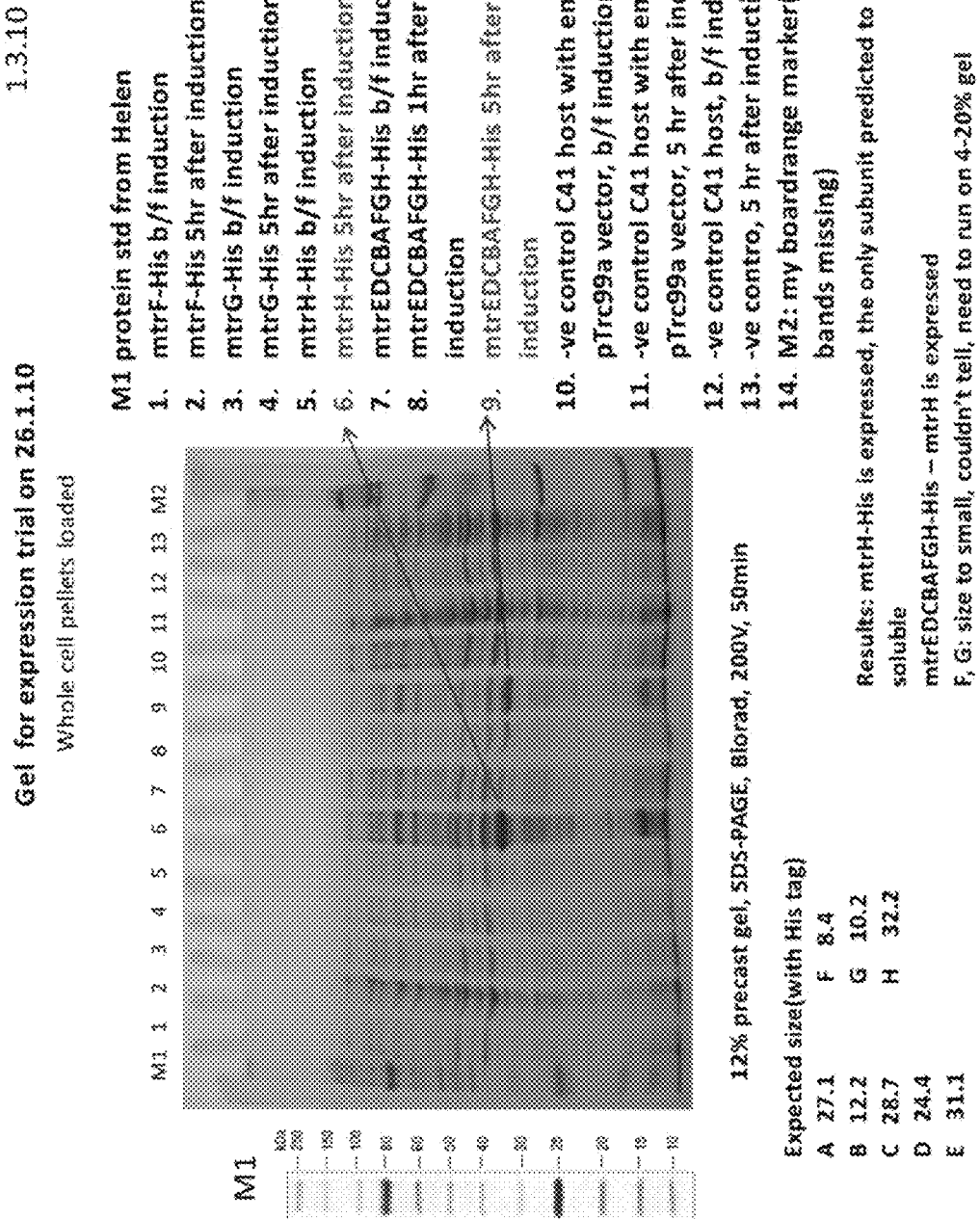

FIG. 34: SDS-PAGE analysis of mtrF-His, mtrG-His, mtrH-His and mtrEDCBAFGH-His expression in *E. coli* C41 (IPTG induction, at 37° C. for 5 hr).

Figure 35:
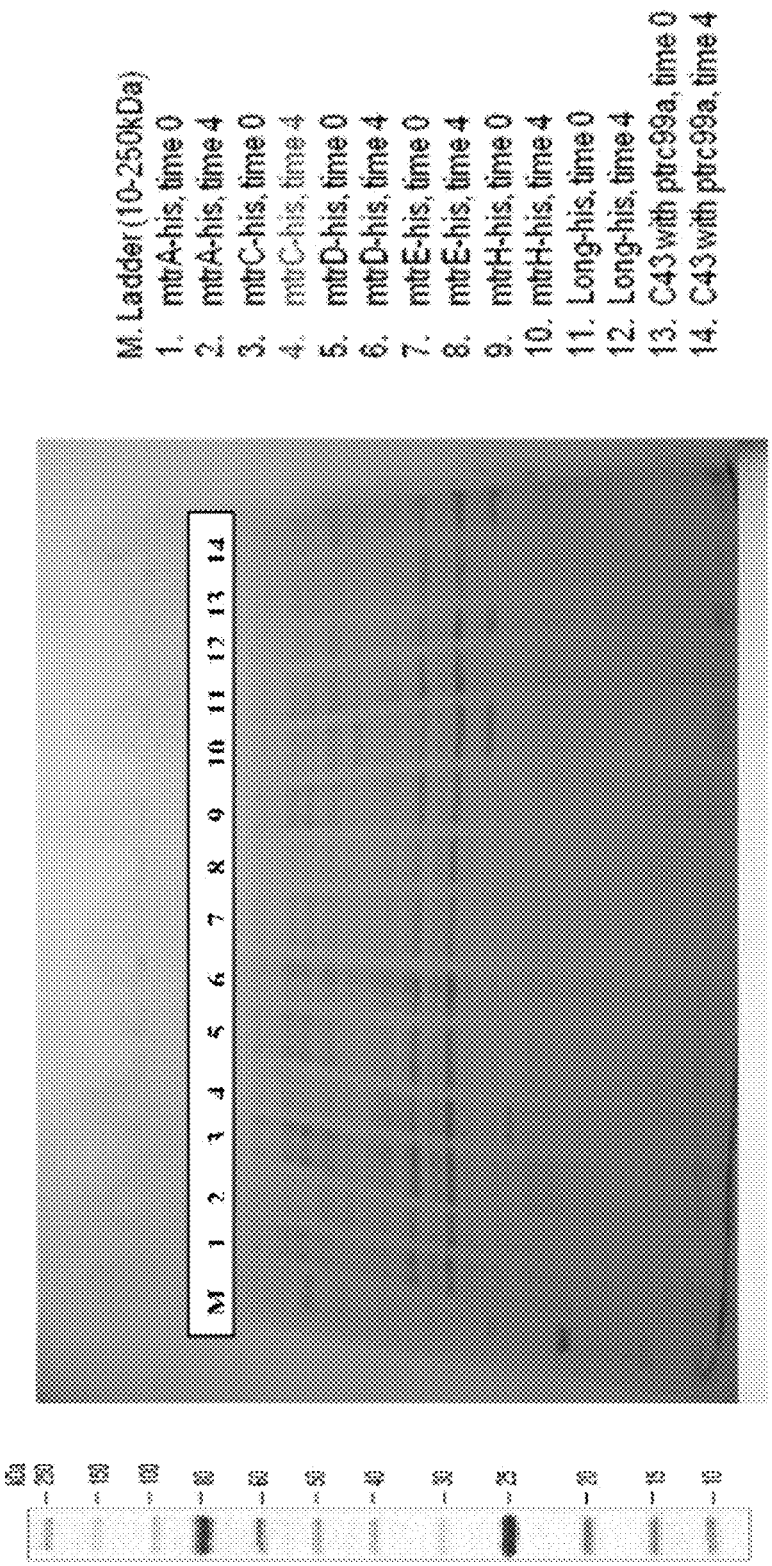

FIG. 35: SDS-PAGE analysis of mtrA-His, mtrC-His, mtrD-His, mtrE-His, mtrH-His and mtrEDCBAFGH-His expression in *E. coli* C43 (IPTG induction, at 37° C. for 4 hr).

Figure 36:
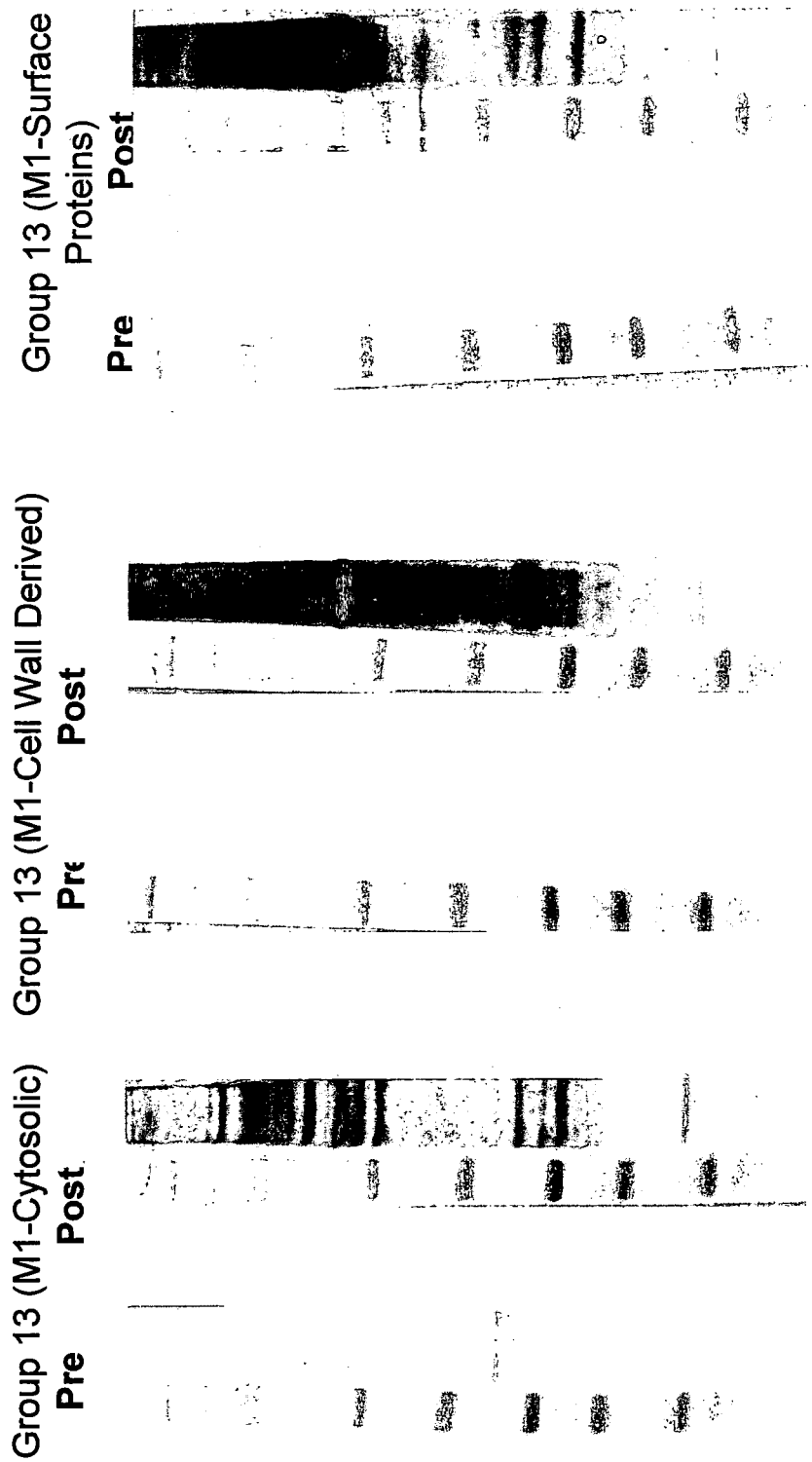

FIG. 36: Western Blot analysis of *M. ruminantium* surface protein antisera against M1 cell fraction. Pre: sera obtained before immunisation; Post: sera obtained after immunisation.

Figure 37:
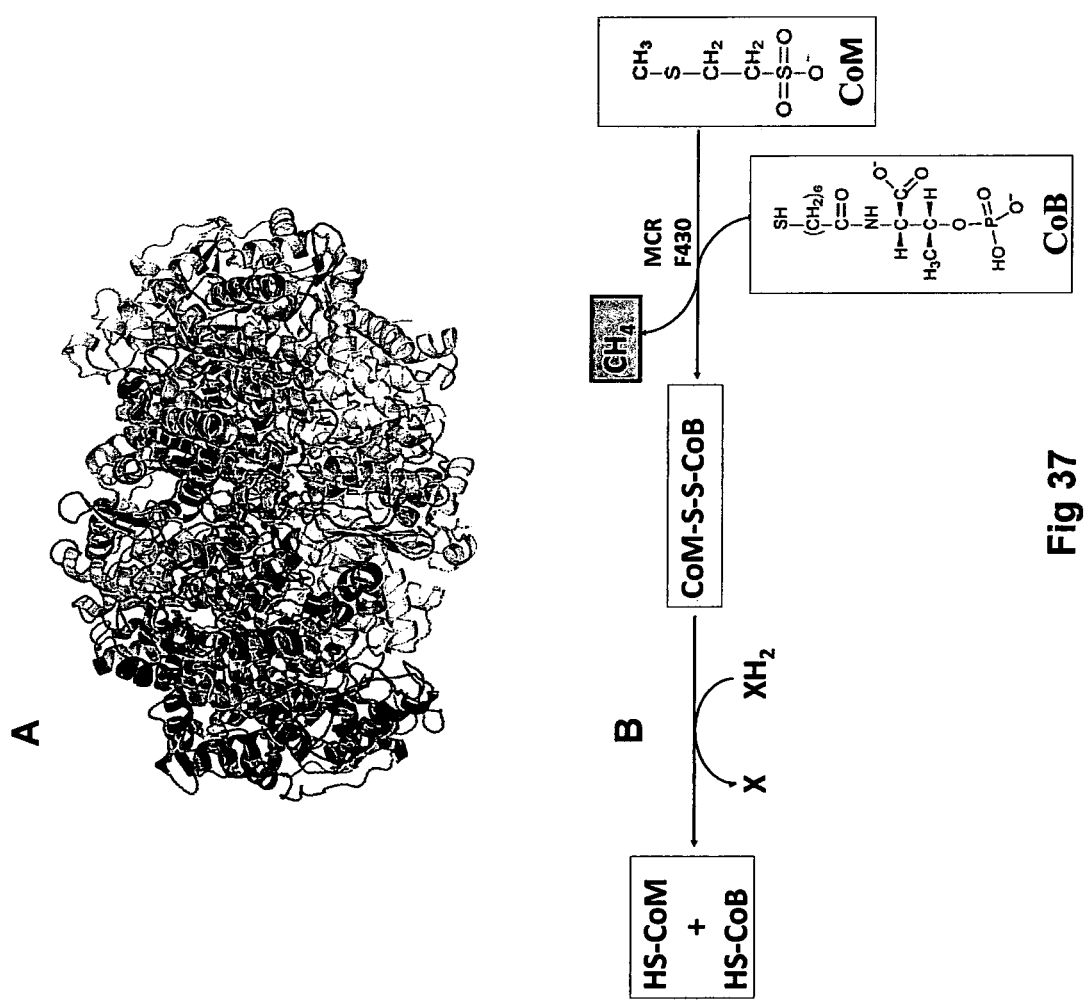

FIG. 37: (A) The α2β2γ2 subunit structure of MCR which contains two nickel porphinoid F430 rings and two molecules each of methylcoenzyme M (CoM) and coenzyme B (CoB). (B) The final reaction of the energy conserving pathway of methanogenic archaea in which CoM and CoB are converted to methane and the heterodisulfide product CoM-S-S-CoB.

Figure 38:
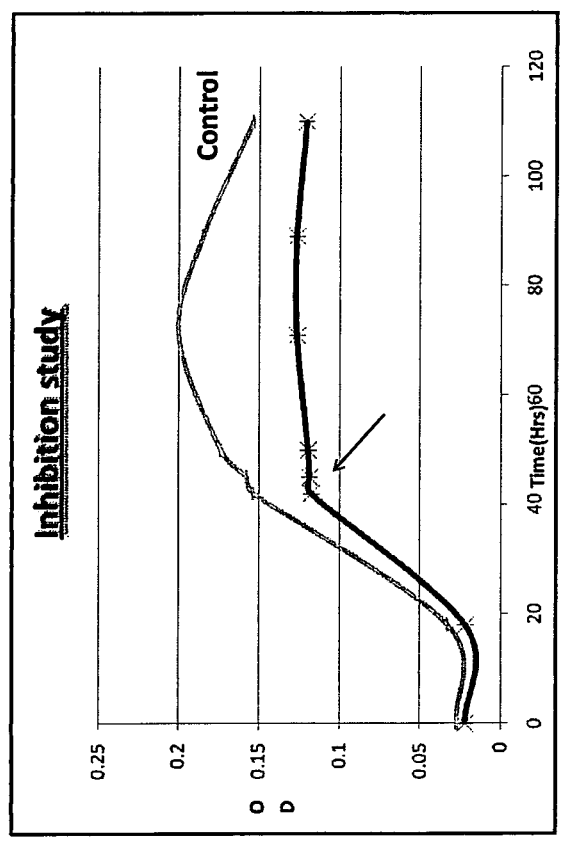

FIG. 38: Optical cell density was measured in pure culture over time to assess the effectiveness of potential inhibitors.

DETAILED DESCRIPTION OF THE INVENTION

Definitions

The term "antibody" should be understood in the broadest possible sense and is intended to include intact monoclonal antibodies and polyclonal antibodies. It is also intended to cover fragments and derivatives of antibodies so long as they exhibit the desired biological activity. Antibodies encompass immunoglobulin molecules and immunologically active portions of immunoglobulin (Ig) molecules, i.e., molecules that contain an antigen binding site that specifically binds (immunoreacts with) an antigen. These include, but are not limited to, polyclonal, monoclonal, chimeric, single chain, Fc, Fab, Fab', and Fab$_2$ fragments, and a Fab expression library.

Antibody molecules relate to any of the classes IgG, IgM, IgA, IgE, and IgD, which differ from one another by the nature of heavy chain present in the molecule. These include subclasses as well, such as IgG1, IgG2, and others. The light chain may be a kappa chain or a lambda chain. Reference herein to antibodies includes a reference to all classes, subclasses, and types. Also included are chimeric antibodies, for example, monoclonal antibodies or fragments thereof that are specific to more than one source, e.g., one or more mouse, human, or ruminant sequences. Further included are camelid antibodies or nanobodies. It will be understood that each reference to "antibodies" or any like term, herein includes intact antibodies, as well as any fragments, alterations, derivatives, or variants thereof.

"Altered" polynucleotides encoding peptides, polypeptides, or antibodies, as used herein, include those with deletions, insertions, or substitutions of different nucleotides resulting in a polynucleotide that encodes the same or functionally equivalent sequence.

The encoded peptide, polypeptide, or antibody may also be "altered" and contain deletions, insertions, or substitutions of amino acid residues which produce a silent change and result in a functionally equivalent sequence. Deliberate amino acid substitutions may be made on the basis of similarity in polarity, charge, solubility, hydrophobicity, hydrophilicity, and/or the amphipathic nature of the residues as long as the biological activity (e.g., cell association, membrane association) or immunogenic/immunological activity is retained. For example, negatively charged amino acids may include aspartic acid and glutamic acid; positively charged amino acids may include lysine and arginine; and amino acids with uncharged polar head groups having similar hydrophilicity values may include leucine, isoleucine, and valine, glycine and alanine, asparagine and glutamine, serine and threonine, and phenylalanine and tyrosine.

The amino acid molecules as noted herein, refer to oligopeptides, peptides, polypeptides, proteins or antibodies, and any fragments thereof, and to any naturally occurring, recombinant, synthetic, or semi-synthetic molecules. These molecules of the invention comprise at least 5, 10, 15, 20, 25, 30, 35, 40, 45, 50, 100, 150, 200, 250 amino acids, preferably at least 5 to 10, 10 to 20, 20 to 30, 30 to 40, 40 to 50, 50 to 100, 100 to 150, 150 to 200, 200 to 250, or at least 300, 350, 400, 450, or 500 amino acids. Such amino acid sequences preferably retain the biological activity (e.g., effect on cell growth) or the immunogenicity/immunological activity of the molecule. The amino acid molecules noted herein are not limited to the complete, native sequence associated with the full-length molecule, but include also any fragments, alterations, derivatives, and variants thereof.

"Amplification", as used herein, refers to the production of additional copies of a nucleic acid sequence and is generally carried out using polymerase chain reaction (PCR) technologies well known in the art (Dieffenbach, C. W. and G. S. Dveksler (1995) PCR Primer, a Laboratory Manual, Cold Spring Harbor Press, Plainview, N.Y.).

The terms "biologically active" or "functional," as used herein, refer to a peptide or polypeptide retaining one or more structural, immunogenic, or biochemical functions (e.g., cell association, membrane association) of a naturally occurring sequence.

The terms "cell inhibitor" or "inhibitor," as used herein, refer to agents that decrease or block the growth or replication of microbial cells, especially methanogen cells. A cell inhibitor can act to decrease or block, for example, cellular division. An inhibitor can decrease or block, for example, DNA synthesis, RNA synthesis, protein synthesis, or post-translational modifications. An inhibitor can also decrease or block the activity of enzymes involved in the methanogenesis pathway. An inhibitor can also target a cell for recognition by immune system components. Inhibition of a cell also includes cell killing and cell death, for example, from lysis, apoptosis, necrosis, etc. Useful inhibitors include, but are not limited to, anti-methanogenesis compounds (e.g., bromoethanesulphonic acid), antibodies and antibody fragments, lytic enzymes, peptide nucleic acids, antimicrobial peptides, and other antibiotics as described in detail herein.

The terms "complementary" or "complementarity," as used herein, refer to the natural binding of polynucleotides under permissive salt and temperature conditions by base-pairing. For the sequence A-G-T, the complementary sequence is T-C-A, the reverse complement is A-C-T and the reverse sequence is T-G-A. Complementarity between two single stranded molecules may be partial, in which only some of the nucleic acids bind, or it may be complete when total complementarity exists between the single stranded molecules. The degree of complementarity between nucleic acid strands has significant effects on the efficiency and strength of hybridization between nucleic acid strands. This is of particular importance in amplification reactions, which depend upon binding between nucleic acids strands and in the design and use of PNA molecules.

As used herein, "computer readable media" refers to any medium which can be read and accessed directly by a computer. A "computer-based system" refers to the hardware means, software means, and data storage means used to analyze the sequence information of the present invention.

The term "derivative", as used herein, refers to the chemical modification of a nucleic acid encoding a peptide, polypeptide, or antibody, or a nucleic acid complementary thereto. Such modifications include, for example, replacement of hydrogen by an alkyl, acyl, or amino group. In preferred aspects, a nucleic acid derivative encodes a peptide, polypeptide, or antibody which retains a biological or immunogenicity/immunological activity of the natural molecule. A derivative peptide, polypeptide, or antibody is one which is modified by glycosylation, pegylation, or any similar process which retains one or more biological function (e.g., cell association, membrane association) or immunogenicity/immunological activity of the sequence from which it was derived.

The term "homology", as used herein, refers to a degree of complementarity. There may be partial homology (i.e., less than 100% identity) or complete homology (i.e., 100% identity). A partially complementary sequence that at least partially inhibits an identical sequence from hybridizing to a target nucleic acid is referred to using the functional term "substantially homologous." The inhibition of hybridization of the completely complementary sequence to the target sequence may be examined using a hybridization assay (e.g., Southern or northern blot, solution hybridization and the like) under conditions of low stringency. A substantially homologous sequence or hybridization probe will compete for and inhibit the binding of a completely homologous sequence to the target sequence under conditions of low stringency. This is not to say that conditions of low stringency are such that non-specific binding is permitted; low stringency conditions require that the binding of two sequences to one another be a specific (i.e., selective) interaction.

The term "hybridization", as used herein, refers to any process by which a strand of nucleic acid binds with a complementary strand through base pairing.

An "immunogenic epitope" is defined as a part of a protein that elicits an antibody response when the whole protein is the immunogen. On the other hand, a region of a protein molecule to which an antibody can bind is defined as an "antigenic epitope."

An "insertion" or "addition", as used herein, refers to a change in an amino acid or nucleotide sequence resulting in the addition of one or more amino acid residues or nucleotides, respectively, as compared to the naturally occurring molecule.

A "methanogen," as used herein, refers to microbes that produce methane gas, which include *Methanobrevibacter, Methanothermobacter, Methanomicrobium, Methanobacterium*, and *Methanosarcina*. Specific methanogens include, but are not limited to, *Methanobrevibacter ruminantium* (i.e., the M1 strain (also called "M1"), or strain DSM1093 hypertext transfer protocol://www.dsmz.de/microorganisms/html/strains/strain.dsm001093.htm), *Methanobrevibacter smithii, Methanobrevibacter acididurans, Methanobrevibacter thaueri, Methanobacterium bryantii, Methanobacterium formicicum, Methanothermobacter marburgensis, Methanothermobacter wolfeii, Methanosphaera stadtmanae, Methanomicrobium mobile, Methanosarcina barkeri, Methanosarcina mazei, Methanococcoides burtonii*, and *Methanolobus taylorii*. All methanogen genera and species are encompassed by this term.

"Microbial" cells as used herein, refers to naturally-occurring or genetically modified microbial cells including archaebacteria such as methanogens, halophiles, and thermoacidophiles, and eubacteria, such as cyanobacteria, spirochetes, proteobacteria, as well as Gram positive and Gram negative bacteria.

The term "modified" refers to altered sequences and to sequence fragments, variants, and derivatives, as described herein.

The nucleic acid molecules as noted herein refer to polynucleotides, oligonucleotides, or fragments thereof, and to DNAs or RNAs of natural, recombinant, synthetic or semi-synthetic, origin which may be single or double stranded, and can represent sense or antisense strands, or coding or non-coding regions, or intergenic regions. These molecules of the invention preferably comprise at least 12, 15, 30, 45, 60, 75, 90, 105, 120, 135, 150, 300, 450, 600, 750 nucleotides, preferably at least 15 to 30, 30 to 60, 60 to 90, 90 to 120, 120 to 150, 150 to 300, 300 to 450, 450 to 600, or 600 to 750 nucleotides, or at least 800, 850, 900, 950, 1000, 1200, 1300, 1400, or 1500 nucleotides. It will be understood that a nucleic acid molecule as noted herein, will include the native, full length sequence, as well as any complements, fragments, alterations, derivatives, or variants, thereof.

The term "oligonucleotide" refers to a nucleic acid sequence of at least 6, 8, 10, 12, 15, 18, 21, 25, 27, 30, or 36 nucleotides, or at least 12 to 36 nucleotides, or at least 15 to 30 nucleotides, which can be used in PCR amplification, sequencing, or hybridization assays. As used herein, oligonucleotide is substantially equivalent to the terms "amplimers," "primers," "oligomers," and "probes," as commonly defined in the art.

The term "polynucleotide," when used in the singular or plural, generally refers to any nucleic acid sequence, e.g., any polyribonucleotide or polydeoxyribonucleotide, which may be unmodified RNA or DNA or modified RNA or DNA. This includes, without limitation, single and double stranded DNA, DNA including single and double stranded regions, single and double stranded RNA, and RNA including single and double stranded regions, hybrid molecules comprising DNA and RNA that may be single stranded or, more typically, double stranded or include single and double stranded regions. Also included are triple-stranded regions comprising RNA or DNA or both RNA and DNA. Specifically included are mRNAs, cDNAs, and genomic DNAs, and any fragments thereof. The term includes DNAs and RNAs that contain one or more modified bases, such as tritiated bases, or unusual bases, such as inosine. The polynucleotides of the invention can encompass coding (e.g., SEQ ID NO: 1-1718) or non-coding sequences (e.g., SEQ ID NO: 1719-3102 or SEQ ID NO:7607-7684), or intergenic sequences (e.g., SEQ ID NO: 3103-5866), or sense or antisense sequences, or iRNAs such as siRNAs. It will be understood that each reference to a "polynucleotide" or like term, herein, will include the full length sequences as well as any complements, fragments, alterations, derivatives, or variants thereof.

A "peptide" and "polypeptide," as used herein, refer to the isolated peptides or polypeptides of the invention obtained from any species, preferably microbial, from any source whether natural, synthetic, semi-synthetic, or recombinant. Specifically, a peptide or polypeptide of the invention can be obtained from methanogen cells, such as *Methanobrevibacter* cells, in particular, *M. ruminantium*, or *M. smithii* cells. For recombinant production, a peptide or polypeptide of the invention can be obtained from microbial or eukaryotic cells, for example, *Escherichia, Streptomyces, Bacillus, Salmonella*, yeast, insect cells such as *Drosophila*, animal cells such as COS and CHO cells, or plant cells. It will be understood that each reference to a "peptide" or "polypeptide," herein, will include the full-length sequence, as well as any fragments, alterations, derivatives, or variants, thereof.

"Peptide nucleic acid" or "PNA" as used herein, refers to an antisense molecule or anti-gene agent which comprises bases linked via a peptide backbone.

The term "ruminant," as used herein, refers to animals that have a rumen as a special type of digestive organ. Ruminants include, but are not limited to, cattle, sheep, goats, buffalo, moose, antelope, caribou, and deer.

The term "SEQ ID NO:" refers to a specifically numbered sequence as disclosed herein. The format of "SEQ ID NO: ##" refers to each sequence taken individually, and any combination thereof.

The terms "stringent conditions" or "stringency," as used herein, refer to the conditions for hybridization as defined by the nucleic acid, salt, and temperature. These conditions are well known in the art and may be altered in order to identify or detect identical or related polynucleotide sequences. See, e.g., Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York, N.Y. Numerous equivalent conditions comprising either low or high stringency depend on factors such as the length and nature of the sequence (DNA, RNA, base composition), nature of the target (DNA, RNA, base composition), milieu (in solution or immobilized on a solid substrate), concentration of salts and other components (e.g., formamide, dextran sulfate and/or polyethylene glycol), and temperature of the reactions (e.g., within a range from about 5° C. below the melting temperature of the probe to about 20° C. to 25° C. below the melting temperature). One or more factors may be varied to generate conditions of either low or high stringency different from, but equivalent to, the above listed conditions.

The term "subject" includes human and non-human animals. Non-human animals include, but are not limited to, birds and mammals, such as ruminants, and in particular, mice, rabbits, cats, dogs, pigs, sheep, goats, cows, and horses.

The terms "substantially purified" or "isolated" as used herein, refer to polypeptides, peptides, or polynucleotides, that are removed from their cellular, recombinant, or synthetic environment, and are at least 60% free, preferably 75% free, and most preferably at least 90% free or at least 99% free from other components with which they are associated in their environment. "Isolated" polynucleotides and polypeptides have been identified and separated from at least one contaminant molecule with which they are associated in their natural state. Accordingly, it will be understood that isolated polynucleotides and polypeptides are in a form which differs from the form or setting in which they are found in nature. It will further be appreciated that "isolated" does not necessarily reflect the exact extent (e.g., a specific percentage) to which the sequence has been purified.

"Transformation," as defined herein, describes a process by which exogenous DNA enters and changes a recipient cell. It may occur under natural or artificial conditions using various methods well known in the art. Transformation may rely on any known method for the insertion of foreign polynucleotides into a prokaryotic or eukaryotic host cell. The method is selected based on the type of host cell being transformed and may include, but is not limited to, viral infection, electroporation, heat shock, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time.

"Vaccines" as used herein include all components and compositions for stimulating the immune response in a subject. Particularly useful in this regard are subunit vaccines, including peptide vaccines, and also vectored vaccines, nucleic acid vaccines, and edible vaccines. Vaccines can be used to establish or strengthen an immune response to an antigen, particularly a microbial antigen. In particular aspects, vaccines comprise antigens that evoke host-protective reactions, e.g., antibody formation, T helper, and T cell responses. Vaccines can also comprise antibodies, for example, for passive immunization.

A "variant" of a peptide, polypeptide, or antibody, as used herein, refers to an amino acid molecule that is altered by one or more amino acids. A variant polynucleotide is altered by one or more nucleotides. A variant may result in "conservative" changes, wherein a substituted amino acid has similar structural or chemical properties, e.g., replacement of leucine with isoleucine. More rarely, a variant may result in "nonconservative" changes, e.g., replacement of a glycine with a tryptophan. Analogous minor variations may also include amino acid deletions or insertions, or both. Guidance in determining which amino acid residues may be substituted, inserted, or deleted without abolishing biological or immunogenic/immunological activity may be found using computer programs well known in the art, for example, LASERGENE software (DNASTAR).

The invention also encompasses nucleic acid and amino acid variants which retain at least one biological activity (e.g., cell association, membrane association) or immunogenicity/immunological activity. A preferred variant is one having substantially the same or a functionally equivalent sequence, for example, having at least 70%, at least 75%, at least 80%, at least 85%, and more preferably at least 90%, sequence identity to a disclosed sequence. A most preferred variant is one having at least 95%, at least 97%, at least 98%, or at least 99%, at least 99.5%, at least 99.8%, or at least 99.9% sequence identity to a sequence disclosed herein. The percentage identity is determined by aligning the two sequences to be compared as described below, determining the number of identical residues/nucleotides in the aligned portion, dividing that number by the total number of residues/nucleotides in the inventive (queried) sequence, and multiplying the result by 100. A useful alignment program is AlignX (Vector NTI).

Description of the Invention

Methane is produced in the foregut of ruminants by methanogens which act as terminal reducers of carbon in the rumen system. The multi-step methanogenesis pathway is well elucidated, mainly from the study of non-rumen methanogens. However, the adaptations that allow methanogens to grow and persist in the rumen are not well understood. *Methanobrevibacter ruminantium* (formerly *Methanobacterium ruminantium*) is the so-called type species of the *Methanobrevibacter* genus and was isolated from the bovine rumen (Smith, 1958). *M. ruminantium* is a dominant methanogen worldwide which is found in ruminants fed a wide variety of diets (Janssen, 2008). As such, *M. ruminantium* represents an important target for anti-methane technology.

We have embarked on a programme to sequence the genomes of cultured representatives of the main rumen methanogen groups. Defining gene targets within rumen methanogens for $CH_4$ mitigation technologies is somewhat akin to developing a therapeutic intervention for a microbial pathogen. Therefore, our analysis of the *M. ruminantium* genome is presented with an emphasis on identifying conserved methanogen surface proteins suitable for vaccine development via reverse vaccinology techniques (Rappuoli, 2001) and enzyme targets susceptible to small molecule inhibitors through a chemogenomics approach (Caron et al., 2001).

In view of this, we have elucidated the full genome sequence of *M. ruminantium* and have identified all of the components of the methanogenesis pathway therein. Comparison of these gene sequences with those from *Methanobacterium thermoautotrophicum* and *Methanosphaera stadtmanae* indicates methanogenesis gene organisation is conserved within the *Methanobacteriales* (FIGS. 1, 10, 13, and 15). The *M. ruminantium* genome also includes many large surface proteins which may mediate association with other rumen microbes. Based on the role of *M. ruminantium* in the rumen environment, the identified polynucleotides and polypeptides can be used as a means for inhibiting methanogens and/or methanogenesis, and to further elucidate the role of *M. ruminantium* in methane formation. Particularly useful are the disclosed polynucleotides and polypeptides identified as components involved in methanogenesis (Tables 2, 4, 5, and 9, below), as cell surface components (Tables 3, 5, 6, and 9, below), as components involved in exopolysaccharide biosynthesis (Tables 2, 4, and 9, below), as components with membrane spanning domains (Tables 3 and 9, below), as components involved in non-ribosomal peptide synthesis (Tables 7 and 9, below), as well as the polynucleotides and polypeptides for antibody production (Tables 2 and 9, below). The specific *M. ruminantium* sequences are disclosed herewith include identified ORFs (Table 11), non-coding features (Table 12), and intergenic regions (Table 13).

The M1 genome was sequenced, annotated and subjected to comparative genomic and metabolic pathway analyses. Conserved and methanogen-specific gene sets suitable as targets for vaccine development or chemogenomic-based inhibition of rumen methanogens were identified. The feasibility of using a synthetic peptide-directed vaccinology approach to target epitopes of methanogen surface proteins was demonstrated. A prophage genome was described and its lytic enzyme, endoisopeptidase PeiR, was shown to lyse M1 cells in pure culture. A predicted stimulation of M1 growth by alcohols was demonstrated and microarray analyses indicated up-regulation of methanogenesis genes during co-culture with a hydrogen (H2) producing rumen bacterium. We also report the discovery of non-ribosomal peptide synthetases in *M. ruminantium* M1, the first reported in archaeal species. The M1 genome sequence provides new insights into the lifestyle and cellular processes of this important rumen methanogen. It also defines vaccine and chemogenomic targets for broad inhibition of rumen methanogens and represents a significant contribution to worldwide efforts to mitigate ruminant methane emissions and reduce production of anthropogenic greenhouse gases.

Peptides, Polypeptides, and Polynucleotides

The invention encompasses peptides and polypeptides, including those comprising at least one of SEQ ID NO: 5867-7584, and fragments, variants, and derivatives thereof. The peptides and polypeptides of the present invention may be expressed and used in various assays to determine their biological activity. The peptides and polypeptides may be used for large-scale synthesis and isolation protocols, for example, for commercial production. Such peptides and polypeptides may be used to raise antibodies, to isolate corresponding amino acid sequences, and to quantitatively determine levels of the amino acid sequences. The peptides and polypeptides can be used for vaccines for targeting and inhibiting microbial cells, especially methanogen cells. The peptides and polypeptides can also be used for preparing antibodies to inhibit the growth or replication of such cells. The peptides and polypeptides of the present invention may also be used as compositions, for example, pharmaceutical compositions, especially vaccine compositions. In particular aspects, slow-release ruminal devices can be used in conjunction with the peptides, polypeptides, antibodies, and compositions (e.g., pharmaceutical compositions, especially vaccine compositions) of the invention.

The peptides of the present invention comprise at least one sequence selected from the group consisting of: (a) peptides comprising at least a fragment of an one amino acid sequence selected from the group consisting of SEQ ID NO: 5867-7584, or fragments, variants, or derivatives thereof; (b) peptides comprising a functional domain of at least one amino acid sequence selected from the group consisting of SEQ ID NO: 5867-7584, and fragments and variants thereof; and (c) peptides comprising at least a specified number of contiguous residues (see exemplary lengths hereinabove) of at least one amino acid sequence selected from the group consisting of SEQ ID NO: 5867-7584, or variants or derivatives thereof. In one embodiment, the invention encompasses an isolated peptide comprising the amino acid sequence of at least one of SEQ ID NO: 5867-7584. All of these sequences are collectively referred to herein as peptides of the invention.

The polypeptides of the present invention comprise at least one sequence selected from the group consisting of: (a) polypeptides comprising at least one amino acid sequence selected from the group consisting of SEQ ID NO: 5867-7584, or fragments, variants, or derivatives thereof; (b) polypeptides comprising a functional domain of at least one amino acid sequence selected from the group consisting of SEQ ID NO: 5867-7584, and fragments and variants thereof; and (c) polypeptides comprising at least a specified number of contiguous residues (see exemplary lengths hereinabove) of at least one amino acid sequence selected from the group consisting of SEQ ID NO: 5867-7584, or variants or derivatives thereof. In one embodiment, the invention encompasses an isolated polypeptide comprising the amino acid sequence of at least one of SEQ ID NO: 5867-7584. All of these sequences are collectively referred to herein as polypeptides of the invention.

The invention also encompasses an isolated polynucleotide that encodes a peptide or polypeptide of SEQ ID NO: 5867-7584. The isolated polynucleotides of the present invention have utility in genome mapping, in physical mapping, and in cloning of genes of more or less related cell surface components. Probes designed using the polynucleotides of the present invention may be used to detect the presence and examine the expression patterns of genes in any organism having sufficiently homologous DNA and RNA sequences in their cells, using techniques that are well known in the art, such as slot blot techniques or microarray analysis. Primers designed using the polynucleotides of the present invention may be used for sequencing and PCR amplifications. The polynucleotides of the invention can be used for preparing expression vectors and host cells for vaccines to target and inhibit microbial cells, especially methanogen cells. The invention further encompasses the use of the polynucleotides for the production of antibodies to inhibit the growth or replication of such cells. The polynucleotides of the present invention may also be used as compositions, for example, pharmaceutical compositions, especially vaccine compositions. In particular aspects, slow-release ruminal devices can be used in conjunction with the polynucleotides, vectors, host cells, and compositions (e.g., pharmaceutical compositions, especially vaccine compositions) of the invention.

The polynucleotides of the present invention comprise at least one sequence selected from the group consisting of: (a) sequences comprising a coding sequence for at least one amino acid sequence selected from the group consisting of SEQ ID NO: 5867-7584, or fragments or variants thereof; (b) complements, reverse sequences, and reverse complements of a coding sequence for at least one amino acid sequence selected from the group consisting of SEQ ID NO: 5867-7584, or fragments or variants thereof; (c) open reading frames contained in the coding sequence for at least one amino acid sequence selected from the group consisting of SEQ ID NO: 5867-7584, and their fragments and variants; (d) functional domains of a coding sequence for at least one amino acid sequence selected from the group consisting of SEQ ID NO: 5867-7584, and fragments and variants thereof; and (e) sequences comprising at least a specified number of contiguous residues (see exemplary lengths hereinabove) of a coding sequence for at least one amino acid sequence selected from the group consisting of SEQ ID NO: 5867-7584, or, variants thereof; and (f) sequences comprising at least a specified number of contiguous nucleotides (see exemplary lengths hereinabove) of any one of SEQ ID NO: 1-1718. Oligonucleotide probes and primers (e.g., SEQ ID NO: 7586-7607) and their variants are also provided. All of these polynucleotides and oligonucleotide probes and primers are collectively referred to herein, as polynucleotides of the invention.

It will be appreciated by those skilled in the art that as a result of the degeneracy of the genetic code, a multitude of nucleotide sequences encoding the peptides or polypeptides of the invention, some bearing minimal homology to the nucleotide sequences of any known and naturally occurring gene, may be produced. Thus, the invention contemplates each and every possible variation of nucleotide sequence that could be made by selecting combinations based on possible codon choices. These combinations are made in accordance with the standard triplet genetic code as applied to naturally occurring amino acid sequences, and all such variations are to be considered as being specifically disclosed.

Nucleotide sequences which encode the peptides or polypeptides, or their fragments or variants, are preferably capable of hybridizing to the nucleotide sequence of the naturally occurring sequence under appropriately selected conditions of peptide or stringency. However, it may be advantageous to produce nucleotide sequences encoding a peptide or polypeptide, or its fragment or derivative, possessing a substantially different codon usage. Codons may be selected to increase the rate at which expression of the peptide or polypeptide occurs in a particular prokaryotic or eukaryotic host in accordance with the frequency with which particular codons are utilized by the host. Other reasons for substantially altering the nucleotide sequence encoding peptides or polypeptides and its derivatives without altering the encoded amino acid sequences include the production of RNA transcripts having more desirable properties, such as a greater half-life, than transcripts produced from the naturally occurring sequence.

The invention also encompasses production of DNA sequences, or fragments thereof, which encode the peptides or polypeptides, or their fragments or variants, entirely by synthetic chemistry. After production, the synthetic sequence may be inserted into any of the many available expression vectors and cell systems using reagents that are well known in the art. Moreover, synthetic chemistry may be used to introduce mutations into a sequence encoding a peptide or polypeptide, or any variants or fragment thereof. Also encompassed by the invention are polynucleotide sequences that are capable of hybridizing to the claimed nucleotide sequences, and in particular, those shown in SEQ ID NO: 1-1718, under various conditions of stringency as taught in Wahl, G. M. and S. L. Berger (1987; Methods Enzymol. 152:399-407) and Kimmel, A. R. (1987; Methods Enzymol. 152:507-511).

Methods for DNA sequencing which are well known and generally available in the art and may be used to practice any of the embodiments of the invention. The methods may employ such enzymes as the Klenow fragment of DNA polymerase I, SEQUENASE (U.S. Biochemical Corp, Cleveland, Ohio), Taq polymerase (Perkin Elmer), thermostable T7 polymerase Amersham Pharmacia Biotech (Piscataway, N.J.), or combinations of polymerases and proofreading exonucleases such as those found in the ELONGASE Amplification System marketed by Life Technologies (Gaithersburg, Md.). Preferably, the process is automated with machines such as the Hamilton Micro Lab 2200 (Hamilton, Reno, Nev.), Peltier Thermal Cycler (PTC200; MJ Research, Watertown, Mass.) the ABI Catalyst and 373 and 377 DNA Sequencers (Perkin Elmer), or the Genome Sequencer 20™ (Roche Diagnostics).

The polynucleotides encoding the peptides or polypeptides may be extended utilizing a partial nucleotide sequence and employing various methods known in the art to detect upstream sequences such as promoters and regulatory elements. For example, one method which may be employed, "restriction-site" PCR, uses universal primers to retrieve unknown sequence adjacent to a known locus (Sarkar, G. (1993) PCR Methods Applic. 2:318-322). In particular, genomic DNA is first amplified in the presence of primer to a linker sequence and a primer specific to the known region. The amplified sequences are then subjected to a second round of PCR with the same linker primer and another specific primer internal to the first one. Products of each round of PCR are transcribed with an appropriate RNA polymerase and sequenced using reverse transcriptase.

Capillary electrophoresis systems which are commercially available may be used to analyze the size or confirm the nucleotide sequence of sequencing or PCR products. In particular, capillary sequencing may employ flowable polymers for electrophoretic separation, four different fluorescent dyes (one for each nucleotide) which are laser activated, and detection of the emitted wavelengths by a charge coupled device camera. Output/light intensity may be converted to electrical signal using appropriate software (e.g. GENOTYPER and Sequence NAVIGATOR, Perkin Elmer) and the entire process from loading of samples to computer analysis and electronic data display may be computer controlled. Capillary electrophoresis is especially preferable for the sequencing of small pieces of DNA which might be present in limited amounts in a particular sample.

In another embodiment of the invention, polynucleotides or fragments thereof which encode peptides or polypeptides may be used in recombinant DNA molecules to direct expression of the peptides or polypeptides, or fragments or variants thereof, in appropriate host cells. Due to the inherent degeneracy of the genetic code, other DNA sequences which encode substantially the same or a functionally equivalent amino acid sequence may be produced, and these sequences may be used to clone and express peptides or polypeptides. The nucleotide sequences of the present invention can be engineered using methods generally known in the art in order to alter amino acid-encoding sequences for a variety of reasons, including but not limited to, alterations which modify the cloning, processing, and/or expression of the gene product. DNA shuffling by random fragmentation and PCR reassembly of gene fragments and synthetic oligonucleotides may be used to engineer the nucleotide sequences. For example, site-directed mutagenesis may be used to insert new restriction sites, alter glycosylation patterns, change codon preference, introduce mutations, and so forth.

In another embodiment of the invention, natural, modified, or recombinant nucleic acid sequences encoding peptides or polypeptides may be ligated to a heterologous sequence to encode a fusion protein. For example, it may be useful to encode a chimeric sequence that can be recognized by a commercially available antibody. A fusion protein may also be engineered to contain a cleavage site located between the peptide or polypeptide of the invention and the heterologous protein sequence, so that the peptide or polypeptide may be cleaved and purified away from the heterologous moiety.

In another embodiment, sequences encoding peptides or polypeptides may be synthesized, in whole or in part, using chemical methods well known in the art (see Caruthers, M. H. et al. (1980) Nucl. Acids Res. Symp. Ser. 215-223, Horn, T. et al. (1980) Nucl. Acids Res. Symp. Ser. 225-232). Alternatively, the polypeptide itself may be produced using chemical methods to synthesize the amino acid molecule, or a fragment thereof. For example, polypeptide synthesis can be performed using various solid-phase techniques (Roberge, J. Y. et al. (1995) Science 269:202-204; Merrifield J. (1963) J. Am. Chem. Soc. 85:2149-2154) and automated synthesis may be achieved, for example, using the ABI 431A Peptide Synthesizer (Perkin Elmer). Various fragments of peptides or polypeptides may be chemically synthesized separately and combined using chemical methods to produce the full length molecule.

The newly synthesized peptide or polypeptide may be isolated by preparative high performance liquid chromatography (e.g., Creighton, T. (1983) Proteins Structures and Molecular Principles, WH Freeman and Co., New York, N.Y.). The composition of the synthetic peptides or polypeptides may be confirmed by amino acid analysis or sequencing (e.g., the Edman degradation procedure; Creighton, supra). Additionally, the amino acid sequence of the peptide or polypeptide, or any part thereof, may be altered during direct synthesis and/or combined using chemical methods with sequences from other proteins, or any part thereof, to produce a variant molecule.

In order to express a biologically active peptides or polypeptides, the nucleotide sequences encoding the sequences or functional equivalents, may be inserted into an appropriate expression vector, i.e., a vector which contains the necessary elements for the transcription and translation of the inserted coding sequence. Methods which are well known to those skilled in the art may be used to construct expression vectors containing sequences encoding the peptide or polypeptide and appropriate transcriptional and translational control elements. These methods include in vitro recombinant DNA techniques, synthetic techniques, and in vivo genetic recombination. Such techniques are described in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York, N.Y.

A variety of expression vector/host systems may be utilized to contain and express sequences encoding the peptides or polypeptides of the invention. These include, but are not limited to, microorganisms such as bacteria transformed with recombinant phage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems. For bacteria, useful plasmids include pET, pRSET, pTrcHis2, and pBAD plasmids from Invitrogen, pET and pCDF plasmids from Novagen, and Director™ plasmids from Sigma-Aldrich. For methanogens, useful plasmids include, but are not limited to pME2001, pMV15, and pMP1. The invention is not limited by the expression vector or host cell employed.

The "control elements" or "regulatory sequences" are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the BLUESCRIPT phagemid (Stratagene, LaJolla, Calif.) or pSPORT1 plasmid (Life Technologies) and the like may be used. The baculovirus polyhedrin promoter may be used in insect cells. Promoters or enhancers derived from the genomes of plant cells (e.g., heat shock, RUBISCO, and storage protein genes) or from plant viruses (e.g., viral promoters or leader sequences) may be cloned into the vector.

In bacterial systems, a number of expression vectors may be selected depending upon the use intended for the peptide or polypeptide. For example, when large quantities of peptide or polypeptide are needed, vectors which direct high level expression of fusion proteins that are readily purified may be used. Such vectors include, but are not limited to, the multifunctional E. coli cloning and expression vectors such as BLUESCRIPT (Stratagene), in which the sequence encoding a polypeptide may be ligated into the vector in frame with sequences for the amino-terminal Met and the subsequent 7 residues of β-galactosidase so that a hybrid protein is produced; pIN vectors (Van Heeke, G. and S. M. Schuster (1989) J. Biol. Chem. 264:5503-5509); and the like.

pGEX vectors (Promega, Madison, Wis.) may also be used to express peptides or polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor Xa protease cleavage sites so that the cloned peptide or polypeptide of interest can be released from the GST moiety at will. In the yeast, Saccharomyces

*cerevisiae*, a number of vectors containing constitutive or inducible promoters such as alpha factor, alcohol oxidase, and PGH may be used. For reviews, see Ausubel et al. (supra) and Grant et al. (1987) Methods Enzymol. 153:516-544.

Specific initiation signals may also be used to achieve more efficient translation of sequences encoding the peptides or polypeptides of the invention. Such signals include the ATG initiation codon and adjacent sequences. In cases where sequences encoding a peptide or polypeptide, its initiation codon, and upstream sequences are inserted into the appropriate expression vector, no additional transcriptional or translational control signals may be needed. However, in cases where only coding sequence, or a fragment thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf, D. et al. (1994) Results Probl. Cell Differ. 20:125-162).

In addition, a host cell strain may be chosen for its ability to modulate the expression of the inserted sequences or to process the expressed peptide or polypeptide in the desired fashion. Such modifications of the sequence include, but are not limited to, acetylation, carboxylation, glycosylation, phosphorylation, lipidation, and acylation. Post-translational processing which cleaves a "prepro" form of the peptide or polypeptide may also be used to facilitate correct insertion, folding, and/or function. Different host cells which have specific cellular machinery and characteristic mechanisms for post-translational activities are available from the American Type Culture Collection (ATCC; Bethesda, Md.) and may be chosen to ensure the correct modification and processing of the sequence. Specific host cells include, but are not limited to, methanogen cells, such as *Methanobrevibacter* cells, in particular, *M. ruminantium*, or *M. smithii* cells. Host cells of interest include, for example, *Rhodotorula, Aureobasidium, Saccharomyces, Sporobolomyces, Pseudomonas, Erwinia* and *Flavobacterium*; or such other organisms as *Escherichia, Lactobacillus, Bacillus, Streptomyces*, and the like. Specific host cells include *Escherichia coli*, which is particularly suited for use with the present invention, *Saccharomyces cerevisiae, Bacillus thuringiensis, Bacillus subtilis, Streptomyces lividans*, and the like.

There are several techniques for introducing polynucleotides into eukaryotic cells cultured in vitro. These include chemical methods (Feigner et al., Proc. Natl. Acad. Sci., USA, 84:7413 7417 (1987); Bothwell et al., Methods for Cloning and Analysis of Eukaryotic Genes, Eds., Jones and Bartlett Publishers Inc., Boston, Mass. (1990), Ausubel et al., Short Protocols in Molecular Biology, John Wiley and Sons, New York, N.Y. (1992); and Farhood, Annal. NY Acad. Sci., 716:23 34 (1994)), use of protoplasts (Bothwell, supra) or electrical pulses (Vatteroni et al., Mutn. Res., 291:163 169 (1993); Sabelnikov, Prog. Biophys. Mol. Biol., 62: 119 152 (1994); Bothwell et al., supra; and Ausubel et al., supra), use of attenuated viruses (Davis et al., J. Virol. 1996, 70(6), 3781 3787; Brinster et al. J. Gen. Virol. 2002, 83(Pt 2), 369 381; Moss, Dev. Biol. Stan., 82:55 63 (1994); and Bothwell et al., supra), as well as physical methods (Fynan et al., Int J Immunopharmacol. 1995 February; 17(2):79-83; Johnston et al., Meth. Cell Biol., 43(Pt A):353 365 (1994); Bothwell et al., supra; and Ausubel et al., supra).

Successful delivery of polynucleotides to animal tissue can be achieved by cationic liposomes (Watanabe et al., Mol. Reprod. Dev., 38:268 274 (1994)), direct injection of naked DNA or RNA into animal muscle tissue (Robinson et al., Vacc., 11:957 960 (1993); Hoffman et al., Vacc. 12:1529 1533; (1994); Xiang et al., Virol., 199:132 140 (1994); Webster et al., Vacc., 12:1495 1498 (1994); Davis et al., Vacc., 12:1503 1509 (1994); Davis et al., Hum. Molec. Gen., 2:1847 1851 (1993); Dalemans et al. Ann NY Acad. Sci. 1995, 772, 255 256. Conry, et al. Cancer Res. 1995, 55(7), 1397-1400), and embryos (Naito et al., Mol. Reprod. Dev., 39:153 161 (1994); and Burdon et al., Mol. Reprod. Dev., 33:436 442 (1992)), intramuscular injection of self replicating RNA vaccines (Davis et al., J Virol 1996, 70(6), 3781 3787; Balasuriya et al. Vaccine 2002, 20(11 12), 1609 1617) or intradermal injection of DNA using "gene gun" technology (Johnston et al., supra).

A variety of protocols for detecting and measuring the expression of the peptides or polypeptides of the invention, using either polyclonal or monoclonal antibodies specific for the protein are known in the art. Examples include enzyme-linked immunosorbent assay (ELISA), radioimmunoassay (RIA), and fluorescence activated cell sorting (FACS). A two-site, monoclonal-based immunoassay can be used with monoclonal antibodies reactive to two non-interfering epitopes on the peptide or polypeptide, but a competitive binding assay can also be used. These and other assays are described, among other places, in Hampton, R. et al. (1990; Serological Methods, a laboratory Manual, APS Press, St Paul, Minn.) and Maddox, D. E. et al. (1983; J. Exp. Med. 158:1211-1216).

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences encoding the peptides or polypeptides, or any fragments or variants thereof, may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits Amersham Pharmacia Biotech, Promega, and US Biochemical. Suitable reporter molecules or labels, which may be used for ease of detection, include radionuclides, enzymes, fluorescent, chemiluminescent, or chromogenic agents as well as substrates, cofactors, inhibitors, magnetic particles, and the like.

Expression vectors or host cells transformed with expression vectors may be cultured under conditions suitable for the expression and recovery of the peptide or polypeptide from culture. The culture can comprise components for in vitro or in vivo expression. In vitro expression components include those for rabbit reticulocyte lysates, *E. coli* lysates, and wheat germ extracts, for example, Expressway™ or RiPs systems from Invitrogen, Genelator™ systems from iNtRON Biotechnology, EcoPro™ or STP3™ systems from Novagen, TNT® Quick Coupled systems from Promega, and EasyXpress systems from QIAGEN. The peptide or polypeptide produced from culture may be secreted or contained intracellularly depending on the sequence and/or the vector used. In particular aspects, expression vectors which encode a peptide or polypeptide can be designed to contain signal sequences which direct secretion of the peptide or polypeptide through a prokaryotic or eukaryotic cell membrane. Specific signal peptides for use herein have been disclosed in detail in U.S. 60/975,104 filed 25 Sep. 2007, and in PCT/2008/000247 filed 25 Sep. 2008, which are hereby incorporated by reference herein in their entirety.

Other constructions may include an amino acid domain which will facilitate purification of the peptide or polypeptide. Such domains include, but are not limited to, metal chelating domains such as histidine-tryptophan (e.g., 6X-HIS) modules that allow purification on immobilized metals, protein A domains that allow purification on immobilized immunoglobulin, and the domain utilized in the FLAG® extension/affinity purification system (Immunex Corp., Seattle, Wash.). Useful epitope tags include 3XFLAG®, HA, VSV-G, V5, HSV, GST, GFP, MBP, GAL4, and β-galactosidase. Useful plasmids include those comprising a biotin tag (e.g., PinPoint™ plasmids from Promega), calmodulin binding protein (e.g., pCAL plasmids from Stratagene), streptavidin binding peptide (e.g., InterPlay™ plasmids from Stratagene), a c-myc or FLAG® tag (e.g., Immunoprecipitation plasmids from Sigma-Aldrich), or a histidine tag (e.g., QIAExpress plasmids from QIAGEN).

To facilitate purification, expression vectors can include cleavable linker sequences such as those specific for Factor Xa or enterokinase (Invitrogen, San Diego, Calif.). For example, the vector can include one or more linkers between the purification domain and the peptide or polypeptide. One such expression vector provides for expression of a fusion protein comprising a peptide or polypeptide of the invention and a polynucleotide encoding 6 histidine residues preceding a thioredoxin or an enterokinase cleavage site. The histidine residues facilitate purification on IMAC (immobilized metal ion affinity chromatography as described in Porath, J. et al. (1992) Prot. Exp. Purif. 3:263-281) while the enterokinase cleavage site provides a means for purifying the peptide or polypeptide from the fusion protein. A discussion of vectors which contain fusion proteins is provided in Kroll, D. J. et al. (1993; DNA Cell Biol. 12:441-453).

In another aspect, the invention provides a peptide or polypeptide comprising an epitope-bearing portion of a polypeptide of the invention. The epitope of this polypeptide portion can be an immunogenic (eliciting an immune response) or antigenic (antibody-binding) epitope. These immunogenic epitopes can be confined to a few loci on the molecule. It is understood that the number of immunogenic epitopes of a protein generally is less than the number of antigenic epitopes. See, for instance, Geysen et al., Proc. Natl. Acad. Sci. USA 81:3998-4002 (1983).

As to the selection of peptides or polypeptides bearing an antigenic epitope (i.e., that contain a region of a protein molecule to which an antibody can bind), it is well known in that art that relatively short synthetic peptides that mimic part of a protein sequence are routinely capable of eliciting an antiserum that reacts with the partially mimicked protein. See, for instance, Sutcliffe, J. G., Shinnick, T. M., Green, N. and Learner, R. A. (1983). Antibodies that react with predetermined sites on proteins are described in Science 219: 660-666. Peptides capable of eliciting protein-reactive sera are frequently represented in the primary sequence of a protein, can be characterized by a set of simple chemical rules, and are confined neither to immunodominant regions of intact proteins (i.e., immunogenic epitopes) nor to the amino or carboxyl terminals. Peptides that are extremely hydrophobic and those of six or fewer residues generally are ineffective at inducing antibodies that bind to the mimicked protein; longer, peptides, especially those containing proline residues, usually are effective. Sutcliffe et al., p. 661.

Antigenic epitope-bearing peptides and polypeptides of the invention are therefore useful to raise antibodies, including monoclonal antibodies, that bind specifically to a polypeptide of the invention. Thus, a high proportion of hybridomas obtained by fusion of spleen cells from donors immunized with an antigen epitope-bearing peptide generally secrete antibody reactive with the native protein. Sutcliffe et al., p. 663. The antibodies raised by antigenic epitope-bearing peptides or polypeptides are useful to detect the mimicked protein, and antibodies to different peptides may be used for tracking the fate of various regions of a protein precursor which undergoes post-translational processing. The peptides and anti-peptide antibodies may be used in a variety of qualitative or quantitative assays for the mimicked protein, for instance in competition assays since it has been shown that even short peptides (e.g., about 9 amino acids) can bind and displace the larger peptides in immunoprecipitation assays. See, for instance, Wilson et al., Cell 37:767-778 (1984) at 777. The anti-peptide antibodies of the invention also are useful for purification of the mimicked protein, for instance, by adsorption chromatography using methods well known in the art.

Antigenic epitope-bearing peptides and polypeptides of the invention designed according to the above guidelines preferably contain a sequence of at least seven, more preferably at least nine and most preferably between about 15 to about 30 amino acids contained within the amino acid sequence of a polypeptide of the invention. However, peptides or polypeptides comprising a larger portion of an amino acid sequence of a polypeptide of the invention, containing about 30 to about 50 amino acids, or any length up to and including the entire amino acid sequence of a polypeptide of the invention, also are considered epitope-bearing peptides or polypeptides of the invention and also are useful for inducing antibodies that react with the mimicked protein. Preferably, the amino acid sequence of the epitope-bearing peptide is selected to provide substantial solubility in aqueous solvents (i.e., the sequence includes relatively hydrophilic residues and highly hydrophobic sequences are preferably avoided); and sequences containing proline residues are particularly preferred.

The epitope-bearing peptides and polypeptides of the invention may be produced by any conventional means for making peptides or polypeptides including recombinant means using polynucleotides of the invention. For instance, a short epitope-bearing amino acid sequence may be fused to a larger polypeptide which acts as a carrier during recombinant production and purification, as well as during immunization to produce anti-peptide antibodies. Epitope-bearing peptides also may be synthesized using known methods of chemical synthesis. See, e.g., Houghten, R. A. (1985) General method for the rapid solid-phase synthesis of large numbers of peptides: specificity of antigen-antibody interaction at the level of individual amino acids. Proc. Natl. Acad. Sci. USA 82:5131-5135. This process is further described in U.S. Pat. No. 4,631,211 to Houghten et al. (1986). In this procedure the individual resins for the solid-phase synthesis of various peptides are contained in separate solvent-permeable packets, enabling the optimal use of the many identical repetitive steps involved in solid-phase methods. A completely manual procedure allows 500-1000 or more syntheses to be conducted simultaneously. Houghten et al., p. 5134

Epitope-bearing peptides and polypeptides of the invention are used to induce antibodies according to methods well known in the art. See, for instance, Sutcliffe et al., supra; Wilson et al., supra; Chow, M. et al., Proc. Natl. Acad. Sci. USA 82:910-914; and Bittle, F. J. et al., J. Gen Virol. 66:2347-2354 (1985). Generally, animals may be immunized with free peptide; however, anti-peptide antibody titer may be boosted by coupling of the peptide to a macromolecular carrier, such as keyhole limpet hemacyanin (KLH) or tetanus toxoid. For instance, peptides containing cysteine may be coupled to carrier using a linker such as m-maleimidobenzoyl-N-hydroxysuccinimide ester (MBS), while other peptides may be coupled to carrier using a more general linking agent such as glutaraldehyde. Animals such as rabbits, rats and mice are immunized with either free or carrier-coupled peptides, for instance, by intraperitoneal and/or intradermal injection of emulsions containing about 100 g peptide or carrier protein and Freund's adjuvant. Several booster injections may be needed, for instance, at intervals of about two weeks, to provide a useful titer of anti-peptide antibody which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

Immunogenic epitope-bearing peptides of the invention, i.e., those parts of a protein that elicit an antibody response when the whole protein is the immunogen, are identified according to methods known in the art. For instance, Geysen et al., supra, discloses a procedure for rapid concurrent synthesis on solid supports of hundreds of peptides of sufficient purity to react in an enzyme-linked immunosorbent assay. Interaction of synthesized peptides with antibodies is then easily detected without removing them from the support. In this manner a peptide bearing an immunogenic epitope of a desired protein may be identified routinely by one of ordinary skill in the art For instance, the immunologically important epitope in the coat protein of foot-and-mouth disease virus was located by Geysen et al. with a resolution of seven amino acids by synthesis of an overlapping set of all 208 possible hexapeptides covering the entire 213 amino acid sequence of the protein. Then, a complete replacement set of peptides in which all 20 amino acids were substituted in turn at every position within the epitope were synthesized, and the particular amino acids conferring specificity for the reaction with antibody were determined. Thus, peptide analogs of the epitope-bearing peptides of the invention can be made routinely by this method. U.S. Pat. No. 4,708,781 to Geysen (1987) further describes this method of identifying a peptide bearing an immunogenic epitope of a desired protein.

Further still, U.S. Pat. No. 5,194,392 to Geysen (1990) describes a general method of detecting or determining the sequence of monomers (amino acids or other compounds) which is a topological equivalent of the epitope (i.e., a "mimotope") which is complementary to a particular paratope (antigen binding site) of an antibody of interest. More generally, U.S. Pat. No. 4,433,092 to Geysen (1989) describes a method of detecting or determining a sequence of monomer which is a topographical equivalent of a ligand which is complementary to the ligand binding site of a particular receptor of interest. Similarly, U.S. Pat. No. 5,480,971 to Houghten, R. A. et al. (1996) on Peralkylated Oligopeptide Mixtures discloses linear $C_1$-$C_7$-alkyl peralkylated oligopeptides and sets and libraries of such peptides, as well as methods for using such oligopeptide sets and libraries for determining the sequence of a peralkylated oligopeptide that preferentially binds to an acceptor molecule of interest. Thus, non-peptide analogs of the epitope-bearing peptides of the invention also can be made routinely by these methods.

As one of skill in the art will appreciate, the polypeptides of the present invention and the epitope-bearing fragments thereof described above can be combined with parts of the constant domain of immunoglobulins (IgG), resulting in chimeric polypeptides. These fusion proteins facilitate purification and show an increased half-life in vivo. This has been demonstrated, e.g., for chimeric proteins consisting of the first two domains of the human CD4-polypeptide and various domains of the constant regions of the heavy or light chains of mammalian immunoglobulins (EPA 394,827; Traunecker et al., Nature 331:84-86 (1988)). Fusion proteins that have a disulfide-linked dimeric structure due to the IgG part can also be more efficient in binding and neutralizing other molecules than the monomeric protein or protein fragment alone (Fountoulakis et al., J Biochem 270:3958-3964 (1995)).

Non-Ribosomal Peptide Synthetases

As particular examples, the polypeptides of the invention may include non-ribosomal peptide synthetases. Non-ribosomal peptides are synthesized on enzymatic thiotemplates termed non-ribosomal peptide synthetases (NRPS). The non-ribosomal peptides encompass a wide range of compounds having diverse activities including, but not limited to, immunosuppressive (such as cyclosporin), surfactant (such as surfactin), siderophores (such as enterobactin), virulence factors (such as yersinabactin), antibacterial (such as penicillin and vancomycin), and anti-cancer (such as actinomycin and bleomycin) activities (Weber et al., Current Genomics 1994; 26:120-25; Ehmann et al., Proc. Nat. Acad. Sci. 2000; 97:2509-14; Gehring et al., Biochemistry 1998; 37:11637; Kallow et al., Biochemistry 1998; 37:5947-52; Trauger et al., Proc. Nat. Acad. Sci. 2000; 97:3112-17; Schauweker et al., J. Bacteriology 1999; 27:2468-74; and Shen et al., Bioorganic Chem 1999; 27:155-71). As to particular NRPS products, see Felnagle et al., Nonribosomal peptide synthetases involved in the production of medically relevant natural products, Mol. Pharm. 2008 March-April; 5(2):191-211.

Non-ribosomal peptides typically range in size from 1-11 amino acids and are produced by a variety of microbes including cyanobacteria, actinomycetes, and fungi. In many cases the non-ribosomal peptides contain non-proteogenic amino acids such as norleucine, β-alanine, ornithine, etc., for which biogenesis pathways, which are secondary to primary metabolism, are required and are post-synthetically modified (e.g., hydroxylated, methylated or acylated) by tailoring enzymes. The term proteogenic indicates that the amino acid can be incorporated into a protein in a cell through well-known metabolic pathways. The choice of including a (D)- or (L)-amino acid into a peptide of the present invention depends, in part, on the desired characteristics of the peptide. For example, the incorporation of one or more (D)-amino acids can confer increasing stability on the peptide in vitro or in vivo. The term amino acid equivalent refers to compounds which depart from the structure of the naturally occurring amino acids, but which have substantially the structure of an amino acid, such that they can be substituted within a peptide that retains biological activity. Thus, for example, amino acid equivalents can include amino acids having side chain modifications and/or substitutions, and also include related organic acids, amides or the like.

The polynucleotide sequences required to make a NRPS and the necessary tailoring enzymes have been shown in all cases to be localized to the chromosome of the producing microbe. NRPS are modular in nature, where a module may be defined as a segment of the NRPS necessary to catalyze the activation of a specific amino acid and result in the incorporation of that amino acid into a non-ribosomal peptide. A minimal module contains three domains: (1) adenylation domains (about 60 kDa), responsible for selecting and activating an amino acid and transferring the aminoacyl adenylate to a peptidyl carrying centre; (2) thiolation domains, also referred to as peptidyl carrier proteins (8-10 kDa), containing a serine residue which is post-translationally modified with a 4-phosphopantetheine group (Ppant) which acts as an acceptor for the aminoacyl adenylate; and (3) condensation domains (50-60 kDa) which catalyze peptide bond-forming chain-translocating steps between an upstream peptidyl-s-Ppant and the downstream aminoacyl-Ppant of the adjacent module (Doekel, S, and Marahiel, M. A. 2000; Chem. Biol. 7:373-384). This minimal module for chain extension is typically repeated within a synthetase and a co-linear relationship exists between the number of modules present and the number of amino acids in the final product with the order of the modules in the synthetase determining the order of the amino acids in the peptide.

The adenylation domain is typically about 60 kDa. The main function of this domain is to select and activate a specific amino acid as an aminoacyl adenylate. Based on its function, the adenylation domain regulates the sequence of the peptide being produced. Once charged (as an amino acyl adenylate moiety), the amino acid is transferred to a thiolation domain (peptidyl carrying centre). The thiolation domain is also referred to as a peptidyl carrier protein. This domain is typically 8-10 kDa and contains a serine residue that is post-translationally modified with a 4-phosphopantetheine group. This group acts as an acceptor for the aminoacyl adenylate moiety on the amino acid. A nucleophilic reaction leads to the release of the aminoacyl adenylate and conjugation of the amino acid to thiolation domain via a thioester bond. The condensation domain is typically about 50-60 kDa in size. The main function of this domain is to catalyze the formation of a peptide bond between two amino acids. In this reaction an upstream tethered peptidyl group is translocated to the downstream aminoacyl-s-Ppant and linked to the amino acid by peptide bond formation.

This minimal module for chain extension is typically repeated within a synthetase. Additionally, and typically, a co-linear relationship exists between the number of modules present and the number of amino acids in the final product with the order of the modules in the synthetase determining the order of the amino acids in the peptide. This 1:1 relationship, with every amino acid in the product having one module within the enzyme, is referred to as the co-linearity rule. Examples have been found that violate this rule, and in such cases, the NRPS contains more modules than one would expect based on the number of amino acids incorporated in the peptide product (Challis et al., Chem. Biol. 2000; 7:211-24). In some cases the minimal module also is supplemented with additional domains (epimerization, N- or C-methylation, or cyclization domain), with their position in the synthetase determining the substrate upon which they can act. In addition, it has been observed that NRPS contain inter-domain spacers or linker regions. It has been proposed that these spacers may play a critical role in communication between domains, modules, and even entire synthetases.

There are highly conserved motifs in the catalytic domains of peptide synthetases including: 10 conserved motifs in the adenylation domain; 1 conserved motif in the thiolation domain; 7 conserved motifs in the condensation domain; 1 conserved motif in the thioesterase domain; 7 conserved motifs in the epimerization domains; and 3 conserved motifs in the N-methylation domains. These are detailed in Marahiel et al., Chemical Rev. 1997; 97:2651-73. In addition to modifications such as epimerization, methylation and cyclization during peptide synthesis, post-translational modifications including methylation, hydroxylation, oxidative cross-linking and glycosylation can occur (Walsh et al., Curr. Opin. Chem. Biol. 2001; 5:525-34).

In the present invention, the polynucleotide and polypeptide sequences for NRPS from *M. ruminantium* have been characterized (see below). For use with the present invention, the enzymes may be tailored as needed. For example, after production of the core of the peptide product, the sequence may then be modified by additional enzymes which are herein termed tailoring enzymes. These enzymes alter the amino acids in the compound without altering the number or the specific amino acids present within the compound. Such tailoring enzymes may include, but are not limited to, arginine cyclase, an O-mannosyltransferase, a phenylalanine C-methyltransferase, a first isovaleryl transferase, and a second isovaleryl transferase. The present invention permits specific changes to be made, either by site directed mutagenesis or replacement, to genetically modify the peptide core. The modifications may be made in a rational manner to improve the biological activity of the peptide produced by the strain or to direct synthesis of compounds that are structurally related to the peptide. The invention also allows for the tailoring enzymes to be used for biotransformation experiments to produce enzymes to modify and possibly improve other useful compounds. As to modified NRPS products, see Velkov et al., Non-ribosomal peptide synthetases as technological platforms for the synthesis of highly modified peptide bioeffectors—Cyclosporin synthetase as a complex example, Biotechnol Annu Rev. 2003;9:151-97.

The determination of the NRPS from *M. ruminantium* also enables one of ordinary skill in the art to clone and express the pathway into a heterologous organism. Any organism may be used, although preferably a bacterial strain is used. The choice of organism is dependent upon the needs of the skilled artisan. For example, a strain that is amenable to genetic manipulation may be used in order to facilitate modification and production of the peptide product. The present invention advantageously permits specific changes to be made to individual modules of NRPS, either by site directed mutagenesis or replacement, to genetically modify the peptide core. Additionally, the NRPS modules can be used to modify other NRPS that direct the synthesis of other useful peptides through module swapping. For example, the module in NRPS that incorporates tyrosine into the peptide core of the product may be modified so as to incorporate a serine in its place.

The activity of any NRPS disclosed herein may be evaluated using any method known in the art. For example, specific modifications to the polypeptide sequence may be produced to alter the final product. Other non-limiting examples of studies that may be conducted with these proteins include (i) evaluation of the biological activity of a protein and (ii) manipulation of a synthetic pathway to alter the final product from microbes. Genetic manipulations and expression of the polypeptides discussed herein may be conducted by any method known in the art. For example, the effect of point mutations may be evaluated. The mutations may be produced by any method known in the art. In one specific method, the manipulations and protein expression may be conducted using a vector that comprises at least one origin of replication. The origins of replication allow for replication of the polynucleotide in the vector in the desired cells. Additionally, the vector may comprise a multiple cloning site that allows for the insertion of a heterologous nucleic acid that may be replicated and transcribed by a host cell. In one particular aspect, conjugation can be used for the direct transfer of nucleic acid from one prokaryotic cell to another via direct contact of cells. The origin of transfer is determined by a vector, so that both donor and recipient cells obtain copies of the vector. Transmissibility by conjugation is controlled by a set of genes in the tra region, which also has the ability to mobilize the transfer of chromosomes when the origin of transfer is integrated into them (Pansegrau et al., J. Mol. Biol., 239:623-663, 1994; Fong and Stanisich, J. Bact., 175:448-456, 1993).

The vector described previously may be used to assess the biological activity of the NRPS. The vector may be used to alter a polypeptide, either by partial or complete removal of the polynucleotide sequence encoding the protein, or by disruption of that sequence. Evaluation of the products produced when the altered polypeptide is present is useful in determining the functionality of the polypeptide. As discussed above, specific polypeptides within the biochemical pathway may be modified to assess the activity of the compounds produced by these altered polypeptides and to determine which sections of the product are important for activity and function. The present invention contemplates any method of altering any of the NRPS of the present invention. More specifically, the invention contemplates any method that would insert amino acids, delete amino acids or replace amino acids in the polypeptides of the invention. Additionally, a whole domain in a module in a NRPS may be replaced. Therefore, for example, the acylation domain that incorporates tyrosine into the final product may be replaced with a domain that incorporates serine. The modifications may be performed at the nucleic acid level. These modifications may be performed by standard techniques and are well known within the art. Upon production of the polynucleotide encoding the modified polypeptide, the amino acid sequence can be expressed in a host cell. Then the host cell can be cultured under conditions that permit production of a product of the altered pathway. Once the product is isolated, the activity of the product may be assessed using any method known in the art. The activity can be compared to the product of the non-modified biosynthetic pathway and to products produced by other modifications. Correlations may be drawn between specific alterations and activity. For example, it may be determined that an active residue at a specific position may increase activity. These types of correlations will allow one of ordinary skill to determine the most preferred product structure for specified activity. As to modification techniques for NRPS, see Dürfahrt et al., Functional and structural basis for targeted modification of non-ribosomal peptide synthetases, Ernst Schering Res Found Workshop. 2005;(51):79-106.

The present invention also contemplates a method for using an intergeneric vector to manipulate, modify, or isolate a protein involved in the synthesis of a specific product. For example, the vector of the present invention may be used to alter an enzyme which is involved in incorporation of an alanine residue into a peptide, so that a tyrosine residue is incorporated instead. The effect of this modification on peptide function may be then be evaluated for biological efficacy. In the above example, modifications to the enzyme may include, but are not limited to, removal of amino acids and/or sequences that specifically recognize alanine and/or incorporation of amino acids and/or sequences that specifically recognize tyrosine. Therefore, in general terms, the vector of the present invention may be used to alter a gene sequence by insertion of nucleic acid sequences, deletion of nucleic acid sequences, or alteration of specific bases within a nucleic acid sequence to alter the sequence of a polypeptide of interest; thereby producing a modified protein of interest. Preferably, the polypeptide of interest is involved in the synthesis of a compound of interest. The method of modifying a protein may comprise (i) transfecting a first microbial cell with the vector of the present invention, (ii) culturing the first microbial cell under conditions that allow for replication of the vector, (iii) conjugating the first microbial cell with a second microbial cell under conditions that allow for the direct transfer of the vector from the first microbial cell to the second microbial cell, and (iv) isolating the second microbial cell transformed with the vector. Other method of vector transfer are also contemplated and disclosed herein.

Antibodies and Vaccines

The antibodies of the invention may be produced using methods which are generally known in the art. In particular, purified peptides, polypeptides, or polynucleotides may be used to produce antibodies in accordance with known methods. Such antibodies may include, but are not limited to, polyclonal, monoclonal, chimeric, and single chain antibodies, Fab fragments, and fragments produced by a Fab expression library. Neutralizing antibodies, (i.e., those which inhibit function) are especially preferred for use with vaccines.

For the production of antibodies, various hosts including goats, rabbits, rats, mice, humans, and others, may be immunized by injection with a peptide, polypeptide, polynucleotide, or any fragment thereof which has immunogenic properties. Depending on the host species, various adjuvants may be used to increase immunological response. Such adjuvants include, but are not limited to, Freund's, mineral gels such as aluminium hydroxide, and surface active substances such as lysolecithin, pluronic polyols, polyanions, peptides, oil emulsions, keyhole limpet hemocyanin, and dinitrophenol. Among adjuvants used in humans, BCG (bacilli Calmette-Guerin) and *Corynebacterium parvum* are especially preferable.

It is preferred that the peptides, polypeptides, or fragments used to induce antibodies have an amino acid sequence comprising at least five amino acids and more preferably at least 10 amino acids. It is also preferable that they are identical to a portion of the amino acid sequence of the natural protein, and they may contain the entire amino acid sequence of a small, naturally occurring molecule. Short stretches of amino acids may be fused with those of another protein such as keyhole limpet hemocyanin and antibody produced against the chimeric molecule.

Monoclonal antibodies may be prepared using any technique which provides for the production of antibody molecules by continuous cell lines in culture. These include, but are not limited to, the hybridoma technique, the human B-cell hybridoma technique, and the EBV-hybridoma technique (Kohler, G. et al. (1975) Nature 256:495-497; Kozbor, D. et al. (1985) J. Immunol. Methods 81:31-42; Cote, R. J. et al. (1983) Proc. Natl. Acad. Sci. 80:2026-2030; Cole, S. P. et al. (1984) Mol. Cell Biol. 62:109-120).

In addition, techniques developed for the production of "chimeric antibodies", e.g., the combining of mouse antibody genes and human antibody genes to obtain a molecule with appropriate antigen specificity and biological activity can be used (Morrison, S. L. et al. (1984) Proc. Natl. Acad.

Sci. 81:6851-6855; Neuberger, M. S. et al. (1984) Nature 312:604-608; Takeda, S. et al. (1985) Nature 314:452-454). Alternatively, techniques described for the production of single chain antibodies may be adapted, using methods known in the art, to produce specific single chain antibodies. Antibodies with related specificity, but of distinct idiotypic composition, may be generated by chain shuffling from random combinatorial immunoglobin libraries (Burton D. R. (1991) Proc. Natl. Acad. Sci. 88:11120-3).

Those of skill in the art to which the invention relates will appreciate the terms "diabodies" and "triabodies". These are molecules which comprise a heavy chain variable domain (VH) connected to a light chain variable domain (VL) by a short peptide linker that is too, short to allow pairing between the two domains on the same chain. This promotes pairing with the complementary domains of one or more other chains and encourages the formation of dimeric or trimeric molecules with two or more functional antigen binding sites. The resulting antibody molecules may be monospecific or multispecific (e.g., bispecific in the case of diabodies). Such antibody molecules may be created from two or more antibodies using methodology standard in the art to which the invention relates; for example, as described by Todorovska et al. (Design and application of diabodies, triabodies and tetrabodies for cancer targeting. J. Immunol. Methods. 2001 Feb. 1;248(1-2):47-66).

Antibodies may also be produced by inducing in vivo production in the lymphocyte population or by screening immunoglobulin libraries or panels of highly specific binding reagents as disclosed in the literature (Orlandi, R. et al. (1989) Proc. Natl. Acad. Sci. 86:3833-3837; Winter, G. et al. (1991) Nature 349:293-299).

Antibody fragments which contain specific binding sites may also be generated. For example, such fragments include, but are not limited to, the F(ab')$_2$ fragments which can be produced by pepsin digestion of the antibody molecule and the Fab fragments which can be generated by reducing the disulfide bridges of the F(ab')$_2$ fragments. Alternatively, Fab expression libraries may be constructed to allow rapid and easy identification of monoclonal Fab fragments with the desired specificity (Huse, W. D. et al. (1989) Science 254:1275-1281).

Various immunoassays may be used for screening to identify antibodies having binding specificity. Numerous protocols for competitive binding or immunoradiometric assays using either polyclonal or monoclonal antibodies with established specificities are well known in the art. Such immunoassays typically involve the measurement of complex formation between a peptide, polypeptide, or polynucleotide and its specific antibody. A two-site, monoclonal-based immunoassay utilizing monoclonal antibodies reactive to two non-interfering epitopes is preferred, but a competitive binding assay may also be employed (Maddox, supra).

The antibodies described herein have the ability to target and/or inhibit cells and are also useful as carrier molecules for the delivery of additional inhibitory molecules into microbial cells. The chemistry for coupling compounds to amino acids is well developed and a number of different molecule types could be linked to the antibodies. The most common coupling methods rely on the presence of free amino (alpha-amino or Lys), sufhydryl (Cys), or carboxylic acid groups (Asp, Glu, or alpha-carboxyl). Coupling methods can be used to link the antibody to the cell inhibitor via the carboxy- or amino-terminal residue. In some cases, a sequence includes multiple residues that may react with the chosen chemistry. This can be used to produce multimers, comprising more than one cell inhibitor. Alternatively, the antibody can be shortened or chosen so that reactive residues are localized at either the amino or the carboxyl terminus of the sequence.

For example, a reporter molecule such as fluorescein can be specifically incorporated at a lysine residue (Ono et al., 1997) using N-α-Fmoc-Nε-1-(4,4-dimethyl-2,6 dioxocyclohex-1-ylidene-3-methylbutyl)-L-lysine during polypeptide synthesis. Following synthesis, 5- and 6-carboxyfluorescein succinimidyl esters can be coupled after 4,4-dimethyl-2,6 dioxocyclohex-1-ylidene is removed by treatment with hydrazine. Therefore coupling of an inhibitory molecule to the antibody can be accomplished by inclusion of a lysine residue to the polypeptide sequence, then reaction with a suitably derivatised cell inhibitor.

EDC (1-ethyl-3-(3-dimethylaminopropyl)carbodiimide hydrochloride) or the carbodiimide coupling method can also be used. Carbodiimides can activate the side chain carboxylic groups of aspartic and glutamic acid as well as the carboxyl-terminal group to make them reactive sites for coupling with primary amines. The activated antibody is mixed with the cell inhibitor to produce the final conjugate. If the cell inhibitor is activated first, the EDC method will couple the cell inhibitor through the N-terminal alpha amine and possibly through the amine in the side-chain of Lys, if present in the sequence.

m-Maleimidobenzoyl-N-hydroxysuccinimide ester (MBS) is a heterobifunctional reagent that can be used to link an antibody to cell inhibitors via cysteines. The coupling takes place with the thiol group of cysteine residues. If the chosen sequence does not contain Cys it is common to place a Cys residue at the N- or C-terminus to obtain highly controlled linking of the antibody to, the cell inhibitor. For synthesis purposes, it may be helpful for the cysteine to be placed at the N-terminus of the antibody. MBS is particularly suited for use with the present invention.

Glutaraldehyde can be used as a bifunctional coupling reagent that links two compounds through their amino groups. Glutaraldehyde provides a highly flexible spacer between the antibody and cell inhibitor for favorable presentation. Glutaraldehyde is a very reactive compound and will react with Cys, Tyr, and His to a limited extent. The glutaraldehyde coupling method is particularly useful when a polypeptide contains only a single free amino group at its amino terminus. If the antibody contains more than one free amino group, large multimeric complexes can be formed.

In one aspect, the antibodies of the invention can be fused (e.g., by in-frame cloning) or linked (e.g., by chemical coupling) to cell inhibitors such as antimicrobial agents. Included among these are antimicrobial peptides, for example, bactericidal/permeability-increasing protein, cationic antimicrobial proteins, lysozymes, lactoferrins, and cathelicidins (e.g., from neutrophils; see, e.g., Hancock and Chapple, 1999, Antimicrob. Agents Chemother. 43:1317-1323; Ganz and Lehrer, 1997, Curr. Opin. Hematol. 4:53-58; Hancock et al., 1995, Adv. Microb. Physiol. 37:135-175). Antimicrobial peptides further include defensins (e.g., from epithelial cells or neutrophils) and platelet microbiocidal proteins (see, e.g., Hancock and Chapple, 1999, Antimicrob. Agents Chemother. 43:1317-1323). Additional antimicrobial peptides include, but are not limited to, gramicidin S, bacitracin, polymyxin B, tachyplesin, bactenecin (e.g., cattle bactenecin), ranalexin, cecropin A, indolicidin (e.g., cattle indolicidin), and nisin (e.g., bacterial nisin).

Also included as antimicrobial agents are ionophores, which facilitate transmission of an ion, (such as sodium), across a lipid barrier such as a cell membrane. Two ionophore compounds particularly suited to this invention are the RUMENSIN™ (Eli Lilly) and Lasalocid (Hoffman LaRoche). Other ionophores include, but are not limited to, salinomycin, avoparcin, aridcin, and actaplanin. Other antimicrobial agents include Monensin™ and azithromycin, metronidazole, streptomycin, kanamycin, and penicillin, as well as, generally, β-lactams, aminoglycosides, macrolides, chloramphenicol, novobiocin, rifampin, and fluoroquinolones (see, e.g., Horn et al., 2003, Applied Environ. Microbiol. 69:74-83; Eckburg et al., 2003, Infection Immunity 71:591-596; Gijzen et al., 1991, Applied Environ. Microbiol. 57:1630-1634; Bonelo et al., 1984, FEMS Microbiol. Lett. 21:341-345; Huser et al., 1982, Arch. Microbiol. 132:1-9; Hilpert et al., 1981, Zentbl. Bakteriol. Mikrobiol. Hyg. 1 Abt Orig. C 2:21-31).

Particularly useful inhibitors are compounds that block or interfere with methanogenesis, including bromoethanesulphonic acid, e.g., 2-bromoethanesulphonic acid (BES) or a salt thereof, for example, a sodium salt. Sodium molybdate (Mo) is an inhibitor of sulfate reduction, and can be used with bromoethanesulphonic acid. Other anti-methanogenesis compounds include, but are not limited to, nitrate, formate, methyl fluoride, chloroform, chloral hydrate, sodium sulphite, ethylene and unsaturated hydrocarbons, acetylene, fatty acids such as linoleic and cis-oleic acid, saturated fatty acids such as behenic and stearic acid, and, also lumazine (e.g., 2,4-pteridinedione). Additional compounds include 3-bromopropanesulphonate (BPS), propynoic acid, and ethyl 2-butynoate.

Further included as antimicrobial agents are lytic enzymes, including phage lysozyme, endolysin, lysozyme, lysin, phage lysin, muralysin, muramidase, and virolysin. Useful enzymes exhibit the ability to hydrolyse specific bonds in the bacterial cell wall. Particular lytic enzymes include, but are not limited to, glucosaminidases, which hydrolyse the glycosidic bonds between the amino sugars (e.g., N-acetylmuramic acid and N-acetylglucosamine) of the peptidoglycan, amidases, which cleave the N-acetylmuramoyl-L-alanine amide linkage between the glycan strand and the cross-linking peptide, and endopeptidases, which hydrolyse the interpeptide linkage (e.g., cysteine endopeptidases) and endoisopeptidases that attack pseudomurein of methanogens from the family Methanobacteriaceae.

Additionally, PNAs are included as antimicrobial agents. PNAs are peptide-nucleic acid hybrids in which the phosphate backbone has been replaced by an achiral and neutral backbone made from N-(2-aminoethyl)-glycine units (see, e.g., Eurekah Bioscience Collection. PNA and Oligonucleotide Inhibitors of Human Telomerase. G. Gavory and S. Balasubramanian, Landes Bioscience, 2003). The bases A, G, T, C are attached to the amino nitrogen on the backbone via methylenecarbonyl linkages (P. E. Nielsen et al., Science 1991. 254: 1497-1500; M. Egholm et al., Nature 1993. 365: 566-568). PNAs bind complementary sequences with high specificity, and higher affinity relative to analogous DNA or RNA (M. Egholm et al., supra). PNA/DNA or PNA/RNA hybrids also exhibit higher thermal stability compared to the corresponding DNA/DNA or DNA/RNA duplexes (M. Egholm et al., supra). PNAs also possess high chemical and biological stability, due to the unnatural amide backbone that is not recognized by nucleases or proteases (V. Demidov et al., Biochem Pharmacol 1994. 48: 1310-1313). Typically, PNAs are at least 5 bases in length, and include a terminal lysine. PNAs may be pegylated to further extend their lifespan (Nielsen, P. E. et al. (1993) Anticancer Drug Des. 8:53-63).

In one particular aspect, the antibodies of the invention can be fused or linked to other antibodies or fragments thereof. The added antibodies or antibody fragments can be directed to microbial cells, or particularly methanogen cells, or one or more cell components. For example, cell surface proteins, e.g., extracellular receptors, can be targeted. In certain aspects, the antibodies or antibody fragments can be engineered with sequences that are specifically expressed in subjects, for example, human or ruminant sequences. Also included are chimeric antibodies, for example, monoclonal antibodies or fragments thereof that are specific to more than one source, e.g., one or more mouse, human, or ruminant sequences. Further included are camelid antibodies or nanobodies.

The antibodies of the invention find particular use in targeting a microbial cell, in particular, a methanogen cell. In certain aspects, the antibodies can be used to associate with or bind to the cell wall or membrane and/or inhibit growth or replication of the cell. As such, the antibodies can be used for transient or extended attachment to the cell, or to mediate sequestration or engulfment of the cell, and/or lysis. To effect targeting, the microbial cell can be contacted with an antibody as isolated from a host organism, or produced by expression vectors and/or host cells, or synthetic or semi-synthetic chemistry as described in detail herein. Alternately, the antibodies can be produced by the host organism itself in response to the administration or the peptides, polypeptides, or polynucleotides disclosed herein. It is understood that the antibodies of the invention, as well as the corresponding polynucleotides, expression vectors, host cells, peptides, and polypeptides, can be used to target various microbes, for example, *Methanobrevibacter ruminantium*, which is the primary methanogen in ruminants, and *Methanobrevibacter smithii*, which is the primary methanogen in humans. In particular aspects, the antibodies, or corresponding polynucleotides, expression vectors, host cells, peptides, or polypeptides, are delivered to subjects as a composition described in detail herein, for example, through use of a slow-release ruminal device.

In various aspects, the agents of the invention (e.g., one or more peptides, polypeptides, polynucleotides, and antibodies) can be included in a composition, for example, a pharmaceutical composition, and especially a vaccine composition. The composition comprises, for example: a) an isolated peptide or alteration, fragment, variant, or derivative thereof; b) an isolated polypeptide, or an alteration, fragment, variant, or derivative thereof; c) an isolated polynucleotide, or an alteration, fragment, variant, or derivative thereof; d) an expression vector comprising this polynucleotide; e) a host cell comprising this expression vector; or (f) an antibody, or an alteration, fragment, variant, or derivative thereof. The compositions of the invention can be specifically packaged as part of kits for targeting, and/or inhibiting microbial cells, especially methanogen cells, in accordance with the disclosed methods. The kits comprise at least one composition as set out herein and instructions for use in targeting cells or inhibiting cell growth or replication, for methanogens or other microbes.

For vaccines, a number of approaches can be used to increase antigen immunogenicity, for example, by use of antigen particles; antigen polymers and polymerization; emulsifying agents; microencapsulation of antigens; killed bacteria and bacterial products; chemical adjuvants and cytokines; and agents for targeting antigens to antigen presenting cells (reviewed in Paul, Fundamental Immunology, 1999, Lippincott-Raven Publishers, New York, N.Y., p. 1392-1405).

To render antigens particulate, alum precipitation can be used. With the use of aluminium hydroxide or aluminium phosphate, the antigen in question becomes incorporated into an insoluble, gel-like precipitate or else is bound to preformed gel by electrostatic interactions. Antigens can be subjected to mild heat aggregation. Antigens exhibiting self-assembly can also be used. Liposomes, virosomes, and immunostaining complexes (ISCOMs) are also useful for forming particulates.

To promote polymerization, nonionic block copolymers can be used as additives to adjuvants, e.g., polymers or polyoxypropylene and polyoxyethylene, with which antigen can be associated. These are found as components of complex adjuvant formulations by both Syntex (SAF-1, Syntex Adjuvant Formulation-1) and Ribi Chemical Co. Carbohydrate polymers of mannose (e.g., mannan) or of β1-3 glucose (e.g., glucan) can be used in similar fashion (Okawa Y, Howard C R, Steward M W. Production of anti-peptide antibody in mice following immunization of mice with peptides conjugated to mannan. J Immunol Methods 1992; 142:127-131; Ohta M, Kido N, Hasegawa T, et al. Contribution of the mannan side chains to the adjuvant action of lipopolysaccharides. Immunology 1987;60:503-507).

Various agents can be used for emulsification, including water-in-oil emulsions, such as Freund's adjuvants (e.g., Freund's incomplete adjuvant), or other mixtures comprising tiny droplets of water stabilized by a surfactant such as mannide monooleate in a continuous phase of mineral oil or other oils, such as squalane. An alternative approach is to use oil-in-water emulsions, such as MF5963 (Chiron), or other mixtures comprising oil droplets of squalene and a mixture of emulsifying agents TWEEN80 and SPAN85, and chemical immunomodulators such as derivatives or muramyl dipeptide, e.g., muramyl tripeptide-phosphatidyl ethanolamine (MTP-PE) (Valensi J-P M, Carlson J R, Van Nest G A. Systemic cytokine profiles in Balb/c mice immunized with trivalent influenza vaccine containing MF59 oil emulsion and other advanced adjuvants. J Immunol 1994;153: 4029-4039). Small amounts of polysorbate 80 and sorbitan trioleate can also be used in the mixtures. As another example, SAF-165 (Syntex) can be used, or other oil-in-water mixtures comprising Pluronic L121, squalene, and TWEEN80.

Microcapsules, in particular, biodegradable microcapsules, can be used to prepare controlled-release vaccines (Chang T M S. Biodegradable, semi-permeable microcapsules containing enzymes hormones, vaccines and other biologicals. J Bioeng 1976;1:25-32; Langer R. Polymers for the sustained release of macromolecules: their use in a single step method of immunization. Methods Enzymol 1981;73: 57-75). Cyanoacrylates are another form of biodegradable polymer. For example, poly(butyl-2-cyanoacrylate) can be used as an adjuvant for oral immunization (O'Hagan D T, Palin K J, Davis S S. Poly (butyl-2-cyanoacrylate) particles as adjuvants for oral immunization. Vaccine 1989;7:213-216). Microcapsules are useful for the mucosal administration of vaccines. Particles of very small size (nanoparticles) are particularly suitable. Digestion in the stomach can be countered by enteric coated polymers, and coating with substances that increase intestinal absorption, as needed.

Various bacteria, other than killed *M. tuberculosis*, can be used as adjuvants. Where the killed bacterial preparation is itself highly antigenic, the adjuvant properties extend to the co-administered antigen. Useful organisms include *Bordetella pertussis*, *Corynebacterium parvum*, and *Nippostrongylus brasiliensis*. Peptide and lipid components of bacteria can also be used. Exemplary components include acetylmuramyl-L-alanyl-D-isoglutamine, or muramyl dipeptide (MDP) (Ellouz F, Adam A, Ciorbaru R, Lederer E. Minimal structural requirements for adjuvant activity of bacterial peptidoglycans. Biochem Biophys Res Commun 1974;59:1317-1325), MDP (murabutide) (Chedid L, Parant M A, Audibert F M, et al. Biological activity of a new synthetic muramyl dipeptide devoid of pyrogenicity. Infect Immun 1982;35:417-424), threonyl MDP (Allison A C, Byars N E. An adjuvant formulation that selectively elicits the formation of antibodies of protective isotypes and cell-mediated immunity. J Immunol Methods 1986;95:157-168), and MTP-PE. Lipid adjuvants can comprise LPS endotoxins of gram-negative bacteria, such as *Escherichia, Salmonella*, and *Pseudomonas*. In certain approaches, the lipid A structure can be chemically modified to lower toxicity but retain adjuvanticity, e.g., as for monophosphoryl lipid A (MPL) (Johnson A G, Tomai M, Solem L, Beck L, Ribi E. Characterization of non-toxic monophosphoryl lipid. Rev Infect Dis 1987;9:S512).

Various chemicals can be used as adjuvants, including polynucleotides, such as poly-I:C and poly-A:U, vitamin D3, dextran sulphate, inulin, dimethyl dioctadecyl ammonium bromide (DDA), pyridine, carbohydrate polymers similar to mannan, and trehalose dimycolate (Morein B, Lövgren-Bengtsson K, Cox J. Modern adjuvants: functional aspects. In: Kaufmann S H E, ed. Concepts in vaccine development. Berlin: Walter de Gruyter, 1996:243-263). Also included are polyphosphazines (initially introduced as slow release-promoting agents) and a *Leishmania* protein, LeIF. Cytokines can also be used as adjuvants, for example, IL-2, IL-4, IL-6, IL-10, GM-CSF, and IFN-g.

For targeting antigen presenting cells, C3d domains, Fc domains, and CTB domains can be used (Dempsey P W, Allison M E D, Akkaraju S, Goodnow C C, Fearon D T. C3d of complement as a molecular adjuvant: bridging innate and acquired immunity. Science 1996; 271:348-350; Sun J-B, Holmgren J, Czerkinsky C. Cholera toxin B subunit: an efficient transmucosal carrier-delivery system for induction of peripheral immunological tolerance. Proc Natl Acad Sci USA 1994;91:10795-10799; Sun J-B, Rask C, Olsson T, Holmgren J, Czerkinsky C. Treatment of experimental autoimmune encephalomyelitis by feeding myelin basic protein conjugated to cholera toxin B subunit. Proc Natl Acad Sci USA 1996;93:7196-7201).

Specific adjuvants for mucosal delivery, e.g., CT, LT, and Fragment C of tetanus toxin, can also be used (Elson C J, Ealding W. Generalized systemic and mucosal immunity in mice after mucosal stimulation with cholera toxin. J Immunol 1984;132:2736-2743; Holmgren J, Lycke N, Czerkinsky C. Cholera toxin and cholera B subunit as oral-mucosal adjuvant and antigen vector systems. Vaccine 1993;11:1179-1184; Clements J D, Hartzog N M, Lyon F L. Adjuvant activity of *Escherichia coli* heat-labile enterotoxin and effect on the induction of oral tolerance in mice to unrelated protein antigens. Vaccine 1988;6:269-277; Gomez-Duarte O G, Galen J, Chatfield S N, Rappuoli R, Eidels L, Levine M M. Expression of fragment C of tetanus toxin fused to a carboxyl-terminal fragment of diphtheria toxin in *Salmonella typhi* CVD 908 vaccine strain. Vaccine 1995;13:1596-1602).

Therapeutics and Diagnostics

The peptides, polypeptides, polynucleotides, and antibodies of the present invention are considered to have health benefits. In particular aspects, vaccines that target methanogens can be used to restore energy to the subject that is normally lost as methane. The invention therefore relates to a pharmaceutical composition (especially a vaccine composition) in conjunction with a pharmaceutically acceptable carrier, for use with any of the methods discussed above. Such pharmaceutical compositions may comprise a peptide, polypeptide, or antibody in combination with a cell inhibitor. Alternatively, the pharmaceutical compositions may comprise a polynucleotide, expression vector, or host cell as described in detail herein. The compositions may be administered alone or in combination with at least one other agent, such as stabilizing compound, which may be administered in any sterile, biocompatible pharmaceutical carrier, including, but not limited to, saline, buffered saline, dextrose, and water. The compositions may be administered to a subject alone, or in combination with other agents, drugs (e.g., antimicrobial drugs), or hormones.

In addition to the active ingredients, these pharmaceutical compositions may contain suitable pharmaceutically acceptable carriers comprising excipients and auxiliaries which facilitate processing of the active compounds into preparations which can be used pharmaceutically. Further details on techniques for formulation and administration may be found in the latest edition of Remington's Pharmaceutical Sciences (Maack Publishing Co., Easton, Pa.). The pharmaceutical compositions utilized in this invention may be administered by any number of routes including, but not limited to, oral, intravenous, intramuscular, intra-arterial, intramedullary, intrathecal, intraventricular, transdermal, subcutaneous, intraperitoneal, intranasal, enteral, topical, sublingual, or rectal means.

Pharmaceutical compositions for oral administration can be formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions, and the like, for ingestion by the subject. Pharmaceutical preparations for oral use can be obtained through combination of active compounds with solid excipient, optionally grinding a resulting mixture, and processing the mixture of granules, after adding suitable auxiliaries, if desired, to obtain tablets or dragee cores. Suitable excipients are carbohydrate or protein fillers, such as sugars, including lactose, sucrose, mannitol, or sorbitol; starch from corn, wheat, rice, potato, or other plants; cellulose, such as methyl cellulose, hydroxypropylmethyl-cellulose, or sodium carboxymethylcellulose; gums including arabic and tragacanth; and proteins such as gelatin and collagen. If desired, disintegrating or solubilising agents may be added, such as the crosslinked polyvinyl pyrrolidone, agar, alginic acid, or a salt thereof, such as sodium alginate.

Pharmaceutical preparations which can be used orally include push-fit capsules made of gelatin, as well as soft, sealed capsules made of gelatin and a coating, such as glycerol or sorbitol. Push-fit capsules can contain active ingredients mixed with a filler or binders, such as lactose or starches, lubricants, such as talc or magnesium stearate, and, optionally, stabilizers. In soft capsules, the active compounds may be dissolved or suspended in suitable liquids, such as fatty oils, liquid, or liquid polyethylene glycol with or without stabilizers. Dragee cores may be used in conjunction with suitable coatings, such as concentrated sugar solutions, which may also contain gum arabic, talc, polyvinylpyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound, i.e., dosage.

Pharmaceutical formulations suitable for parenteral administration may be formulated in aqueous solutions, preferably in physiologically compatible buffers such as Hanks' solution, Ringer's solution, or physiologically buffered saline. Aqueous injection suspensions may contain substances which increase the viscosity of the suspension, such as sodium carboxymethyl cellulose, sorbitol, or dextran. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Non-lipid polycationic amino polymers may also be used for delivery. Optionally, the suspension may also contain suitable stabilizers or agents which increase the solubility of the compounds to allow for the preparation of highly concentrated solutions. For topical or nasal administration, penetrants appropriate to the particular barrier to be permeated are used in the formulation. Such penetrants are generally known in the art.

The pharmaceutical compositions of the present invention may be manufactured in a manner that is known in the art, e.g., by means of conventional mixing, dissolving, granulating, dragee-making, levigating, emulsifying, encapsulating, entrapping, or lyophilizing processes. The pharmaceutical composition may be provided as a salt and can be formed with many acids, including but not limited to, hydrochloric, sulfuric, acetic, lactic, tartaric, malic, succinic, etc. Salts tend to be more soluble in aqueous or other protonic solvents than are the corresponding free base forms. In other cases, the preferred preparation may be a lyophilized powder which may contain any or all of the following: 1-50 mM histidine, 0.1%-2% sucrose, and 2-7% mannitol, at a pH range of 4.5 to 5.5, that is combined with buffer prior to use. After pharmaceutical compositions have been prepared, they can be placed in an appropriate container and labeled for treatment of an indicated condition. For administration of a composition of the invention, such labeling would include amount, frequency, and method of administration.

Pharmaceutical compositions suitable for use in the invention include compositions wherein the active ingredients are contained in an effective amount to achieve the intended purpose. For any compound, the therapeutically effective dose can be estimated initially either in cell assays, e.g., in microbial cells, or in particular, in methanogen cells, or in animal models, usually mice, rabbits, dogs, or pigs, or in ruminant species such as sheep, cattle, deer, and goats. The animal model may also be used to determine the appropriate concentration range and route of administration. Such information can then be used to determine useful doses and routes for administration. Normal dosage amounts may vary from 0.1 to 100,000 micrograms, up to a total dose of about 1 g, depending upon the route of administration. Guidance as to particular dosages and methods of delivery is provided in the literature and generally available to practitioners in the art. Those skilled in the art will employ different formulations for polynucleotides than for polypeptides. Similarly, delivery of peptides, or polypeptides, polynucleotides, or antibodies will be specific to particular cells, conditions, locations, etc.

The exact dosage will be determined by the practitioner, in light of factors related to the subject that requires treatment. Dosage and administration are adjusted to provide sufficient levels of the active agent or to maintain the desired effect. Factors which may be taken into account include the severity of the disease state, general health of the subject, age, weight, and gender, diet, time, and frequency of administration, drug combination(s), reaction sensitivities, and tolerance/response to therapy. Long-acting pharmaceutical compositions may be administered every 3 to 4 days, every week, or once every two weeks depending on half-life and clearance rate of the particular formulation. The compositions can be co-administered with one or more additional anti-microbial agents, including anti-methanogenesis compounds (e.g., bromoethanesulphonic acid), antibodies and antibody fragments, lytic enzymes, peptide nucleic acids, antimicrobial peptides, and other antibiotics as described in detail herein. Co-administration can be simultaneous or sequential, or can alternate with repeated administration.

Particularly useful for the compositions of the invention (e.g., pharmaceutical compositions) are slow release formulas or mechanisms. For example, intra-ruminal devices include, but are not limited to, Time Capsule™ Bolus range by Agri-Feeds Ltd., New Zealand, originally developed within AgResearch Ltd., New Zealand, as disclosed in WO 95/19763 and NZ 278977, and CAPTEC by Nufarm Health & Sciences, a division of Nufarm Ltd., Auckland, New Zealand, as disclosed in AU 35908178, PCT/AU81/100082, and Laby et al., 1984, *Can. J. Anim. Sci.* 64 (Suppl.), 337-8, all of which are incorporated by reference herein. As a particular example, the device can include a spring and plunger which force the composition against a hole in the end of a barrel.

As a further embodiment, the invention relates to a composition for a water supplement, e.g., drenching composition, or food supplement, e.g., ruminant feed component, for use with any of the methods discussed above. In particular aspects, the food supplement comprises at least one vegetable material that is edible, and a peptide or polypeptide of the invention. Alternatively, the food supplement comprises at least one vegetable material that is edible, and a polypeptide or peptide, or a polynucleotide encoding a peptide or polypeptide disclosed herein, for example, as an expression vector or host cell comprising the expression vector. In particular, the composition further includes a cell inhibitor, as fused or linked to the resultant sequence. The preferred vegetable material include any one of hay, grass, grain, or meal, for example, legume hay, grass hay, corn silage, grass silage, legume silage, corn grain, oats, barley, distillers grain, brewers grain, soy bean meal, and cotton seed meal. In particular, grass silage is useful as a food composition for ruminants. The plant material can be genetically modified to contain one or more components of the invention, e.g., one or more polypeptides or peptides, polynucleotides, or vectors.

In another embodiment, antibodies which specifically bind the peptides, polypeptides, or polynucleotides of the invention may be used to determine the presence of microbes, especially methanogens, or in assays to monitor levels of such microbes. The antibodies useful for diagnostic purposes may be prepared in the same manner as those described above. Diagnostic assays include methods which utilize the antibody and a label to detect a peptide or polypeptide in human body fluids or extracts of cells or tissues. The antibodies may be used with or without modification, and may be labeled by joining them, either covalently or non-covalently, with a reporter molecule. A wide variety of reporter molecules which are known in the art may be used, several of which are described above.

A variety of protocols for measuring levels of a peptide, polypeptide, or polynucleotide are known in the art (e.g., ELISA, RIA, and FACS), and provide a basis for diagnosing the presence or levels of a microbe, especially a methanogen. Normal or standard levels established by combining body fluids or cell extracts taken from normal subjects, e.g., normal humans or ruminants, with the antibody under conditions suitable for complex formation. The amount of standard complex formation may be quantified by various methods, but preferably by photometric means. Quantities of peptide, polypeptide, or polynucleotide expressed in subject, control, and treated samples (e.g., samples from vaccinated subjects) are compared with the standard values. Deviation between standard and subject values establishes the parameters for determining the presence or levels of the microbe.

In another embodiment of the invention, the polynucleotides may be used for diagnostic purposes using particular hybridization and/or amplification techniques. The polynucleotides which may be used include oligonucleotides, complementary RNA and DNA molecules, and PNAs. The polynucleotides may be used to detect and quantitate gene expression in samples in which expression may be correlated with the presence or levels of a microbe. The diagnostic assay may be used to distinguish between the absence, presence, and alteration of microbe levels, and to monitor levels during therapeutic intervention.

In one aspect, hybridization with PCR probes may be used to identify nucleic acid sequences, especially genomic sequences, which encode the peptides or polypeptides of the invention. The specificity of the probe, whether it is made from a highly specific region, e.g., 10 unique nucleotides in the 5' regulatory region, or a less specific region, e.g., in the 3' coding region, and the stringency of the hybridization or amplification (maximal, high, intermediate, or low) will determine whether the probe identifies only naturally occurring sequences, alleles, or related sequences. Probes may also be used for the detection of related sequences, and should preferably contain at least 50% of the nucleotides from any of the coding sequences. The hybridization probes of the subject invention may be DNA or RNA and derived from the nucleotide sequence of SEQ ID NO: 1-1718, or complements, or modified sequences thereof, or from genomic sequences including promoter and enhancer elements of the naturally occurring sequence.

Means for producing specific hybridization probes for DNAs include the cloning of polynucleotides into vectors for the production of mRNA probes. Such vectors are known in the art, commercially available, and may be used to synthesize RNA probes in vitro by means of the addition of the appropriate RNA polymerases and the appropriate labeled nucleotides. Hybridization probes may be labeled by a variety of reporter groups, for example, radionuclides such as $^{32}P$ or $^{35}S$, or enzymatic labels, such as alkaline phosphatase coupled to the probe via avidin/biotin coupling systems, and the like. The polynucleotides may be used in Southern or northern analysis, dot blot, or other membrane-based technologies; in PCR technologies; or in dipstick, pin, ELISA assays, or microarrays utilizing fluids or tissues from subject biopsies to detect the presence or levels of a microbe. Such qualitative or quantitative methods are well known in the art.

In a particular aspect, the polynucleotides may be useful in various assays labelled by standard methods, and added to a fluid or tissue sample from a subject under conditions suitable for hybridization and/or amplification. After a suitable incubation period, the sample is washed and the signal is quantitated and compared with a standard value. If the amount of signal in the test sample is significantly altered from that of a comparable control sample, the presence of altered levels of nucleotide sequences in the sample indicates the presence or levels of the microbe. Such assays may also be used to evaluate the efficacy of a particular vaccination regimen in animal studies, in clinical trials, or in monitoring the treatment of a subject.

In order to provide a basis for the diagnosis of the presence or levels of a microbe, a normal or standard profile for expression is established. This may be accomplished by combining body fluids or cell extracts taken from normal subjects, with a polynucleotide or a fragment thereof, under conditions suitable for hybridization and/or amplification. Standard levels may be quantified by comparing the values obtained from normal subjects with those from an experiment where a known amount of a substantially purified polynucleotide is used. Standard values obtained from normal samples may be compared with values obtained from samples from subjects treated for microbial growth. Deviation between standard and subject values is used to establish the presence or levels of the microbe.

Once the microbe is identified and a vaccination protocol is initiated, hybridization and/or amplification assays may be repeated on a regular basis to evaluate whether the level of expression in the subject begins to decrease relative to that which is observed in the normal subject. The results obtained from successive assays may be used to show the efficacy of vaccination over a period ranging from several days to months.

Particular diagnostic uses for oligonucleotides designed from the polynucleotides may involve the use of PCR. Such oligomers may be chemically synthesized, generated enzymatically, or produced in vitro. Oligomers will preferably consist of two nucleotide sequences, one with sense orientation (5'.fwdarw.3') and another with antisense orientation (3'.fwdarw.5'), employed under optimized conditions for identification of a specific gene or condition. The same two oligomers, nested sets of oligomers, or even a degenerate pool of oligomers may be employed under less stringent conditions for detection and/or quantitation of closely related DNA or RNA sequences.

Methods which may also be used to quantitate expression include radiolabeling or biotinylating nucleotides, coamplification of a control nucleic acid, and standard curves onto which the experimental results are interpolated (Melby, P. C. et al. (1993) J. Immunol. Methods, 159:235-244; Duplaa, C. et al. (1993) Anal. Biochem. 229-236). The speed of quantitation of multiple samples may be accelerated by running the assay in an ELISA format where the oligomer of interest is presented in various dilutions and a spectrophotometric or colorimetric response gives rapid quantitation.

In further embodiments, oligonucleotides or longer fragments derived from any of the polynucleotides described herein may be used as targets in a microarray. The microarray can be used to monitor the expression level of large numbers of genes simultaneously (to produce a transcript image), and to identify genetic variants, mutations and polymorphisms. This information may be used to determine gene function, to understand the genetic basis of disease, to diagnose disease, and to develop and monitor the activities of therapeutic agents. In one embodiment, the microarray is prepared and used according to methods known in the art such as those described in PCT application WO 95/11995 (Chee et al.), Lockhart, D. J. et al. (1996; Nat. Biotech. 14: 1675-1680) and Schena, M. et al. (1996; Proc. Natl. Acad. Sci: 93: 10614-10619).

In one aspect, the oligonucleotides may be synthesized on the surface of the microarray using a chemical coupling procedure and an ink jet application apparatus, such as that described in PCT application WO 95/251116 (Baldeschweiler et al.). In another aspect, a "gridded" array analogous to a dot or slot blot (HYBRIDOT apparatus, Life Technologies) may be used to arrange and link cDNA fragments or oligonucleotides to the surface of a substrate using a vacuum system, thermal, UV, mechanical or chemical bonding procedures. In yet another aspect, an array may be produced by hand or by using available devices, materials, and machines (including multichannel pipettors or robotic instruments; Brinkmann, Westbury, N.Y.) and may include, for example, 24, 48, 96, 384, 1024, 1536, or 6144 spots or wells (e.g., as a multiwell plate), or more, or any other multiple from 2 to 1,000,000 which lends itself to the efficient use of commercially available instrumentation.

In order to conduct sample analysis using the microarrays, polynucleotides are extracted from a biological sample. The biological samples may be obtained from any bodily fluid (blood, urine, saliva, phlegm, gastric juices, etc.), cultured cells, biopsies, or other tissue preparations. To produce probes, the polynucleotides extracted from the sample are used to produce polynucleotides which are complementary to the nucleic acids on the microarray. If the microarray consists of cDNAs, antisense RNAs are appropriate probes. Therefore, in one aspect, mRNA is used to produce cDNA which, in turn and in the presence of fluorescent nucleotides, is used to produce fragments or antisense RNA probes. These fluorescently labeled probes are incubated with the microarray so that the probe sequences hybridize to the cDNA oligonucleotides of the microarray. In another aspect, polynucleotides used as probes can include polynucleotides, fragments, and complementary or antisense sequences produced using restriction enzymes, PCR technologies, and oligolabeling kits (Amersham Pharmacia Biotech) well known in the area of hybridization technology.

In another embodiment of the invention, the peptides or polypeptides of the invention or functional or immunogenic fragments or oligopeptides thereof, can be used for screening libraries of compounds in any of a variety of drug screening techniques. The fragment employed in such screening may be free in solution, affixed to a solid support, borne on a cell surface, or located intracellularly. The formation of binding complexes, between the peptide or polypeptide and the agent being tested, may be measured.

One technique for drug screening which may be used provides for high throughput screening of compounds having suitable binding affinity to the peptide or polypeptide of interest as described in published PCT application WO 84/03564. In this method, large numbers of different small test compounds are synthesized on a solid substrate, such as plastic pins or some other surface. The test compounds are reacted with the peptide or polypeptide, or fragments thereof, and washed. Bound peptide or polypeptide is then detected by methods well known in the art. Purified peptide or polypeptide can also be coated directly onto plates for use in the aforementioned drug screening techniques. Alternatively, non-neutralizing antibodies can be used to capture the peptide and immobilize it on a solid support.

In another technique, one may use competitive drug screening assays in which neutralizing antibodies capable of binding the peptide or polypeptide specifically compete with a test compound for binding to the peptide or polypeptide. In this manner, the antibodies can be used to detect the presence of a test compound which shares one or more antigen binding sites with the antibody.

Plant Constructs and Plant Transformants

Of particular interest is the use of the polynucleotides of this invention for plant transformation or transfection. Exogenous genetic material may be transferred into a plant cell and the plant cell regenerated into a whole, fertile, or sterile plant. Exogenous genetic material is any genetic material, whether naturally occurring or otherwise, from any source that is capable of being inserted into any organism. Such genetic material may be transferred into either monocotyledons or dicotyledons including but not limited to the plants used for animal feed, e.g., feed for sheep, cows, etc.

A variety of methods can be used to generate stable transgenic plants. These include particle gun bombardment (Fromm et al., Bio/Technology 8:833-839 (1990)), electroporation of protoplasts (Rhodes et al., Science 240:204-207 (1989); Shimamoto et al., Nature 338:274-276 (1989)), treatment of protoplasts with polyethylene glycol (Datta et al., Bio/Technology, 8:736-740 (1990)), microinjection (Neuhaus et al., Theoretical and Applied Genetics, 75:30-36 (1987)), immersion of seeds in a DNA solution (Ledoux et al., Nature, 249:17-21 (1974)), and transformation with T-DNA of *Agrobacterium* (Valvekens et al., PNAS, 85:5536-5540 (1988); Komari, Plant Science, 60:223-229 (1989)). In most, perhaps all plant species, *Agrobacterium*-mediated transformation is the most efficient and easiest of these methods to use. T-DNA transfer generally produces the greatest number of transformed plants with the fewest multi-copy insertions, rearrangements, and other undesirable events.

Many different methods for generating transgenic plants using *Agrobacterium* have been described. In general, these methods rely on a "disarmed" *Agrobacterium* strain that is incapable of inducing tumours, and a binary plasmid transfer system. The disarmed strain has the oncogenic genes of the T-DNA deleted. A Binary plasmid transfer system consists of one plasmid with the 23-base pair T-DNA left and right border sequences, between which a gene for a selectable marker (e.g. an herbicide resistance gene) and other desired genetic elements are cloned. Another plasmid encodes the *Agrobacterium* genes necessary for effecting the transfer of the DNA between the border sequences in the first plasmid. Plant tissue is exposed to *Agrobacterium* carrying the two plasmids, the DNA between the left and right border repeats is transferred into the plant cells, transformed cells are identified using the selectable marker, and whole plants are regenerated from the transformed tissue. Plant tissue types that have been reported to be transformed using variations of this method include: cultured protoplasts (Komari, Plant Science, 60:223-229 (1989)), leaf disks (Lloyd et al., Science 234:464-466 (1986)), shoot apices (Gould et al., Plant Physiology, 95:426-434 (1991)), root segments (Valvekens et al., PNAS, 85:5536-5540 (1988)), tuber disks (Jin et al., Journal of Bacteriology, 169: 4417-4425 (1987)), and embryos (Gordon-Kamm et al., Plant Cell, 2:603-618 (1990)).

In the case of *Arabidopsis thaliana* it is possible to perform in plant germline transformation (Katavic et al., Molecular and General Genetics, 245:363-370 (1994); Clough et al., Plant Journal, 16:735-743 (1998)). In the simplest of these methods, flowering *Arabidopsis* plants are dipped into a culture of *Agrobacterium* such as that described in the previous paragraph. Among the seeds produced from these plants, 1% or more have integration of T-DNA into the genome.

Monocot plants have generally been more difficult to transform with *Agrobacterium* than dicot plants. However, "supervirulent" strains of *Agrobacterium* with increased expression of the virB and virG genes have been reported to transform monocot plants with increased efficiency (Komari et al., Journal of Bacteriology, 166:88-94 (1986); Jin et al., Journal of Bacteriology, 169:417-425 (1987)

Most T-DNA insertion events are due to illegitimate recombination events and are targeted to random sites in the genome. However, given sufficient homology between the transferred DNA and genomic sequence, it has been reported that integration of T-DNA by homologous recombination may be obtained at a very low frequency. Even with long stretches of DNA homology, the frequency of integration by homologous recombination relative to integration by illegitimate recombination is roughly 1:1000 (Miao et al., Plant Journal, 7:359-365 (1995); Kempin et al., 389:802-803 (1997)).

Exogenous genetic material may be transferred into a plant cell by the use of a DNA vector or construct designed for such a purpose. Vectors have been engineered for transformation of large DNA inserts into plant genomes. Binary bacterial artificial chromosomes have been designed to replicate in both *E. coli* and *Agrobacterium* and have all of the features required for transferring large inserts of DNA into plant chromosomes. BAC vectors, e.g. a pBACwich, have been developed to achieve site-directed integration of DNA into a genome.

A construct or vector may also include a plant promoter to express the gene or gene fragment of choice. A number of promoters that are active in plant cells have been described in the literature. These include the nopaline synthase (NOS) promoter, the octopine synthase (OCS) promoter, a caulimovirus promoter such as the CaMV 19S promoter and the CaMV 35S promoter, the figwort mosaic virus 35S promoter, the light-inducible promoter from the small subunit of ribulose-1,5-bis-phosphate carboxylase (ssRUBISCO), the Adh promoter, the sucrose synthase promoter, the R gene complex promoter, and the chlorophyll a/b binding protein gene promoter.

For the purpose of expression in source tissues of the plant, such as the leaf; seed, root, or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea, the chloroplast fructose-1,6-biphosphatase (FBPase) promoter from wheat, the nuclear photosynthetic ST-LS1 promoter from potato, the phenylalanine ammonia-lyase (PAL) promoter and the chalcone synthase (CHS) promoter from *Arabidopsis thaliana*.

Also reported to be active in photosynthetically active tissues are the ribulose-1,5-bisphosphate carboxylase (RbcS) promoter from eastern larch (*Larix laricina*), the promoter for the cab gene, cab6, from pine, the promoter for the Cab-1 gene from wheat, the promoter for the CAB-1 gene from spinach, the promoter for the cab1R gene from rice, the pyruvate, orthophosphate dikinase (PPDK) promoter from *Zea mays*, the promoter for the tobacco Lhcb1*2 gene, the *Arabidopsis thaliana* SUC2 sucrose-$^{H+}$ symporter promoter, and the promoter for the thylacoid membrane proteins from spinach (psaD, psaF, psaE, PC, FNR, atpC, atpD, cab, rbcS). Other promoters for the chlorophyll a/b-binding proteins may also be utilized in the present invention, such as the promoters for LhcB gene and PsbP gene from white mustard (*Sinapis alba*). Additional promoters that may be utilized are described, for example, in U.S. Pat. Nos. 5,378,619; 5,391,725; 5,428,147; 5,447,858; 5,608,144; 5,608,144; 5,614,399; 5,633,441; 5,633,435 and 4,633,436, all of which are herein incorporated in their entirety.

Constructs or vectors may also include, with the coding region of interest, a nucleic acid sequence that acts, in whole or in part, to terminate transcription of that region. For example, such sequences have been isolated including the Tr7 3' sequence and the nos 3' sequence or the like. It is understood that one or more sequences of the present invention that act to terminate transcription may be used.

A vector or construct may also include other regulatory elements or selectable markers. Selectable markers may also be used to select for plants or plant cells that contain the exogenous genetic material. Examples of such include, but are not limited to, a neo gene which codes for kanamycin resistance and can be selected for using kanamycin, G418, etc.; a bar gene which codes for bialaphos resistance; a mutant EPSP synthase gene which encodes glyphosate resistance; a nitrilase gene which confers resistance to bromoxynil, a mutant acetolactate synthase gene (ALS) which confers imidazolinone or sulphonylurea resistance; and a methotrexate resistant DHFR gene.

A vector or construct may also include a screenable marker to monitor expression. Exemplary screenable markers include a .beta.-glucuronidase or uidA gene (GUS), an R-locus gene, which encodes a product that regulates the production of anthocyanin pigments (red colour) in plant tissues; a beta-lactamase gene, a gene which encodes an enzyme for which various chromogenic substrates are known (e.g., PADAC, a chromogenic cephalosporin); a luciferase gene, a xylE gene which encodes a catechol dioxygenase that can convert chromogenic catechols; an alpha-amylase gene, a tyrosinase gene which encodes an enzyme capable of oxidizing tyrosine to DOPA and dopaquinone which in turn condenses to melanin; an alpha-galactosidase, which will turn a chromogenic alpha-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins detectable, e.g., by ELISA, small active enzymes detectable in extracellular solution (e.g., alpha-amylase, beta-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

Thus, any of the polynucleotides of the present invention may be introduced into a plant cell in a permanent or transient manner in combination with other genetic elements such as vectors, promoters enhancers etc. Further any of the polynucleotides encoding a protein or fragment thereof or homologs of the present invention may be introduced into a plant cell in a manner that allows for expression (e.g., overexpression) of the protein or fragment thereof encoded by the polynucleotide.

Computer Related Uses

In one embodiment, a nucleotide or amino acid sequence of the present invention can be recorded on computer readable media. This takes into account any medium which can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a sequence of the present invention.

A skilled artisan can readily adopt any of the presently know methods for recording information on computer readable medium to generate manufactures comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium.

As non limiting examples, the sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing the sequence of any SEQ ID NO: herein, or a representative fragment thereof, or any variant thereof, in computer readable form, a skilled artisan can routinely access the sequence information for a variety of purposes. Computer software is publicly available which allows a skilled artisan to access sequence information provided in a computer readable medium. For example, software can be used to implement the BLAST (Altschul et al., J. Mol. Biol. 215:403-410 (1990)) and BLAZE (Brutlag et al., Comp. Chem. 17:203-207 (1993)) search algorithms, e.g., on a Sybase system to identify, open reading frames (ORFs) which contain homology to ORFs or proteins from other organisms. Such ORFs may be protein encoding sequences which are useful in producing commercially important proteins such as enzymes.

The present invention further provides systems, particularly computer-based systems, which contain the sequence information described herein. Such systems are designed to identify commercially important sequences of the M. ruminantium genome. This includes the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As stated above, the computer-based systems of the present invention comprise a data storage means having stored therein a nucleotide sequence of the present invention and the necessary hardware means and software means for supporting and implementing a search means. This refers to memory which can store nucleotide sequence information of the present invention, or a memory access means which can access manufactures having recorded thereon the nucleotide sequence information of the present invention. Searching can include one or more programs which are implemented on the computer-based system to compare a target sequence or target structural motif with the sequence information stored within the data storage means.

Search means are used to identify fragments or regions of the M. ruminantium genome which match a particular target sequence or target motif, e.g., antibody targets. A variety of known algorithms are disclosed publicly and a variety of commercially available software for conducting search means are and can be used in the computer-based systems of the present invention. Examples of such software include, but are not limited to, MacPattern (EMBL), BLASTN and BLASTX (NCBIA). A skilled artisan can readily recognize that any one of the available algorithms or implementing software packages for conducting homology searches can be adapted for use in the present computer-based systems.

The target sequence can be any DNA or amino acid sequence of six or more nucleotides or two or more amino acids. A skilled artisan can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that searches for commercially important fragments of the *M. ruminantium* genome, such as sequence fragments involved in gene expression and protein processing, may be of shorter length.

A target structural motif, or target motif includes any rationally selected sequence or combination of sequences in which the sequence(s) are chosen based on a three-dimensional configuration which is formed upon the folding of the target motif. There are a variety of target motifs known in the art. Protein target motifs include, but are not limited to, enzyme active sites and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *M. ruminantium* genome possessing varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments of the *M. ruminantium* genome. In particular aspects, software can be used implement the BLAST and BLAZE algorithms (Altschul et al., J. Mol. Biol. 215:403-410. (1990)) and to identify open reading frames. A skilled artisan can readily recognize that any one of the publicly available homology search programs can be used as the search means for the computer-based systems of the present invention The computer system may include a processor connected to a bus. Also connected to the bus may be a main memory (preferably implemented as random access memory, RAM) and a variety of secondary storage devices, such as a hard drive and a removable medium storage device. The removable medium storage device may represent, for example, a floppy disk drive, a CD-ROM drive, a magnetic tape drive, etc. A removable storage medium (such as a floppy disk, a compact disk, a magnetic tape, etc.) containing control logic and/or data recorded therein may be inserted into the removable medium storage device. The computer system may include appropriate software for reading the control logic and/or the data from the removable medium storage device once inserted in the removable medium storage device.

A sequence of the present invention may be stored in a well known manner in the main memory, any of the secondary storage devices, and/or a removable storage medium. Software for accessing and processing the genomic sequence (such as search tools, comparing tools, etc.) reside in main memory during execution.

EXAMPLES

The examples described herein are for purposes of illustrating embodiments of the invention. Other embodiments, methods, and types of analyses are within the scope of persons of ordinary skill in the molecular diagnostic arts and need not be described in detail hereon. Other embodiments within the scope of the art are considered to be part of this invention.

Example 1

Materials and Methods

Strain Information and Growth Conditions

*Methanobrevibacter ruminantium* $M1^T$ (DSM1093) was obtained from the German Collection of Microorganisms and Cell Cultures (DSMZ), Braunschweig, Germany. The original description of *Methanobacterium ruminantium* was made by Smith and Hungate (Smith & Hungate, 1958) and the genus designation later changed to *Methanobrevibacter* (Balch et al., 1979). *Methanobrevibacter ruminantium* $M1^T$ (DSM1093) was isolated from bovine rumen contents by Bryant (Bryant, 1965). It is designated the neotype strain for this species because the original strain of Smith and Hungate was not maintained. *M. ruminantium* strain $M1^T$ was routinely grown in basal medium (Joblin et al., 1990) with added trace elements (Balch et al., 1979), ($BY^+$ medium), with $H_2$ plus $CO_2$ (4:1) at 180 kPa overpressure. The culture tubes were incubated on their sides, at 39° C. in the dark, on a platform shaken at 200 rpm.

Co-Culture of *M. ruminantium* and *Butyrivibrio proteoclasticus*

M1 was grown in co-culture with Butyrivibrio proteoclasticus $B316^T$ (DSM14932) to examine gene expression under rumen-like conditions. Eighteen pure cultures of M1 were grown in $BY^+$ medium with $H_2$ plus $CO_2$ (4:1) at 180 kPa overpressure in 100 ml volumes in 125 ml serum bottles sealed with blue butyl septum stoppers and aluminium seals (Bellco Glass, Vineland, N.J., USA). When the cultures reached mid-exponential phase, as measured by optical density at 600 nm (Ultrospec 1100 pro UV/Vis spectrophotometer, Amersham Biosciences, Little Chalfont, Buckinghamshire, UK) they were flushed with $O_2$-free 100% $CO_2$ gas until $H_2$ was not detectible by gas chromatography. All 18 cultures were supplemented with oat spelt xylan (Sigma-Aldrich, St. Louis, Mo., USA) to 0.2% (w/v) final concentration, then nine of the cultures were inoculated with 0.5 ml of a late-exponential phase culture of *B. proteoclasticus*. The other nine were re-pressurized to $H_2$ plus $CO_2$ (4:1) at 180 kPa overpressure. Three further serum bottles of $BY^+$ medium supplemented with 0.2% (w/v) xylan were also inoculated with an equivalent inoculum of *B. proteoclasticus*. Growth in the co-culture was monitored periodically by Thoma slide enumeration (Webber Scientific International Ltd., Teddington, England). Mid-exponential phase co-cultures and monocultures were harvested by centrifugation (10,000×g, 5 min at 4° C.), and the cell pellets resuspended in 10 ml of $BY^+$ medium (+0.2% [w/v] xylan) and 20 ml of RNAprotect (Qiagen, Hilden, Germany). These were incubated for 5 min at room temperature, and were immediately processed for RNA extraction.

Microarray Analyses

RNA Isolation, cDNA Synthesis and Labelling. Cells of M1 and *B. proteoclasticus* from mono- or co-cultures prepared as described above, were pelleted by centrifugation (5,000×g, 10 min room temperature), air-dried and frozen under liquid $N_2$. Frozen pellets were ground in a sterile pre-chilled (−20° C.) mortar and pestle under liquid $N_2$, and the ground samples resuspended in excess TRIzol (Invitrogen, Carlsbad, Calif., USA). The mixtures were incubated at 20° C. for 5 min. Chloroform (200 µl) was then added, mixed vigorously, and incubated for a further 3 min. The samples were centrifuged (12,000×g, 15 min, 4° C.) and the aqueous phases transferred to fresh tubes, mixed with 0.5 volumes isopropanol and incubated at 20° C. for 10 min to precipitate the RNAs. Precipitated RNAs were pelleted by centrifugation (12,000×g, 10 min, 4° C.), the supernatants removed and the RNAs washed with 5 ml of 75% (v/v) ethanol before being re-pelleted by centrifugation. Ethanol was removed, the pellets air dried on ice and finally each resuspended in 1 ml of diethyl pyrocarbonate (DEPC) treated Milli-Q water. The RNAs were further purified using an RNeasy Midi kit (Qiagen, Hilden, Germany) and quantified using an Agilent 2100 Bioanalyzer (Agilent Technologies, Santa Clara, Calif., USA) following the respective manufacturer's instructions. cDNA synthesis, labeling and purification were carried out using the Invitrogen cDNA labelling purification kit, while the Cy3 and Cy5 dyes were from GE Healthcare (Uppsala, Sweden).

Quantification of Co-Culture mRNA. The relative quantities of RNAs contributed by each organism to the co-culture samples were determined by quantitative PCR of the *B. proteoclasticus* butyryl-CoA dehydrogenase (bcd) gene (using primers bcdqfp: tgagaagggaacacctggat; SEQ ID NO: 7586, and bcdqrp: ttgctcttccgaactgctt; SEQ ID NO: 7587), and the M1 gene encoding $N^5,N^{10}$-methenyl-$H_4$MPT cyclohydrolase (mch) (using primers mchqfp: gtattgcctggtgaagatgt; SEQ ID NO: 7588 and mchqrp: gtcgatttggtagaagtca; SEQ ID NO: 7589). Homologs of both genes have previously been shown to be constitutively expressed in closely related species (Reeve et al., 1997; Asanuma et al., 2005). The mono-culture RNAs were then combined in equal proportions to normalise mRNA abundance with their co-culture replicates.

Probe Synthesis and Slide Printing. Oligonucleotide 70mer probes were designed against the draft genomes of M1 and *Butyrivibrio proteoclasticus* B316$^T$ using ROSO software (Reymond et al., 2004) and synthesised by Illumina (San Diego, Calif., USA). Oligonucleotides were spotted onto epoxy-coated slides (Corning, Lowell, Mass., USA) using an ESI robot (Engineer Service Inc., Toronto, Ontario, Canada).

Microarray Hybridization and Scanning. Microarrays were replicated 6 times (3 biological replicates per treatment, each with a dye swap) and each gene was represented on the array 3 to 7 times. Microarray slides were pre-warmed in microarray prehybridization buffer (50° C. for 30 min), and transferred into hybridization chambers (Corning, Lowell, Mass., USA) and lifter cover slips (Erie Scientific, Portsmouth, N.H., USA) were laid over the probe areas. Samples of RNA to be compared (e.g., Cy3 co-culture versus combined Cy5 individual mono-cultures) were combined, denatured at 95° C. for 10 min, and mixed with 60 µl of pre-warmed (68° C.) Slide Hyb buffer #1 (Ambion, Austin, Tex., USA). The mixture was loaded onto the slide, the hybridization chamber sealed, and incubated in a water bath at 50° C. for 24 h. Following hybridization, the slides were washed by vigorous shaking by hand in pre-warmed (50° C.) wash solutions 1 to 3 (wash solution 1: 10% SDS, 2×SSC; wash solution 2: 1×SSC; wash solution 3: 0.1× SSC), 7 min per wash in aluminium foil-covered Falcon tubes (Becton, Dickinson and Co. Sparks, Md., USA). Following the third wash, the slides were dried by low speed centrifugation (1,500×g, 4 min) followed by incubation for 20 min in a 37° C. vacuum oven (Conthemn, Wellington, NZ) in the dark. Microarray slides were scanned using a GenePix® Professional 4200 scanner and GenePix Pro 6.0 software (Molecular Devices, Sunnyvale, Calif., USA) and analysed using the Limma package in Bioconductor (Smyth, 2005). Genes with an up- or down-regulation of 2 fold or greater and an FDR value <0.05 were deemed statistically significant.

Growth Experiments to Test Effects of PeiR and Alcohols

M1 was grown in medium RM02 in anaerobic culture tubes (16 mm internal diameter, 18 mm outer diameter, 150 mm long; Bellco Glass, Vineland, N.J., USA), essentially as described by Balch and Wolfe, 1976. The mineral salts base of RM02 contained (per liter of medium): 1.4 g of $KH_2PO_4$, 0.6 g of $(NH_4)_2SO_4$, 1.5 g of KCl, 1 ml trace element solution SL10 (Widdel et al., 1983), 1 ml of selenite/tungstate solution (Tschech and Pfennig, 1984) and 4 drops of 0.1% (w/v) resazurin solution. This solution was mixed and then boiled under $O_2$-free 100% $CO_2$, before being cooled in an ice bath while it was bubbled with 100% $CO_2$. Once the medium was cool, 4.2 g of $NaHCO_3$ and 0.5 g of L-cysteine.HCl.$H_2O$ was added per liter. The medium was dispensed into the culture tubes while being gassed with 100% $CO_2$, at 9.5 ml of medium per tube, and the tubes sealed with blue butyl septum stoppers and aluminium seals (Bellco), with a headspace of 100% $CO_2$. These tubes were sterilised by autoclaving for 20 min at 121° C. Before use, the tubes were stored in the dark for at least 24 h. Sodium acetate (20 mM final conc.), sodium formate (60 mM final conc.), coenzyme M (10 µM final conc.), and vitamin-supplemented clarified rumen fluid were added to sterile media, before inoculation with 0.5 ml of an actively growing culture of *M. ruminantium*, then gassed with $H_2$ plus $CO_2$ (4:1) to 180 kPa overpressure. In some experiments, the formate was omitted, and alcohols were added, as noted in the experimental descriptions accompanying the results. The culture tubes were incubated on their sides, at 39° C. in the dark, on a platform shaken at 200 rpm.

To prepare the clarified rumen fluid, rumen contents were collected from a ruminally-fistulated cow that had been fed hay for 48 h after being on a rye-grass clover pasture. Feed was withheld from the animal overnight and rumen contents collected the next morning. The material was filtered through a single layer of cheesecloth and then fine particulate material removed by centrifugation at 10,000×g for 20 min. The supernatant was stored at −20° C. Before further use, it was thawed, and any precipitates removed by centrifugation at 12,000×g for 15 min. The supernatant was bubbled for 10 min with 100% $N_2$ gas, before being autoclaved under 100% nitrogen for 15 min to remove viruses. The following was then added per 100 ml of rumen fluid while stirring under air: 1.63 g of $MgCl_2.6H_2O$ and 1.18 g of $CaCl_2.2H_2O$. The resulting heavy precipitate was removed by centrifuging at 30,000×g and 4° C. for 60 min. The supernatant was designated the clarified rumen fluid. Two grams of yeast extract powder was added, and the mixture then bubbled with $N_2$ gas for 15 min, before being transferred to a $N_2$-flushed sterile serum vial through a 0.2-µm pore size sterile filter using a syringe and needle.

Two ml of Vitamin 10 concentrate was then added per 100 ml of preparation by syringe and needle. Vitamin 10 concentrate contained 1000 ml of distilled water, 40 mg of 4-aminobenzoate, 10 mg of D-(+)-biotin, 100 mg of nicotinic acid, 50 mg of hemicalcium D-(+)-pantothenate, 150 mg of pyridoxamine hydrochloride, 100 mg of thiamine chloride hydrochloride, 50 mg of cyanocobalamin, 30 mg of D,L-6,8-thioctic acid, 30 mg of riboflavin and 10 mg of folic acid. After preparation, the solution was well mixed and then bubbled with $N_2$ gas for 15 min, before being transferred to a $N_2$-flushed sterile serum vial through a 0.2 µm pore size sterile filter using a syringe and needle.

Growth of M1 was followed by measuring the culture density at 600 nm by inserting the tubes directly into an Ultrospec 1100 pro UV/Vis spectrophotometer (Amersham Biosciences, Little Chalfont, Buckinghamshire, UK). Tubes containing 10 ml of medium RM02 were inoculated with 0.5 ml of an actively growing culture of M1, then gassed with $H_2$ plus $CO_2$ (4:1) to 180 kPa overpressure. Additions of PeiR in 0.1 ml of buffer (20 mM 3-[N-morpholino]propane sulfonic acid: 1 mM dithiothreitol: 0.3 M NaCl, 20% glycerol [v/v], pH 7.0 with NaOH), 0.1 ml of buffer only, or 0.1 ml of chloroform were made when the cultures had grown to mid-exponential phase (optical density at 600 nm [$OD_{600}$] ~0.1, 16 mm path length). In the experiments testing the effects of PeiR addition, the culture densities were mathematically normalised to an $OD_{600}$ of 0.1 at the time the additions were made, and all other readings corrected by the same ratio. This was done to remove the effect of lack of absolute synchronicity between cultures, a common phenomenon when culturing methanogens. This normalisation was not done for experiments testing the utilisation of alcohols. Methane was measured by gas chromatography, taking a 0.3 ml sample from the culture headspace, at the pressure in the culture tube, and injecting it into an Aerograph 660 (Varian Associates, Palo Alto, Calif., USA) fitted with a Porapak Q 80/100 mesh column (Waters Corporation, Milford, Mass., USA) and a thermal conductivity detector operated at 100° C. The column was operated at room temperature with $N_2$ as the carrier gas at 12 cm$^3$/min.

DNA Extraction

Genomic DNA was extracted from M1 grown on BY medium with $H_2$ plus $CO_2$ (4:1), using the liquid $N_2$ freezing and grinding method (Jarrell et al., 1992). Briefly, M1 cultures were harvested by centrifugation at 27,000×g for 20 min at 4° C. and cell pellets combined and placed into 40 ml Oakridge centrifuge tubes (Thermo Fisher Scientific, Inc.). The cells were frozen at −20° C. and kept frozen for at least 4 days. The frozen cell pellets were placed in a sterile, pre-cooled (−85° C.) mortar and liquid $N_2$ poured over the pellet. After the $N_2$ had evaporated, the pellet was ground to a powder with a sterile glass rod. Immediately, 0.5 ml of TES buffer (10 mM. Tris-HCl: 1 mM EDTA:0.25 M sucrose, pH 7.5) was added to the powdered cell pellet and mixed gently into a slurry. Sodium dodecyl sulfate was added to a final concentration of 1% (w/v) and Proteinase K (Roche Diagnostics, Mannheim, Germany) added to a final concentration of 50 µg/ml. The mixture was incubated at 60° C. for 30 min. NaCl was added to a final concentration of 0.5 M and the lysate was placed on ice for 1 h. The lysate was centrifuged at 25,000×g for 15 min at 4° C. and the supernatant recovered carefully. An equal volume of cold (4° C.) isopropanol was added to the supernatant, and the precipitated DNA was collected by centrifugation at 12,000×g for 10 min at room temperature and re-dissolved in TE buffer (10 mM Tris-HCl: 1 mM EDTA, pH 7.5). The DNA was treated with RNase (10 µg/ml), (Sigma-Aldrich) for 30 min at 37° C., and extracted twice with an equal volume of phenol/chloroform/isoamyl alcohol (25:24:1) and twice with an equal volume of chloroform alone. NaCl was added to a final concentration of 0.5 M and the DNA precipitated by adding 2.5 volumes of cold (4° C.) ethanol. The precipitated DNA was collected by centrifugation at 14,000×g for 10 min at 4° C. and re-dissolved in TE buffer.

Pulsed-Field Gel Electrophoresis (PFGE)

Standard PFGE protocol involves embedding cells in agarose and lysis with lysozyme and/or proteases, but this was not possible with M1 because its pseudomurein-containing cell wall was resistant to lysis by commercially available enzymes. In order to overcome this, the cell pellet from a centrifuged 50 ml culture was frozen with liquid $N_2$ and very gently ground in a pestle and mortar to damage the cell wall. The ground material was allowed to thaw, 2 ml of 1 M NaCl plus 10 mM Tris (pH 7.6) was added and 300 µl aliquots were mixed with an equal volume of 2% (w/v) low melt agarose (Bio-Rad Laboratories, Hercules, Calif., USA). Embedded cells were treated with 0.1 mg ml$^{-1}$ Proteinase K in lysis buffer (50 mM Tris-HCl: 50 mM EDTA: 1% [w/v] sarkosyl, pH 8.0) at 50° C. for up to 24 h. The agarose plugs were washed twice with sterile water and three times with TE buffer (10 mM Tris-HCl: 1 mM EDTA, pH 8.0) before storage in 10 mM Tris-HCl: 100 mM EDTA (pH 8.0) at 4° C. DNA embedded in agarose was digested for 16 h with 1.0 U of ApaI, BssHII or MluI (New England Biolabs, Beverly, Mass., USA) in 100 µl of restriction enzyme buffer, loaded into wells of 1% (w/v) agarose gels (SeaKem Gold agarose, Cambrex Bio Science, Rockland, Me., USA), and run at 200 V for 20 h at 14° C. in 0.5×Tris-borate buffer using a CHEF DR III PFGE apparatus and model 1000 mini chiller (Bio-Rad). Double-digest combinations of these enzymes were digested and run in the same way. DNA was visualized by staining with ethidium bromide and the image captured using a Gel Doc 1000 system (Kodak Gel Logic 200 Imaging System, Eastman Kodak, Rochester, N.Y., USA).

Genome Sequencing, Assembly and Validation

The genome sequence of M1 was determined using a whole genome shotgun strategy (Agencourt Biosciences, USA) and a pyrosequencing approach (Macrogen, USA). A hybrid assembly (Goldberg et al., 2006) was performed utilising the Staden package (Staden & Bonfield, 2000), Phred (Ewing et al., 1998), Phrap (hypertext transfer protocol://www.phrap.org), Paracel (Paracel Inc.) and Repeatmasker (hypertext transfer protocol://repeatmasker.org) resulting in a 27 contig assembly. Gaps were closed using additional sequencing by PCR-based techniques. Quality improvement of the genome sequence was performed using standard PCR to ensure correct assembly and the resolution of any remaining base conflicts. Assembly validation was confirmed by pulsed-field gel electrophoresis (see above).

Genome Analysis and Annotation

A GAMOLA (Altermann and Klaenhammer, 2003) Artemis (Rutherford et al., 2000) software suite was used to manage genome annotation. Protein-encoding open reading frames (ORFs) were identified using the ORF-prediction program Glimmer (Delcher et al., 1999) and BLASTX (Gish & States, 1993). A manual inspection was performed to verify or, if necessary, redefine the start and stop of each ORF. Assignment of protein function to ORFs was performed manually using results from the following sources; BLASTP (Altschul et al., 1990) to both a non-redundant protein database provided by the National Centre for Biotechnology Information (NCBI) (Sayers et al., 2009) and clusters of orthologous groups (COG) (Tatusov et al., 2000) database. HMMER (Eddy, 1998) was used to identify protein motifs to both the PFAM (Finn et al., 2008) and TIGRFAM (Haft et al., 2003) libraries. TMHMM (Krogh et al., 2001; hypertext transfer protocol://www.cbs.dtu.dk/services/TMHMM/) was used to predict transmembrane sequences, and SignalP (Bendtsen et al., 2004) was used for the prediction of signal peptides.

Ribosomal RNA genes were detected on the basis of BLASTN searches to a custom GAMOLA ribosomal database. Transfer RNA genes were identified using tRNAscan-SE (Lowe & Eddy, 1997). Miscellaneous-coding RNAs were identified using the Rfam database utilizing the INFERNAL software package (Eddy, 2002). Insertion sequence elements were identified using Repeatfinder (Volfovsky et al., 2001) and BLAST and annotated manually. Genome atlas visualisations were constructed using GENEWIZ (Jensen et al., 1999). Horizontal gene transfer studies were performed using Darkhorse (Podell & Gaasterland, 2007), GC % content (Rice et al., 2000) and the Codon Adaptation Index (Sharp & Li, 1987). A BLAST analysis was performed against the arCOG (Makarova et al., 2007) database. Analysis of non-ribosomal peptide synthetases (NRPSs) was performed using NRPSpredictor (Rausch et al., 2005). An LPxTG-HMM (Boekhorst et al., 2005) was used for the identification of LPxTG motifs. Metabolic pathway reconstructions were performed using Pathway Voyager (Altermann & Klaenhammer, 2005) and the KEGG (Kyoto Encyclopedia of Genes and Genomes) database (Kanehisa & Goto, 2000) combined with an extensive review of the literature. Identification of open reading frames (ORFs) as vaccine and drug targets was performed as described. Genome sequences used in comparative studies were downloaded from the National Centre for Biotechnology Information (NCBI) FTP website and are listed in Table 10, below.

Genome sequence was prepared for NCBI submission using Sequin (Benson et al., 2009). The adenine residue of the start codon of the Cdc6-1 (mru0001) gene was chosen as the first base for the M1 genome. For GC skew and synteny analysis, the sequences of genomes of other members of the order Methanobacteriales were rotated to begin at the same location. GC skew analysis was performed by circular_diagram.pl (Rutherford, K, Sanger Centre software) and synteny plots were generated using MUMmer3.0 (Delcher et al., 2003).

Vaccine Target ORF Identification

Vaccine targets are likely to be surface exposed or membrane associated and conserved among methanogens or archaeal species. Methanogens are the only known resident archaea in the rumen and therefore archaeal specific candidates were not omitted from target lists, likewise when present, sequence homology to proteins associated with known vaccine or drug design remained a strong element for target selection regardless of other criteria. To identify the surface-exposed or membrane-associated ORFs of M1 a combination of methods was utilized. To date, there is no signal peptide model for archaea. There are simply too few experimentally verified secretory proteins available for Archaea to train a specific model. For this reason ORF sequences were analysed for the presence of signal peptides using SignalP Version 3.0 (Bendtsen et al., 2004) trained against the Gram-positive, Gram-negative and Eukaryotic models and the results combined. SignalP-HMM (hidden markov models) was used to discriminate between signal peptide and non-signal peptide ORFs whereas SignalP-NN (neural networks) was utilized for the prediction of cleavage sites as described by Emanuelsson et al., 2007 (Emanuelsson et al., 2007). TMHMM (Krogh et al., 2001; hypertext transfer protocol://www.cbs.dtu.dk/services/TMHMW) was used for the prediction of transmembrane domains and (Nakai & Horton, 1999) PSORT trained on a Gram-positive model was used to predict a protein's subcellular localization. BLASTP results were analyzed to identify methanogen specific ORFs.

Chemogenomics Target ORF Identification

Three different approaches were utilized to identify candidate chemogenomics targets.

Metabolic Profiling Analyses. Several factors were taken into consideration when performing this analysis. Utilizing the metabolic reconstruction of M1 and an extensive review of the literature, archaeal- or methanogen-specific enzymes, or enzymes with sufficient structural or biochemical differences compared to their bacterial or eukaryl counterparts were identified. Some methanogen enzymes or pathways that have been previously targeted by researchers for inhibition demonstrating the essentiality of certain enzymes/pathways were also taken into consideration. In addition, a few enzymes which represent key enzymes to several pathways or are well known validated targets in pathogenic bacteria or parasites, whilst still retaining sufficient sequence divergence to potentially be able to be targeted effectively were also included. Most of the cell wall enzymes are listed as the majority of successful antibiotics that have been developed against pathogenic bacteria target cell wall biosynthesis. Methanobacterial cell wall synthesis, despite apparently sharing some common enzymes (e.g., mur ligases) is widely divergent in biochemical terms from bacterial cell wall synthesis and the homologous enzymes share only limited sequence homology. The degree to which strain M1, or other rumen methanogens, are able to utilize amino acids, vitamins, or purine or pyrimidine compounds in rumen fluid is under investigation.

Functional Genome Distribution (FGD). A FGD analysis (Altermann 2009, manuscript in preparation) was performed using 26 publicly available draft and complete methanogen genome sequences (dbMethano, Table 10). In contrast to an evolutionary phylogeny, FGD analyzes the functional relationship between microbes based on their predicted ORFeomes. FGD is a comparative genomics approach to genome-genome comparisons, emphasizing functional relationships rather than ancestral lineages. Briefly, pooled ORFeomes are subjected to all-vs-all analyses, evaluating the level and quality of amino-acid similarities between individual ORFs pairings. Individual results for each genome-genome combination are then combined into a symmetrical distance matrix and can be visualized using the Unweighted Pair Group Method with Arithmetic mean (UPGMA) method (Sneath and Sokal, 1973) Numerical Taxonomy. Freeman, San Francisco. Strain and cluster conserved and specific gene sets were mined based on respective BLAST e-values, using custom developed software.

Differential Blast Analysis (DBA). The reference genome of M1 was subjected to analysis against two BLASTP databases using GAMOLA (Altermann and Klaenhammer, 2003). The first amino-acid database employed all methanogen ORFeomes used in the FGD analysis (dbMethano), while the second database was comprised of the non-redundant database (nr) as provided by NCBI, excluding hits to genera used in dbMethano. E-values of best BLASTP hits for both database sets were consolidated into an empirically determined e-value trust level range ($[T_{e\text{-}value}]$) and their respective differential calculated as follows: $\Delta = T_{nr}$ −T$_{dbMethano}$). Results were visualized on a genome atlas using Genewiz (Jensen et al., 1999) and software developed in-house.

Peptide Vaccine Methods

The use of synthetic peptides to raise antibodies against predicted M1 surface proteins was investigated. The M1 proteins encoding the membrane-spanning subunits of tetrahydromethanopterin S-methyltransferase (MtrCDE, mru1921, 1922 and 1923), adhesin-like proteins (mru2049, 0842, 0143 and 2048) and a magnesium chelatase subunit H (BchH, mru2047) containing N-terminal and C-terminal TMHs, were analysed to identify extracellular peptide sequences which might serve as potential antibody binding sites. Nine suitable peptide sequences from extracellular regions of these eight proteins were identified and used to guide the manufacture of the corresponding synthetic peptides. Each peptide was coupled to the Keyhole Limpet hemocyanin (KLH) protein via an additional N- or C-terminal cysteine residue and a maleimidocaproyl-N-hydroxysuccinimide linker and used to raise antibodies in sheep (Invitrogen, USA). The conjugated peptides (200 µg) were injected intradermally (ID) into sheep (1-3 yr age) in Complete Freund's Adjuvant (CFA) at 10-15 sites on day 0, and secondary boosters in CFA were given on day 14. Six ID injections of 200 µg KLH-peptide in Incomplete Freund's Adjuvant at 10-15 sites were given at days 28, 56, 70, 84, 98 and 112. Test bleeds (2-5 ml) were taken on days 42, 56, 84, and 112 for ELISA analyses.

Antibody titer was determined with an ELISA with Peptide-GGG (goat gamma globulin) bound in solid phase (0.1 µg/100 µl/well) on high binding 96 well plates. The serum was first diluted 50-fold and then further diluted in 2-fold serial dilutions. The ELISA titer is the estimated dilution factor that resulted in an OD$_{405}$ nm of 0.2 and is derived from nonlinear regression analysis of the serial dilution curve. Detection was obtained using an HRP (horseradish peroxidase)-conjugated secondary antibody and ABTS (2,2'-azino-bis(3-ethylbenzthiazoline-6-sulphonic acid). In the antibody-binding experiment M1 cells (40 µl of cells in 2 ml of sodium carbonate buffer) were immobilised on Maxisorp ELISA plates and antibody binding was determined by ELISA. Serum samples were diluted 1/20 in diluent (1% w/v casein in PBS Tween 20 (g/l NaCl, 8.0; KCl, 0.2; Na2HPO4, 1.15; KH2PO4, 0.2; pH 7.2-7.4; Tween 20, 0.5 ml) and incubated at room temperature for 1 hr. Plates were washed 6 times with PBS Tween 20 and conjugate (donkey anti-sheep/goat IgG HRP, 50 µl/well of a 1/5000 diluted solution) and substrate (3, 3',5,5'tetramethyl benzidine, 50 µl/well) were added. After incubation at room temperature in the dark for 15 min, stop solution (50 µl/well of 0.05 M H2SO4) was added and OD$_{450}$ nm readings were taken.

Accession Numbers and Sequence Listing

The nucleotide sequence of the *M. ruminantium* M1 chromosome has been deposited in GenBank under Accession Number CP001719. Microarray data has been submitted to the Gene Expression Omnibus (GEO) in accordance with MIAME standards under GEO Accession Number GSE18716. The specific *M. ruminantium* sequences are disclosed herewith as a text file (.txt) for the sequence listing. The contents of sequence listing are hereby incorporated by reference herein in their entirety.

Example 2

Results

General Genome Characteristics

The genome sequence of M1 consists of a single 2.93 megabase (Mb) circular chromosome, the assembly of which has been verified by pulsed-field gel electrophoresis (FIG. 6). The general features of the M1 genome compared to other genomes of species within the order Methanobacteriales are summarized in Table 1, below, and FIG. 10. M1 has the largest genome of the Methanobacteriales sequenced to date. This increased genome size is due in part to a lower overall coding density, but also to a large number of genes encoding surface adhesin-like proteins, the presence of a prophage, and a variety of genes unique to the M1 genome. M1 encodes 2217 open reading frames (ORFs) and a functional classification of each ORF is presented in Table 9, below, and FIG. 15. Genomes of the Methanobacteriales display a GC skew similar to bacterial chromosomes (Lobry, 1996) (FIG. 2) and an X-shaped synteny pattern that is characteristic of moderately diverged genomes (FIG. 3). Analysis of potential horizontal gene transfer (HGT) events in M1 identified a number of genes which show high sequence similarity to non-methanogens, typically from members of the bacterial phylum Firmicutes (Table 4, below, and FIG. 16). These potential HGT events can be visualized in a BLAST heat map analysis (FIG. 16). Several approaches were used to define potential gene targets for $CH_4$ mitigation from M1. An integral part of this process was the analysis of genes which are conserved across methanogen genomes (FIG. 13 and Table 8, below). Coupled with this, chemogenomic targets (FIG. 1*a*) were selected on the basis of detailed metabolic analysis (Table 2, below), while potential vaccine targets (FIG. 1*b*) were chosen from proteins predicted to be associated with the M1 cell surface. Examination of the M1 genome has revealed a number of features and targets that could lead to an effective enteric methane mitigation technology, and these are discussed below.

Growth and Methanogenesis

Many of the enzymes involved in the methanogenesis pathway are strongly conserved and found only among methanogens, and therefore present good targets for $CH_4$ mitigation technologies. Although this pathway has been well studied in methanogens from a range of other environments (Thauer et al., 2008), the M1 genome shows for the first time details of this pathway in a rumen methanogen. M1 can grow with $H_2$+$CO_2$ and formate (Smith & Hungate, 1958) and encodes the enzymes, and most of the cofactors, required for conversion of these substrates through to methane according to the metabolic scheme presented in FIG. 11. Consistent with this hydrogenotrophic lifestyle, M1 lacks the methanophenazine-reducing [Ni—Fe] hydrogenase (VhoACG) and methanophenazine-dependant heterodisulphide reductase (HdrDE) found in methanophenazine-containing species within the order Methanosarcinales (Abken et al., 1998).

Surprisingly, M1 has two NADPH-dependent $F_{420}$ dehydrogenase (npdG1, 2) genes and three NADP-dependent alcohol dehydrogenase (adh1, 2 and 3) genes. In some methanogens, these enzymes allow growth on ethanol or isopropanol via $NADP^+$-dependent oxidation of the alcohol coupled to $F_{420}$ reduction of methenyl-$H_4$MPT to methyl-$H_4$MPT (Berk & Thauer, 1997) (FIG. 11). M1 is reported as not being able to grow on ethanol or methanol (Smith & Hungate, 1958), although a ciliate-associated *M. ruminan-*

*tium*-like isolate was able to use isopropanol to a limited degree but data were not presented (Tokura et al., 1999). Our attempts to grow M1 on alcohols indicate that ethanol and methanol stimulate growth in the presence of limiting amounts of $H_2+CO_2$, but they do not support growth when $H_2$ is absent (FIG. 14). M1 does not contain homologues of the mta genes known to be required for methanol utilization in other methanogens (Fricke et al., 2006). The adh genes may play a role in alcohol metabolism but the mechanism is under assessment.

Hydrogenotrophic methanogens usually encode a methyl coenzyme reductase II (mcrII or mrt), an isoenzyme of the methyl CoM reductase I (mcrI) enzyme which is differentially regulated during growth (Reeve et al., 1997) to mediate methane formation at high partial pressures of $H_2$. Interestingly, M1 does not encode a mail system. In the rumen, methanogens depend on fermentative microbes to supply $H_2$, usually at very low concentrations, and M1 appears to have adapted its lifestyle for growth at low levels of $H_2$ using the mcrI system only.

To examine the expression of genes involved in methanogenesis, in the presence of a $H_2$-forming rumen bacterium, M1 was grown in co-culture with *Butyrivibrio proteoclasticus* B316 (Moon et al., 2008) in a medium containing xylan as the sole carbon source, and gene expression was analysed by microarrays. Formylmethanofuran dehydrogenase (fwdA), methyl CoM reductase (mcrB-CDG), methyl viologen-reducing hydrogenase (mvhG), and $H_4$MPT methyltransferase (mtrABCH) were significantly up-regulated (≥2 fold) in the co-culture compared to the monoculture of M1 grown with $H_2+CO_2$ (Table 5, below). Interestingly, formate utilisation (fdhAB) genes were also up-regulated, suggesting that formate formed by *B. proteoclasticus* was an important methanogenic substrate transferred during this syntrophic interaction.

Genes encoding enzymes in the methanogenesis pathway that are potential targets are highlighted in FIG. 11. Several methanogenesis marker proteins found in methanogen genomes, with hypothetical function, were also included in the target list. Many of the enzyme subunit targets are predicted to be within the cell cytoplasm, and therefore best pursued via a chemogenomics approach (FIG. 11). However, several, subunits including those of the Aha, Eha, Ehb and Mtr enzyme complexes, are membrane-located and may be suitable as vaccine targets. Mtr catalyses the transfer of the methyl group from methyl-$H_4$MPT to CoM and couples this to the efflux of $Na^+$ ions (Reeve et al., 1997). Three of the Mtr subunits (MtrEDC) are predicted to be membrane-spanning in M1 and in each of the membrane-spanning regions the transmembrane helices have peptide loops located outside the cell membrane. These loops are potential antibody binding sites. Synthetic peptides corresponding to the loop regions of MtrE, MtrD and MtrC have been coupled to a carrier protein and used as antigens to vaccinate sheep. The resulting immune sera were shown to bind specifically to immobilized M1 cells (FIG. 17), demonstrating the feasibility of such a peptide-directed reverse vaccinology approach.

Analysis of the M1 genome has helped explain the growth requirements of M1 for acetate, 2-methylbutyrate and coenzyme M (CoM) (Bryant et al., 1971). Acetate is required for cell carbon biosynthesis after activation to acetyl CoA (acs, acsA), followed by reductive carboxylation to pyruvate (porABCDEF, Table 9, below). Reductive carboxylation of 2-methylbutyrate is probably the route for isoleucine biosynthesis (Robinson & Allison, 1969), as M1 lacks a gene encoding a homoserine kinase needed for the usual pathway from threonine (Table 9, below). Exogenously supplied CoM is essential for M1 growth as two genes needed in the CoM biosynthetic pathway, phosphosulfolactate synthase (comA) and sulfopyruvate decarboxylase (comDE) (Graham et al., 2002), are missing in M1 (FIG. 11).

Cell Envelope

The methanogen cell envelope serves as the interface between the organism and its rumen environment, and as such represents a key area for the identification of vaccine and drug targets. The main structural component of the cell envelope of M1 (FIG. 12), as with other Gram-positive methanogens, is pseudomurein. This is structurally analogous, but chemically different, to peptidoglycan, which performs the comparable function in bacteria (König et al., 1994). Bacterial peptidoglycan biosynthesis has long been a major target of antimicrobials but these compounds are largely ineffective against pseudomurein-containing cells (Kandler & König, 1998). The pathway for pseudomurein biosynthesis and its primary structure have been proposed (Kandler & König, 1998), but the enzymes involved have not been characterized. Our genomic analysis has identified several genes encoding enzymes likely to be involved both in the intracellular biosynthesis of the pseudomurein precursors and the processes involved in exporting and assembling these into the cell wall (FIG. 5).

The original description of *M. ruminantium* reported the existence of a capsule surrounding the cells, and chemical analysis of the cell walls showed that galactose and rhamnose together with lower amounts of glucose and mannose were present in addition to pseudomurein (Kandler & König, 1978; Kandler & König, 1985). The cell walls are also reported to contain high levels of phosphate, comparable to that found in bacterial cell walls containing teichoic acid (Kandler & König, 1978). M1 contains homologs of genes involved in teichoic acid production in Gram positive bacteria (Bhavsar & Brown, 2006; Weidenmaier & Peschel, 2008) (Table 9, below), suggesting the presence of as-yet unidentified cell wall glycopolymers. Additionally, several genes are predicted to be involved in exopolysaccharide production, sialic acid biosynthesis and protein glycosylation (Table 9, below). The genome contains a homolog of the eukaryal oligosaccharyl transferase (mru0391), a membrane protein believed to be involved in glycosylating proteins translocated via the Sec pathway (Yurist-Doutsch, 2008) (FIG. 12). Glycoproteins derived from the cell wall of M1 have been shown to be highly immunogenic in sheep. The resulting antisera agglutinated M1 cells and significantly reduced their ability to grow and produce methane in vitro (Wedlock et al., in preparation). Overall, polysaccharides and glycosylated molecules are a major component of the M1 cell envelope, and their accessibility at the cell surface make these polymers viable methane mitigation targets.

Genomes of human gut methanogens encode large surface proteins that have features similar to bacterial (Fricke et al., 2006; Samuel et al., 2007) adhesins. Similarly, M1 has an array of large adhesin-like proteins, much greater in number than those reported from other gut methanogens (Table 1, below). In the co-culturing experiments described above, six M1 adhesin-like proteins were upregulated (Table 5, below), and microscopic examination showed co-aggregation of M1 and *B. proteoclasticus* cells (FIG. 9). In addition, immune sera produced by small peptides synthesized to correspond to four M1 adhesin-like proteins were shown to bind specifically to immobilized M1 cells (FIG. 17). Identifying highly conserved methanogen-specific features of these adhesin-like proteins may present a pathway to vaccine development. Sixty two adhesin-like proteins are predicted to be extracellular and contain a cell-anchoring domain (FIG. 12). These proteins represent a significant component of the M1 cell envelope (Table 3). The largest group of these (44) contain a conserved C-terminal domain (M1-C, FIG. 4) with weak homology to a Big_1 domain (Pfam accession number PF02369) which may be involved in attachment to the cell wall, possibly by interaction with pseudomurein or cell wall glycopolymers. Several of these proteins also contain a papain family cysteine protease domain (PF00112), and their role may be in the turnover of pseudomurein cell walls.

A second group of 14 proteins is predicted to contain a C-terminal transmembrane domain, suggesting they are anchored in the cell membrane. Curiously, the genome contains one adhesin-like protein (mru2147) with a cell wall LPxTG-like sorting motif and three copies of a cell wall binding repeat (PF01473), both of which are commonly found in Gram-positive bacteria. There has only been one other report of a LPxTG-containing protein in a methanogen, the pseudomurein containing *Methanopyrus kandleri* (Boekhorst et al., 2005). Our analysis of the *M. smithii* PS genome revealed the presence of two LPxTG containing proteins (msm0173 and msm0411). Such proteins are covalently attached to the cell wall by membrane associated transpeptidases, known as sortases. Sortase activity has been recognised as a target for anti-infective therapy in bacteria (Maresso & Schneewind, 2008) and a sortase (mru1832) has been identified in the M1 genome.

Prophage

Phage exert a significant ecological impact on microbial populations in the rumen, and have been suggested as biocontrol agents for rumen methanogens (Klieve & Hegarty, 1999). M1 has 70 ORFs (mru0256-0325) over a 62 Kb GC-rich (39% G+C content) region of the genome that encode a prophage genome, designated φmru. Based on a functional annotation, φmru is partitioned into distinct modules encoding integration, DNA replication, DNA packaging, phage capsid, lysis and lysogenic functions (Attwood et al., 2008). Within the lysis module, a gene encoding a putative lytic enzyme, endoisopeptidase PeiR (mru0320), was identified. Recombinant phage lytic enzymes have been used for controlling antibiotic-resistant bacterial pathogens (Hermoso et al., 2007), and a methanogen phage lytic enzyme may be a viable biocontrol option. We have confirmed the ability of recombinant PeiR to lyse M1 cells in pure culture (WO 09041831A1) (FIG. 8). PeiR represents a novel enzyme, as it does not show significant homology to any sequence currently in public databases. The variety of methanogen cell wall types means a combination of different lytic enzymes will be required for effective methanogen lysis in the rumen. However, the expression of PeiR and demonstration of its effectiveness against a major rumen methanogen is an important step towards this goal. PeiR will also be useful in increasing the permeability of pseudomurein-containing cell walls of methanogens to aid development of genetic systems for performing gene knockouts to validate targets, while the φmru phage itself might be useful as a genetic tool for *M. ruminantium*. The prophage has also been disclosed in detail in U.S. 60/989,840 filed 22 Nov. 2007, and in PCT/2008/000248 filed 25 Sep. 2008, which are hereby incorporated by reference herein in their entirety.

Non-Ribosomal Peptide Synthetases

Figure 18:
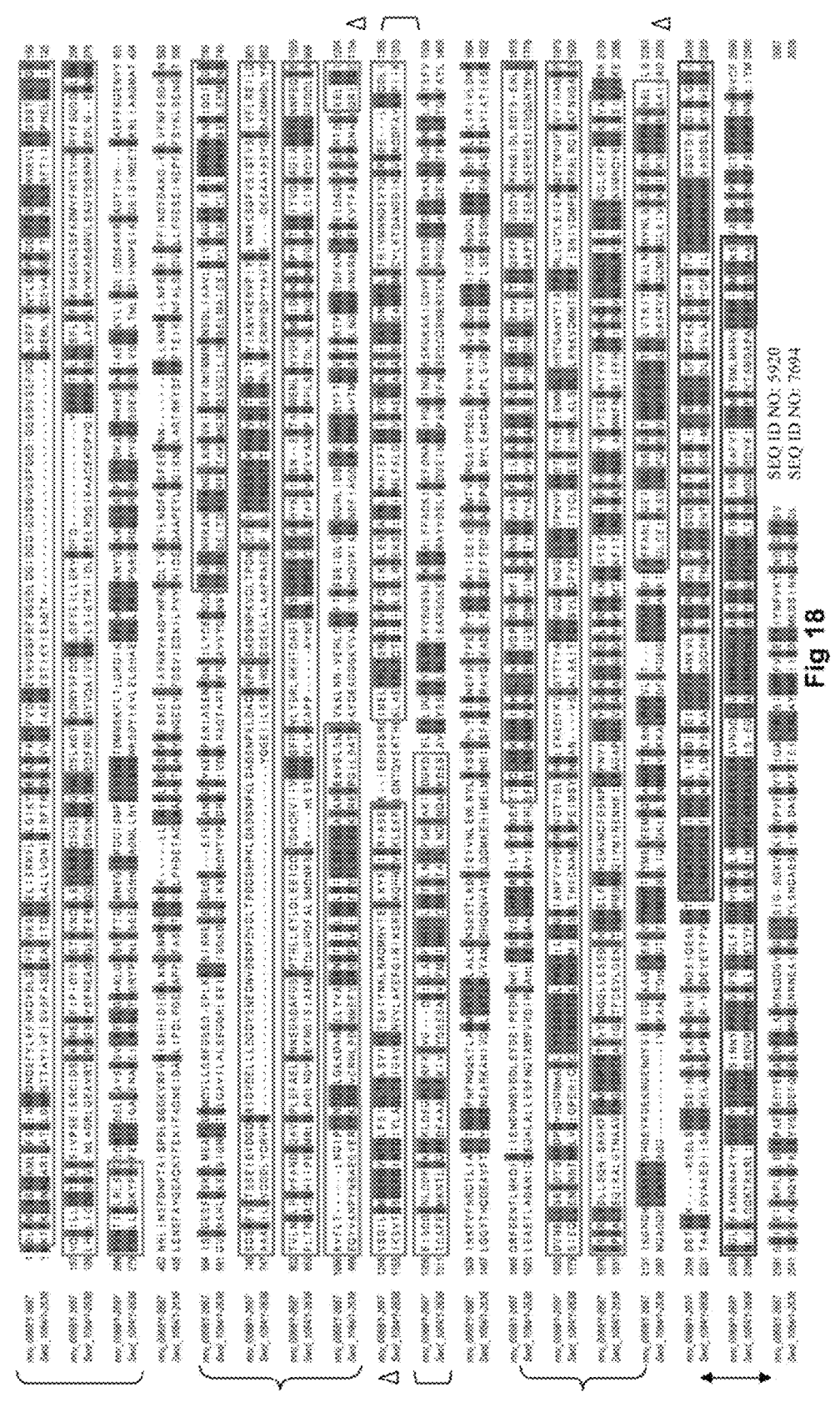

An unforeseen and novel feature of M1 is the presence of two large proteins (mru0068 and mru0351) showing the distinctive domain architecture of non-ribosomal peptide synthetases (NRPS) (FIG. 7). To our knowledge, this is the first report of NRPS genes identified in an archaeal genome. HGT studies indicate that these genes may be bacterial in origin (Table 4, below). NRPSs produce a wide variety of small molecule natural products that have biotechnological applications as peptide antibiotics, siderophores, immunosupressants or antitumor drugs (Amoutzias et al., 2008). The NRPS encoded by mru0068 is predicted to encode two modules, each containing condensation, adenylation and thiolation domains. The presence of a condensation domain in the first module is often associated with NRPSs that make N-acylated peptides (Fischbach and Walsh, 2006). The second module is followed by a terminal thioesterase domain which is thought to release the peptide from the final thiolation domain. Mru0068 is surrounded by genes that encode two serine phosphatases (mru0066, mru0071), an anti-sigma factor antagonist (mru0067), and a MatE efflux family protein (mru0069), which are likely to be involved in environment sensing, regulating NRPS expression and export of the NRP, respectively. Mru0068 displays full length protein alignment with a putative NRPS from *Syntrophomonas wolfei* subsp. *wolfei* strain Göttingen (FIG. 18), a Gram-positive bacterium known to participate in syntrophic interactions with methanogens (McInerney et al., 1979).

The second NRPS gene (mru0351) contains 4 modules and a thioesterase domain. Downstream of mru0351 is another MatE efflux family protein (mru0352), presumably involved in NRP export. A third, smaller cluster of genes located elsewhere in the genome (mru0513-0516) appear to encode NRPS-associated functions. This cluster includes a 4'-phosphopantetheinyl transferase (mru0514) which primes NRPSs by adding a phosphopantetheinyl group to a conserved serine within the thiolation domain, an acyltransferase (mru0512) possibly involved in NRP acylation, a serine phosphatase (mru0515), an anti-sigma factor antagonist (mru0513), and an anti-sigma regulatory factor serine/threonine protein kinase (mru0516) that may function in sensing the environment and NRPS regulation. Although the products of each NRPS are unknown, an analysis of adenylation domain amino acid sequences predicts 10 residues (boxed, FIG. 7) which are important for substrate binding and catalysis. HGT studies indicate that these genes may be bacterial in origin (Table 4).

Thus, several genes in M1 are possibly involved in sensing the environment, and in the regulation and transport of the NRP (FIG. 7) and such genes are also present in the *S. wolfei* genome. Although the actual roles of these genes have not been defined conclusively, NRPs are known to contribute to microbial growth and ecological interactions, thus may provide a means to manage methane emissions from livestock.

Comparative Genomics Analysis

To functionally compare *M. ruminantium* to other methanogens, 25 publicly accessible complete and draft phase genome sequences were subjected to a Functional Genome Distribution (FGD) analysis (Altermann, submitted) (FIG. 13). Together with *Methanobrevibater smithii, Methonsphaera stadtmanae*, and *Methanothermobacter thermoautotrophicus, M. ruminantium* formed a functional cluster. Within this cluster, a large number of predicted genes were found to be conserved (low e-value cutoff 1e-100, Table 8, below). The majority of these conserved genes were classified into core biological categories, such as amino acid biosynthesis, cell cycle, central carbon metabolism, nucleic acid metabolism, protein fate and synthesis and purine and pyrimidine biosynthesis. Similarly, genes involved in energy metabolism, especially in the methanogenesis pathway were commonly shared within this functional cluster.

Most notably, only one fourth of this gene set was found to be conserved when compared with other functional clusters. A similar observation was found for conserved genes involved in the biosynthesis of vitamins and co-factors. 23 genes were found to be highly conserved within the *M. ruminantium* functional cluster, whereas only two genes involved in cobalamin and thimaine biosynthesis were shared with methanogens outside this cluster, respectively. It is also interesting to note that, apart from *Methanopyrus kandleri*, pseudomurein containing methanogens have been functionally grouped together in the *M. ruminantium* cluster. This is clearly reflected in the 14 highly conserved genes involved in pseudomurein and exopolysaccharide biosynthesis. Outside this functional cluster only one gene, a glucosamine-fructose-6-phosphate aminotransferase, GlmS2, was found to be conserved at this level.

While conserved gene sets cause functional clustering, strain or cluster specific genes are responsible for differentiation. When compared to all other members of its own cluster, *M. ruminantium* was found to harbour 468 strain specific genes (high e-value cutoff 1e-10). While the vast majority (341 genes) was assigned to genes with hypothetical or unknown functional categories, a significant number of genes were identified assigned to relevant biological functions. Mobile elements such a transposases and prophage elements were identified as strain specific to *M. ruminantium*. Strain-specific genes involved in the production of exopolysaccharides and cell surface proteins are likely to endow *M. ruminantium* with surface and adhesion properties distinctly different from other members of the *M. ruminantium* functional cluster. Similarly, ten unique transport systems were identified ranging from generic multidrug transporter to predicted pH homeostasis systems. Also 22 regulatory proteins (16 involved in protein interaction and five transcriptional regulators) were detected. When extending the search for strain specific genes outside its own functional cluster, the number of identified ORFs dropped down significantly. Only three genes coding for adhesion-like proteins and two genes involved in the production of exopolysaccharides (a sialyltransferase and a glycosyl transferase) were found to be *M. ruminantium* specific.

Comparing pseudomurein producers (PMP) to all other methanogens using a relaxed parameter set (low e-value cutoff 1e-60; high e-value cutoff 1e-10; mismatch tolerance 2) revealed an interesting set of genes functionally specific to this subset. A number of genes involved in pseudomurein biosynthesis were identified to be functionally specific to PMPs. In addition, two genes coding for adhesion-like proteins, four genes predicted to be involved in exopolysaccharide production and one gene coding for a poly-gamma-glutamate biosynthesis protein, likely to be involved in capsule synthesis, were found to be cluster specific. These genes coding for cell surface structures represent prime targets for vaccination based methane mitigation strategies, as their gene products are likely to reflect unique structures with the potential to induce specific antibodies. Interestingly, a gene coding for the energy-converting hydrogenase A subunit R was found to be PMP specific (including *M. thermoautotrophicus* and *M. kandleri*). This gene product is involved in electron transfer by reducing a ferredoxin. The Eha/Ehb complex is already being targeted for the development of a methanogen vaccine (FIG. 11).

Currently a bias exists for pseudomurein producing methanogen genomes. With the exception of *Methanothermobacter thermoautotrophicus* (isolated from sewage sludge) and *Methanopyrus kandleri* (isolated from a submarine hydrothermal vent) all PMP methanogens were isolated either from rumen, the gastrointestinal tract or from faeces. It stands to reason that these closely related ecological niches facilitate common lifestyle adaption events. Such an event was detected in the presence of a highly conserved bile salt hydrolase which is predicted to hydrolyse the amide linkage between the bile acid carboxyl group and the glycine or taurine amino group. The presence of a bile salt hydrolase explicitly implies that *M. ruminantium* (and other rumen methanogens) is well adapted for a passage from the rumen environment through to the gastrointestinal tract. Functionally conserved oxidative stress response genes such as rubredoxin rub1 further suggest a certain tolerance of methanogens to aerobic environments and a life-cycle from oral intake, biological activity in rumen and gastrointestinal tract ecologies, excretion into the aerobic environment and a subsequent—potentially time limited—waiting period for the next oral intake event may be proposed. How strictly anaerobic organisms such as methanogens survive exposure to high stress levels remains subject to further evaluation.

A recently published phylogenetic tree based on seven core enzymes (Miller, 2001) deviates in part significantly from the functional clustering shown in FIG. 13. Anderson et al. propose three classes of methanogens, based on the resulting phylogenetic approximation. In contrast, the FGD analysis revealed the presence of only two major functional clusters which can each be split into further sub-clusters (FIG. 13). Most notably, *Methanocorpusculum labreanum*, *Methanococcoides burtonii* and *Methanosaeta thermophila* form a distinct functional cluster under the FGD analysis (FIG. 13, sub-cluster 1.3) but are separated into Class II and Class III, respectively, based on the phylogenetic analysis. These differences clearly highlight the importance of whole genome analyses to address lifestyle adaptation processes (as described above) and genomic plasticity within a biotechnological context.

To investigate the broader phylogenetic placement of *M. ruminantium* and assess the potential level of horizontal gene transfer between archaea and archaea and eubacteria, a Blast Heat Map analysis was performed based on the non-redundant amino-acid database (FIG. 16). Significant heat flares were detected within archaea for the genera of *Methanococcus*, and, to lesser degrees for *Methanosarcina* and *Thermococcus* (FIG. 16A). Surprisingly, considerable levels of high sequence similarities were detected for the eubacterial genera of *Clostridium* and *Bacillus*, commonly found in ecological niches inhabited by *M. ruminantium*. These heat flares infer a profound level of shared and functionally similar gene sets and fortify the notion that genetic exchange between microbial domains is a common event, likely driven by lifestyle adaption forces. Analysing the relative quality of sequence similarity levels revealed a core set of genes commonly shared among phylogenetically diverse methanogenic archaea (FIG. 16B). Interestingly, individual heat flares of other archaea such as Halobacteria sharing highly conserved gene sets to *M. ruminantium* appear similar in shape than flares observed for *Clostridium* and *Bacillus*, further strengthening the model of genetic exchange between domains. Interestingly, a more detailed analysis of the *M. ruminantium* M1 ORFeome to bacterial sequences highlighted a series of gene sets not commonly found in other Methanobacteriales such as genes involved in biotin and cobalamin biosynthesis (Table 8, below).

Based on these observations we conducted a differential Blast Analysis (DBA) using the non-redundant database and the 26 methanogen genomes as references. While a DBA analysis is more liberal than FGD, it is able to highlight gene products present in at least one methanogen genome comprising dbMethano but not present in any other organism (nr database) and vice versa. Therefore, gene sets found to be present in methanogens but not in other microbes might represent prime targets for methane mitigation strategies. Using a minimum DBA value of four, 117 gene targets were identified to be conserved between *M. ruminantium* and methanogens but not present in other organisms. Notably, 21 genes predicted to be associated to the cell envelope were identified, including cell surface proteins and genes involved in exopolysaccharide and pseudomurein biosynthesis. One gene coding for a polysaccharide biosynthesis protein and two adhesion-like proteins were among the most prominent targets (DBA value of −6). All three genes are involved in cell-cell interaction and could represent targets for methanogen modulation. Interestingly, a single adhesion like protein was identified near the origin of DNA replication, conserved between *M. ruminantium* and other organisms but absent in methanogens (FIG. 10).

Closest hits were found to *Coprococcus eutactus* (Acc: ZP_02205388.1, isolated from human faeces), *Streptococcus sanguinis* (Acc: YP_001036038.1, isolated from human dental plaque), *Peptostreptococcus micros* (renamed as: *Parvimonas micra*, Acc: ZP_02093886.1, isolated from human gut), *Arcanobacterium pyogenes* (Acc: AA043108.1, commonly found on mucosal surfaces of livestock) and *Bacillus weihenstephanensis* (Acc: YP_001647931.1, human pathogen). All of those organisms are able to interact with either animal or human hosts and it is tempting to speculate that this adhesion reflects a specific lifestyle adaptation of *M. ruminantium* to the rumen and, possibly, to the gastrointestinal tract environment. This clearly strengthens the previous hypothesis modelled on the Blast Heat Map proposing a significant level of genetic exchange between *M. ruminantium* and certain genera of Eubacteria. Similarly, two adjacent glycosylhydrolases of the GT2 family were found to be shared in a similar way. For both proteins, top Blast hits link to Clostridia and Bacilli while their function was associated to the transfer of sugar units to teichoic acids which in turn are covalently linked to the cell wall thus providing *M. ruminantium* with a methanogen-unique outer cell-surface structure.

Genes predicted to be involved in hydrogen metabolism and methanogenesis such as the energy-converting hydrogenase B (Ehb) and the tungsten formylmethanofuran dehydrogenase (Fwd) were found to be methanogen specific. Also, another gene involved core functions, a Fibrillarin-like archaeal protein, commonly thought to participate in processing pre-ribosomal rRNA, was found to be methanogen specific. This is interesting, as only methanogen genera were excluded from the non-redundant database, but not other archaea. Therefore, this gene might present an opportunity to target methanogens at an essential function. An in-depth analysis of the presence/absence of this gene in the methanogen genomes revealed an interesting distribution pattern. With the exception of *Methanospitillum hungatei* members of functional cluster 4 (FIG. 13) do not harbours this gene, while cluster 3 predominantly features this archaeal gene, with the notable exception of *Methanococcoides burtonii*, *Methanosaeta thermophila* and *Methanosphaera stadtmanae*. It might be noteworthy, that within methanogens this gene is either absent or present, creating a highly conserved target with low genetic drift. Although not universally conserved, this gene might offer the opportunity to specifically target the majority of cluster 3 methanogens, thus including those of rumen origin, for methane mitigation strategies.

Identification of Targets for Methane Mitigation

Figure 1:
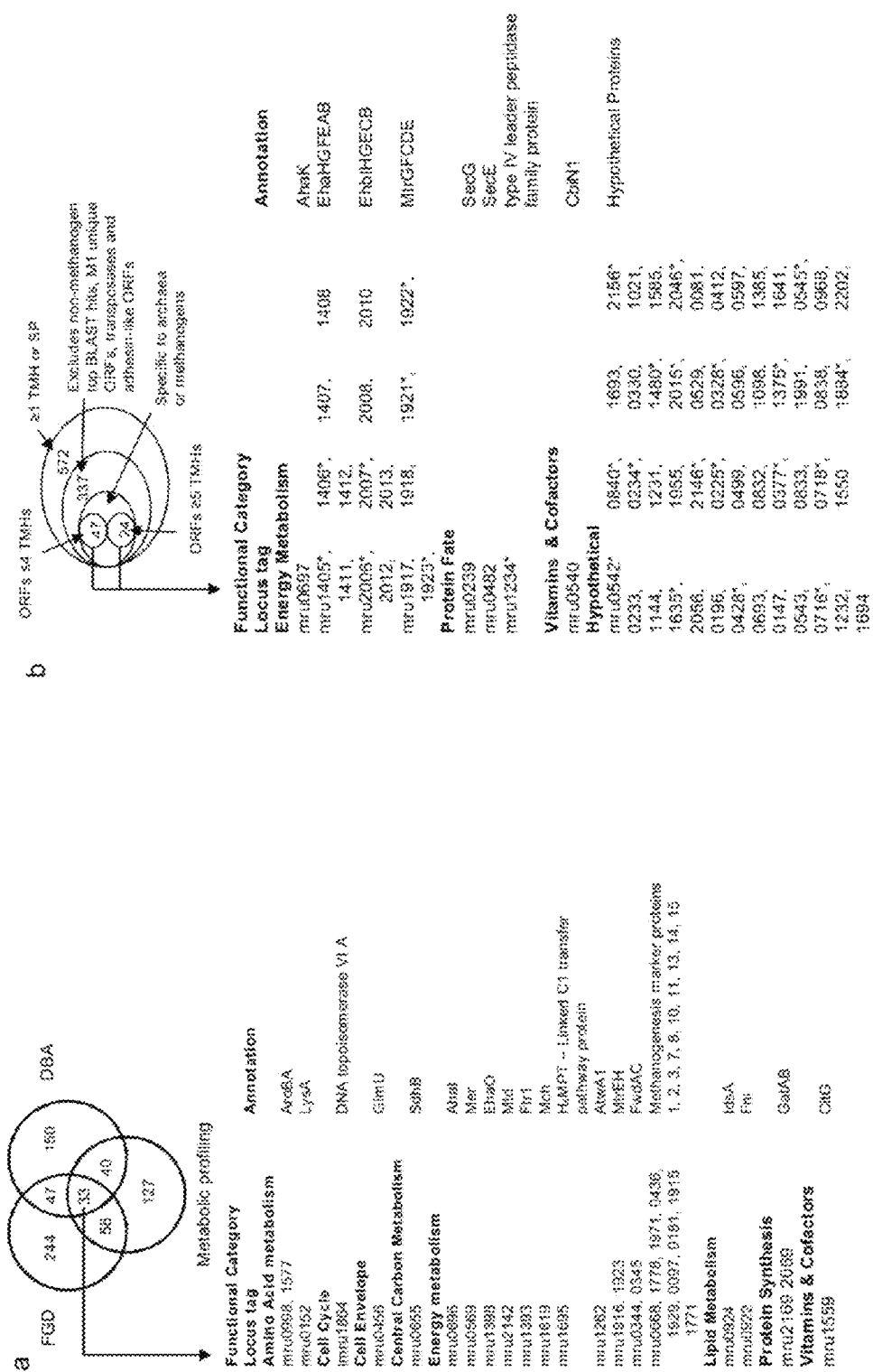
FIG. 1: Chemogenomic and vaccine gene targets within M1. The number of genes identified by each analysis is shown in the Venn diagram and a selection of the gene targets are summarized in the tables grouped by functional category (a) Chemogenomic gene targets were defined by identification of genes that occurred across three separate analyses; the Functional Genome Distribution (FGD), Differential BLAST analysis (DBA) and metabolic profiling. (b) Vaccine target genes were defined as described and discussed below. TMH, transmembrane helices, SP, signal peptide.
Figure 2:
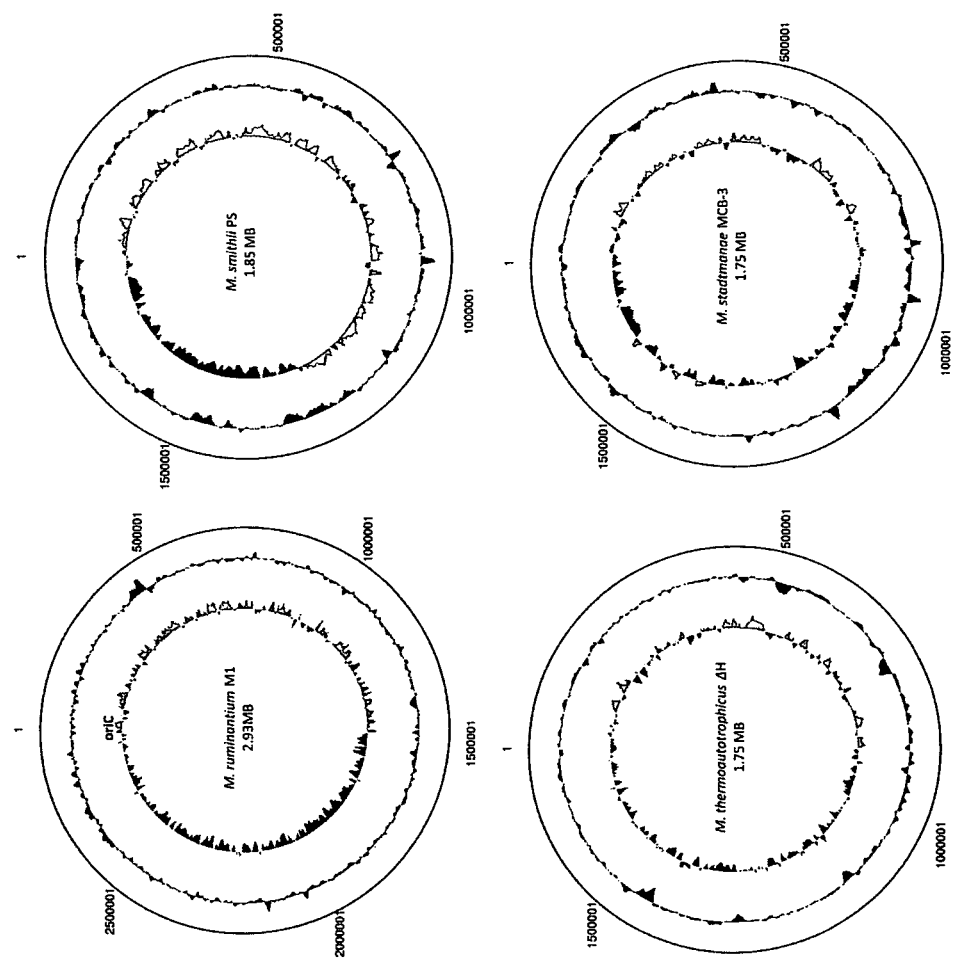
FIG. 2: GC analysis. Base-pair scale (outer circle), G+C content (middle circle) and GC skew (inner circle, (G−C/G+C), darker shade indicates values >1, lighter shade <1. Genomes of the Methanobacteriales order display a DNA skew similar to bacterial chromosomes. In *M. ruminantium* M1 the origin of replication (oriC) was identified as being immediately upstream of the Cdc6-1 gene (mru0001) based on GC skew analysis and homology to the origin of replication experimentally verified for *M. thermoautotrophicus* (Reymond et al., 2004). As with other Methanobacteriales genomes, *M. ruminantium* M1 contains a second Cdc6 homolog (mru0423). It also contains a truncated third Cdc6 homolog within the prophage sequence.

Several approaches were used to define potential gene targets from M1 for $CH_4$ mitigation via chemogenomic and vaccine approaches (FIG. 1). Genes suitable as chemogenomics targets were identified using a combination of metabolic profiling, review of the literature pertaining to the biochemistry and physiology of methanogens, and comparative genomics. The 33 candidate genes commonly identified by these approaches are shown in FIG. 1A. The full list of ORFs identified as chemogenomic targets by metabolic profiling of M1 and literature can be found in Table 5. Comparative studies were based on M1 and 26 complete and draft phase methanogen genome sequences, using a functional genome distribution (FGD) analysis (Table 3, FIG. 13). This analysis of whole genome gene conservation among methanogens showed that M1 and other members of the Methanobacteriales formed a functional cluster that shared a large number of conserved genes predicted to be involved in core biological functions (low e-value cut-off 1e-100, Table 3). In addition, a differential blast analysis (DBA) was conducted using the non-redundant (nr) database and a methanogen genome sequence database (dbMethano). The DBA analysis highlighted genes present in at least one methanogen genome within dbMethano but not present in any other organism within the nr database and vice versa (FIG. 10), thus identifying methanogen-specific genes. The majority of the 33 selected conserved and methanogen-specific genes encode enzymes that fall within the energy metabolism category, mainly within the methanogenesis pathway (Table 9). This also included several methanogenesis marker proteins found in methanogen genomes, but currently without defined function. Most of these methanogenesis enzymes are located within the cell cytoplasm, and therefore have been tagged as key targets for inhibitor discovery via a chemogenomics approach (FIG. 11).

The alternative approach of inducing the ruminant immune system to produce salivary antibodies against conserved features of rumen methanogens is an attractive methane mitigation strategy. The rumen epithelium is not immunologically active, and rumen contents do not contain complement proteins, therefore specific immune responses in the rumen do not occur. The effectiveness of a vaccination approach relies on the binding of salivary antibodies to methanogen surface features which results in their inactivation or clearance from the rumen. Vaccines are typically composed of proteins or polysaccharides derived from killed or attenuated whole cells or components presented on the outside of the cell such as flagella, capsules, cell walls, fimbrae, or secreted toxins. In the case of rumen methanogens, the primary vaccine targets are likely to be surface-exposed or membrane-associated proteins that are conserved among methanogens or archaeal species and which encode functions vital to methanogen growth and survival in the rumen. In silico analysis of the M1 ORFeome (all ORFs) identified an initial pool of 572 ORFs containing one or more transmembrane helices (TMH) or signal peptide (SP) indicating a cell membrane or cell surface location and therefore potential vaccine targets. Those ORFs with a top BLAST hit to a non-methanogen or with no homology to the nr database were removed from the analysis, as were transposase sequences (which are unlikely to represent good vaccine targets), while adhesin-like ORFs are dealt with separately above. This gave a new total of 337 ORFs. Examination of the remaining 337 ORFs, assessing their predicted function, degree of conservation among methanogens and the nature of their transmembrane structures, refined the list to 71 ORFs (FIG. 1B). Heterologous expression of membrane proteins with more than 4 TMHs has been difficult in RV studies of other microbes (Vivona et al., 2008). Therefore, a cut-off of 4 THMs was applied to define two final groups: Group A with 47 ORFs with 4 or fewer TMHs suitable for cloning and heterologous expression studies; and Group B composed of 24 ORFs with more than 4 TMHs more suitable for a synthetic peptide-directed vaccine approach.

The majority of vaccine targets identified above correspond to hypothetical proteins of unknown function. While these ORFs are presumed to be of value to M1, their importance to M1 growth and survival in the rumen is not evident, and therefore they are of lower priority as vaccine candidates. Of the remaining ORFs, those involved in energy metabolism are again prime vaccine candidates (FIG. 11). Of particular interest is the Mtr enzyme complex, which catalyses the essential methanogen function of transferring the methyl group from methyl-$H_4$MPT to CoM, coupled to the efflux of $Na^+$ ions (Lienard et al., 1996). Three of the Mtr subunits (MtrEDC) are each predicted to have >4 membrane-spanning regions and, in each of the membrane-spanning regions, the transmembrane helices have peptide loops located outside the cell membrane. These loops are potential antibody binding sites. We synthesised peptides corresponding to the loop regions of MtrE, MtrD and MtrC which were coupled to a carrier protein and then used as antigens to vaccinate sheep. The resulting immune sera bound specifically to immobilized M1 cells (FIG. 17), demonstrating the feasibility of such a peptide-directed RV approach.

Vaccine Target Identification Results

TMHMM predicted 542 ORFs to contain one or more transmembrane (TM) domains, 243 of which are also predicted to contain a signal peptide (SP). A further 30 ORFs were predicted to contain a signal peptide but no TM domain. This gave a total pool of 572 ORFs as potential vaccine candidates for the *M. ruminantium* M1 genome. Blast analyses revealed ORFs that had a top blast hit to a non-methanogen or had no homology to the NR database. These ORFs were removed from the analysis at this point as were transposase sequences (which are unlikely to represent a good vaccine target) and adhesin-like ORFs which were dealt with separately. This gave a new total of 339 ORFs. Those genes which are presently only found in *M. ruminantium* M1 and provide important information about rumen methanogens.

Methanogens are strict anaerobes and are thus present challenges for culturing in vitro and genetic techniques for validating both drug and vaccine targets particularly the Methanobacteria with their thick cell walls are still being established. As such, a further manual analysis of the 339 ORFs functions was undertaken re-examining their functional annotation, their conservation among methanogens and the prediction of their transmembrane structures and subcellular location which refined the target list to 71 ORFs which are presently specific to methanogens or archaea. Because expression can be challenging for membrane proteins, a cut-off of four TM domains was applied to expression studies of *M. ruminantium* M1 (multiple TMs can be indicative of a surface exposed protein, but conversely, they are known to impair heterologous expression in *Escherichia coli*) This resulted in a final two groups; Group A—47 vaccine targets (less than or equal to 4 TM) suitable for further cloning and expression studies and Group B—24 vaccine targets (greater than 4 TM) more suitable for a synthetic peptide directed vaccine approach. The adhesin-like ORFs were treated as a separate vaccine target list. Vaccine targets have also be disclosed in detail in U.S. 60/989,841 filed 22 Nov. 2007, and in PCT/2008/000249 filed 25 Sep. 2008, which are hereby incorporated by reference herein in their entirety.

Example 3

Overview

Genome Sequencing

*Methanobrevibacter ruminantium* was chosen for genome sequencing because of its prevalence in the rumen under a variety of dietary conditions (based on cultivation and molecular detection data), the availability of cultures, its amenity to routine growth in the laboratory, and the relatively large amount of previous studies and background literature available for this organism. A significant number of the genes within the *M. ruminantium* have been assigned a function, and have thereby allowed a detailed picture of this organism's lifestyle within the rumen. *M. ruminantium*'s dependence on simple substrates ($H_2+CO_2$, formate) and its interaction with the rumen environment via surface proteins and exopolysaccharides are important targets for inhibition. Similarly, the SPIDRs hold promise for both specific targeting of *M. ruminantium* and for future genetic manipulations to assist in determining gene function. The sequence data elucidates the metabolism of this organism and how it interacts with other microbes, and points to conserved systems and components among methanogens that can be inactivated to prevent or reduce methane formation in the rumen.

Drug Discovery for Reducing Rumen Methane Emissions

The completion of the *M. ruminantium* genome now enables the full power of '-omic' approaches to be used for developing novel drugs for reducing methane emissions. A rational drug discovery approach to the development of effective methane mitigation agents, analogous to the established approaches utilised for developing novel antibiotics against human pathogens, should proceed through several stages including: target identification; target/pathway validation; lead identification; verification of effectiveness of lead in rumen-like conditions; and ultimately, testing in animal trials (Gerdes et al. 2006; Pucci 2006; Galperin 2007). A priori, it is important to know the breadth of methanogen diversity in the rumen, and this has recently been summarised in a meta-analysis incorporating data from 14 phylogenetic studies (Janssen and Kirs, 2008). The study has shown that the vast majority of rumen archaea (92.3%) fall into three clades, the genera *Methanobrevibacter* (61.6%) and *Methanomicrobium* (14.9%) and an uncultured group termed rumen cluster C (15.8%) of as yet unknown physiology (Janssen and Kirs, 2008). Methanogens typically only account for approximately 1-4% of the total microbial community (Janssen and Kirs 2008).

Inter-genome comparisons of representative organisms, including relevant gut methanogens (e.g., *Methanobrevibacter smithii, Methanospirillim hungatei* and *Methanosphaera stadtmanae*), other rumen microorganisms (bacterial, fungal and prozoal) and mammals can aid in the identification of suitable targets (Samuel et al. 2007; Fricke et al. 2006). Overall, rumen methanogens should be somewhat easier to inhibit than bacteria, fungi or protozoa given that they are the only resident archaea in the rumen and are well known to possess several unique traits including distinctive cofactors, cell wall chemistries and lipids. Furthermore, they tend to have smaller genomes with less metabolic capability, tend to be less adaptable with fewer regulatory systems and are probably less able to develop resistance to drugs.

Given the diversity of methanogens in the rumen, the aim of developing a full spectrum anti-methanogen 'magic bullet' for complete mitigation of emissions would necessitate the targeting of enzymes that are essential to all rumen methanogens under normal rumen growth conditions. However, partial inhibition may also be desirable for extended periods of time, due to the potential decrease in the efficiency of feed conversion resulting from feedback inhibition of ruminal fermentation (Hegarty 1999; Russell and Rychlik, 2005). Significant partial reductions in methane emissions which might be more sustainable could also possibly be achievable by limiting the targeting to specific phylogenetic groups, such as the dominant Methanobrevibacteria. Methanogens grow slowly compared to rumen bacteria and are prone to being flushed out of the rumen (Janssen and Kirs 2008).

Analysis of the *M. ruminantium* genome, combined with the genome comparison and a consideration of the literature that has identified archaeal/methanogen-specific enzymes or has demonstrated the essentiality of enzymes/pathways has allowed us to generate a list of targets of interest (Tables 2 and 3, below). General targets areas include the methanogenesis pathway, energy metabolism, transcription, protein synthesis, cell wall synthesis, lipid synthesis, cofactor synthesis, and some key central carbon metabolic enzymes that are important links between essential pathways. Target prioritisation for introducing enzymes into the work stream is based on the ultimate aim of obtaining enzymes for high-throughput screening and crystal structure determinations for in silico lead identification. Targets are spread over multiple susceptible pathways to minimise risk. Prioritisation takes into consideration the presumed essentiality of target, the expected ease of expression of the proteins (e.g., size, number of subunits and presence of transmembrane domains), availability of assays, expected 'druggability' and availability crystal structures of homologous enzymes (Pucci, 2006; Hopkins and Groom, 2002).

There are several factors relevant to the development of future small molecule inhibitors of methanogens. These include that they should have minimal toxicity to the host animals, minimal accumulation or toxicity in any downstream products for human consumption, minimal deleterious effects on beneficial microorganisms responsible for normal fermentation in the rumen, and minimal downstream environmental impact. Ideally, they should also be inexpensive, given the current cost of carbon, be impervious to the large hydrolytic capacity of the rumen and should have reduced potential for allowing resistance to develop amongst the rumen methanogens. In the best circumstances, the concentration of inhibitor required should be low enough to prevent any rumen microbes from utilising the inhibitor as a substrate for growth and minimise overall costs (Weimer, 1998). It would be very beneficial if future anti-methanogen compounds that satisfy the above criteria can also help to reduce methane emissions emanating from other sources such as rice paddies. The goal of providing long term reductions in rumen methane emissions over decades will likely require a suite of non over-lapping anti-methanogen compounds. Compounds that are shown to inhibit an enzyme in an in vitro high-throughput assay should sequentially be verified for their effectiveness in pure culture experiments, followed by in vitro rumen simulations, and finally in short term and long term animal trials.

In the last decade there has been growing concern, as evidenced by recent EU legislation banning their use (McAllister and Newbold, 2008), about the use of antibiotics and other feed additives as growth promoters largely due to the development of antibiotic resistance. Consequently, even though methanogens are usually not thought to be directly implicated as a causative agent in pathogenic disease (Macario and Macario, 2008), it may be wise to avoid over-reliance on anti-methanogen agents that seek to inhibit enzymes that are common between them such as those in pseudomurein and peptidoglycan synthesis. Significantly, approximately two-thirds of antibiotics in use today against pathogenic microorganisms target cell wall synthesis, many of these the transpeptidation reaction catalysing the closure of bacterial peptidoglycan, but enzymes that catalyse earlier steps are being increasingly investigated as alternatives (Hammes et al. 1979). One of the main reasons for this is that the final steps of cell wall synthesis occurs extracellularly and are therefore the drugs are less prone to inactivation.

The recent development of an anti-*Mycobacterium tuberculosis* drug that targets the E subunit of the $F_0F_1$-ATPase that is also present in humans highlights the fact that even relatively small differences in structure could possibly be exploited to discover novel anti-methanogen compounds (Andries et al. 2005). The implication of this finding is that many essential methanogen enzymes that are not methanogen-specific. Targets that share <30-40% identity with their bacterial or eukaryal counterparts could ultimately be exploited for designing effective inhibitors.

The number of enzymes or pathways in methanogens demonstrated to be essential to help guide prioritisation of targets is relatively limited. Historically, the methanogenesis pathway itself has been targeted in numerous experiments using halogenated compounds such as chloroform that inhibit the terminal step of methanogenesis catalysed by methyl coenzyme M reductase, but these are not sustainable due to toxicity and environmental concerns (hypertext transfer protocol:///www.mafgovt.nz/mafnet/rural-nz/sustainable-resource-use/climate/green-house-gas-migration/ghg-mitigation-05.htm). In only a couple of other cases has a methanogen enzyme inhibitor been used to check whether rumen methanogen isolates hare also inhibited in pure culture, for example the targeting of the RFA-P synthase (Dumitru et al. 2003) and HMG CoA reductase with statins (Miller and Wolin, 2001). In addition, some additional understanding of growth characteristics of methanogens in the rumen may be needed. For example, researchers are still determining the extent to which rumen methanogens utilise amino acids in the rumen, which vitamins are used or enhance growth or the degree, if any, to utilise purines and pyrimidines. Thus at the moment, it may less desirable to target enzymes dedicated to the synthesis of amino acids, purines or pyrimidines.

The analysis of the M1 genome has provided new perspectives on the lifestyle and cellular processes of this prominent rumen methanogen. The genome sequence confirms the hydrogenotrophic lifestyle of M1 and gene expression data indicate that formate may be an important substrate for methanogenesis during syntrophic interaction with *B. proteoclasticus*. The ability of short chain alcohols to stimulate growth on $H_2$ but not support growth themselves is intriguing. We speculate that methanol or ethanol are oxidised by the NADP-dependent alcohol dehydrogenases and the reducing potential used to form $F_{420}H_2$ using NADPH-dependent $F_{420}$ dehydrogenase, thus augmenting the cellular pool of $F_{420}H_2$. This metabolism of alcohols could spare some of the $H_2$ or formate normally used to produce $F_{420}H_2$ and would explain the stimulation of growth by alcohols in the presence of $H_2$. The lack of a means of reducing ferredoxins with electrons from alcohols would explain why growth is not possible on alcohols alone. Further work will be required to test this hypothesis.

The abundance of genes encoding adhesin-like proteins in M1 indicates a significant ability to modulate cell surface topology. While the exact role of these proteins is currently unknown, initial observations from co-culture experiments indicate that at least some are involved in mediating close associations with hydrogen-producing bacteria in the rumen and others may be concerned with similar interactions with rumen protozoa and fungi.

The φmru prophage sequence within the M1 genome yielded the PeiR enzyme which is able to lyse methanogen cells. The variety of methanogen cell wall types means a combination of different lytic enzymes would be required for effective methanogen lysis in the rumen. However, the expression of PeiR and demonstration of its effectiveness against a major rumen methanogen is an important step towards this goal. The PeiR enzyme and the φmru phage may also be useful in increasing the permeability of M1 and other pseudomurein-containing methanogens to facilitate DNA entry and for developing tools for genetic manipulation of M1.

Methanogens are not known as producers of secondary metabolites, so the discovery of two NRPS genes was surprising, and to our knowledge, they are the first reported in an archaeal genome. Non-ribosomal peptides (NRPs) are known to contribute to microbial growth and ecological interactions and therefore their function is of interest as they could lead to a means of modulating methanogen growth.

The metabolic profiling and comparative genomics carried out in this study identified several sets of conserved, methanogen-specific genes that are currently being investigated further in our laboratory. Chemogenomic targets are being investigated via heterologous expression of genes in *Escherichia coli* coupled with the development of bioassays for screening these enzymes against libraries of chemical compounds to find specific inhibitors with efficacy at low concentrations. Vaccine candidate proteins with <4 TMHs are being investigated via heterologous expression in *E. coli* and vaccination of sheep. We have also shown the use of synthetic peptides in a reverse vaccinology approach to elicit specific antibody responses against M1 proteins with >4 TMHs. This demonstrates that membrane-embedded M1 proteins, that are unlikely to be amenable to expression in a heterologous host, are viable targets as vaccine antigens.

A wider representation of rumen methanogen genomes will be essential to verify that the selected vaccine and chemogenomics targets are conserved among other rumen methanogens, and ensure a successful, long-term $CH_4$ mitigation technology for the rumen. The wealth of biological information provided by the M1 genome represents a significant advancement for ruminant methane mitigation efforts, aimed at identifying anti-methanogen technologies' with broad efficacy.

Example 4

$A_1A_o$ ATP Synthase Cloning and Characterisation

We designed and developed an over-expression system for the $A_1A_O$-ATPase from *Methanobrevibacter ruminantium* and *Methanobrevibacter smithii* to allow the subsequent purification and characterisation of the $A_1A_O$-ATPase. *Methanobrevibacter ruminantium* and *Methanobrevibacter smithii* PCR Cloning And Introduction of Hexa-his Tag by PCR Overlap Extension To study the biochemical properties of the *M. ruminantium* $A_1$-ATPase, we prepared inverted membrane vesicles and tested for ATP hydrolysis activity. We were unable to detect any significant levels of ATP hydrolysis activity from inverted membrane vesicles of *M. ruminantium*. Due to the limited amount of cells that can be prepared at any given time for *M. ruminantium*, we undertook a heterologous over-expression approach to produce the $A_1$-ATPase. For this, we cloned the *M. ruminantium* $A_1$-ATPase genes as a 6.3 kb BamH1-Xba1 PCR product into the expression vector pTrc99a, generating plasmid pTrMbrA1. To insert the HIS-tag at the N-terminal of Subunit-A PCR overlap extension was conducted. Using this approach, we generated a clone named pTrMbrA1HIS which contains the genes encoding for the *M. ruminantium* $A_1$-ATPase in the *E. coli* expression vector pTrc99a, and introduced a Hexa-Histidine tag onto the N-terminal of Subunit A. We also cloned the $A_o$ genes with the $A_1$ genes to construct a full-length $A_1A_o$ ATP synthase expression plasmid. This was named pTrMbbr$A_1A_o$His9. In addition, we cloned the $A_1$-ATPase of *Methanobrevibacter smithii* as a 6.3 kb PCR product into the *E. coli* expression vector pTrc99a generating the plasmid pTrMbsA1. To facilitate purification, we introduced a Hexa-Histidine tag onto the N-terminal of the *M. smithii* Subunit-A by PCR overlap extension. This was named pTrMbsA1HIS. The lists of primers and plasmids from this study are shown below.

Primers

| Primer Name | Primer | Modifications | SEQ ID NO: |
|---|---|---|---|
| MbrA1FWD | AAATTTGGATCCGGAATCTTAGGTTAGGAGGTCAAT | (BamHI) | 7590 |
| MbrA1REV | AAATTTTCTAGATAACAAGCAAAATATGAATTGC | (XbaI) | 7591 |
| MbrA1HisFWD | ATGCATCATCATCATCATCATAGAGGAACTCAAATGTATGAA | HEXA-HIS TAG | 7592 |
| MbrA1HisREV | ATGATGATGATGATGATGCATCCCATCTGCGACGATAACAGG | HEXA-HIS TAG | 7593 |
| MbrA1His_MID | TTAGACAAGTTCTTAGTCGACTCTG | (Sal) | 7594 |
| MbrAOREV | AGAGACAATTTTATCTGCCCCAGAGCTCAT | (Sac) | 7595 |
| MbrA1FWD | ATTTAATTACCATGGTGATTTATTATGGCA | (Nco) | 7596 |

-continued

| Primer Name | Primer | Modifications | SEQ ID NO: |
|---|---|---|---|
| MbrA1ASeq1 | ATTGCAGGTCCTGTTATCGTC | | 7597 |
| MbrA1ASeq2 | GGACATTCCACTTATTACCGC | | 7598 |
| MbrA1ASeq3 | ACTTATCCGAACCGGTTACTC | | 7599 |
| MbsA1FWD | AAATTTTAAGGATCCAATCTGTATGAGCTCAG | BamHI | 7600 |
| MbsA1REV | AAATTTGTCGACCAATTACACAAAAAGATGAGCCGTTAC | SalI | 7601 |
| MbsA1HisFWD | ATGATTCATCATCATCATCATCATATCGAAGGAAAAATTATTAAA | HEXA-HIS TAG | 7602 |
| MbsA1HisREV | ATGATGATGATGATGATGAATCATTTAACCATCTCTACCCCAATA | HEXA-HIS TAG | 7603 |
| MbsA1_AatIIREV | ATTTATCCACATATGGACGTCCTTTCCTTA | (AatII) | 7604 |
| MbsA1Seq1 | CCTCTGAAGGATCATCTGAT | | 7605 |
| MbsA1Seq2 | AGCATTGCTTCTGAAGGTGAA | | 7606 |
| MbsA1Seq3 | GAGTAAACACTATTGGTACTA | | 7607 |

Plasmids

| Plasmid Name | Details | Features |
|---|---|---|
| pTrMbrA1 | *Methanobrevibacter ruminantium* $A_1$-ATPase cloned into expression vector pTrc99a as a 6.3 kb Bam/Xba fragment | |
| pTrMbrA1HIS | *Methanobrevibacter ruminantium* $A_1$-ATPase, cloned into expression vector pTrc99a as a 6.3 kb Bam/Xba fragment. N-terminal Hexa-Histidine tag on Subunit A | Hexa-His Tag |
| pTrMbrA1AO | *Methanobrevibacter ruminantium* $A_1A_o$-ATPase cloned into expression vector pTrc99a as a Nco/Xba fragment. N-terminal Hexa-Histidine tag on Subunit A | Hexa-His Tag |
| pTrMbsA1 | *Methanobrevibacter smithii* $A_1$-ATPase cloned into expression vector pTrc99a as a 6.3 kb Bam/Sal fragment | |
| pTrMbsA1HIS | *Methanobrevibacter smithii* $A_1$-ATPase cloned into expression vector pTrc99a as a 6.3 kb Bam/Sal fragment. N-terminal Hexa-Histidine tag on Subunit A | Hexa-His Tag |

Over-Expression and Purification of pTrMbrA1HIS and pTrMbsA1HIS as Analysed by Western Blotting As noted above, we generated a clone named pTrMbrA1HIS which contains the genes encoding for the *M. ruminantium* $A_1$-ATPase in the *E. coli* expression vector pTrc99a, and introduced a Hexa-Histidine tag onto the N-terminal of Subunit A. We expressed the plasmid pTrMbrA1HIS in the *E. coli* strain DK8, and purified the expressed protein complex by Ni-affinity chromatography. We were able to detect Subunit-A via both Western and MALDI-TOF/TOF analysis. Subunit-A was found to be running at an incorrect molecular mass of approximately 24 kDa compared to the 65 kDa predicted molecular mass. We found that this discrepancy was caused by a mutation within Subunit-A. This mutation has now been corrected, and we have repeated the over-expression and purification with the new construct. Furthermore, we have also created a clone to express the full length $A_1A_O$-ATPase in *E. coli*. The purification and characterisation of the $A_1A_O$-ATPase from *M. ruminantium* has proceeded accordingly.

From Western analysis of the *M. smithii* over-expression, two dominant bands can be observed. One protein band runs above the 72 kDa marker, and the other runs at approximately 33 kDa. The expected size of the *M. smithii* Sub-unit-A is 64.8 kDa, therefore the protein band running at approximately 72 kDa is likely the *Mbb. smithii* Subunit-A, and the lower band running at 33 kDa is likely a breakdown product, or unassembled Subunit-A which still retains the HIS-tag. We are proceeding to further purify the Ni-affinity eluted fractions, through either PEG-fractionation or gel filtration with the aim to remove the lower contaminating band, while still retaining $A_1$-ATPase activity. We have assayed the ATPase activity of the eluted *M. smithii* $A_1$-ATPase and found the sample to hydrolyse with a specific activity of approximately 0.4 Units/mg.

*Mbb. ruminantium* $A_1A_o$ ATP Synthase Expression in a Foreign Host

Figure 24:
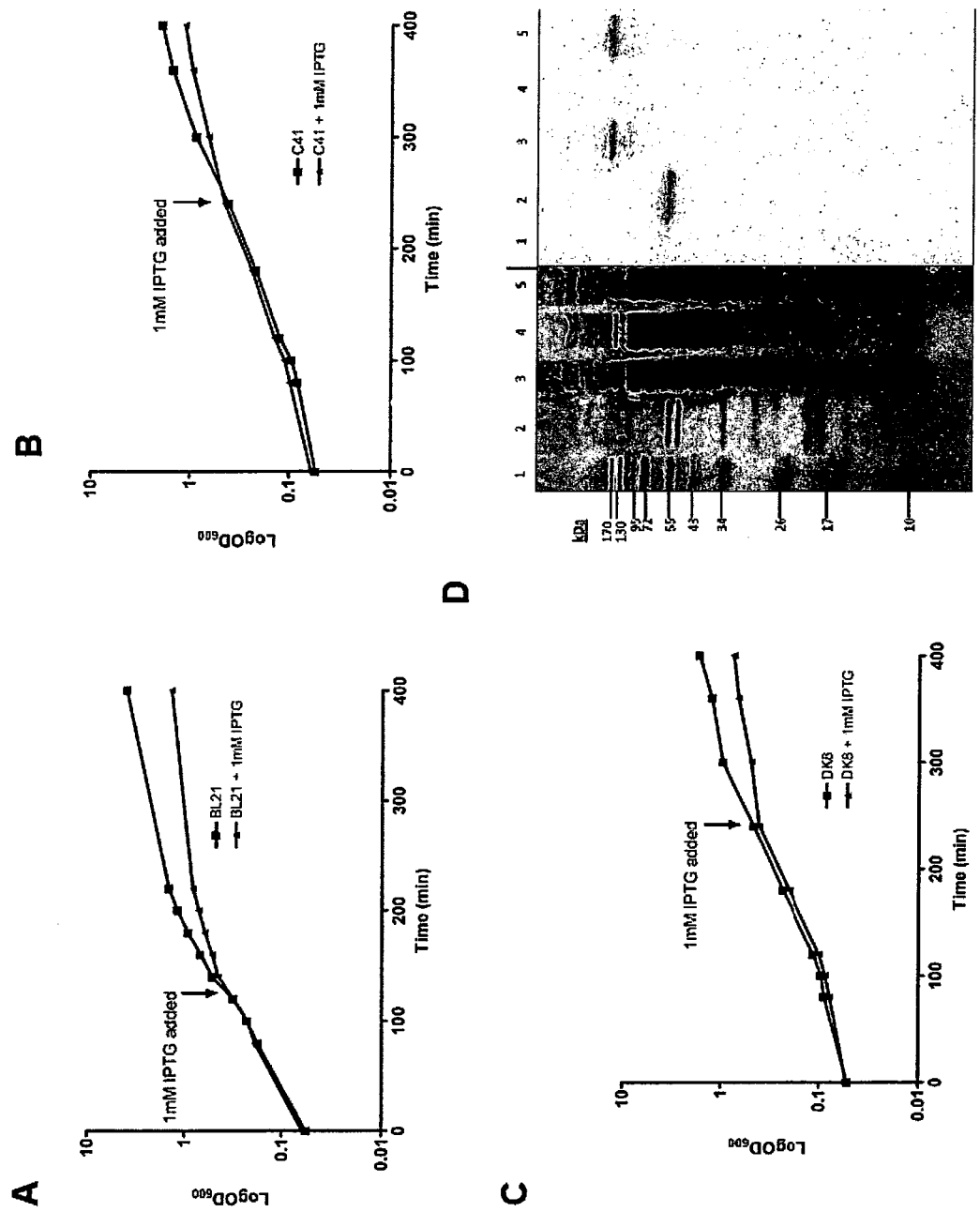

The *Mbb. ruminantium* $A_1A_O$-ATPase was expressed in *E. coli* strains DK8 (Δatp), BL21 and C41 (FIG. 24A-D). All strains showed a decrease in growth after induction of expression with 1 mM IPTG. BL21 showed the best growth (FIG. 24A) and expression of the $A_1A_O$-ATP synthase and therefore was chosen as a suitable expression host for subsequent purification. Growth of the induced cultures (BL21, C41 or DK8/pIrMbbr$A_1A_o$His9) is at a reduced rate compared to the non-induced control culture in all 3 strains (see FIG. 24A-C), a phenomenon that is a good indication of foreign protein over-expression in *E. coli*. To examine the localization of the recombinant $A_1A_O$-ATP synthase in *E. coli* the cell debris, cytoplasm and membranes were examined by SDS-PAGE and immunoblotting. Purified $F_1F_o$-ATPase (his-tag on β-subunit) from TA2.A1 enzyme was used as a positive control (FIG. 24D). The enzyme was localized in the membranes and not in the cytoplasm indicating the presence of a properly assembled enzyme. pTrMbbr$A_1A_o$His9 was able to be expressed in *E. coli* strains BL21, C41 or DK8, with the best growth and overexpression in BL21 (data not shown). These results also show the $A_1A_O$-ATP synthase is specifically localizing to the membrane preparation in both BL21 and DK8 cells.

Extraction of the $A_1A_O$-ATP Synthase from Cell Membranes

Figure 25:
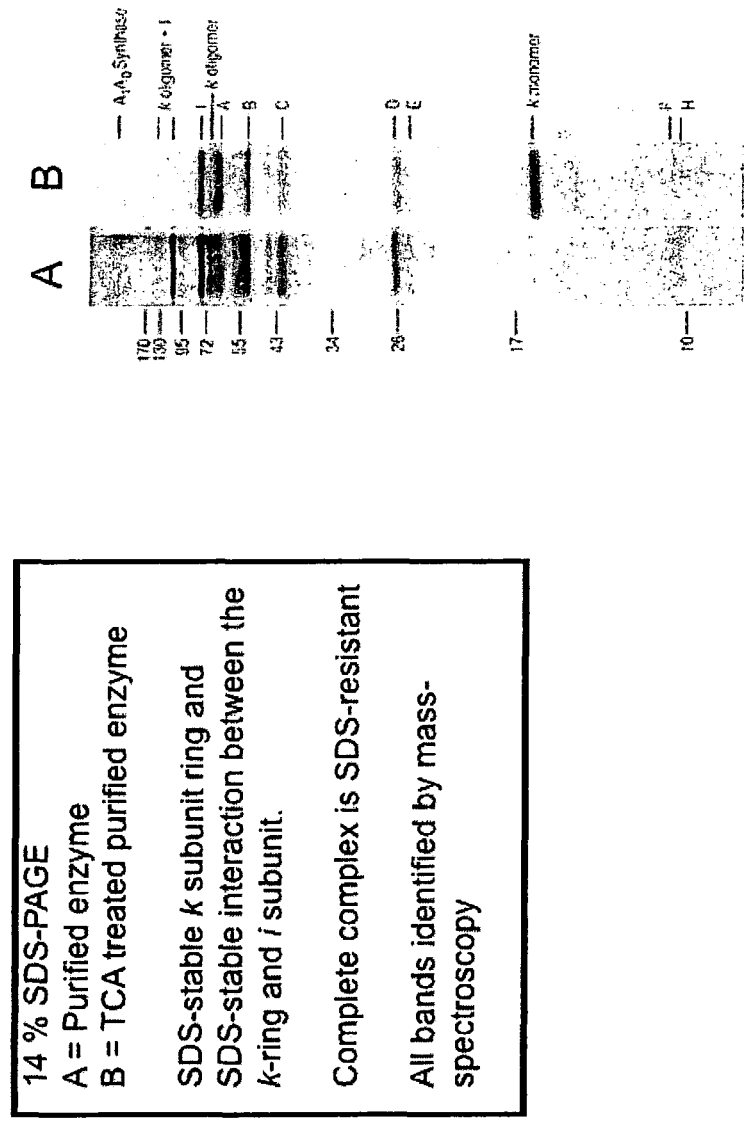
Figure 26:
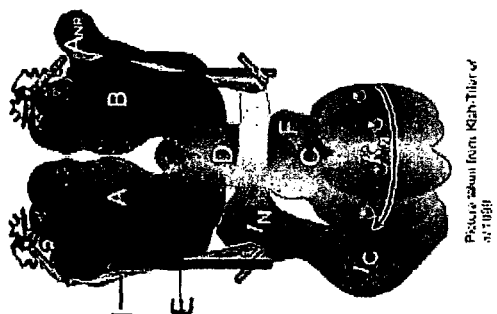

The *Mbb. ruminantium* $A_1A_O$-ATPase was expressed in the *E. coli* DK8 (Δatp) and BL21 (FIG. 24A-D). Previously, we were able to solubilize the *Mbb. ruminantium* $A_1A_o$ using 2% DDM, and we are able to semi-purify the *Mbb. ruminantium* $A_1A_o$ ATP synthase by exploiting the introduced hexa-histidine tag on the A subunit (elution at 120 mM imidazole, see FIG. 25). However, solubilisation was considered limited with only about 40% of the tagged protein being extracted from membranes. Therefore, to determine the detergent with the optimal solubilisation effect, *E. coli* BL21 inverted membrane vesicles were diluted in solubilisation buffer supplemented with different detergents to concentrations of 0.5, 1, 2 or 4%, and a concentration of 5 mg protein/ml. Solubilisation was performed under gentle stirring overnight at 4° C. or at room temperature with DM, DDM, Triton X-100, Cymal-6, CHAPS, cholate, octylglucoside and fos-choline. SDS was used as a positive control as it solubilized 100% of the membranes. The soluble and insoluble fractions were analyzed by SDS-PAGE and immunoblotting. Comparison of the immunoblots revealed that fos-choline had the best solubilisation effect (90-100%), followed by DDM (40%), DM (35%) and cymal-6 (39%). Triton X-100 and octylglucoside were weak (>20%). CHAPS and cholate led to a significant degradation of the enzyme (a smear) and were therefore not feasible. However, after activity was measured of the solubilized membrane protein, the best detergent was DDM or cymal-6 both liberating 40% of the ATPase and maintaining activity the highest activity. The Fos-choline samples did not contain enzyme activity regardless of concentration.

Purification of the *Mbb. ruminantium* $A_1A_o$-ATPase

BL21 containing pTrMbbr$A_1A_o$His9 induced with 1 mM IPTG and expression conducted for 4 hours at 37° C. Membranes were prepared by French-press, and solubilized with 2% DDM at 4° C. overnight in the presence of 0.1% TCEP (a reductant). The purification was then routinely performed by IMAC and the bound protein subjected to 10, 20, 40 then 60 mM imidazole wash steps before elution at 100 mM imidazole. It should be noted that elution of a significant amount of $A_1A_o$ protein is observed at 60 mM imidazole, however to ensure a very clean preparation this step was essential to remove contaminating proteins. To remove additional contaminants, the eluant was PEG-precipitated for 1 h at room temperature with 10% $PEG_{6000}$ followed by 15% $PEG_{6000}$. The first step precipitation removed contaminating proteins (fraction split), the second precipitates the $A_1A_o$ ATPase.

Figure 27:
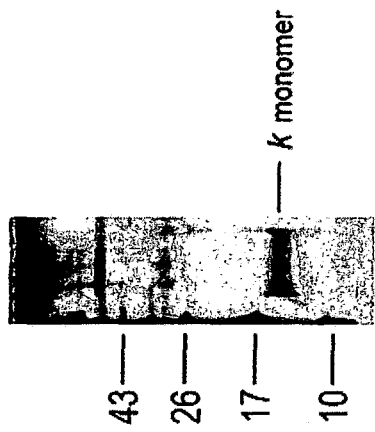
Figure 28:
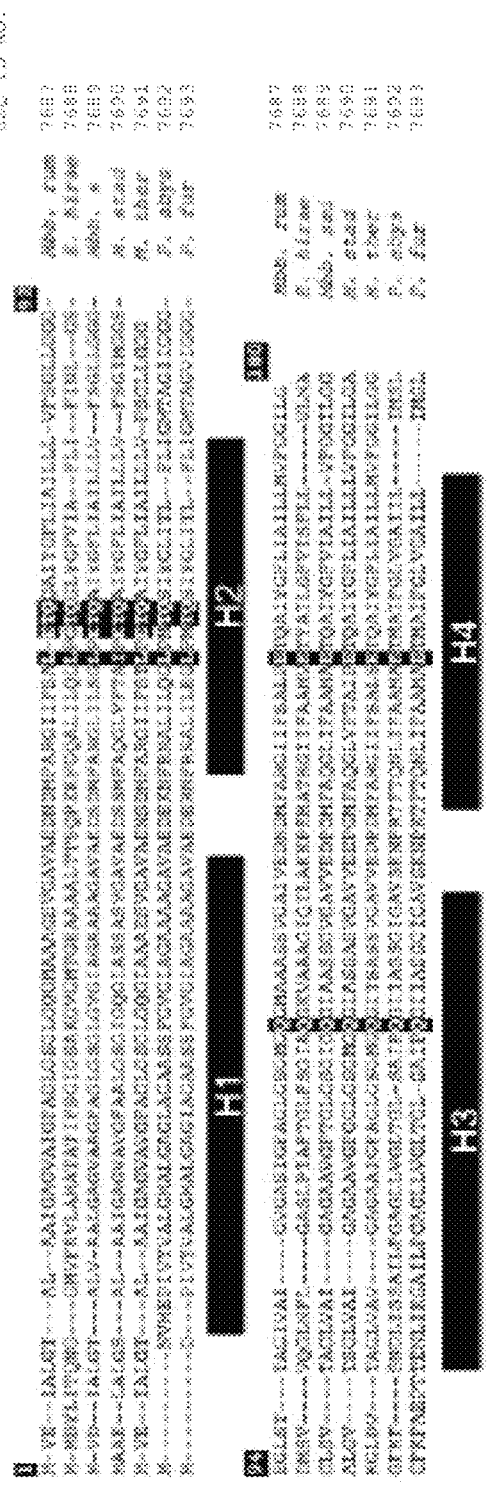

The purified *Mbb. ruminantium* $A_1A_o$-ATPase contained all 9 subunits, which was confirmed by MS/MS (FIGS. 25A and B). The K-subunit appears both as a monomer and as an oligomer on a 14% SDS-PAGE gel. When this enzyme preparation was TCA-treated, the oligomers were no longer seen, and a strong band of the K monomer was observed. This observation is indicative of an SDS-stable K ring. This was further confirmed by isolation of monomers of the K-subunit by methanol/chloroform extraction (FIG. 27). This K ring preparation is being used for antibody trials.

Purified *Mbb. ruminantium* $A_1A_o$ ATP Synthase Characterization

Two enzyme preparations were studied. Purified ATP synthase from BL21 and recombinant enzyme expressed in *E. coli* DK8 membranes. Purified $A_1A_o$ ATP synthase was examined for ATPase activity using the inorganic phosphate assay. After examining current literature on the *Methanosarcina mazei* and *Methanococcus jannaschii* $A_1A_o$ ATP synthases, it was decided to examine activity at 39° C. and a pH value of 6.5 in a buffering system that mimics the $Na^+$ concentration in the rumen (70-137 mM $Na^+$).

Figures 1, 29:
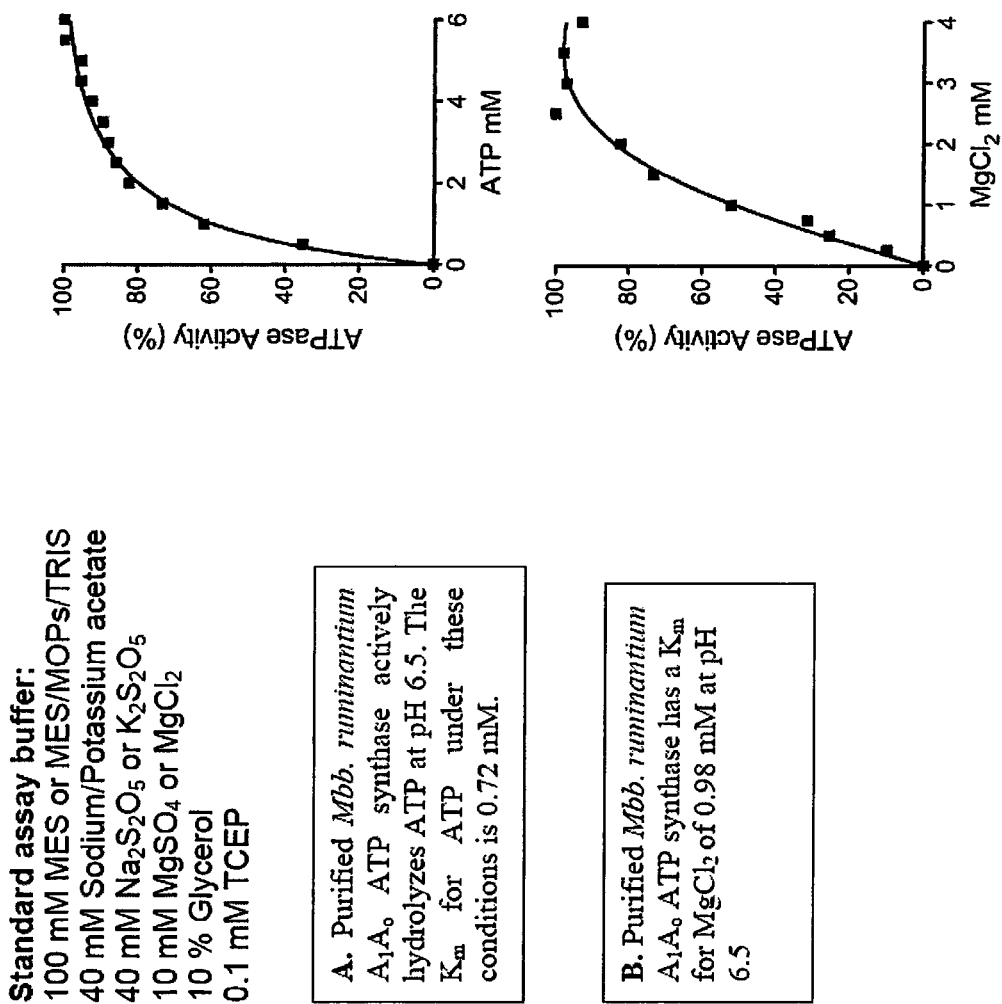
Figures 2, 29:
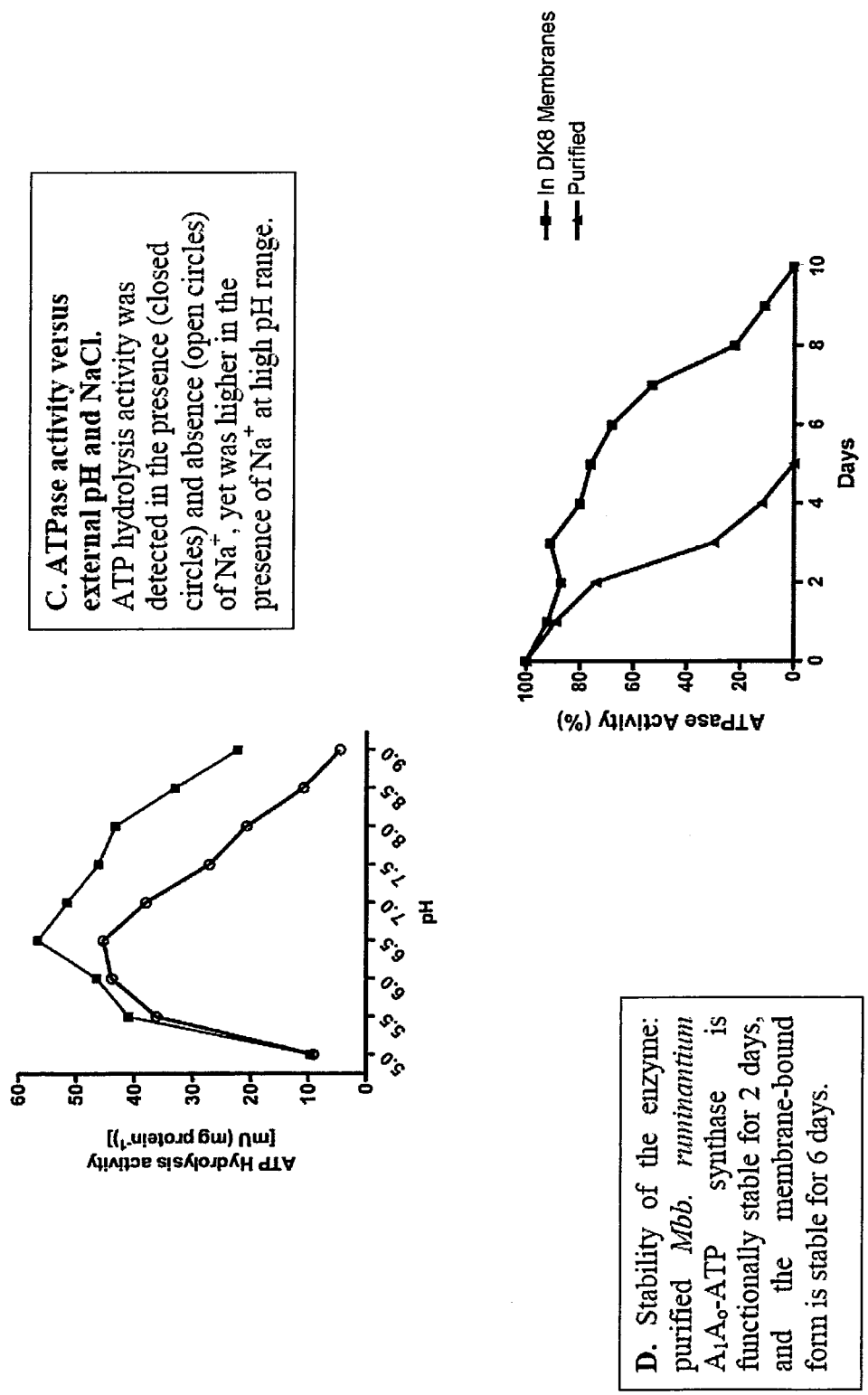

To determine the kinetics of ATP hydrolysis, the reaction was started at 39° C. by addition of $Na_2$-ATP to a final concentration of 2.5 mM. 16 µg of protein was used in each end-point assay. Background ATPase activity generated by thermal hydrolysis of ATP or contaminant ATP in buffer or enzyme was subtracted (these totaled <5% of the final value shown; FIG. 29A). The influence of $Mg^{2+}$ on the kinetics of ATP hydrolysis was also evaluated. The reaction was started by addition of Tris-ATP to a final concentration of 2.5 mM. 16 µg of protein was used in each end-point assay. Background ATPase activity generated by thermal hydrolysis of ATP or contaminant ATP in buffer or enzyme was subtracted (these totaled <5% of the final value shown; FIG. 29B).

ATPase activity was tested over a pH value range from 5.5 to 8.5 and in presence and absence of $Na^+$ using the purified recombinant $A_1A_o$-ATPase. The reaction was started at 39° C. by addition of $Na_2$-ATP or Tris-ATP to a final concentration of 2.5 mM. 16 µg of protein was used in each end-point assay. Background ATPase activity generated by thermal hydrolysis of ATP or contaminant ATP in buffer or enzyme was subtracted (these totaled <5% of the final value shown; FIG. 29C). The stability of the purified and membrane-bound (in DK8 membranes) *Mbb. ruminantium* $A_1A_o$ ATP synthase was also tested. ATPase activity was examined each day after the preparation of either purified recombinant or DK8 membrane bound *Mbb. ruminantium* $A_1A_o$ ATP synthase. The reaction was started at 39° C. by addition of $Na_2$-ATP to a final concentration of 2.5 mM. 16 µg of purified protein or 0.5 mg inverted membrane vesicles was used in each end-point assay. Background ATPase activity generated by thermal hydrolysis of ATP or contaminant ATP in buffer or enzyme was subtracted (these totaled <5% of the final value shown; FIG. 29D).

To gain insight to whether the purified or membrane-bound *Mbb. ruminantium* $A_1A_o$ ATP synthase is functionally coupled to an ionic driving force ($H^+$ or $Na^+$), tributylin (TBT) was tested as an inhibitor. TBT is a well characterized $F_o$ and $A_o$ channel inhibitor of ATP synthases. To examine the coupling ion used by the *Mbb. ruminantium* $A_1A_o$ ATP synthase, the effect of amiloride, a known $Na^+$-coupled V-type ATPase and $Na^+$ channel inhibitor was also examined.

Figures 1, 30:
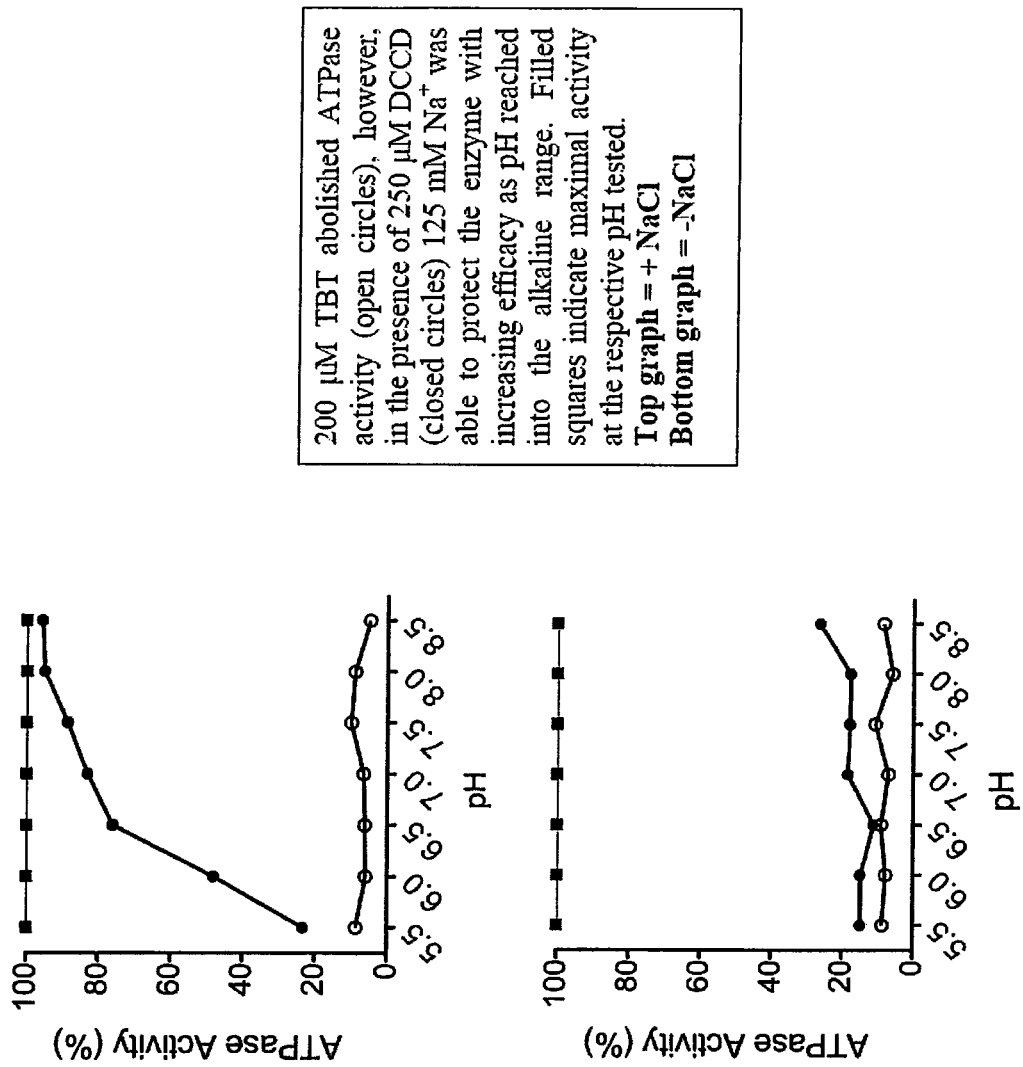
Figures 2, 30:
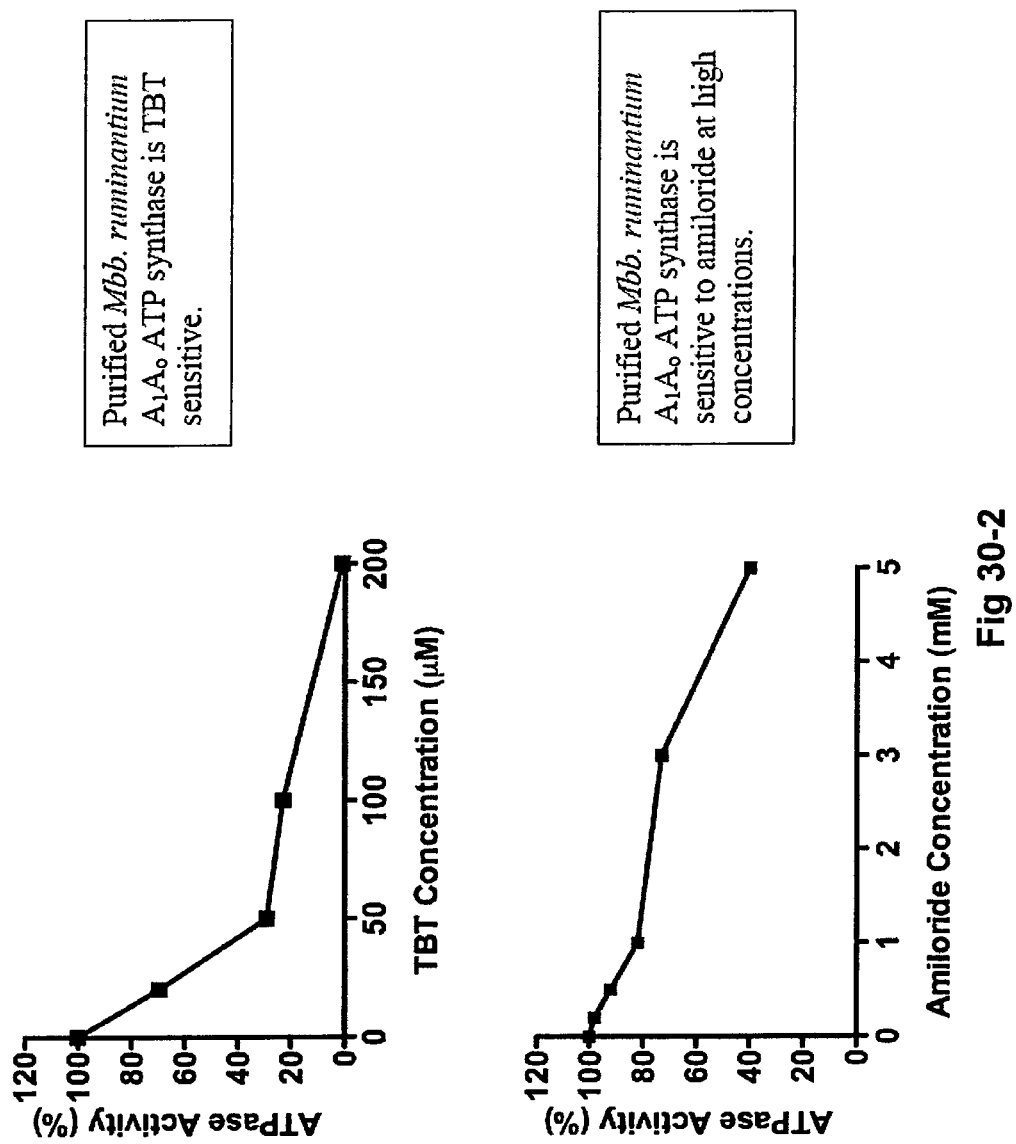

The effects of TBT and DCCD on ATPase activity were investigated as follows. *E. coli* DK8 (Δatp) inverted membranes containing the recombinant $A_1A_o$-ATPase were used to determine the effects of the inhibitors TBT (200 µM) and DCCD (250 µM) at different pH values. ATPase activity was measured in presence of 130 mM $Na^+$ (FIG. 30A) and in absence of $Na^+$ (FIG. 30B). After preincubation with the inhibitor for 20 min at room temperature (TBT or DCCD), the reaction was started at 39° C. by addition of $Na_2$-ATP or Tris-ATP to a final concentration of 2.5 mM. 0.5 mg inverted membrane vesicles was used in each end-point assay. Background ATPase activity generated by thermal hydrolysis of ATP or contaminant ATP in buffer or enzyme has been subtracted (these totaled <5% of the final value shown; FIGS. 30A and 30B).

Tributylin inhibition of ATP hydrolysis by purified recombinant *Mbb. ruminantium* $A_1A_o$ ATP synthase was then evaluated. After preincubation with the inhibitor tributylin (TBT) for 20 min at room temperature, the reaction was started at 39° C. by addition of $Na_2$-ATP to a final concentration of 2.5 mM. 16 µg of protein was used in each end-point assay. Background ATPase activity generated by thermal hydrolysis of ATP or contaminant ATP in buffer or enzyme was subtracted (these totaled <5% of the final value shown; FIG. 30C). Amiloride inhibition of ATP hydrolysis of the *Mbb. ruminantium* $A_1A_o$ ATP synthase was evaluated next. After preincubation with the inhibitor tributylin (TBT) for 20 min at room temperature, the reaction was started at 39° C. by addition of $Na_2$-ATP to a final concentration of 2.5 mM. 16 µg of protein was used in each end-point assay. Background ATPase activity generated by thermal hydrolysis of ATP or contaminant ATP in buffer or enzyme was subtracted (these totaled <5% of the final value shown; FIG. 30D).

Figure 31:
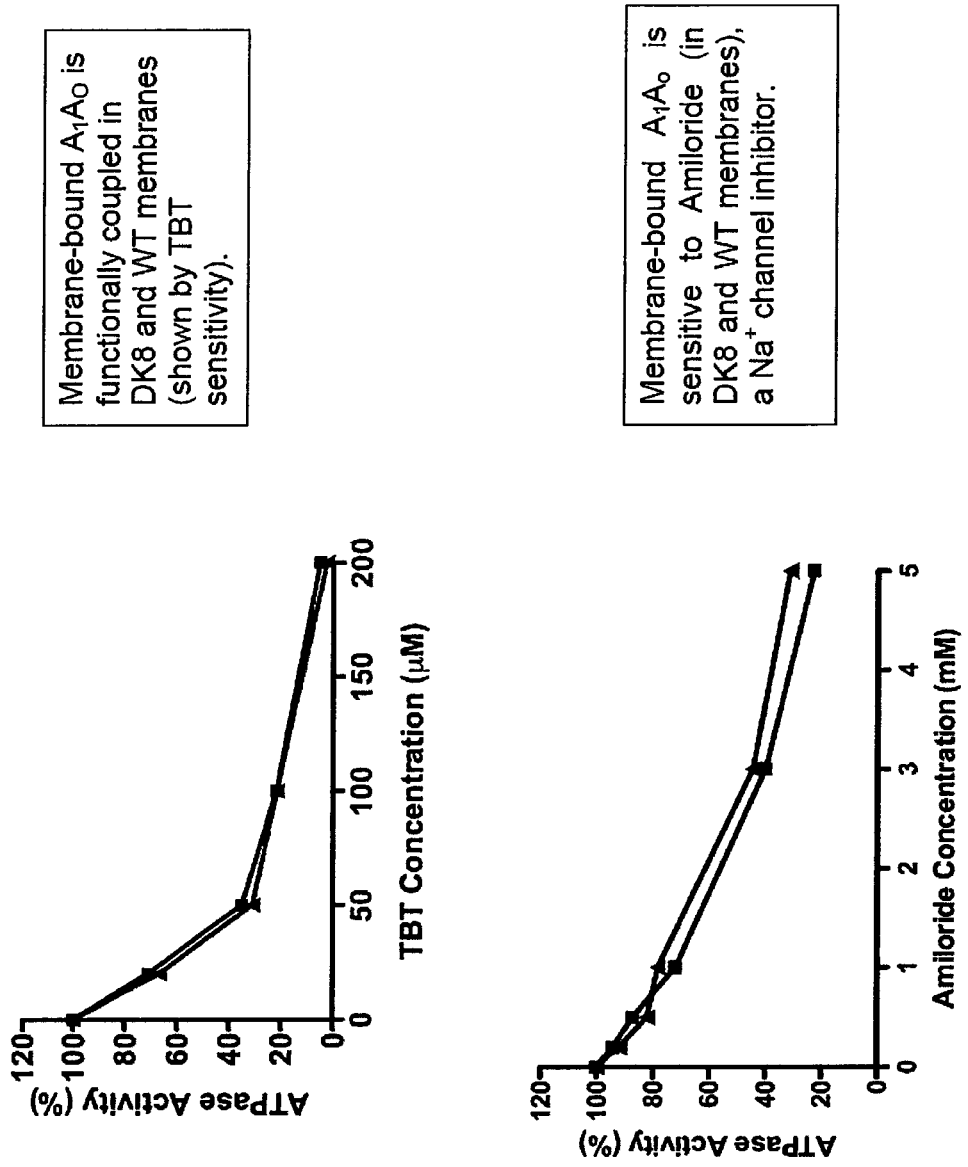

Tributylin inhibition of ATP hydrolysis by the *Mbb. ruminantium* $A_1A_o$ ATP synthase was also tested in DK8 and native membranes. After preincubation with the inhibitor tributylin (TBT) for 20 min at room temperature, the reaction was started at 39° C. by addition of $Na_2$-ATP to a final concentration of 2.5 mM. 0.5 mg inverted membrane vesicles was used in each end-point assay. Background ATPase activity generated by thermal hydrolysis of ATP or contaminant ATP in buffer or enzyme was subtracted (these totaled <5% of the final value shown; FIG. 31A). Amiloride inhibition of ATP hydrolysis of purified recombinant *Mbb. ruminantium* $A_1A_o$ ATP synthase was further tested in DK8 and native membranes. After preincubation with the inhibitor tributylin (TBT) for 20 min at room temperature, the reaction was started at 39° C. by addition of $Na_2$-ATP to a final concentration of 2.5 mM. 0.5 mg inverted membrane vesicles was used in each end-point assay. Background ATPase activity generated by thermal hydrolysis of ATP or contaminant ATP in buffer or enzyme was subtracted (these totaled <5% of the final value shown; FIG. 31B).

Figure 32:
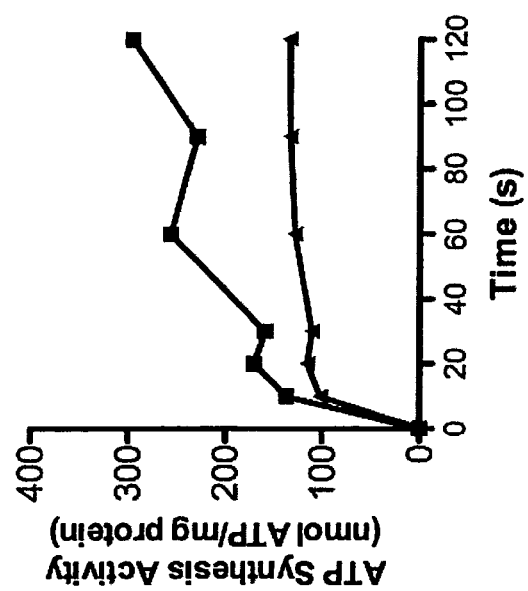

ATP synthesis in *E. coli* DK8 inverted membrane vesicles was further evaluated. Time-course of ATP synthesis was assessed at pH 6.5, 125 mM $Na^+$ and 39° C. with 0.5 mg of inverted membrane vesicles using the ATP synthesis inverted membrane vesicle assay using NADH as a driving force. Membranes were preincubated for 2 min with 2.5 mM NADH with stirring before the reaction was initiated using 0.75 mM ADP and 2.5 mM $P_i$. Closed squares with no DCCD; closed triangles, a 20 min preincubation with 250 µM TBT (FIG. 32).

Overview

We have successfully cloned, expressed and characterized the $A_1A_o$-ATP synthase from *Mbb. ruminantium*. SDS-PAGE revealed 9 subunits and an SDS-stable K ring, which was purified. The $A_1A_o$ synthase is active in both synthesis and hydrolysis, but the enzyme activities can be improved. This is consistent with other published $A_1A_o$-ATP synthases from methanogens. The coupling ion for the enzyme is being identified with studies suggesting both $H^+$ and $Na^+$ ions being important. ATP hydrolysis activity is sensitive to TBT, DCCD, and amiloride in high concentrations, suggesting these inhibitors will be ineffective against the growth of methanogens, hence the need to find a better inhibitor.

We will proceed to test antibodies generated towards the $A_1A_o$-ATP synthase in sheep against the purified enzyme in a Western blot. The antibodies have been directed against the soluble $A_1$ part of the enzyme and therefore are probably inaccessible during growth inhibition studies. This suggests that targeting the $A_1$ portion will be ineffective. We will also use the membrane-embedded sector (K ring) of the enzyme for new sheep antibody trials. This component would be accessible in the whole cell, so could be very useful as a target. We will also use the recombinant enzyme to identify inhibitors of activity using LOPAC1280™ which is a versatile compound library for assay validation and high throughput screening.

Example 5

Cloning and Expression of Non-Ribosomal-Peptide-Synthase (NRPS) Genes

Experiments are being performed to obtain expression of full-length NRPS genes, isolate the expression product and submit for structural determination and activity testing. Two non-ribosomal peptide synthetase gene sequences have been identified in *M. ruminantium* M1 (Leahy et al., 2010). We have been able to clone and amplify most of the functional modules of the NRPS1 gene of *M. ruminantium*. This allows us to investigate the substrate specificity and mode-of-action of individual NRPS domains. We have also completed the design and in vitro assessment of predicted synthetic peptides from both the NRPS1 and NRPS2 gene products from *M. ruminantium* M1. The unexpected outcomes of these experiments (an opposed reaction to known siderophores) has prompted significant interest in the nature of these NRPs and their native molecular structure.

We have shown the presence of the native NRPs in *M. ruminantium* M1 growth supernatant, and are obtaining further information on secondary and tertiary native structures and on any further modification to the peptide backbone, such as cyclisation or acylation. Therefore, expression of full length NRPS genes in a heterologous expression system will give us an opportunity to purify the active peptide compounds synthesized and make the genes available for large scale production.

Suitable primer sets were designed to ensure full length amplification and subsequent cloning into suitable expression systems. We have obtained full length amplification of the M1 NRPS2 gene and are carrying out further experiments to clone this amplicon into a vector system. Small amounts of NRPS1 from M1 have been amplified and inserted into entry vectors. These vectors are now being sequenced to confirm that the inserted amplicons reflect the NRPS gene and are free of non-silent nucleotide mutations.

We are also synthesizing NRPS genes using GeneArt's gene optimization service. This optimization not only adapts codon usage to the heterologous expression host *E. coli* but also accounts for factors that may compromise the stability of mRNA, such as extreme GC content, ribosomal binding sites, repeats and secondary structures. Substrate feeding studies with *E. coli* crude extract and *E. coli* II *M. ruminantium* crude extract mix will be carried out to evaluate the amount of functional NRPS units. Biological active NRP molecules will subsequently be detected using the CAS colorimetric assay.

We are also working to induce gene expression by providing a range of stimuli (i.e., increasing amounts of ion chelators) in the growth medium and monitor gene expression levels. An alternative approach to isolate the non-ribosomal peptides is to identify induction conditions of the NRPS genes via Northern Blot analyses. Induction of those genes will lead to increased mRNA levels, more active NRPS units and, subsequently, more NRP molecules in the growth supernatant. Based on our preliminary results reported earlier, we have identified two initial stress conditions to test. The interaction of NRP1 and 2 with Chrome Azure S (CAS) and Fe-ions, make iron scavengers and chelators such as Desferal and EDTA prime candidates for initial induction testing. The addition of both compounds to the growth medium may trigger the NRPS sensor system and cause elevated gene expression.

For these experiments, *M. ruminantium* M1 was grown to an $OD_{600}$ of 0.1 and then aliquoted in 5 mL amounts into anaerobic tubes. Different concentrations of EDTA and Desferal were added to the cultures. Each culture was sampled at 1, 2, and 4 hours and overnight after the addition of EDTA or Desferal. Samples were centrifuged to pellet the cells, supernatant was removed and the samples stored at −80° C. Subsequently, total RNA has been isolated and tested for integrity. To test semi-quantitatively the level of gene expression, RNA dilution series for each sampled time point and each inducer concentration will be established in a Northern Dot Blot system.

Three different probes have been designed targeting one house-keeping gene as positive control, and both NRPS genes. We are currently in the process of labelling these probes and will commence testing. When appropriate induction conditions have been established, we will purify the native non-ribosomal peptides from *M. ruminantium* culture supernatant using HPLC and assess for functionality using CAS assays. Furthermore, purified NRPs will be subjected to structural analyses were possible. A comparison between the non-ribosomal peptides from *M. ruminantium* and those purified from the heterologous gene expression system will allow upscaling the production of NRPs and derivatives thereof.

Example 6

Vaccination of Sheep Using Candidate Proteins Identified from the *M. ruminantium* Genome and Other Rumen Methanogens Experiments are being performed to use up to ten selected gene targets from *M. ruminantium* for heterologous expression, vaccinate sheep and test resulting serum antibodies against methanogen cultures. The first step in identifying candidate proteins for vaccine development is to determine which *M. ruminantium* proteins are cell surface-located and potentially accessible to antibody binding. In silico analysis of the *M. ruminantium* M1 open reading frames (ORFs) identified an initial pool of 572 ORFs containing one or more transmembrane helices (TMH) or signal peptide (SP) indicating a cell membrane or cell surface location. Those ORFs with a top BLAST hit to a non-methanogen or with no homology to the non-redundant database were removed and adhesin-like ORFs were dealt with separately. This gave a new total of 337 ORFs. Examination of the remaining 337 ORFs, assessing their predicted function, degree of conservation among methanogens and the nature of their transmembrane structures, refined the list to 71 ORFs (Leahy et al., 2010). Heterologous expression of membrane proteins with more than 4 TMHs has been difficult in reverse vaccinology studies of other microbes, so a cut-off of 4 THMs was applied to define two final groups: Group A with 47 ORFs with 4 or fewer TMHs suitable for cloning and heterologous expression studies; and Group B composed of 24 ORFs with more than 4 TMHs more suitable for a synthetic peptide-directed vaccine approach (see below).

*M. ruminantium* Surface and Membrane Proteins Selected as Vaccine Targets

| Functional Category and Locus tag | Annotation |
|---|---|
| Energy Metabolism | |
| mru0697 | AhaK |
| mru1405*, 1406*, 1407, 1408, 1411, 1412 | EhaHGFEAB |
| mru2006, 2007, 2008, 2010, 2012, 2013 | EhbIHGECB |
| mru1917, 1918, 1921*, 1922*, 1923* | MtrGFCDE |
| Protein Fate | |
| mru0239 | SecG |
| mru0482 | SecE |
| mru1234* | type IV leader peptidase family protein |
| Vitamins & Cofactors | |
| mru0540 | CbiN1 |
| Hypothetical | |
| mru0542*, 0840*, 1693, 2156*, 0233, 0234*, 0330, 1021, 1144, 1231, 1480*, 1585, 1635*, 1955, 2015*, 2046*, 2056, 2146* 0529 0081, 0196, 0225*, 0328*, 0412, 0428*, 0499, 0596, 0597, 0693, 0832, 1098, 1385, 0147, 0377*, 1375*, 1641, 0543, 0833, 1991, 0545*, 0716*, 0718*, 0838, 0968, 1232, 1550, 1884*, 2202, 1694 | Hypothetical proteins |

*ORFs ≥ 5 TMHs

Many of these candidate genes correspond to proteins whose function is under investigation. However, some are involved in energy production and are therefore prime candidates for vaccine development (FIG. 11). Of particular interest are the membrane-embedded ATP synthase enzyme complex which generates ATP from either a sodium or proton gradient (Aha), the $H_4MPT$ methyl transferase enzyme complex that catalyses the second to last step in the methanogenesis pathway (Mtr) and two membrane-bound energy converting [Ni—Fe] hydrogenases (Eha and Ehb).

The $H_4MPT$ methyl transferase enzyme complex is the penultimate step in the methanogenesis pathway. The methanogenic archaea use this pathway to generate energy (FIG. 11). The first five steps result in the sequential reduction of $CO_2$ by electrons sourced from $H_2$ to form N5-methyl-H4MPT, then the methyl group is transferred to coenzyme M via the action of the methyl-H4MPT:CoM-methyltransferase. Mtr is made up of multiple enzyme subunits (Mtr E, D, C, B, A, F, G, H; FIG. 33) and couples the methyl transfer reaction to the efflux of $Na^+$ ions out of the methanogen cell. This creates a $Na^+$ gradient that is used, either directly, or via a $Na^+$-$H^+$ antiporter, to drive ATP synthesis. Our analyses indicate that Mtr subunits are sufficiently conserved and specific to methanogens to be prime candidates for vaccine development. Therefore we are sub-cloning and expressing these subunits in order to obtain protein to vaccinate into sheep.

In order to clone the genes into the pTrc99A vector, 2 pairs of primers were designed for each of the 9 target ORFs (8 individual subunits and complete operon-mtrED-CBEFGH). One set of primers introduces a His (6×Histidine) tag to the N-terminal of the translated proteins, while the other set of primers do not include this tag. The primers were designed for insertion of the fragments between the NcoI site and XbaI site of the pTrc99A vector. Each open reading frame (ORF) from the mtr operon was amplified from *M. ruminantium* M1 genomic DNA, and ligated into the appropriately digested vector. The ligation products were transformed into DH5$^{\alpha}$ competent cells and insert-containing colonies were selected and analysed to verify insertion of the correct gene. In order to improve the chances of mtr gene expression, a codon-optimised mtr construct was designed for synthesis by GENEART (Germany) and cloned into pTrc99A. Each mtr gene contains an RBS site, an N-terminal 6×His tag, a TEV protease cleavage site, and is flanked by unique restriction site compatible with sub-cloning individual synthetic ORFs into the pTrc99A.

The table below summarises the mtr gene cloning and expression results. All 9 ORFs were successfully amplified with the two pairs of primers, giving 18 constructs, of which 17 were successfully cloned into the pTrc99A vector. All constructs were sequenced to confirm correct gene inserts.

Mtr Cloning and Expression

| Constructs | Cloned | Sequenced | Expression |
|---|---|---|---|
| mtrA-His | ☑ Yes | ☑ Yes | In progress |
| mtrB-His | ☑ Yes | ☑ Yes | In progress |
| mtrC-His | ☑ Yes | ☑ Yes | ☑ Yes |
| mtrD-His | ☑ Yes | ☑ Yes | In progress |
| mtrE-His | ☑ Yes | ☑ Yes | In progress |
| mtrF-His | ☑ Yes | ☑ Yes | In progress |
| mtrG-His | ☑ Yes | ☑ Yes | In progress |
| mtrH-His | ☑ Yes | ☑ Yes | ☑ Yes |
| mtrEDCBAFGH-His | ☑ Yes | ☑ Yes | In progress |
| mtrA | ☑ Yes | ☑ Yes | In progress |
| mtrB | ☑ Yes | ☑ Yes | In progress |
| mtrC | ☑ Yes | ☑ Yes | In progress |
| mtrD | ☑ Yes | ☑ Yes | In progress |
| mtrE | ☑ Yes | ☑ Yes | In progress |
| mtrF | ☑ Yes | ☑ Yes | In progress |
| mtrG | ☑ Yes | ☑ Yes | In progress |
| mtrH | ☑ Yes | ☑ Yes | ☑ Yes |

Only the complete mtr operon without the 6×His tag failed to clone from the PCR product. Expression of all 17 mtr constructs has been obtained using the expression host OverExpress C41 (DE3) (Lucigen) cells grown in YT medium and induced by IPTG at either 37° C. or 30° C. MtrH with or without the 6×His tag was successfully overexpressed, and there also appeared to be some mtrH expression from the mtrEDCBAFGH-His construct (FIG. 34).

The MtrC construct with 6×His tag had low level expression in the OverExpress C43 (DE3) (Lucigen) expression host (FIG. 35). After lysis of the cells expressing the mtrH and mtrC proteins, the two proteins were solubilised and put through the nickel columns for purification, but the proteins did not bind well to the columns, preventing column purification. The codon-optimised mtr synthetic construct has also been tested for expression in OverExpress C43 (DE3) (Lucigen) cells in YT medium, and Rosetta II (DE3), OverExpress C43 (DE3), OverExpress C41 (DE3), OverExpress C43 (DE3) pLysS, OverExpress C41 (DE3) pLysS cells in auto-induction medium (ZYP5052). No expression from any of the mtr genes was detected under any of these conditions. Further expression of codon-optimised mtr synthetic construct in Rosettall (DE3) and induction temperature at 20 to 37° C. for a range of induction times (4 to 16 hrs), with IPTG concentration ranging from 0.1 mM to 1 mM is being assessed. We also plan to sub-clone each of the individual mtr subunits from the synthetic construct and obtain expression individually.

Example 7

Vaccination of Sheep Using Cell Surface Protein Fractions Isolated from *M. ruminantium* Cells Traditional vaccine development against bacteria relies on using cell fractions to elicit antigenic responses in the host animal. This approach, while generally accepted, carries the inherent risk of contamination from other cell fractions. As an alternative to traditional cell fractionation, cell surface proteins isolated via non-destructive treatment are investigated for their ability to create effective and specific antigens. Chaotropic salts, such as guanidine hydrochloride, have been widely used to remove non-covalently bound proteins such as S-layers from the cell surface, while maintaining viable microbial cells.

In our experiments, *M. ruminantium* M1 cells have been subjected to chaotropic salt treatment removing non-covalently bound proteins from the cell surface. In a second step the treated methanogen cells have been subjected to a trypsin digest. This cleaved off exposed protein epitopes from the cell surface, without disrupting the cell wall or cell membrane. For this protocol, *M. ruminantium* M1 cells were grown in RM02 media for 7 days. The culture was then centrifuged to spin down the cells and the supernatant discarded. The cell pellet was washed three times in sterile distilled water, resuspended in 2 mL of 4M guanidine-HCl pH 7.0 and incubated at 37° C. for 1 hour. The suspension was centrifuged in a microfuge at 13 000 rpm. The supernatant (containing non-covalently bound surface proteins) was carefully removed and dialysed twice against 100 mM ammonium bicarbarbonate buffer (pH 8). A sample was run on an SDS-PAGE to estimate number and quantity of isolated proteins.

These samples have been used in a sheep vaccination trial. A Western blot analysis of M1 cell fractions against sheep antisera from the trial has been carried out and a significant level of cross-reaction has been observed (FIG. 36).

A trypsin digest was then carried out for both the non-covalently bound isolated proteins and the exposed cell-surface epitopes. This digest also served to prepare the samples for subsequent MALDI-TOF analyses. Trypsin was added at an approximate ratio of 1:50 relative to estimated amount of protein (based on SDS-PAGE). 10% (v/v) HPLC grade acetonitrile was added and the samples were incubated at 37° for 12 hours. The digests were centrifuged, supernatants were collected and subsequently dialysed against 100 mM ammonium bicarbonate buffer (pH 8). Where appropriate, DTT (dithiothreitol) was added to a final concentration of 50 mM and the samples were incubated at 60° C. for 30 minutes to reduce disulphides. IAM (iodoacetamide) was then added to a final concentration of 150 mM and samples were incubated in the dark at room temperature for 30 minutes. DTT and IAM were removed from the sample by dialysis or washing with 100 mM ammonium bicarbonate buffer (pH 8). Both preparations were sent to Dr Stefan Clerens (AgResearch, Lincoln) for MALDI-TOF.

Protein fragments were subsequently compared to the non-redundant amino-acid database hosted by NCBI and a custom ORFeome based *M. ruminantium* database (Leahy et al., 2010), associating epitopes with their respective ORFs.

Six independent culture trials were conducted, including cells from normal growth conditions, cells from medium supplemented with methanol and cell subjected to oxygen stress. A total of 57 fragments could be assigned to their respective *M. ruminantium* M1 genes (see table, below). It is noteworthy that a significant level of variety in identified ORFs was encountered in between the individual protein isolations. This may be caused by a sensitive and rapid adaptation of *M. ruminantium* to even small changes in culture conditions. Notable targets such as adhesion-like proteins or an ABC transporter substrate-binding protein were detected which will be merged into the priority target list. Interestingly, a number of cytosolic proteins (i.e., ribosomal proteins and other predicted highly expressed genes) were also detected, indicating a certain amount of ongoing cell lysis during the sample preparation. In this context, we also identified the M1 bacteriophage φmru integrase protein, pointing to a continued phage lysis process. This is supported by the detection of φmru particle in culture supernatant during normal growth conditions. The active prophage not only points to a highly stressed *M. ruminantium* cell condition but also may cause an altered biochemical and phenotypical profile.

It therefore is important to improve culture conditions and also develop a prophage-free strain that lacks the potential of accelerated and uncontrolled cell lysis. Consequently, we have initiated a phage curing experiment which aims to create a phage-free *M. ruminantium* derivative. Because *M. ruminantium* cannot be cultivated on solid media traditional phage curing methods cannot be employed. We have therefore opted for an evolutionary approach that uses ProteinaseK to remove free phage particles and continuous minimal subculturing. We will enrich for a prophage-free *M. ruminantium* population that eventually evolves in a fully cured derivative. This derivative would then also be used in further experiments, such as the assessment of the prophage ϕmru. Most interestingly, we were also able to identify the M1 NRPS1 gene product, indicating that the NRPS system can be active and expressed under laboratory growth conditions.

List of Open Reading Frames Identified by MALDI-TOF Analyses.

| ORF number | Annotation | Count |
|---|---|---|
| 82 | Adhesin-like protein+ | 1 |
| 113 (1228) | Exopolysaccharide biosynthesis polyprenyl glycosylphosphotransferase^ | 1 |
| 115 | RadA DNA repair and recombination protein+ | 1 |
| 117 | HdrA CoB-CoM heterodisulfide reductase subunit A*** | 7 |
| 201 | ModA molybdate ABC transporter substrate-binding protein+ | 1 |
| 205 | Copper ion binding protein^ | 1 |
| 247 | ThiC1 thiamine biosynthesis protein*** | 7 |
| 256 | Phage integrase*** | 5 |
| 326 | Adhesin-like protein*** | 2 |
| 333 | FdhA1*** | 3 |
| 334 | FdhB1*** | 3 |
| 351 | Nrps1+ | 1 |
| 455 | Acetyltransferase+ | 1 |
| 481 | FtsZ cell division protein+ | 1 |
| 498 | Fbp fructose 1,6-bisphosphatase*** | 3 |
| 520 | Translation elongation factor aEF-1 beta+ | 1 |
| 526 | Hmd coenzyme F420-dependent N(5),N(10)-methenyltetrahydromethanopterin reductase*** | 5 |
| 550 | PorA pyruvate ferredoxin oxidoreductase alpha subunit*** | 4 |
| 551 | PorB pyruvate ferredoxin oxidoreductase beta subunit*** | 2 |
| 569 | Mer 5,10-methylenetetrahydromethanopterin reductase*** | 7 |
| 582 | PhoU phosphate uptake regulator PhoU*** | 2 |
| 595 | PurP+ | 1 |
| 629 | Hypothetical protein+ | 1 |
| 735 | Rbr1+ | 1 |
| 727 (2191) | Adhesin-like protein with cysteine protease domain^ | 1 |
| 774 | Archaeal histone+ | 1 |
| 816 | HdrC CoB-CoM heterodisulfide reductase subunit C*** | 6 |
| 817 | HdrB*** | 3 |
| 851 | Rpl3p ribosomal protein L3P+ | 1 |
| 872 | Rps5p ribosomal protein S5P+ | 1 |
| 949 | BtcC bicarbonate ABC transporter substrate-binding protein*** | 8 |
| 1052 | Transcriptional regulator+ | 1 |
| 1091 | SucD^ | 2 |
| 1490 | Ribosomal protein L7Ae+ | 1 |
| 1228 | Hypothetical protein^ | 1 |

-continued

| ORF number | Annotation | Count |
|---|---|---|
| (113) | | |
| 1371 | Hypothetical protein+ | 1 |
| 1491 | Archaeal histone*** | 8 |
| 1499 | Adhesin-like protein with transglutaminase domain+ | 1 |
| 1570 | Acs, ADP-dependent acetyl-CoA synthetase*** | 5 |
| 1645 | Thermosome subunit*** | 2 |
| 1683 | Hypothetical protein*** | 3 |
| 1686 | Archaeal histone*** | 2 |
| 1691 | MoaA molybdenum cofactor biosynthesis protein+ | 1 |
| 1730 | Heat shock protein Hsp20+ | 1 |
| 1805 | Translation elongation factor aEF-1 alpha*** | 7 |
| 1836 | Cell shape determining protein MreB/MrI family*** | 3 |
| 1888 | PycB+ | 1 |
| 1897 | PpsA1 phosphoenolpyruvate synthase+ | 1 |
| 1900 | Hypothetical protein+ | 1 |
| 1901 | Peptidyl-prolyl cis-trans isomerase+ | 1 |
| 1906 | MvhA methyl viologen-reducing hydrogenase alpha*** | 7 |
| 1907 | MvhG methyl viologen-reducing hydrogenase gamma*** | 4 |
| 1916 | MtrH tetrahydromethanopterin S-methyltransferase*** | 9 |
| 1919 | MtrA1 tetrahydromethanopterin S-methyltransferase*** | 4 |
| 1920 | MtrB tetrahydromethanopterin S-methyltransferase+ | 1 |
| 1921 | MtrC tetrahydromethanopterin S-methyltransferase*** | 2 |
| 1924 | McrA methyl-coenzyme M reductase alpha subunit*** | 5 |
| 1925 | McrG methyl-coenzyme M reductase gamma subunit*** | 12 |
| 1928 | McrB methyl-coenzyme M reductase beta subunit*** | 9 |
| 1993 | CBS domain-containing protein+ | 1 |
| 1994 | CBS domain-containing protein*** | 8 |
| 2022 | Ftr2 formylmethanofuran-tetrahydromethanopterin formyltransferase*** | 7 |
| 2074 | FdhA2 formate dehydrogenase alpha chain+ | 1 |
| 2110 | IlvC ketol-acid reductoisomerase+ | 1 |
| 2121 | Hcp hydroxylamine reductase*** | 5 |
| 2131 | Fae/Hps bifunctional formaldehyde-activating enzyme/3-hexulose-6-phosphate synthase+ | 1 |
| 2142 | Mtd F420-dependent methylenetetrahydromethanopterin dehydrogenase*** | 11 |
| 2159 | TrpB2 tryptophan synthase beta subunit*** | 6 |
| 2191 (727) | CDP-glycerol:poly(glycerophosphate) glycerophosphotransferase^ | 1 |

ORF number indicates the respective locus tag within the *M. ruminantium* M1 genome;
Annotation shows the corresponding functional annotation;
Count highlights the number of occurrences found for each ORF throughout the six individual runs.
***ORFs found multiple times,
+unique hits,
^Hits with sequence mismatch to M1 deduced aa sequences. ORF numbers in brackets indicate ambiguous hits.

Example 8

Expression and Purification of Enzymes from the Methanogen *M. ruminantium* for the Discovery of Inhibitors Novel inhibitors have great potential to provide mitigation of the greenhouse gas methane from ruminants. This area of research has significance in the stabilisation of greenhouse gas concentrations in the atmosphere to prevent climate change. The principal methane forming organisms in the rumen are archaea belonging to the genus *Methanobrevibacter*. We are targeting genes of rumen methanogens for cloning and expression in *E. coli* with the aim of obtaining purified enzymes that can be used for: high-throughput screening (HTS) assays of chemical compound libraries; and in silico screening of inhibitors. The majority of the targets are from five main functional classes; methanogenesis/energy metabolism, central carbon metabolism, cofactor synthesis, cell wall synthesis and lipid synthesis. Work will continue to advance the targets through the pipeline. This project brings together diverse disciplines including chemogenomics, in silico modelling, structural biology, and the in vitro biological screening of targeted compounds to formulate the development of potent anti-methanogen compounds that are non-toxic to host ruminant animals and have negligible environmental impact.

Our aim is to discover small molecule inhibitors of methanogens, based on genomics, biochemistry, and structural biology. This is a powerful means to search for inhibitors of methanogens, which are difficult to culture and are not amenable to high-throughput screening with cells. In this study, a number of enzymes from *Methanobrevibacter ruminantium* were found to be solubly expressed in *E. coli* e.g. 3-hydroxy-3-methylglutaryl-CoA reductase (HMGR), methenyltetrahydromethanopterin cyclohydrolase (MCH), 3-hexylose-6-phosphate isomerise (PHI) and bifunctional formaldehyde-activating enzyme/3-hexylose-6-phosphate synthase (FAE/HPS). HMGR catalyzes the rate-limiting step in the synthesis of isoprenoid units, which are components of archaeal membrane lipids. MCH is an enzyme involved in the methanogenesis pathway. PHI and FAE/HPS are key enzymes of the ribulose monophosphate pathway, used by methanogens to generate ribose for nucleotide synthesis.

As a first step, we made a selection of targets. Information from literature and genome of *Methanobrevibacter ruminantium* (Leahy et. al., 2010) was studied and 34 targets (see table in Example 9, below) were chosen. Next, we carried out cloning in *E. coli*. Genes were amplified and cloned into expression vector pET151D (Invitrogen). Plasmids were used to transform *E. coli* BL21-Rosetta 2 cells (Novagen). From this, 27 positive clones (see table, below) were obtained. We then looked for expression of recombinant proteins. Cells were grown in auto induction medium ZYP-5052 (Studier, 2005), with shaking at 25° C. or 30° C. for approx 16 hr. Cells were lysed using lysozyme at 4° C. The hexa-histidine-tagged enzymes were then purified from cell free extracts by nickel-affinity chromatography. Imidazole was removed and buffer was exchanged. We found 15 proteins were expressed while 10 (12) were soluble (see table, below). Clones that failed to express were grown in LB media induced with IPTG. Clones with insoluble expression were subjected to varying lysis conditions. To overcome the lack of expression in some clones, the genes have been synthesised for optimum expression in *E. coli* (GeneArt).

Biochemical characterisation of HMGR has also been carried out. This included assays to measure the oxidation of NADHP (366 nm, ε3,300 M-1 cm-1), which were performed at 37° C. Activity was expressed in U mg-1 of enzyme. One unit was defined as the turnover of one μmol of NADPH per minute (2 NADPH molecules are required to reduce 1 HMG-CoA). Standard assays contained 50 mM BTP (Bis-Tris propane) pH 6.5, 400 mM NaCl, 0.05 mM DTT, 2.5% glycerol, 338 μM NADPH and 250 μM (R,S)-HMG-CoA. Prior to use, the enzyme stock (0.6 mg/mL) was incubated in 400 mM NaCl and 10 mM DTT for 2 hours at 4° C. and for 20 minutes at 37° C. then kept on ice. Assays were carried out in duplicate. HMGR was susceptible to oxidation and could be reactivated by incubation with 10 mM dithiothreitol for two hours. Highest activity was found at pH 6.5 and at 0.4-1.5 M NaCl. HMGR was able to oxidize NADPH but not NADH. The enzyme had Km values of 165±35 and 12.4±1.83 μM for NADPH and HMG-CoA, respectively. The statins simvastatin and lovastatin inhibit HMGR with high Kic values of 3.7±0.65 and 8.5±1.1 μM, respectively. Statins have previously been shown to inhibit the growth of strains of rumen *Methanobrevibacter* (Wolin and Miller, 2006). Notably, structure-based alignment showed that the enzyme is a Class I HMGR.

Example 9

In Silico Modelling of Enzymes from the Methanogen *Methanobrevibacfer ruminantium* for the Discovery of Novel Inhibitors Analysis of the *Methanobrevibacter ruminantium* genome (Leahy et. al., 2010) has revealed archaeal and methanogen-specific enzyme pathways involved in methane production, energy metabolism, protein, lipid, cofactor and cell wall synthesis. Making comprehensive use of this genomic data, essential protein targets have been analysed based on already available structural data of related enzymes for homology modelling, or when possible, purified protein has been submitted to protein crystallisation trials for x-ray structure determination.

The presence of published crystal structures that are similar in sequence is a factor for selecting targets, due to the fact that they can be used to guide the determination of our own crystal structures, thus saving time. In addition, high-resolution structures can also be used as models to develop inhibitors, as is now being performed. For example, ODcase (orotidine-5'-phosphate decarboxylase; PyrF) is a key enzyme in the biosynthesis of the pyrimidine uridine-5'-monophosphate (UMP) (Nyce and White. 1996). ODcase from other sources have provided crystal structures and high-quality work on developing inhibitors as part of its kinetic characterisation (Wu and Pai, 2002; Poduch et al., 2006; Poduch et al., 2008; Fujihashi et al., 2009; Bello et al., 2007). Other researchers are using ODcase for the development of novel anti-pathogenic compounds based on small differences between the pathogen and mammalian structures (Bello et al., 2007). There are over 40 crystal structures for methanogen ODcases. Similarly, HMG CoA reductase from other sources has been identified as the presumed target of statins (Miller and Wolin, 2001). The work of Miller and Wolin validated HMG CoA reductase as a target in methanogens, and indeed, the entire mevalonate pathway for lipid synthesis. There are >20 HMG CoA reductase crystal structures available.

The target sn-glycerol-1-phosphate dehydrogenase (NAD(P)-dependent glycerol-1-phosphate dehydrogenase, EgsA) is a well known archaeal enzyme that forms the stereo-specific glycerol-1-phosphate backbone for archaeal lipids (Koga and Morii, 2007). GGPS (geranylgeranylphosphate synthase) is another lipid synthesis enzyme that is being targeted as it also has an archaeal stereospecific catalytic site (Koga and Morii, 2007). A crystal structure is available for a methanogen GGPS (Payandeh et al. 2006). As another example, DAPDC (diaminopimelate decarboxylase; LysA) helps catalyse the formation of lysine which is a key cross-linking component of *M. ruminantium* cell walls. Lysine is an essential amino acid in mammals and therefore the lysine biosynthesis pathway has been targeted for the development of novel antibiotics (Hutton et al., 2007). A crystal structure is available for DAPDC (Ray et al., 2002). The methanopterin biosynthesis pathway enzyme RFA-P synthase has been validated as a target in other systems, and a vast array of potential inhibitors have been identified (Dumitru et al., 2003; Dumitru and Ragsdale, 2004; Scott and Rasche, 2002; Miner et al., 2003). The methanopterin pathway enzyme CitG is presumed to be essential and is nearly-methanogen specific (Chistoserdova et al., 2003, Chistoserdova et al., 2004, Schneider et al., 2000). HisAF is also indicated to be part of the methanopterin pathway (Chistoserdova et al., 2003, 2004).

The F420 biosynthesis pathway includes the targets of CofA, PLT (CofD), CofC (PLGT), and creatinine amidohydrolase (CA) and FucA are nearly methanogen-specific and presumed to be essential for methanogen survival (Graham and White 2002). Most of the remainder of the F420 pathway is also being targeted. A crystal structure is available for PLT (Forouhar et al. 2008). Several methanogenesis pathway enzymes are included which are encoded by single genes. These are essential for survival and there are crystal structures for all four (Hiromoto et al., 2009; Shima et al., 2008; Grabarse et al., 1999; Aufhammer et al., 2005; Hegemeier et al., 2003). The Coenzyme M (CoM) pathway is also thought to be essential for survival and crystal structures are available for ComA and ComC (Irimia et al. 2004; Wise et al. 2003). The Coenzyme B biosynthesis pathway is the only methanogen cofactor pathway that is fully methanogen-specific and should be absolutely essential (Graham and White, 2002). Despite this, all the known enzymes (AksA, AksD, AksE and AksF) share significant homology with bacterial proteins, and three have some homology with mammalian enzymes (AksD, AksE and AksF have some homology with mammalian aconitase subunits and/or isocitrate dehydrogenase).

The RuMP, or ribulose monophosphate pathway, is used by methanogens to generate ribose for nucleotide synthesis. Although it is not methanogen-specific it is only found in a very limited number of organisms and these are not typically found in the rumen (Werken et al., 2008; Growchowski and White, 2005). Several of the key enzymes of the pathway are of interest, and in *M. ruminantium* two of these are linked to form a bifunctional enzyme (HPS-FAE, formaldehyde-activating enzyme/hexylose-6-phosphate synthase). Phi1 (hexylose-6-phosphate isomerase) is also being targeted and is also part of the RuMP pathway. Interestingly, *M. ruminantium* also, has another Phi (Phi2), although sequence analyses suggests that Phi1 is the more likely to be involved in the RuMP pathway. A methanogen crystal structure is available for Phi (Martinez-Cruz et al., 2002).

The targets Mur 53, 78, 520, 873 and 874 are murein ligases involved in synthesising the amino acid peptide linkages of the cell walls of members of the *Methanobacteriales*. Murein ligases are also found in bacteria. Disruption of cross-linking peptide biosynthesis would be akin to discovering an 'anti-methanogen antibiotic' with similar effects to penicillin-like drugs (Zoeiby et al., 2003; Hartmann and König, 1990). Most of these, methanogen murein ligases (53, 520, 873 and 874) are quite distinct from their bacterial homologues, whereas Mur 78 retains quite high levels of homology with its bacterial counterparts. Interestingly, Mur 520 is also found in some *Methanococci* and *Methanosarcina*. Bacterial murein ligase structures (>40) are available that could be used as scaffolds for performing molecular replacement, thus aiding future structure determination of the methanogen enzymes.

Several enzymes are targeted as they are considered 'key' enzymes that are central to metabolism (gluconeogenesis that is required for amino acid, cell wall sugar synthesis, DNA and RNA synthesis and the TCA cycle), and therefore essential. Most of these have relatively easy spectrophotometric assays (Acs, PEP syn, AcsA, SdhA/SdhB). Acs and SdhA/B have archaeal-specific features (Bobik and Wolfe, 1989; Musfeldt and Schönheit, 2002). GatD and GatE are involved in translation and are archaeal-specific and provide glutaminyl-tRNA for protein synthesis (Possot et al. 1988). tRNA synthetases have been successfully targeted for the development of novel antibiotics (Ahel et al. 2005). There is a methanogen crystal structure for GatD/E (Oshikane et al. 2006).

The current targets (see below) represent 12 different cellular processes or metabolic pathways with a large share (16 targets) being derived from methanogen cofactor synthesis pathways. Taking everything into consideration, methanogen cofactors represent strong targets overall as they are typically restricted to methanogens, are likely to be essential and the cofactors themselves are fairly small molecules. Advantages of small molecules are that it can be easier to synthesise substrates for enzyme assays and easier to synthesise potential inhibitors that share similar structural features. Due to potential off-target effects, we have decided to avoid most vitamin synthesis pathways as almost all of the methanogen enzymes have counterparts in bacteria and therefore, inhibitors would have a high chance of also inhibiting beneficial rumen bacteria.

Current Chemogenomics Targets

| Target | pathway | PCR | clone | expressed/soluble | Pure | X-tal | comments |
|---|---|---|---|---|---|---|---|
| ODcase (PyrF) | pyrimidines | no | | | | | early target |
| HMG CoA red | lipids | yes | yes | yes/yes | yes | yes | early target |
| sn-G1P deh2 | lipids | yes | yes | no | | | GA; early target |
| DAPDC (LysA) | lysine/CW | yes | yes | yes/yes | yes | | early target |
| RFA-P (MptG) | methanopterin | yes | yes | yes/no | | | GA |
| PLT (CofD) | F420 | yes | yes | no | | | GA |
| CofA(1093) | F420 | yes | yes | | | | GA |
| FucA | F420 | yes | yes | yes/yes | | | |
| Phi1 | RuMP | yes | yes | yes/yes | yes | yes | |
| Hmd | methanogenesis | yes | yes | no | | | GA |
| Mch | methanogenesis | yes | yes | yes/yes | yes | yes | |
| Mer | methanogenesis | yes | yes | yes/no | | | GA |
| Mtd | methanogenesis | yes | yes | | | | GA |
| AksA | Coenzyme B | yes | | | | | |
| AksD | Coenzyme B | yes | yes | yes/no | | | |
| AksE | Coenzyme B | yes | | | | | |
| AksF | Coenzyme B | yes | yes | no | | | |
| CitG | methanopterin | yes | yes | yes/yes | | | |
| ComA (Homolog) | coenzyme M | yes | yes | yes/yes | | | |
| ComB (Homolog) | coenzyme M | yes | yes | no | | | GA |
| ComC (Homolog) | coenzyme M | yes | yes | yes/yes | yes | | |
| ComD (Homolog) | coenzyme M | yes | yes | no | | | GA |
| ComE (Homolog) | coenzyme M | yes | yes | no | | | GA |

| Target | pathway | PCR | clone | expressed/ soluble | Pure | X-tal | comments |
|---|---|---|---|---|---|---|---|
| Hps-Fae | RuMP | yes | yes | yes/yes | yes | yes | |
| Acs | key enzyme | yes | | | | | |
| AcsA | key enzyme | yes | | | | | |
| PEP syn | key enzyme | yes | yes | yes/yes | | | |
| GGPS | lipids | yes | yes | yes/ some | | | |
| SdhA | TCA | yes | | | | | |
| SdhB | TCA | yes | | | | | |
| Mur 53 | cell wall | yes | yes | | | | GA |
| Mur 78 | cell wall | yes | yes | yes/ some | yes | | |
| Mur 520 | cell wall | yes | yes | | | | |
| Mur 873 | cell wall | no | | | | | GA |
| Mur 874 | cell wall | no | | | | | GA |
| GatD | translation | yes | yes | | | | |
| GatE | translation | yes | | | | | |
| CofC | F420 | no | | | | | |
| CA | F420/riboflavin | no | | | | | |
| HisAF | methanopterin | no | | | | | |

GA, gene synthesised by GeneArt and will be recloned;
CA, creatinine amidohydrolase For specific experiments, in silico screening of large commercial compound libraries using the docking programme GOLD (Verdonk et. al., 2003; Cole, J. C. et. al., 2005) has formed the basis of our selection and design of high affinity ligands for our modelled proteins. Work is currently underway for evaluating the essential methanogen enzyme methyl-coenzyme M reductase (MCR), an enzyme that catalyzes the terminal step in methane production. A number of enzymes are being crystallised and include 3-hydroxy-3-methylglutaryl-CoA reductase (HMGR), the rate-limiting step in the synthesis of isoprenoid units, which are components of archaeal membrane lipids. Others include 3-hexylose-6-phosphate isomerase (PHI), a key enzyme of the ribulose monophosphate pathway and methenyltetrahydromethanopterin cyclohydrolase (Mch), an enzyme involved in the methanogenesis pathway.

The programme GOLD (Verdonk et. al., 2003; Cole, J. C. et. al., 2005) has been tasked in carrying out the in silico docking process in order to obtain novel inhibitors of archaeal and methanogen-specific enzymes, in particular MCR (Grabarse et. al., 2001; FIG. 37A). MCR has an α2β2γ2 subunit structure which contains two nickel porphinoid F430 rings which forms the centre of enzyme activity and two molecules each of methylcoenzyme M (CoM) and coenzyme B (CoB). These cofactors operate under strictly anaerobic conditions to carry out the final reaction of the energy conserving pathway of methanogenic archaea in which CoM and CoB are converted to methane and the heterodisulfide product CoM-S-S-CoB (FIG. 37B). This product is subsequently reduced with H2 back to the thiol forms of the separate cofactors by heterodisulfide reductase.

A number of structural databases from commercial suppliers have been downloaded from the ZINC (Irwin and Shoichet, 2005) website hypertext transfer protocol://zinc.docking.org/index.shtml and screened with GOLD (Verdonk et. al., 2003; Cole, J. C. et. al., 2005). Commercial databases available from the zinc website such as Asinex, Chembridge building blocks and the LOPAC library of proven pharmacologically-active compounds were screened with MCR. Utilizing a ruminant model of MCR based on a crystal structure from Methanothermobacter marburgensis (pdb code 1HBM4) active site regions were subjected to specific and targeted docking attempts to find inhibitors that could mimic the natural substrates and product of the enzyme. The effectiveness of candidate inhibitors were then monitored in pure culture experiments. Cell density was measured over time to assess the effectiveness of potential inhibitors (FIG. 38).

Lengthy table referenced here

US09441016-20160913-T00001

Please refer to the end of the specification for access instructions.

Lengthy table referenced here

US09441016-20160913-T00002

Please refer to the end of the specification for access instructions.

Lengthy table referenced here

US09441016-20160913-T00003

Please refer to the end of the specification for access instructions.

Lengthy table referenced here

US09441016-20160913-T00004

Please refer to the end of the specification for access instructions.

Lengthy table referenced here

US09441016-20160913-T00005

Please refer to the end of the specification for access instructions.

Lengthy table referenced here

US09441016-20160913-T00006

Please refer to the end of the specification for access instructions.

Lengthy table referenced here

US09441016-20160913-T00007

Please refer to the end of the specification for access instructions.

Lengthy table referenced here

US09441016-20160913-T00008

Please refer to the end of the specification for access instructions.

Lengthy table referenced here

US09441016-20160913-T00009

Please refer to the end of the specification for access instructions.

Lengthy table referenced here

US09441016-20160913-T00010

Please refer to the end of the specification for access instructions.

Lengthy table referenced here

US09441016-20160913-T00011

Please refer to the end of the specification for access instructions.

Lengthy table referenced here

US09441016-20160913-T00012

Please refer to the end of the specification for access instructions.

Lengthy table referenced here

US09441016-20160913-T00013

Please refer to the end of the specification for access instructions.

REFERENCES

Abken H J, Tietze M, Brodersen J, Bäumer S, Beifuss U et al. (1998) Isolation and characterization of methanophenazine and function of phenazines in membrane-bound electron transport of *Methanosarcina mazei* Gö1. J Bacteriol 180: 2027-2032.

Acharya, P., Warkentin, E., Ermler, U., Thauer, R. K. & Shima, S. The structure of formylmethanofuran: tetrahydromethanopterin formyltransferase in complex with its coenzymes. J. Mol. Biol. 357, 870-879 (2006).

Ahel, D., Slade, D., Mocibob, M., S. D. & Weygand-Durasevic, I. Selective inhibition of divergent seryl-tRNA synthetases by serine analogues. FEBS Lett. 579, 4344-4348 (2005).

Ahel I, Stathopoulos C, Ambrogelly A, Sauerwald A, Toogood H et al. (2002) Cysteine activation is an inherent in vitro property of prolyl-tRNA synthetases. J Biol Chem 277:34743-34748.

Alex, L. A., Reeve, J. N., Orme-Johnson, W. H. & Walsh, C. T. Cloning, sequence determination and expression of the genes encoding the subunits of the nickel-containing 8-hydroxy-5-deazaflavin reducing hydrogenase from *Methanobacterium thermoautotrophicum*. Biochem. 29, 7237-7244 (1990).

Altermann E, Klaenhammer T R (2005) PathwayVoyager: pathway mapping using the Kyoto Encyclopedia of Genes and Genomes (KEGG) database. BMC Genomics 6:60-66.

Altermann E, Klaenhammer T R (2003) GAMOLA: a new local solution for sequence annotation and analyzing draft and finished prokaryotic genomes. Omics 7: 161-169.

Altschul S F, Madden T L, Schaffer A A, Zhang J, Zhang Z, Miller W, Lipman D J (1997) Gapped BLAST and PSI-BLAST: a new generation of protein database search programs. Nucleic Acids Research 25, 3389-3402.

Altschul, S. F., Gish, W., Miller, W., Myers, E. W. & Lipman, D. J. Basic local alignment search tool. Journal of molecular biology 215, 403-410 (1990).

Ambrogelly, A., Kamtekar, S., Stathopoulos, C., Kennedy, D. & Söll, D. Asymmetric behavior of archaeal proly-tRNA synthetase. FEBS Lett. 579, 6017-6022 (2005).

Ammelburg M, Hartmann M D, Djuranovic S, Alva V, Koretke K K et al. (2007) A CTP-dependent archaeal riboflavin kinase forms a bridge in the evolution of cradle-loop barrels. Structure 15:1577-9150.

Amoutzias, G. D., Van de Peer, Y. & Mossialos, D. Evolution and taxonomic distribution of nonribosomal peptide and polyketide synthases. Future Microbiol. 3, 361-370 (2008).

Amoutzias G D, Van de Peer Y, Mossialos D (2008) Evolution and taxonomic distribution of nonribosomal peptide and polyketide synthases. Future Microbiol 3: 361-370.

Anderson I, Ulrich L E, Lupa B, Susanti D, Porat I et al. (2009) Genomic characterization of Methanomicrobiales reveals three classes of methanogens. PLoS One 4:e5797.

Andreesen, J. R. & Makdessi, K. Tungsten, the surprisingly positively acting heavy metal element for prokaryotes. Ann. N.Y. Acad. Sci. 1125, 215-29 (2008).

Andries K., Verhasselt P., Guillemont J., Göhlmann. H. W., Neefs J. M., Winkler H., Van Gestel J., Timmerman P., Zhu M., Lee E., Williams P., de Chaffoy D., Huitric E., Hoffner S., Cambau E., Truffot-Pemot C., Lounis N., Jarlier V. A diarylquinoline drug active on the ATP synthase of *Mycobacterium tuberculosis*. Science 307, 223-227 (2005).

Angelaccio S, Chiaraluce R, Consalvi V, Buchenau B, Giangiacomo L et al. (2003) Catalytic and thermodynamic properties of tetrahydromethanopterin-dependent serine hydroxymethyltransferase from *Methanococcus jannaschii*. J Biol Chem 278:41789-97.

Ansorg, R., Rath, P-M., Runde, V. & Beelen, D. W. Influence of intestinal decontamination using metronidazole on the detection of methanogenic Archaea in bone marrow transplant recipients. Bone Marr. Transplant. 31, 117-119 (2003).

Asanuma N, Ishiwata M, Yoshii T, Kikuchi M, Nishina Y et al. (2005) Characterization and transcription of the genes involved in butyrate production in Butyrivibrio fibrisolvens type I and type II strains. Curr Microbiol 51:91-94.

Ataide, S. F. & Ibba, M. Small molecules: big players in the evolution of protein synthesis. ACS Chem. Biol. 1, 285-297 (2006).

Attwood, G. & McSweeney, C. Methanogen genomics to discover targets for methane mitigation technologies and options for alternative H2 utilisation in the rumen. Aust. J. Exper. Agric. 48, 28-37 (2008).

Attwood, G. T., Kelly, W. J., Altermann, E. H. and Leahy, S. C. Analysis of the Methanobrevibacter ruminantium draft genome: understanding methanogen biology to inhibit their action in the rumen. Aust. J. Exp. Agric. 48(2), 83-88 (2008).

Aufhammer S W, Warkentin E, Ermler U, Hagemeier C H, Thauer R K et al. (2005) Crystal structure of formylmethanofuran: tetrahydromethanopterin formyltransferase in complex with coenzyme F420: architecture of the F420/FMN binding site of enzymes within the nonprolyl cis-peptide containing bacterial luciferase family. Pro Sci 14:1840-1849.

Balch W E, Wolfe R S (1976) New approach to cultivation of methanogenic bacteria: 2-mercaptoethanesulfonic acid (HS-CoM)-dependent growth of Methanobacterium ruminantium in a pressurized atmosphere. Appl Environ Microbiol 32:781-791.

Balch W E, Fox G E, Magrum L J, Woese C R, Wolfe R S (1979) Methanogens: reevaluation of a unique biological group. Microbiological Reviews 43, 260-296.

Bambini, S. & Rappuoli, R. The use of genomics in microbial vaccine development. Drug discovery today 14, 252-260 (2009).

Baresi, L. and Bertani, G. (1984) Isolation of a bacteriophage for a methanogenic bacterium. In Abstracts of the Annual Meeting of the American Society for Microbiology. Washington D.C.: American Society for Microbiology, p. 133.

Barkley S. J., Cornish R. M. & Poulter, C. D. Identification of an Archaeal type II isopentenyl diphosphate isomerase in Methanothermobacter thermoautotrophicus. J. Bacteriol. 186, 1811-1817 (2004).

Bauer M, Lombardot T, Teeling H, Ward N L, Amann R I et al. Archaea-like genes for C1-transfer enzymes in Planctomycetes: phylogenetic implications of their unexpected presence in this phylum. J Mol Evol 59:571-586 (2004).

Becher, B., Muller, V. & Gottschalk, G. N5-methyltetrahydromethanopterin:coenzyme M methyltransferase of Methanosarcina strain Go1 is an Na(+)-translocating membrane protein. Journal of bacteriology 174, 7656-7660 (1992).

Beifuss, U., Tietze, M., Baumer, S. & Deppenmeier, U. Methanophenazine: Structure, Total Synthesis, and Function of a New Cofactor from Methanogenic Archaea This work was supported by the Deutsche Forschungsgemeinschaft (Sonderforschungsbereich 416; grants De 488/6-1 and De 488/4-2) and the Fonds der Chemischen Industrie. We are grateful to Drs. J. Paust and H. Jaedicke (BASF AG, Ludwigshafen) and Dr. R. K. Muller (Hoffmann-La Roche Ltd., Basel) for generously providing chemicals. Angewandte Chemie (International ed 39, 2470-2472 (2000).

Bello, A. M., Poduch, E., Fujihashi, M., Amani, M., Li, Y., Crandall, I., Hui, R., Lee, P. I., Kain, K. C., Pai, E. F., Kotra, L. P. A potent, covalent inhibitor of orotidine 5'-monophosphate decarboxylase with antimalarial activity. J. Med. Chem. 50, 915-21 (2007).

Bendtsen, J. D., Nielsen, H., von Heijne, G. & Brunak, S. Improved prediction of signal peptides: SignalP 3.0. Journal of molecular biology 340, 783-795 (2004).

Benson D A, Karsch-Mizrachi I, Lipman D J, Ostell J, Sayers E W (2009) Genbank. Nucleic Acids Res 37:D26-31.

Berk, H. & Thauer, R. K. Function of coenzyme F420-dependent NADP reductase in methanogenic archaea containing an NADP-dependent alcohol dehydrogenase. Archives of microbiology 168, 396-402 (1997).

Bhaysar, A. P. & Brown, E. D. Cell wall assembly in Bacillus subtilis: how spirals and spaces challenge paradigms. Molecular microbiology 60, 1077-1090 (2006).

Bickle, T. A. and D. H. Kruger. 1993. Biology of DNA restriction. Microbiol. Rev. 57:434-450.

Bobik, T. A. & Wolfe, R. S. An unusual thiol-driven fumarate reductase in Methanobacterium with the production of the heterodisulfide of coenzyme M and N-(7-mercaptoheptanoyl)threonine-O3-phosphate. J. Biol. Chem. 264, 18714-8 (1989).

Bock, A-K., Kunow, J., Glasemacher, J. & Schönheit, P. Catalytic properties, molecular composition and sequence alignments of pyruvate:ferredoxin oxidoreductase from the methanogenic archaeon Methanosarcina barkeri (strain Fusaro). Eur. J. Biochem. 237, 35-44 (1996).

Boekhorst J, de Been M W, Kleerebezem M, Siezen R J (2005) Genome-wide detection and analysis of cell wall-bound proteins with LPxTG-like sorting motifs. J Bacteriol 187: 4928-4934.

Bonanno J B, Edo C, Eswar N, Pieper U, Romanowski M J et al. Structural genomics of enzymes involved in sterol/isoprenoid biosynthesis: Proc Natl Acad Sci USA 98:12896-12901 (2001).

Born, T. L. & Blanchard, J. S. Structure/function studies on enzymes in the diaminopimelate pathway of bacterial cell wall biosynthesis. Curr. Opin. Chem. Biol. 3, 607-613 (1999).

Boucher, Y., Kamekura, M. & Doolittle, W. F. Origins and evolution of isoprenoid lipid biosynthesis in archaea. Molec. Microbiol. 52, 515-527 (2004).

Bouhss, A., Trunkfield, A. E., Bugg, T. D. & Mengin-Lecreulx, D. The biosynthesis of peptidoglycan lipid-linked intermediates. FEMS Microbiol. Rev. 32, 208-33 (2008).

Bredel, M. & Jacoby, E. Chemogenomics: an emerging strategy for rapid target and drug discovery. Nat Rev Genet 5, 262-275 (2004).

Bryant, M. P. Rumen methanogenic bacteria. In Dougherty, R. W., Allen, R. S., Burroughs, W., Jaskson, N. L. & McGillard (ed). Physiology of digestion of the ruminant, (1965) Butterworths Publishing Inc., Washington, D.C.

Bryant, M. P., Tzeng, S. F., Robinson, I. M. & Joyner, Jr. A. E. Nutritional requirements of methanogenic bacteria, p. 23-40. In F. G. Pohland (ed.), Anaerobic biological treatment processes. Advances in chemistry series 105. American Chemical Society, Washington, D.C. (1971).

Buckel, W. & Golding, B. T. Radical enzymes in anaerobes. Annu. Rev. Microbiol. 60, 7-49 (2006).

Bult C J, et al. (1996) Complete genome sequence of the methanogenic archaeon, Methanococcus jannaschii. Science 273, 1058-1073.

Campbell, J. W. & Cronan, Jr., J. E. Bacterial fatty acid biosynthesis: targets for antibacterial drug discovery. Annu. Rev. Microbiol. 55, 305-332 (2001).

Candela, T. & Fouet, A. Poly-gamma-glutamate in bacteria. Mol. Microbiol. 60, 1091-1098 (2006).

Caron P R, Mullican M D, Mashal R D, Wilson K P, Su M S et al. (2001) Chemogenomic approaches to drug discovery. Curr Opin Chem Biol 5: 464-470.

Chistoserdova L, Jenkins C, Kalyuzhnaya M G, Marx C J, Lapidus A et al. (2004) The enigmatic Planctomyctes may hold a key to the origins of methanogenesis and methylotrophy. Mol Biol Evol 21:1234-1241.

Chistoserdova, L., Che, S-W., Lapudis, A. & Lidstrom, M. E. Methylotrophy in *Methylobacterium extorquens* AM1 from a genomic point of view. J. Bacteriol. 185, 2980-2987 (2003).

Chistoserdova, L., Vorholt, J., Thauer, R. K. & Lidstrom, M. E. C1 transfer enzymes and coenzyme linking methylotrophic bacteria and methanogenic archaea. Science 281, 99-102 (1998).

Cole, J. C. et al. Virtual Screening in Drug Discovery (Eds. B. Shoichet, Alvarez), Taylor & Francis CRC Press, Boca Raton, Fla., USA (2005).

Coskun U, Grüber G, Koch M H, Godovac-Simmermann J, Lemker T et al. (2002) Cross-talk in the A1-ATPase from *Methanosarcina mazei*. Göl due to nucleotide binding. J Biol Chem 277:17327-17333.

Coskun U, Chaban Y L, Lingi A, Müller V, Keegstra W et al. (2004) Structure and subunit arrangement of the A-type ATP synthase complex from the archaeon *Methanococcus jannaschii* visualized by electron microscopy. J Biol Chem 279:38644-38648.

Coutinho P M, Henrissat B (1999) Carbohydrate-active enzymes: an integrated database approach. In 'Recent Advances in Carbohydrate Bioengineering' (Eds H J Gilbert, G Davies, B Henrissat and B Svensson) pp. 3-12 (The Royal Society of Chemistry, Cambridge) (Carbohydrate Active Enzymes database, hypertext transfer protocol:// world wide web.cazy.org/).

Daiyasu, H., Hiroike, T., Koga, Y. & Toh, H. Analysis of membrane stereochemistry with homology modeling of sn-glycerol-1-phosphate dehydrogenase. Prot. Eng. 15, 987-995 (2002).

Daniel, R. A. & Errington, J. Control of cell morphogenesis in bacteria: two distinct ways to make a rod-shaped cell. Cell. 2003 113, 767-76.

Daugherty, M., Vonstein, V., Overbeek, R. & Ostermann, A. Archaeal shikimate kinase, a new member of the GHMP-kinase family. J. Bacteriol. 183, 292-300 (2001).

de Kruijff, B., van Dam, V. & Breukink, W. Lipid II: a central component in bacterial cell wall synthesis and a target for antibiotics. Prostagland, Leukot. Essent. Fatty Acids 79, 117-121 (2008).

de Macario E. C. & de Macario A. J. L. Methanogenic archaea in health and disease: a novel paradigm of microbial pathogenesis. Internat. J. Med. Microbiol. 299, 99-108 (2009).

de Poorter, L. M. I., Geerts, W. G., Theuvenet, A. P. & Keltjens J. T. Bioenergetics of the formyl-methanofuran dehydrogenase and heterodisulfide reductase, reactions in *Methanothermobacter thermoautotrophicus*. Eur. J. Biochem. 270, 66-75. (2003).

de Ruyck, J. & Wouters, J. Structure-based design targeting biosynthesis of isoprenoids: a crystallographic state of the art of the involved enzymes. Curr. Pro. Pep. Sci. 9, 117-137 (2008).

Delcher A L, Harmon D, Kasif S, White O, Salzberg S L (1999) Improved microbial gene identification with GLIMMER. Nucleic Acids Research 27, 4636-4641.

Delcher, A. L., Salzberg, S. L. & Phillippy, A. M. Using MUMmer to identify similar regions in large sequence sets. Current protocols in bioinformatics/editorial board, Andreas D. Baxevanis et al. Chapter 10, Unit 10 13 (2003).

Deppenmeier, U. Redox-driven proton translocation in methnaogenic Archaea. Cell Mol. Life Sci. 59, 1513-1533 (2002).

Deppenmeier, U. The unique biochemistry of methanogens. Prog. Nucl. Acid. Res. Mol. Biol. 71, 223-283 (2002).

Dermouni, H. L. & Ansorg, R. A. M. Isolation and antimicrobial susceptibility testing of fecal strains of the archaeon *Methanobrevibacter smithii*. Chemother. 47, 177-183 (2001).

DiMarco, A. A., Bobik, T. A. & Wolfe, R. S. Unusual coenzymes of methanogenesis. Annu. Rev. Biochem. 59, 355-394 (1990).

DiMarco, A. A., Donnelly, M. I. & Wolfe, R. S. Purification and properties of the 5,10-methenyltetrahydromethanopterin cyclohydrolase from *Methanobacterium thermoautotrophicum*. J. Bacteriol. 168, 1372-1377 (1986).

Divakaruni, A. V., Baida, C., White, C. L. & Gober, J. W. The cell shape proteins MreB and MreC control cell morphogenesis by positioning cell wall synthetic complexes. Mol Microbiol. 66, 174-88 (2007).

Donnelly, M. I., Escalante-Semerena, J. C., Rinehart, K. L., Jr. & Wolfe R. S. Methenyl-tetrahydromethanopterin cyclohydrolase in cell extracts of *Methanobacterium*. Arch. Biochem. Biophys. 242, 430-439 (1985).

Drevland, R. M., Jia, Y., Palmer, D. R. J. & Graham, D. E. Methanogen homoaconitase catalyses both hydrolase reactions in Coenzyme B biosynthesis. J. Biol. Chem. 283, 28888-28896 (2008).

Dumitru R, Palencia H, Schroeder S D, DeMontigny B A, Takacs J M, Rasche M E, Miner J L, Ragsdale S W. Targeting methanopterin biosynthesis to inhibit methanogenesis. Appl. Environ. Microbiol. 69, 7236-41. (2003).

Dumitru, R. V. & Ragsdale, S. W. Mechanism of 4-(beta-D-ribofuranosyl)aminobenzene 5'-phosphate synthase, a key enzyme in the methanopterin biosynthetic pathway. J. Biol. Chem. 279, 39389-95 (2004).

Eddy, S. R. A memory-efficient dynamic programming algorithm for optimal alignment of a sequence to an RNA secondary structure. BMC bioinformatics 3, 18 (2002).

Eddy, S. R. Profile hidden Markov models. Bioinformatics (Oxford, England) 14, 755-763 (1998).

Eggen, R. I., Geerling, A. C., Boshoven, A. B., de Vos, W. M. Cloning, sequence analysis, and functional expression of the acetyl coenzyme A synthetase gene from *Methanothrix soehngenii* in *Escherichia coli*. J. Bacteriol. 173, 6383-9 (1991).

Eichler, J. & Adams, M. W. Posttranslational protein modification in Archaea. Microbiol Mol Biol Rev 69, 393-425 (2005).

Eisen, J. A., Heidelberg, J. F., White, O. & Salzberg, S. L. Evidence for symmetric chromosomal inversions around the replication origin in bacteria. Genome Biol. 1(6), RESEARCH0011 (2000).

Ellermann, J., Hedderich, R., Bocher, R & Thauer, R. K. The final step in methane formation. Investigations with highly purified methyl-CoM reducatse (component C) from *Methanobacterium thermoautotrophicum* (strain Marburg). Eur. J. Biochem. 172, 669-677 (1988).

Emanuelsson, O., Brunak, S., von Heijne, G. & Nielsen, H. Locating proteins in the cell using TargetP, SignalP and related tools. Nature protocols 2, 953-971 (2007).

Ermler, U. On the mechanism of methyl-coenzyme reductase. Dalton Trans. 21, 3451-3458 (2005).

Ermler, U., Grabarse, W., Shima, S., Goubeaud, M. & Thauer, R. K. Crystal structure of methyl-coenzyme reductase: the key enzyme of biological methane formation. Science 278, 1457-1462 (1997).

Esposito, C., Caputo, I. & Troncone, R. New therapeutic strategies for coeliac disease: tissue transglutaminase as a target. Curr. Med. Chem. 14, 2572-80 (2007).

Ewing, B., Hillier, L., Wendl, M. C. & Green, P. Base-calling of automated sequencer traces using phred. I. Accuracy assessment. Genome research 8, 175-185 (1998).

FAO The State of Food Insecurity in the World. http://www.fao.org/docrep/011/i0291e/i0291e00.htm. Accessed 2009 Sep. 30 (2006).

Ferry, J. G. Enzymology of one-carbon metabolism in methanogenic pathways. FEMS Microbiol. Rev. 23, 13-38 (1999).

Finn R D, Tate J, Mistry J, Coggill P C, Sammut S J et al. (2008) The Pfam protein families database. Nucleic adds research 36, D281-288.

Fischbach M A, Walsh C T (2006) Assembly-line enzymology for polyketide and nonribosomal peptide antibiotics: logic, machinery and mechanisms. Chem Rev 106:3468-3496.

Fischer M, Schott A K, Römisch W, Ramsperger A, Augustin M et al. (2004) Evolution of vitamin B2 biosynthesis. A novel class of riboflavin synthase in Archaea. J Mol Biol 343:267-78.

Fischer M, Römisch W, Illarionov B, Eisenreich W, Bacher A (2005) Structures and reaction mechanisms of riboflavin synthases of eubacterial and archaeal origin. Biochem Soc Trans 33:780-784.

Fleischmann et al., 1995. Whole-genome random sequencing and assembly of *Haemophilus influenzae* Rd Science 269:496-512.

Food and Agriculture Organization of the United Nations (FAO). The State of Food Insecurity in the World. Available: http://www.fao.org/docrep/011/10291e/i0291e00.htm (2008).

Forouhar F, Abashidze M, Xu H, Grochowski L L, Seetharaman J et al. (2008) Molecular insights into the biosynthesis of the F420 coenzyme. J Biol Chem 283: 11832-11840.

Fricke W F, Seedorf H, Henne A, Kruer M, Liesegang H, Hedderich R, Gottschalk G, Thauer R K (2006) The genome sequence of *Methanosphaera stadtmanae* reveals why this human intestinal archaeon is restricted to methanol and H2 for methane formation and ATP synthesis. Journal of Bacteriology 188, 642-658.

Friesen, J. A. & Rodwell, J. A. The 3-hydroxy-3-methyl-glutaryl coenzyme-A (HMG-CoA) reductases. Genome Biol. 5, 248-(2004).

Fujihashi, M., Wei, L., Kotra, L. P., Pai, E. F. Structural characterisation of the molecular events during a slow substrate-product transition in orotidine 5'-monophosphate decarboxylase. J. Mol. Biol. 387, 1199-1210 (2009).

Gadelle, D., Bocs, C., Graille, M. & Forterre, P. Inhibition of archaeal growth and DNA topoisomerase VI activities by the Hsp90 inhibitor radicicol. Nucl. Acids Res. 33, 2310-2317 (2005).

Galperin M. Y. Using archaeal genomes to fight global warming and clostridia to fight cancer. Environ. Microbiol. 9, 279-286 (2007).

Gardner P P, Daub J, Tate J G, Nawrocki E P, Kolbe D L et al. Rfam: updates to the RNA families database. Nucleic acids research 37, D136-140 (2009).

Gerdes S., Edwards R., Kubal M., Fonstein M., Stevens R. & Osterman A. Essential genes on metabolic maps. Curr. Opin. Biotechnol. 17, 448-56 (2006).

Gilles, H. & Thauer, R. K. Uroporphyrinogen III, an intermediate in the biosynthesis of the nickel-containing factor F430 in *Methanobacterium thermoautotrophicum*. Eur. J. Biochem. 135, 109-112 (1983).

Girodeau, J-M., Agouridas, C., Masson, M., Pineau, R. & Le Goffic, F. The lysine pathway as target for a new genera of synthetic antibacterial antibiotics? J. Med. Chem. 29, 1023-1030 (1986).

Gish, W. & States, D. J. Identification of protein coding regions by database similarity search. Nature genetics 3, 266-272 (1993).

Global New Zealand International Trade, Investment and Travel Profile. (2008).

Godde J S, Bickerton A (2006) The repetitive DNAe called CRISPRs and their associated genes: evidence of horizontal transfer among prokaryotes. Journal of Molecular Evolution 62, 718-729.

Goenrich M, Mahlert F, Duin E C, Bauer C, Jaun B et al. (2004) Probing the reactivity of Ni in the active site of methyl-coenzyme M reductase with substrate analogues. J. Biol. Inorg. Chem. 9:691-705.

Goenrich M, Thauer R K, Yurimoto H, Kato N (2005) Formaldehyde activating enzyme (Fae) and hexylose-6-phosphate synthase (Hps) in *Methanosarcina barkeri*: a possible function in ribose-5'-phosphate biosynthesis. Arch Microbiol 184:41-48.

Goldberg S M, Johnson J, Busam D, Feldbylum T, Ferriera S et al. A Sanger/pyrosequencing hybrid approach for the generation of high-quality draft assemblies of marine microbial genomes. Proc Natl Acad Sci USA 103: 11240-11245.

Gottschalk, G. & Thauer, R. K. The Na(+)-translocating methyltransferase complex from methanogenic archaea. Biochimica et biophysica acts 1505, 28-36 (2001).

Grabarse W, Vaupel M, Vorholt J A, Shima S, Thauer R K, Wittershagen A, Bourenkov G, Bartunik H D, Ermler U. The crystal structure of methenyltetrahydromethanopterin cyclohydrolase from the hyperthermophilic archaeon *Methanopyrus kandleri*. Structure. 7, 1257-68 (1999).

Grabarse W, Mahlert F, Duin E C, Goubeaud M, Shima S et al. On the mechanism of biological methane formation: structural evidence for conformational changes methyl-co-enzyme M reductase upon substrate binding. J Mol Biol 309:315-330 (2001).

Graham, D. E, & White, R. H. Elucidation of methanogenic coenzyme biosyntheses: from spectroscopy to genomics. Nat. Prod. Rep. 19, 133-147 (2002).

Graham, D. E., Xu, H. & White, R. H. A member of a new class of GTP cyclohydrolases produces formylaminopyrimidine nucleotide monophosphates. Biochem. 41, 15074-15084 (2002).

Graham, D. E., Xu, H. & White, R. H. Identification of coenzyme M biosynthetic phosphosulfolactate synthase: a new family of sulfonate-biosynthesizing enzymes. The Journal of biological chemistry 277, 13421-13429 (2002).

Graham, D. E., Xu, H. & White, R. H. Identification of the 7,8-didemethyl-8-hydroxy-5-deazariboflavin synthase required for coenzyme F420 biosynthesis. Arch. Microbiol. 180, 455-464 (2003).

Graham, D. E., Xu, H. & White, R. H. *Methanococcus jannaschii* uses a pyruvoyl-dependent arginine decarboxylase in polyamine biosynthesis. J. Biol. Chem. 28, 277, 23500-7 (2002).

Graham, L. L. & Beveridge, T. J. Structural differentiation of the *Bacillus subtilis* 168 cell wall. J. Bacteriol. 176(5), 1413-1421 (1994).

Graille M, Cladière L, Durand D, Lecointe F, Gadelle D et al. (2008) Crystal structure of an intact type II DNA topoisomerase: insights into DNA transfer mechanisms. Struct 16:360-370.

Graupner, M. & White, R. H. The first examples of (S)-2-hydroxyacid dehydrogenases catalysing the transfer of the pro-4S hydrogen of NADH are found in the Archaea. Biochem. Biophys. Acta 1548, 169-173 (2001).

Graupner, M., Xu, H. & White, R. H. Characterization of the 2-phospho-L-lactate transferase enzyme involved in coenzyme F420 biosynthesis in *Methanococcus jannaschii*. Biochem. 41, 3754-3761 (2002).

Graupner, M., Xu, H. & White, R. H. Identification of an archaeal 2-hydroxy acid dehydrogenase catalysing reactions involved in coenzyme biosynthesis in methanoarchaea. J. Bacteriol. 182, 3688-3692 (2000).

Graupner, M., Xu, H. & White, R. H. New class of IMP cyclohydrolase in *Methanococcus jannaschii*. J. Bacteriol. 184, 1471-1473 (2002).

Griffin, M., Casadio, R. & Bergamini, C. M. Transglutaminases: nature's biological glues. Biochem J. 368, 377-396 (2002).

Grochowski L. L., Xu, H. & White, R. H. Identification and characterization of the 2-phospho-L-lactate guanyltransferase involved in coenzyme F420 biosynthesis. Biochem. 47, 3033-3037 (2008).

Grochowski, L. L. & White, R. H. Promiscuous anaerobes: new and unconventional metabolism in methanogenic archaea. Ann. N.Y. Acad. Sci. 1125, 190-214 (2008).

Grochowski, L. L., Xu, H. & White, R. H. An iron(II) dependent formamide hydrolase catalyzes the second step in the archaeal biosynthetic pathway to riboflavin and 7,8-didemethyl-8-hydroxy-5-deazariboflavin. Biochem. 48, 4181-8 (2009).

Grochowski, L. L., Xu, H. & White, R. H. Identification of lactaldehyde dehydrogenase in *Methanocaldococcus jannaschii* and its involvement in production of lactate for F420 biosynthesis. J. Bacteriol. 188, 2836-44 (2006).

Grochowski, L. L., Xu, H. & White, R. H. *Methanocaldococcus jannaschii* uses a modified mevalonate pathway for biosynthesis of isopentenyl diphosphate. J. Bacteriol. 188, 3192-3198 (2006).

Grochowski, L. L., Xu, H. & White, R. H. Ribose-5?-phosphate biosynthesis in *Methanocaldocoocus jannaschii* occurs in the absence of a pentose-phosphate pathway. J. Bacteriol. 187, 7382-7389 (2005).

Grochowski, L. L., Xu, H., White, R. H. Ribose-5-phosphate biosynthesis in *Methanocaldocoocus jannaschii* occurs in the absence of a pentose-phosphate pathway. J. Bacteriol. 187, 7382-7389 (2005).

Grochowski, L. L., Xu, H., Leung, K. & White, R. H. Characterization of an Fe2+-dependent archaeal-specific GTP cyclohydrolase, MptA, from *Methanocaldococcus jannaschii*. Biochem. 46, 6658-6667 (2007).

Grüber, G & Marshansky, V. New insights into structure-function relationships between archaeal ATP synthase (A1A0) and vacuolar type ATPase (V1V0). Bioessays 30, 1096-1109 (2008).

Guerra-Lopez, D., Daniels, L. & Rawat, M. *Mycobacterium smegmatis* mc 155 fbiC and MSMEG_2392 are involved in triphenylmethane dye decolorisation and coenzyme F420 biosynthesis. Microbiol. 153, 2724-2732 (2007).

Guo R T, Cao R, Liang P H, Ko T P, Chang T H et al. (2007) Bisphosphonates target multiple sites in both cis- and trans-prenyltransferases. Proc Natl Acad Sci USA 104: 10022-7.

Haft D H, Selengut J, Mongodin E F, Nelson K E (2005) A guild of 45 CRISPR-associated (Cas) protein families and multiple CRISPR/Cas subtypes exist in prokaryotic genomes. PLoS Computational Biology 1:474-483.

Haft, D. H., Selengut, J. D. & White, O. The TIGRFAMs database of protein families. Nucleic acids research 31, 371-373 (2003).

Hagemeier C H, Shima S, Thauer R K, Bourenkov G, Bartunik H D et al. (2003) Coenzyme F420-dependent methylenetetrahydromethanopterin dehydrogenase (Mtd) from *Methanopyrus kandleri*: a methanogenic enzyme with an unusual quarternary structure. J Mol Biol 332:1047-1057.

Hammes W. P., Winter J. & Kandler O. The sensitivity of pseudomurein-containing genus *Methanobacterium* to inhibitors of murein synthesis. Arch. Microbiol. 123, 275-279 (1979).

Harmer J, Finazzo C, Piskorski R, Ebner S, Duin E C et al. (2008) A nickel hydride complex in the active site of methyl-coenzyme M reductase: implications for the catalytic cycle. J Am Chem Soc 130:10907-10920.

Hartmann, E. & König, H. Comparison of the biosynthesis of the methanobacterial pseudomurein and the eubacterial murein. Nat. Wissenschaft. 77, 472-475 (1990).

Heath, R. J. & Rock, C. O. Fatty acid biosynthesis as a target for novel antibacterials. Curr. Opin. Investig. Drugs 5, 146-153 (2004).

Heath, R. J., White, S. W. & Rock, C. O. Lipid biosynthesis as a target for antibacterial agents. Prog. Lipid Res. 40, 467-497 (2001).

Hedderich, R., Hamann, N. & Bennati, M. Heterosulfide reductase from methanogenic archaea: a new catalytic role for an iron-sulfur cluster. Biol. Chem. 386, 961-970 (2005).

Hegarty R. S. Mechanisms for competitively reducing ruminal methanogenesis. Aust. J. Agric. Res. 50, 1299-1305 (1999).

Heim, S., Künkel, A., Thauer, R. K. & Hedderich, R. Thiol:fumarate reductase (Tfr) from *Methanobacterium thermoautotrophicum*-identification of the catalytic sites for fumarate reduction and thiol oxidation. Eur. J. Biochem. 253, 292-9 (1998).

Hendrickson, E. L. & Leigh, J. A. Roles of coenzyme F420-reducing hydrogenases and hydrogen- and F420-dependent methylenetetrahydromethanopterin dehydrogenases in reduction of F420 and production of hydrogen during methanogenesis. J. Bacteriol. 190, 4818-4821 (2008).

Hermoso J. A., García J. L. & García P. Taking aim on bacterial pathogens: from phage therapy to enzybiotics. Curr. Opin. Microbiol. 10, 461-472 (2007).

Hernández-Montes, G., Díaz-Mejía, J. J., Pérez-Rueda, & Segovia, L. The hidden universal, distribution of amino acid biosynthetic networks: a genomic perspective in their origins and evolution. Genom. Biol. 9, R95 (2008).

Hilpert, R., Winter, J., Hammes, W. & Kandler, O. The sensitivity of archaebacteria to antibiotics. Zbl. Bakt. Hyg. I Abt. Orig. C 2, 11-20 (1981).

Hiromoto T, Ataka K, Pilak O, Vogt S, Stagni M S, Meyer-Klaucke W, Warkentin E, Thauer R K, Shima S, Ermler U. The crystal structure of C176A mutated [Fe]-hydrogenase suggests an acyl-iron ligation in the active site iron complex. FEBS Lett. 583, 585-90 (2009).

Hochheimer, A., Hedderich, R. & Thauer, R. K. The formylmethanofuran dehydrogenase isoenzymes in *Methanobacterium wolfei* and *Methanobacterium thermoautotrophicum*: induction of the molybdenum isoenzyme by molybdate and constitutive synthesis of the tungsten isoenzyme. Arch. Microbiol. 170, 389-93 (1998).

Hochheimer, A., Linder, D., Thauer, R. K. & Hedderich, R. The molybdenum formylmethanofuran dehydrogenase operon and the tungsten formylmethanofuran dehydrogenase operon from *Methanobacterium thermoautotrophicum*. Structures and transcriptional regulation. European Journal of Biochemistry 242, 156-162 (1996).

Hochheimer, A., Schmitz, R. A., Thauer, R. K. & Hedderich, R. The tungsten formylmethanofuran dehydrogenase from *Methanobacterium thermoautotrophicum* contains sequence motifs characteristic for enzymes containing molybdopterin dinucleotide. Eur. J. Biochem. 234, 910-20 (1995).

Hopkins A. L. & Groom C. R. The druggable genome. Nat. Rev. Drug. Discov. 1, 727-730 (2002).

Hoshino, T., Tamegai, H., Kakinuma, K. & Eguchi, T. Inhibition of type 2 isopentenyl diphosphate isomerase from *Methanocaldococcus jannaschii* by a mechanism-based inhibitor of type I1 isopentenyl diphosphate isomerase. Bioorg. Med. Chem. 14, 6555-6559 (2006).

Howell, D. M. & White, R. H. D-erythro-neopterin biosynthesis in the methanogenic archaea *Methanococcus thermophila* and *Methanobacterium thermoautotrophicum* ?H. J. Bacteriol. 179, 5165-5170 (1997).

Howell, D. M., Graupner, M., Xu, H. & White, R. H. Identification of enzymes homologous to isocitrate dehydrogenase that are involved in Coenzyme B and leucine biosynthesis in Methanoarchaea. J. Bacteriol. 182, 5013-5016 (2000).

Howell, D. M., Harich, K., Xu, H. & White, R. H. ?-Keto acid chain elongation reactions involved in the biosynthesis of Coenzyme B (7-mercaptoheptanoyl threonine phosphate). Biochem. 37, 10108-10117 (1998).

Howell, D. M., Xu, H. & White, R. H. (R)-citramalate synthase in methanogenic Archaea. J. Bacteriol. 181, 331-333 (1999).

Hoyt, J. C., Oren, A., Escalante-Semerena, J. C. & Wolfe R. S. Tetramethanopterin-dependent serine transhydroxymethylase from *Methanobacterium thermoautotrophicum*. Arch. Microbiol. 145, 153-158 (1986).

Huang, Q., Tonge, P. J., Slayden, R. A., Kirikae, T. & Ojima, I. FtsZ: a novel target for tuberculosis drug discovery. Curr. Top. Med. Chem. 7, 527-543 (2007).

Hunter S, Apweiler R, Attwood T K, Bairoch A, Bateman A et al. (2009) InterPro: the integrative protein signature database. Nucleic Acids Res 37(Database issue):D211-215.

Hutton, C. A., Perugini, M. A. & Gerrard, J. A. Inhibition of lysine biosynthesis: an evolving antibiotic strategy. Mol. Biosyst. 3, 458-465 (2007).

IPCC (Intergovernmental Panel on Climate Change), 2007. Climate Change 2007: The Physical Science Basis, Contribution of Working Group I to the Fourth Assessment Report of the Intergovernmental Panel on Climate Change (Solomon, S., D. Qin, M. Manning, Z. Chen, M., Marquis, K. B. Averyt, M. Tignor and H. L. Miller (eds.)]. Cambridge University Press, Cambridge United Kingdom and New York, N.Y., USA, Available: http://www.ipcc.ch/publications_and_data/publications_ipcc_fourth_assessment_report_wg1_report_the_physical_science_basis.htm. Accessed 2009 Sep. 30.

Iqbal, M.a.C., Y Mitigation of ruminant methane production:current strategies, constraints and future options. World Journal of Microbiology and Biotechnology, 2747-2755 (2008).

Iranzo, M., Aguado, C., Pallotti, C., Cañizares, J. V. & Mormeneo, S. Transglutaminase activity is involved in *Saccharomyces cerevisiae* wall construction. Microbiol. 148, 1329-34 (2002).

Irimia A., Madern D., Zaccaï G., Vellieux F. M. Methanoarchaeal sulfolactate dehydrogenase: prototype of a new family of NADH-dependent enzymes. EMBO J. 23, 1234-44 (2004).

Irwin, J. J. and Shoichet, B. K. (2005) J. Chem. Inf. Model. 45(1):177-82.

Ishino, Y & Cann, I. K. O. The Euryarchaeotes, a subdomain of Archaea, survive on a single DNA polymerase: Fact or farce? Genes Genet. Syst. 73, 323-336 (1998).

Istvan, E. S. Bacterial and mammalian HMG-CoA reductases: related enzymes and distinct architectures. Curr. Opin. Struct. Biol. 11, 746-751 (2001).

Jacobson, F. S., Daniels, L., Fox, J. A., Walsh, C. T., Orme-Johnson, W. H. Purification and properties of an 8-hydroxy-5-deazaflavin-reducing hydrogenase from *Methanobacterium thermautotrophicum*. J. Biol. Chem. 257, 3385-3388 (1982).

Jansen R, Embden J D, Gaastra W, Schouls L M (2002) Identification of genes that are associated with DNA repeats in prokaryotes. Molecular Microbiology 43, 1565-1575.

Jansen R, van Embden J D, Gaastra W, Schouls L M (2002) Identification of a novel family of sequence repeats among prokaryotes. OMICS: A journal of integrative biology 6, 23-33.

Janssen P. H. & Kirs M. Structure of the archaeal community of the rumen. Appl. Environ. Microbiol. 74, 3619-3625 (2008).

Jarrell, K. F., Faguy, D., Herbert, A. M., and Kalmakoff, M. L. A general method of isolating high molecular weight DNA from methanogenic archaea (archaebacteria) Can. J. Microbiol. 38, 65-68 (1992).

Jenal U, Rechsteiner T, Pan P Y, Bühlmann E, Meile L et al. (1991) Isoleucyl-tRNA synthetase of *Methanobacterium thermautotrophicum* Marburg. J Biol Chem 266:10570-10577.

Jensen, L. J., Friis, C. and Ussery, D. W. 1999 Three views of microbial genomes. Res. Microbiol. 150, 773-777.

Joblin K N, Naylor G E, Williams A G (1990) Effect of *Methanobrevibacter smithii* on xylanolytic activity of anaerobic ruminal fungi. Applied and Environmental Microbiology 56, 2287-2295.

Joerger, A. C., Mueller-Dieckmann, C. & Schulz, G. E. Structures of L-fuculose-1-phosphate aldolase mutants outlining motions during catalysis. J. Mol. Biol. 303, 531-543 (2000).

Johnson, K. A. & Johnson, D. E. Methane emissions from cattle. Journal of animal science 73, 2483-2492 (1995).

Kadziola A, Jepsen C H, Johansson E, McGuire J, Larsen S et al. (2005) Novel class III phosphoribosyl diphosphate synthase: structure and properties of the tetrameric, phosphate-activated, non-allosterically inhibited enzyme from *Methanocaldococcus jannaschii*. J Mol Biol 354:815-828.

Kalyuzhnaya M G, Korotkova N, Crowther G, Marx C J, Lidstrom M E et al. (2005) Analysis of gene islands involved in methanopterin-linked C1 transfer reactions reveals new functions and provides evolutionary insights. J Bacteriol 187:4607-4614.

Kandler, O. & König, H. Cell envelopes of archaebacteria, in The Bacteria Volume VIII: Archaebacteria, C. R. Woese and R. S. Wolfe, Editors. Academic Press: Orlando. p. 413-457 (1985).

Kandler, O. & König, H. Cell wall polymers in Archaea (Archaebacteria). Cell Mol Life Sci 54, 305-308 (1998).

Kandler, O. & König, H. Chemical composition of the peptidoglycan-free cell walls of methanogenic bacteria. Archives of microbiology 118, 141-152 (1978).

Kandler, O. & König, H. in The Bacteria Volume VIII: Archaebacteria. (eds. C. R. Woese & R. S. Wolfe) 413-457 (Academic Press, Orlando; 1985).

Kanehisa M, Goto S, Kawashima S, Okuno Y, Hattori M (2004) The KEGG resource for deciphering the genome. Nucleic Acids Research 32, D277-D280.

Kanehisa, M. & Goto, S. KEGG: Kyoto Encyclopedia of Genes and Genomes. Nucleic Acids Res. 28, 27-30 (2000).

Kang, Y. N., Tran, A., White, R. H., & Ealick, S. E. A novel function for the N-terminal nucleophile hydrolase fold demonstrated by the structure of an archaeal inosine monophosphate cyclohydrolase. Biochem. 46, 5050-5062 (2007).

Kato, N., Yurimoto, H. & Thauer, R. K. The physiological role of the ribulose monophosphate pathway in bacteria and archaea. Biosci. Biotechnol. Biochem. 70, 10-21 (2006).

Kato, S., Kosaka, T. & Watanabe, K. Comparative transcriptome analysis of responses of Methanothermobacter thermoautotrophicus to different environmental stimuli. Environ. Microbiol. 10, 893-905 (2008).

Katz, A. H. & Caufield, C. E. Structure-based design approaches to cell wall biosynthesis inhibitors. Curr. Pharm. Design 9, 857-866 (2003).

Kenealy, W. & Zeikus, J. G. Influence of corrinoid antagonists on methanogen metabolism. J. Bacteriol. 146, 133-140 (1981).

Kengen, S. W., von den Hoff, H. W., Keltjens, J. T., van der Drift, C. & Vogels, G. D. F390 synthetase and F390 hydrolase from Methanobacterium thermoautotrophicum (strain delta H). Biofact. 3, 61-65 (1991).

Kezmarsky, N. D., Xu, H., Graham, D. E. & White, R. H. Identification and characterization of a L-tyrosine decarboxylase in Methanocaldococcus jannaschii. Biochim Biophys Acta. 1722, 175-82 (2005).

Kiener, A., König, H., Winter, J. and Leisinger, T. 1987. Purification and use of Methanobacterium wolfei pseudomurein endopeptidase for lysis of Methanobacterium thermoautotrophicum. J. Bacteriol. 169, 1010-1016.

Kim, H-S., Vothknecht, U. C., Hedderich, R., Celic, I. & Söll, D. Sequence divergence of seryl-tRNA synthetases in Archaea. J. Bacteriol. 180, 6446-6449 (1998).

Kim, S., Lee, S. W., Choi, E.-C. & Choi, S. Y. AminacyltRNA synthetases and their inhibitors as a novel family of antibiotics. Appl. Muicrobiol. Biotechnol. 61, 278-288 (2003).

Kimura, K-i. & Bugg, T. D. H. recent advances in antimicrobial nucleoside antibiotics targeting cell wall biosynthesis. Nat. Prod. Rep. 20, 252-273 (2003).

Klein, A. R., Fernández, V. M. & Thauer, R. K. H2-forming N5-N10-methylenetetrahydromethanopterin dehydrogenase: mechanism of H2 formation analyzed using hydrogen isotopes. FEBS Lett. 368, 203-206 (1995).

Klieve, A. V. & Hegarty, R. S. Opportunities for biological control of ruminal methanogenesis. Aust. J. Exp. Agri. 50, 1315-1319 (1999).

Klipcan, L., Frenkel-Morgenstern, M. & Safro, M. G. Presence of tRNA-dependent pathways correlates with high cysteine content in methanogenic Archaea. Trends Genet. 24, 59-63 (2008).

Knox, M. R. and Harris, J. E. 1986. Isolation and characterisation of a bacteriophage of Methanobrevibacter smithii. In Abstracts of the XIV International Congress on Microbiology. Manchester: International Union of Microbiological Societies.

Koga, Y. & Morii, H. Biosynthesis of ether-linked polar lipids in archaea and evolutionary considerations. Microbiol. Molec. Biol. Rev. 71, 97-120 (2007).

König, H., Hartmann, E. & Karcher, U. Pathways and principles of the biosynthesis of methanobacterial cell wall polymers. Systematic and applied microbiology 16, 510-517 (1994).

Kotnik, M., Anderluh, P. S. & Prezelj, A. Development of novel inhibitors targeting intracellular steps of peptidoglycan biosynthesis. Curr. Pharm. Des. 13, 2283-309 (2007).

Krogh, A., Larsson, B., von Heijne, G. & Sonnhammer, E. L. Predicting transmembrane protein topology with a hidden Markov model: application to complete genomes. Journal of molecular biology 305, 567-580 (2001).

Kurtz S, Schleiermacher C (1999) REPuter: fast computation of maximal repeats in complete genomes. Bioinformatics 15, 426-427.

Kwang-Pil, C., Bair, T., Bae, Y-M. & Daniels, L. Use of transposon Tn5367 mutagenesis and a nitroimidazopyranbased selection system to demonstrate a requirement for fbiA and fbiC in coenzyme F420 biosynthesis by Mycobacterium bovis BCG. J. Bacteriol. 183, 7058-7066 (2001).

Kwang-Pil, C., Kendrick, N. & Daniels, L. Demonstration that fbiC is required for Mycobacterium bovis BCG for coenzyme F420 and FO biosynthesis. J. Bacteriol. 184, 2420-2428 (2002).

Larkin M A, Blackshields G, Brown N P, Chema R, McGettigan P A et al., Clustal W and Clustal X version 2.0. Bioinformatics 23(21), 2947-2948 (2007).

Leahy S C, Kelly W J, Altermann E, Ronimus R S, Yeoman C J, et al. (2010) The Genome Sequence of the Rumen Methanogen Methanobrevibacter ruminantium Reveals New Possibilities for Controlling Ruminant Methane Emissions. PLoS ONE 5(1): e8926. doi:10.1371/journal.pone.0008926.

Lee B I, Chang C, Cho S J, Eom S H, Kim K K et al. (2001) Crystal structure of the MJ0490 gene product of the hyperthermophilic archaebacterium Methanococcus jannaschii, a novel member of the lactate/malate family of dehydrogenases. Biochem 40:10310-10316.

Lee, K. N., Fesus, L., Yancey, S. T., Girard, J. E. & Chung, S. I. Development of selective inhibitors of transglutaminase. J. Biol. Chem. 260, 14689-14694 (1985).

Lemker, T., Grüber, G., Schmid, R. & Müller, V. Defined subcomplexes of the A1 ATPase from the archaeon Methanosarcina mazei Göl: biochemical properties and redox regulation. FEBS Lett. 544, 206-209 (2003).

Lemker, T., Ruppert, C., Stöger, H. Wimmers, S. & Müller, V. Overproduction of a functional A1 ATPase from the archaeon Methanosarcina mazei Got in Escherichia coli. Eur. J. Biochem. 268, 3744-3750 (2001).

Leslie, M., Aspin, M., and Clark, H. Greenhouse gas emissions from New Zealand agriculture:issues, persepectives and industry response. Australian Journal of Experimental Agriculture, 1-5 (2008).

Lewalter, K & Müller, V. Bioenergetics of archaea: ancient energy conserving mechanisms developed in the early history of life. Biochim. Biophys. Acta 1757, 437-445 (2006).

Li, H., Graupner, M., Xu, H. & White, R. H. CofE catalyses the addition of two glutamates to F420-0 in F420 coenzyme biosynthesis in Methanococcus jannaschii. Biochem. 42, 9771-9778 (2003).

Lienard T, Becher. B, Marschall M, Bowien S, Gottschalk G (1996) Sodium ion translocation by N5-methyltetrahydromethanopterin:coenzyme M methyltransferase from Methanosarcina mazei Göl reconstituted in ether lipid liposomes. Eur J Biochem 239: 857-864.

Lin, W. & Whitman, W. B. The importance of porE and porG in the anabolic pyruvate oxidoreductase of *Methanococcus maripaludis*. Arch. Microbiol. 181, 68-73 (2004).

Lin, W. C., Yang, Y-L. & Whtman, W. B. The anabolic pyruvate oxidoreductase from *Methanococcus maripaludis*. Arch. Microbiol. 179, 444-456 (2003).

Lin, Z. & Sparling, R. Investigation of serine hydroxymethyltransferase in methanogens. Can. J. Microbiol. 44, 652-656 (1998).

Lindahl, P. A. & Chang, B. The evolution of acetyl-CoA synthase. Orig. Life Evolut. Biosph. 31, 403-434 (2001).

Lingl A, Huber H, Stetter K O, Mayer F, Kellermann J et al. (2003) Isolation of a complete A1A0 ATP synthase comprising nine subunits from the hyperthermophile *Methanococcus jannaschii*. Extremophiles 7:249-257. Lobry J R (1996) Asymmetric substitution patterns in the two DNA strands of bacteria. Mol Biol Evol 13:660-5.

Lobry J R (1996) Asymmetric substitution patterns in the two DNA strands of bacteria. Mol Biol Evol 13:660-5.

Loenen, W. and N. Murray. 1986. Modification enhancement by restriction alleviation protein (Ral) of bacteriophage lambda. J. Mol. Biol. 190:11-22.

Löwe, J. & Amos, L. A. Crystal structure of the bacterial cell-division protein FtsZ. Nature 391, 203-206 (1998).

Lowe, T. M. & Eddy, S. R. tRNAscan-SE: a program for improved detection of transfer RNA genes in genomic sequence. Nucleic acids research 25, 955-964 (1997).

Lucchini, S., F. Desiere, and H. Brussow. 1999. Comparative genomics of *Streptococcus thermophilus* phage species supports a modular evolution theory. J. Virol. 73:8647-8656.

Luo, H. W., Zhang, H., Suzuki, T., Hattori, S. & Kamagata, Y. Differential expression of methanogenesis genes of *Methanothermobacter thermoautotrophicus* (formerly *Methanobacterium thermoautotrophicum*) in pure culture and in cocultures with fatty acid-oxidizing syntrophs. Applied and environmental microbiology 68, 1173-1179 (2002).

Luo, Y. N., Pfister, P., Leisinger, T. and Wasserfallen, A. 2002. Pseudomurein endoisopeptidases PeiW and PeiP, two moderately related members of a novel family of proteases produced in *Methanothermobacter* strains. FEMS Microbiol. Lett. 208, 47-51.

Majernik, A. I. & Chong, J. P. A conserved mechanism for replication origin recognition and binding in archaea. Biochem. J. 409(2), 511-518 (2008).

Makarova K S, Grishin N V, Shabalina S A, Wolf Y I, Koonin E V (2006) A putative RNA-interference-based immune system in prokaryotes: computational analysis of the predicted enzymatic machinery, functional analogies with eukaryotic RNAi, and hypothetical mechanisms of action. Biology Direct 1:7-32.

Makarova, K. S., Aravind, L. and Koonin, E. V. 1999. A superfamily of archaeal, bacterial, and eukaryotic proteins homologous to animal transglutaminases. Protein Sci. 8, 1714-1719.

Makarova, K. S., Sorokin, A. V., Novichkov, P. S., Wolf, V. I. & Koonin, E. V. Clusters of orthologous genes for 41 archaeal genomes and implications for evolutionary genomics of archaea. Biol. Direct. 27, 2-33 (2007).

Mamat B, Roth A, Grimm C, Ermler U, Tziatzios C et al. (2002) Crystal structures and enzymatic properties of three formyltransferases from archaea: environmental adaptation and evolutionary relationship. Pro Sci 11:2168-2178.

Mareso, A. W. & Schneewind, O. Sortase as a target of anti-infective therapy. Pharmacol. Rev. 60, 128-141 (2008).

Mareso A W, Wu R, Kern J W, Zhang R, Janik D et al. (2007) Activation of inhibitors by sortase triggers irreversible modification of the active site. J Biol Chem 282:23129-23139.

Martinez-Cruz, L. A. et al. Crystal structure of MJ1247 protein from *Methanocaldococcus jannaschii* at 2 Å resolution infers a molecular function of 3-hexylose-6-phosphate isomerase. Struct. 10, 195-204 (2002).

Mashhadi, Z., Zhang, H., Xu, H. & White, R. H. Identification and characterisation of an archeal-specific riboflavin kinase. J. Bacteriol. 190, 2615-2518 (2008).

Mauer, J., Kuettner, H. C., Zhang, J. K., Hedderich, R. & Metcalf, W. W. Genetic analysis of the archaeon *Methanosarcina barkeri* reveals a central role for Ech hydrogenase and ferredoxin in methanogenesis and carbon fixation. Proc. Natl. Acad. Sci. 99, 5632-5637 (2002).

McAllister T. A. & Newbold C. J. Redirecting rumen fermentation to reduce methanogenesis. Aust. J. Exper. Agric. 48, 7-13 (2008).

McInerney, M. J., Bryant, M. P. & Pfennig, N. Anaerobic bacterium that degrades fatty acids in syntrophic association with methanogens. Arch. Microbiol. 122, 129-135 (1979).

Miller, T. L. & Wolin M. J. Inhibition of growth of methane-producing bacteria of the rumen forestomach by hydroxymethylglutaryl~SCoA reductase inhibitors. J. Dairy Sci. 84, 1445-1448 (2001).

Miller, T. L., Genus II. Methanobrevibacter, in Bergey's Manual of Systematic Bacteriology Volume One: The Archaea and the Deeply Branching and Phototrophic Bacteria., D. R. Boone and R. W. Castenholz, Editors. Springer: New York. p. 218-226 (2001).

Mills, S. D. When will the genomics investment pay off for antibacterial discovery? Biochemical pharmacology 71, 1096-1102 (2006).

Ministry for the Environment. New Zealand's greenhouse gas inventory 1990-2005 (2007) Available: http://www.mfe.govt.nz/issues/climate/greenhouse-gas-emissions/greenhouse-gas-inventory.html. Accessed 2009 Sep. 30.

Moon C D, Pacheco D M, Kelly W J, Leahy S C, Li D et al. (2008) Reclassification of *Clostridium proteoclasticum* as Butyrivibrio proteoclasticus comb. nov., a butyrate-producing ruminal bacterium. Int J Syst Evol Microbiol 58:2041-2045.

Morar, M., White, R. H. & Ealick, S. E. Structure of 2-amino-3,7-dideoxy-D-threo-hept-6-ulosonic acid synthase, a catalyst in the archaeal pathway for the biosynthesis of aromatic amino acids. Biochem. 46, 10562-71 (2007).

Morrison, S. D., Roberts, S. A., Zegeer, A. M., Montfort, W. R. & Bandarian, V. A new use for a familiar fold: the X-ray crystal structure of GTP-bound GTP cyclohydrolase III from *Methanocaldococcus jannaschii* reveals a two metal ion catalytic mechanism. Biochem. 47, 230-42 (2008).

Moser, J., Schubert, W.-D., Heinz, D. W. & Jahn, D. Tetrapyrroles: their life, birth and death. Biochem. Soc. Trans. 30, 579-584 (2002).

Mukhopadhyay, B. & Daniels, L. Aerobic purification of N5, N10-methenyltetrahydromethanopterin dehydrogenase. Separated from N5, N10-methenyltetrahydromethanopterin cyclohydrolase, from *Methanobacterium thermoautotrophicum* strain Marburg. Can. J. Microbiol. 35, 499-507 (1989).

Mukhopadhyay, B., Patel, V. J. & Wolfe, R. S. A stable archaeal pyruvate carboxylase from the hyperthermophile *Methanococcus jannaschii*. Arch. Microbiol. 174, 406-14 (2000).

Mukhopadhyay, B., Purwantini, E., Kreder, C. L. & Wolfe, R. S. Oxaloacetate synthesis in the methanarchaeon *Methanosarcina barkeri*: pyruvate carboxylase genes and a putative *Escherichia coli*-type bifunctional biotin protein ligase gene (bpl/birA) exhibit a unique organization. J. Bacteriol. 183, 3804-10 (2001).

Mukhopadhyay, B., Purwantini, E., Pihl, T. D., Reeve, J. N. & Daniels, L. Cloning, sequencing, and transcriptional analysis of the coenzyme F420-dependent methylene-5,6,7,8-tetrahydromethanopterin dehydrogenase gene from *Methanobacterium thermoautotrophicum* strain Marburg and functional expression in *Escherichia coli*. J. Biol. Chem. 270, 2827-2832 (1995).

Mukhopadhyay, B., Stoddard, S. F. &. Wolfe, R. S. Purification, regulation, and molecular and biochemical characterization of pyruvate carboxylase from *Methanobacterium thermoautotrophicum* strain deltaH. J. Biol. Chem. 273, 5155-66 (1998).

Müller, V. An, exceptional variability in the motor of archael A1A0 ATPases: from multimeric to monomeric rotors comprising 6-13 ion binding sites. Journal of bioenergetics and biomembranes 36, 115-125 (2004).

Müller, V., Ruppert, C. & Lemkar, T. Structure and function of the A0A1-ATPase from methanogenic archaea. J. Bioenerg. Biomem. 31, 15-27 (1999).

Musfeldt, M. & Schönheit, P. Novel type of ADP-forming acetyl coenzyme A synthetase in hyperthermophilic archaea: heterologous expression and characterization of isoenzymes from the sulfate reducer *Archaeoglobus fulgidus* and the methanogen *Methanococcus jannaschii*. J. Bacteriol. 184, 636-644 (2002).

Nagar-Anthal, K. R., Worrell, V. E., Teal, R. & Nagle, D. P. The pterin lumazine inhibits growth of methanogens and methane formation. Arch. Microbiol. 166, 136-140 (1996).

Nakai, K. & Horton, P. PSORT: a program for detecting the sorting signals of proteins and predicting their subcellular localization. Trends Biochem. Sci. 24(1), 34-35 (1999).

Nam Shin, J., Kim, M-J., Choi, J-a. & Chun, K. O. Characterization of aldolase from *Methanococcus jannaschii* by gas chromatography. J. Biochem. Molec. Biol. 40, 801-804 (2007).

Namboori, S. E. & Graham, D. E. Acetamido sugar biosynthesis in the Euryarchaea. J. Bacteriol. 190, 2987-2996 (2008).

New Zealand Statistics 2005 (www.stats.govt.nz)

New Zealand's Greenhouse Gas Inventory 1990-2004. The National Inventory Report and Common Reporting Format. (2006) Ministry for the Environment. Hypertext transfer protocol://www.mfe.govt.nz/publications/climate/nir-apr06/nir-apr06.pdf.

New Zealand's greenhouse gas inventory 1990-2005. (2007).

Nocek, B. et al. Structure of an amide bond forming F(420):gamma-glutamyl ligase from *Archaeoglobus fulgidus*—a member of a new family of non-ribosomal peptide synthases. J. Mol Biol. 372, 456-69 (2007).

Nyce G. W. & White R. H. dTMP biosynthesis in Archaea. J. Bacteriol. 178, 914-916 (1996).

Osborn, M. J. & Rothfield, L. Cell shape determination in *Escherichia coli*. Curr. Opin. Microbiol. 10, 606-10 (2007).

Oshikane, H. et al. Structural basis of RNA-dependent recruitment of glutamine to the genetic code. Science 312, 1950-1954 (2006).

Osterman, A. & Overbeek, R. Missing genes in metabolic pathways: a comparative genomics approach. Curr. Opin. Chem Biol. 7, 238-251 (2003).

Patent application: WO 09041831A1

Payandeh, J., Fulihashi, M., Gillon, W. & Pai, E. F. The crystal structure of (S)-3-O-geranylgeranylglyceryl phosphate synthase reveals an ancient fold for an ancient enzyme. J. Biol. Chem. 281, 6070-6078 (2006).

Payne D. J. Desperately seeking new antibiotics. Science 321, 1644-1645 (2008).

Payne, D. J., Warren, P. V., Holmes, D. J., Ji Y. & Lonsdale, J. T. Bacterial fatty acid biosynthesis: a genomics-driven target for antibacterial discovery. Drug Disc. Ther. 6, 537-544 (2001).

Perez-Bercoff, A. Koch, J. & Burglin, T. R. LogoBar: bar graph visualization of protein logos with gaps. Bioinformatics 22(1), 112-114 (2006).

Pfaltz, A., Kobelt, A., Hüster, R. & Thauer, R. K. Biosynthesis of coenzyme F430 in methanogenic bacteria. Eur. J. Biochem. 170, 459-467 (1987).

Pilak O. Mamat B, Vogt S, Hagemeier C H, Thauer Rk et al. (2006) The crystal structure of the apoenzyme of the iron-sulphur cluster-free hydrogenase. J Mol Biol 358:798-809.

Pillai B, Chemey M M, Diaper C M, Sutherland A, Blanchard J S et al. (2006) Structural insights into stereochemical inversion by diaminopimelate epimerase: an antibacterial drug target. Proc Natl Acad Sci USA 103, 8668-73.

Pisa, K. Y., Weidner, C., Maischak. H., Kavermann, H. & Müller, V. The coupling ion in the methanoarchaeal ATP synthase: H+ vs Na+ in the A0A1 ATP synthase from the archaeon *Methanosarcina mazei* Gö1. FEMS Miccrobiol. Lett. 277, 56-63 (2007).

Podell, S. & Gaasterland, T. Darkhorse: a method for genome-wide prediction of horizontal gene transfer. Genome Biol. 8(2), R16 (2007).

Poduch, E., Bello, A. M., Tang, S., Fujihashi, M., Pai, E. F., Kotra, L. P. Design of inhibitors of orotidine monophosphate decarboxylase using bioisosteric replacement and determination of inhibition kinetics. J. Med. Chem. 49, 4937-4945 (2006).

Poduch, E., Wei, L, Pai, E. F., Kotra, L. P. Structural diversity and plasticity associated with nucleotides targeting orotidine monophosphate decarboxylase. J. Med. Chem. 51, 432-438 (2008).

Pohlmann, J. & Brötz-Oesterhelt, H. New aminoacyl-tRNA synthetase inhibitors as antibacterial agents. Curr. Drug Targets-Infect. Dis. 4, 261-272 (2004).

Porat I, Kim W, Hendrickson E L, Xia Q, Zhang Y et al. (2006) Disruption of the operon encoding Ehb hydrogenase limits anabolic CO2 assimilation in the archaeon *Methanococcus maripaludis*. J Bacteriol 188:1373-1380.

Porat I, Sieprawska-Lupa M, Teng Q, Bohanon F J, White R H et al. (2006) Biochemical and genetic characterization of an early step in a novel pathway for the biosynthesis of aromatic amino acids and p-aminobenzoic acid in the archaeon *Methanococcus maripaludis*. Mol Microbiol 62:1117-31.

Porat, I., Waters, B. W., Teng, Q. & Whitman, W. B. The biosynthetic pathways for aromatic amino acid in the archaeon *Methanococcus maripaludis*. J. Bacteriol. 186, 4940-4950 (2004).

Possot, O., Gernhardt, P., Klein, A. & Sibold, L. Analysis of drug resistance in the archaebacterium *Methanococcus voltae* with respect to potential use in genetic engineering. Appl. Environ. Microbiol. 54, 734-74 (1998).

Prætorius-Ibba, M. & Ibba, M. Aminoacyl-tRNA synthesis in archaea: different but not unique. Molec. Microbiol. 48, 631-637 (2003).

Prins, R. A., van Nevel, C. J. & Demeyer, D. I. Pure culture studies of inhibitors for methanogenic bacteria. Anton. Leeuwen. 38, 281-287 (1972).

Pucci M. J. Use of genomics to select antibacterial targets. Biochem. Pharmacol. 71, 1066-1072 (2006).

Ragsdale, S. W. Pyruvate ferredoxin oxidoreductase and its radical intermediate. Chem. Rev. 103, 2333-2346 (2003).

Rappuoli, R. Reverse vaccinology, a genome-based approach to vaccine development. Vaccine 19, 2688-2691 (2001).

Rasche, M. E. & White, R. H. Mechanism for the enzymatic formation of 4-(beta-D-ribofuranosyl)aminobenzene 5'-phosphate during the biosynthesis of methanopterin. Biochem. 37, 11343-51 (1998).

Rausch C, Weber T, Kohlbacher O, Wohlleben W, Huson D H (2005) Specificity prediction of adenylation domains in nonribosomal peptide synthetases (NRPS) using Transductive Support Vector Machines (TSVM). Nucleic Acids Res 33:5799-5808.

Rawlings, N. D., Morton, F. R. and Barrett, A. J. 2006. MEROPS: the peptidase database. Nucleic Acids Res. 34, D270-D272.

Ray, S. S., Bonanno, J. B., Rajashankar, K. R., Pinho, M. G, He, G., De Lencastre, H., Tomasz, A., Burley, S. K. Cocrystal structures of diaminopimelate decarboxylase: mechanism, evolution, and inhibition of an antibiotic resistance accessory factor. Structure. 10, 1499-508 (2002).

Reeve J N, Nolling J Morgan R M, Smith D R (1997) Methanogenesis: genes, genomes and who's on first? Journal of Bacteriology 179, 5975-5986.

Reymond N, Charles H, Duret L, Calevro F, Beslon G et al. (2004) ROSO: optimizing oligonucleotides probes for microarrays. Bioinformatics 20:271-273.

Rice, P., Longden, I. & Bleasby, A. EMBOSS: The European Molecular Biology Open Software Suite. Trends Genet. 16 (6), 276-277 (2000).

Robinson, I. M & Allison, M. J. Isoleucine biosynthesis from 2-methylbutyric acid by anaerobic bacteria from the rumen. J. Bacteriol. 97(3), 1220-1226 (1969).

Römisch-Margl, W., Eisenreich, W., Haase, I, Bacher, A. & Fischer, M. 2,5-diamino-6-ribitylamino-4(3H)-pyriinidinone 5?-phosphate synthases of fungi and archaea. FEBS J. 275, 4403-4414 (2008).

Rospert, S., Voges, M., Berkessel, A., Albracht, S. P. J. & Thauer, R. K. Substrate-induced changes in the nickel-EPR spectrum of active methyl-coenzyme-M reductase from Methanobacterium thermoautotrophicum. Eur. J. Biochem. 210, 101-107 (1992).

Rother M. & Metcalf W. M. Genetic technologies for archaea. Curr. Opin. Microbiol. 8, 745-751 (2005).

Ruiz, N. Bioinformatics identification of MurJ (MviN) as the peptidoglycan lipid II flippase in Escherichia coli. Proc. Natl. Acad. Sci. 105, 15553-15557 (2008).

Russell J. B. & Rychlik J. L. Factors that alter rumen microbial ecology. Science 292, 1119-1122 (2001).

Rutherford K, Parkhill J, Crook J, Horsnell T, Rice P et al. (2000) Artemis: sequence visualization and annotation. Bioinformatics 16: 944-945.

Samuel B S, Hansen E E, Manchester J K, Coutinho P M, Henrissat B et al. (2007) Genomic and metabolic adaptations of Methanobrevibacter smithii to the human gut. Proc Natl Acad Sci USA 104:10643-10648.

Sarkar N, Langley D, Paulus H. Biological function of gramicidin: selective inhibition of RNA polymerase. Proc. Natl. Acad. Sci. U.S.A. 74(4):1478-82 (1977)

Sauer, F. D. Inhibition of methylcoenzyme M methylreductase by a uridine 5?-diphospho-acetylglucosamine derivative. Biochem. Biophys. Res. Comm. 174, 619-624 (1991).

Sayers E W, Barrett T, Benson D A, Bryant S H, Canese K et al. (2009) Database resources of the National Center for Biotechnology Information. Nucleic Acids Res 37:D5-15.

Schäfer I B, Bailer S M, Düser M G, Börsch M, Bernal R A (2006) Crystal structure of the archaeal A1A0 ATPase synthase subunit B from Methanosarcina mazei G61: implications of the nucleotide-binding differences in the major A1A0 subunits A and B. J Mol Biol 358:725-740.

Schäfer, I. B., Engelhard, M. & Müller, V. Bioenergetics of the Archaea. Microbiol. Molec. Biol. 63, 570-620 (1999).

Schäfer I B, Rössle M, Bioković G, Müller V, Grüber G (2006) Structural and functional analysis of the coupling subunit F in solution and topological arrangements of the stalk domains of the methanogenic A1A0 ATP synthase. J Bioenerg Biomem 38:83-92.

Scheehle E A, K. D. Global anthropogenic methane and nitrous oxide emissions. The Energy Journal, 33-44 (2006).

Schmitt, E., Panvert, M., Blanquet, S. & Mechulam, Y. Structural basis for tRNA-dependent amidotransferase function. Struct. 13, 1421-33 (2005).

Schneider, K., Dimroth, P. & Bott, M. Identification of triphosphoribosyl-dephospho-CoA as precursor of the citrate lyase prosthetic group. FEBS Lett. 483, 165-168 (2000).

Scholte, A. A., Eubanks, L. M., Poulter, C. D. & Vederas, J. C. Synthesis and biological activity of isopentenyl diphosphate analogues. Bioorg. Medic. Chem. 12, 763-770 (2004).

Schulz, J. O., Schubert, W-D., Moser, J., Jahn, D. & Heinz, D. W. Evolutionary relationship between initial enzymes of tetrapyrrole biosynthesis. J. Molec. Biol. 358, 1212-1220 (2006).

Schümperli, M., Pellaux, R. & Panke, S. Chemical and enzymatic routes to dihydroxyacetone phosphate. Appl. Microbiol. Biotechnol. 75, 33-45 (2007).

Scorpio A, Chabot D J, Day W A, O'brien D K, Vietri N J et al. (2007) Poly-gamma-glutamate capsule-degrading enzyme treatment enhances phagocytosis and killing of encapsulated Bacillus anthracis. Antimicrob. Agents Chemother 51: 215-222.

Scott, J. W., & Rasche, M. E. Purification, overproduction, and partial characterisation of RFAP synthase, a key enzyme in the methanopterin biosynthesis pathway. J. Bacteriol. 184, 4442-4448 (2002).

Selmer T, Kahnt J, Goubeaud M, Shima S, Grabarse W et al. The biosynthesis of methylated amino acids in the active site region of methyl-coenzyme M reductase. J Biol Chem 275:3755-3760.

Shah, N. N. & Clark, D. S. Partial purification and characterization of two hydrogenases from the extreme thermophile Methanococcus jannaschii. Appl. Environ. Microbiol. 56, 858-863 (1990).

Sharp, P. M. & Li, W. H. The codon Adaptation Index-a measure of directional synonymous codon usage bias, and its potential applications. Nucleic Acids Res. 15(3), 1281-1295 (1987).

Sheppard, K. et al. From one amino acid to another: tRNA-dependent amino acid biosynthesis. Nucl. Acids Res. 36, 1813-1825 (2008).

Sheppard, K., Sherrer, R. L., & Söll, D. Methanothermobacter thermoautotrophicus tRNAGln confines the amidotransferase GatCAB to asparaginyl-tRNAAsn formation. J. Mol. Biol. 377, 845-853 (2008).

Shieh, J. S., Whitman, W. B. Pathway of acetate assimilation in autotrophic and heterotrophic methanococci. J. Bacteriol. (1987) 169(11):5327-9.

Shima S, Pilak O, Vogt S, Schick M, Stagni M S et al. (2008) The crystal structure of [Fe]-hydrogenase reveals the geometry of the active site. Science 321:572-5.

Shima, S., Warkentin, E., Thauer, R. K. & Ermler, U. Structure and function of enzymes involved in the methanogenic pathway utilizing carbon dioxide and molecular hydrogen. J. Biosci. Bioeng. 93, 519-530 (2002).

Shokes J E, Duin E C, Bauer C, Jaun B, Hedderich R et al. (2005) Direct interaction of coenzyme M with the active-site Fe—S cluster of heterodisulfide reductase. FEBS Lett 579:1741-1744.

Silver, L. L. Does the cell wall of bacteria remain a viable source of targets for novel antibiotics? Biochem. Pharm. 71, 996-1005 (2006).

Sment, K. A. & Konisky, J. Excretion of amino acids by 1,2,4-triazole-3-alanine-resistant mutants of *Methanococcus voltae*. Appl. Environ. Microbiol. 55, 1295-1297 (1989).

Smit, A. & Mushegian, A. Biosynthesis of isoprenoid via mevalonte in archaea: the lost pathway. Genom. Res. 10, 1465-1484 (2000).

Smith D R, et al. (1997) Complete genome sequence of *Methanobacterium thermoautotrophicum* H: Functional analysis and comparative genomics. Journal of Bacteriology 179, 7135-7155.

Smith P H, Hungate R E (1958) Isolation and characterization *Methanobacterium ruminantium* n. sp. Journal of Bacteriology 75, 713-718.

Smith, C. A. Structure, function and dynamics in the mur family of bacterial cell wall ligases. J. Mol. Biol. 362, 640-655 (2006).

Smyth G K (2005) Limma: linear models for microarray data. In: Bioinformatics and Computational Biology Solutions using R and Bioconductor, R. Gentleman, V. Carey, S. Dudoit, R. Irizarry, W. Huber (eds.), Springer, New York, 397-420.

Sneath, P. H. A. & Sokal. R. R. Numerical Taxonomy. Freeman, San Francisco (1973).

Soderberg T (2005) Biosynthsis of ribose-5'-phosphate and erythrose-4-phosphate in archaea: a phylogenetic analysis of archaeal genomes. Archaea 1:347-352.

Sprott, G. D. & Jarrell, K. F. Sensitivity of methanogenic bacteria to dicyclohexylcarbodiimide. Can. J. Microbiol. 28, 982-986 (1982).

Sprott, G. D., McKellar, R. C., Shaw, K. M., Giroux, J. & Martin, W. G. Properties of malate dehydrogenase isolated from *Methanospirillum hungatei*. Can. J. Microbiol. 25, 192-200 (1979).

Staden R, Beal K F, Bonfield J K (1998) The Staden Package. Methods in Molecular Biology Bioinformatics Methods and Protocols 132, 115-130.

Staden, R., Beal, K. F. & Bonfield, J. K. The Staden package, 1998. Methods in molecular biology (Clifton, N.J. 132, 115-130 (2000).

Statistics New Zealand. Global New Zealand International Trade, Investment and Travel Profile. New Zealand Ministry of Foreign Affairs & Trade. Available: http://www.stats.govt.nz/products-and-services/global-new-zealand/2008/global-new-zealand-Dec08.htm (2008).

Steenbakkers P. J., Geerts W. J., Ayman-Oz N. A. & Keltjens, J. T. Identification of pseudomurein cell wall binding domains. Mol Microbiol. 62, 1618-30 (2006).

Steinfeld, H., Gerber, P., Wassenaar, T., Castel, V., Rosales, M. et al. Livestock's Long Shadow Environmental Issues and Options. Rome: Food and Agriculture Organization of the United Nations (2006).

Steller, S. et al. Structural and functional organization of the fengycin synthetase multienzyme system from *Bacillus subtilis* b213 and A1/3. Chem. Biol. 6, 31-41 (1999).

Stojanowic, A., Mander, G. J., Duin, E. C. & Hedderich, R. Physiological role of the F420-non-reducing hydrogenase (Mvh) from *Methanothermobacter marburgensis*. Arch. Microbiol. 180, 194-203 (2003).

Storer, A. C., Sprott, G. D. & Martin, W. G. Kinetic and physical properties of the L-malate-NAD+ oxidoreductase from *Methanospirillum hungatei* and comparison with the enzyme from other sources. Biochem. J. 193, 235-244 (1981).

Studier, F. W., (2005) Protein Expr. Purif. 41 207-234.

Stupperich, R. Recent advances in elucidation of biological corrinoid functions. FEMS Microbiol. Rev. 12, 349-366 (1993).

Šurin S, Cubonová L, Majernik Al, McDermott P, Chong J P et al. (2007) Isolation and characterization of an amiloride-resistant mutant of *Methanothermobacter thermoautotrophicus* possessing a defective Na+/H+ antiport. FEMS Microbiol Lett 269:301-308.

Tamura, K., Dudley, J., Nei, M. & Kumar, S. MEGA4: Molecular Evolutionary Genetics Analysis (MEGA) software version 4.0. Molecular biology and evolution 24, 1596-1599 (2007).

Tan, S., Evans, R. & Singh, B. Herbicidal inhibitors of amino acid biosynthesis and herbicide-tolerant crops. Amino Acids 30, 195-204 (2006).

Tatusov R L, Natale D A, Garkavtsev I V, Tatusova T A, Shankavaram U T, Rao B S, Kiryutin B, Galperin M Y, Fedorova N D, Koonin E V (2001) The COG database: new developments in phylogenetic classification of proteins from complete genomes Nucleic Acids Research 29, 22-28.

Tatusov, R. L., Galperin, M. Y., Natale, D. A. & Koonin, E. V. The COG database: a tool for genome-scale analysis of protein functions and evolution. Nucleic acids research 28, 33-36 (2000).

Tersteegen, A. & Hedderich, R. *Methanobacterium thermoautotrophicum* encodes two multisubunit membrane-bound [NiFe] hydrogenases. Transcription of the operons and sequence analysis of the deduced proteins. Eur. J. Biochem. 264, 930-943 (1999).

Thauer, R. Biodiversity and unity in biochemistry. Antonie van Leeuwenhoek 71, 21-32 (1997).

Thauer, R. K. & Bonacher, L. G. Biosynthesis of coenzyme F430, a nickel porphinoid involved in methanogenesis. In: The biosynthesis of the tetrapyrrole pigments. Wiley, Chichester (Ciba Foundation Symposium) 180, 210-227 (1994).

Thauer, R. K., Hedderich, R. & Fischer, R. Unusual coenzymes of methanogenesis from CO2 and H2. In Ferry, J. G. (ed.) Methanogenesis: ecology, physiology, biochemistry and genetics. Chapman and Hall, New York, pp. 209-252 (1993).

Thauer, R. K., Kaster, A. K., Seedorf, H., Buckel, W. & Hedderich, R. Methanogenic archaea: ecologically relevant differences in energy conservation. Nature reviews 6, 579-591 (2008).

Thompson, H., Tersteegen, A., Thauer, R. K. & Hedderich, R. Two malate dehydrogenases in *Methanobacterium thermoautotrophicum*. Arch. Microbiol. 170, 38-42 (1998).

Tietze, M. et al. Redox potentials of methanophenazine and CoB-S-S-CoM, factors involved in electron transport in Methanogenic archaea. Chembiochem 4, 333-335 (2003).

Tokura, M., Tajima, K. & Ushida, K. Isolation of *Methanobrevibacter* sp. as a ciliate-associated ruminal methanogen. J. Gen. Appl. Microbiol. 45(1), 43-47 (1999).

Tolbert, W. D., Graham, D. E., White, R. H. & Ealick, S. E. Pyruvoyl-dependent arginine decarboxylase from *Methanococcus jannaschii*: crystal structures of the self-cleaved and S53A proenzyme forms. Struct. 11, 285-94 (2003).

Tschech A, Pfennig N (1984) Growth yield increase linked to caffeate reduction in *Acetobacterium woodii*. Arch Microbiol 137:163-167.

Tumbula D, Vothknecht U C, Kim H S, Ibba M, et al. Archaeal amino-tRNA synthesis: diversity replaces dogma. Genet 152:1269-1276.

Tumbula, D. L., Becker, N. D., Chang, W-z. & Söll, D. Domain-specific recruitment of amide amino acids for protein synthesis. Nature 407, 106-110 (2000).

Ungerfeld, E. M., Rust, S. R. & Burnett, R. Increases in microbial nitrogen production and efficiency in vitro with three inhibitors of ruminal methanogenesis. Can. J. Microbiol. 53, 496-503 (2007).

Ungerfeld, E. M., Rust, S. R., Boone, D. R. & Liu, Y. (2004) Effects of several inhibitors on pure cultures of ruminal methanogens. J. Appl. Microbiol. 97, 520-526 (2004).

United Nations (1997). Kyoto Protocol to the United Nations Framework Convention on Climate Change. UNEP.IUC/99/10. Chatlelaine, Switzerland, United Nations Environment Programme's Information Unit for Conventions, for the Climate Change Secretariat. Available: http://unfccc.int/resource/docs/convkp/kpeng.pdf Accessed 2009 Sep. 30.

Vaupel, M., Dietz, H., Linder, D. & Thauer, R. K. Primary structure of cyclohydrolase (Mch) from *Methanobacterium thermoautotrophicum* (strain Marburg) and functional expression of the mch gene in *Escherichia coli*. Eur. J. Biochem. 236, 294-300 (1996).

Verdonk, M. L. et al. (2003) Proteins. 52: 609-623.

Vermeij, P., Detmers, F. J. M., Broers, F. J. M., Keltjens, J. T. & Drift, C. Purification and characterization of coenzyme F390 synthetase from *Methanobacterium thermoautrophicum* (strain ΔH). FEBS J., 226, 185-191 (1994).

Vermeij, P., Pennings, J. L. A., Maassen, S. M., Keltjens, J. T. & Vogels, G. D. Cellular levels of factor 390 and methanogenic enzymes during growth of *Methanobacterium thermautotrophicum* ?H. J. Bacteriol. 179, 6640-6648 (1997).

Vermeij, P., Vinke, E., Keltjens, J. T. & van der Drift, C. Purification and properties of coenzyme F390 hydrolase from *Methanobacterium thermoautotrophicum* (strain Marburg). Eur. J. Biochem. 234, 592-597 (1995).

Vignais, P. M., Billoud, B. & Meyer, J. Classification and phylogeny of hydrogenases. FEMS Microbiol. Rev. 25, 455-501 (2001).

Vivona S, Gardy J L, Ranachandran S, Brinkman F S L, Raghava G P S et al. (2008) Computer-aided biotechnology: from immune-informatics to reverse vaccinology. Trends Biotechnol 26: 190-200.

Volfovsky, N., Haas, B. J. & Salzberg, S. L. A clustering method for repeat analysis in DNA sequences. Genome biology 2, RESEARCH0027 (2001).

Vorholt, J. A. The active species of 'CO2' utilized by formylmethanofuran dehydrogenase from methanogenic Archaea. Eur. J. Biochem. 248, 919-924 (1997).

Wackett L P, Honek J F, Begley T P, Wallace V, Orme-Johnson W H et al. Substrate analogues as mechanistic probes of methyl-S-coenzyme M reductase. Biochem 26:6012-6018.

Wasserfallen, A. Formylmethanofuran synthesis by formylmethanofuran dehydrogenase from *Methanobacterium thermoautotrophicum* Marburg. Biochem. Biophys. Res. Comm. 199, 1256-61 (1994).

Waterhouse, A. M., Proctor, J. B., Martin, D. M., Clamp, M. & Barton, G. J. Jalview Version 2-a multiple sequence alignment editor and analysis workbench. Bioinformatics 25(9), 1189-1191 (2009).

Wedlock D N, Pedersen G, Denis M, Dey D, Janssen P H, Buddle B M (2009) Development of a vaccine to mitigate greenhouse gas emissions in agriculture: Vaccination of sheep with methanogen fractions induces antibodies that block methane production in vitro. NZ Vet J. In press.

Weidenmaier, C. & Peschel, A. Teichoic acids and related cell-wall glycopolymers in Gram-positive physiology and host interactions. Nature reviews 6, 276-287 (2008).

Weimer P. J. Manipulating ruminal fermentation: a microbial ecological perspective. J. Anim. Sci. 76, 3114-3122, (1998).

Werken van de, H. J. G., Brouns, S. J. J., & Oost, J. van der. Pentose metabolism in archaea. In: The Archaea, new models for prokaryotic biology. (Ed.) Blum P. Caister Academic Press 71-94 (2008).

Wheeler, D. L. et al. Database resources of the National Center for Biotechnology Information. Nucleic acids research 36, D13-21 (2008).

White, R. H. & Xu, H. Methylglyoxal is an intermediate in the biosynthesis of 6-deoxy-5-ketofructose-1-phosphate: a precursor for aromatic amino acid biosynthesis in *Methanocaldococcus jannaschii*. Biochem. 45, 12366-12379 (2006).

White, R. H. Biosynthesis of methanogenic cofactors. Vitam. Horm. 61, 299-337 (2001).

White, R. H. L-aspartate semialdehyde and a 6-deoxy-5-ketohexose 1-phosphate are the precursors- to the aromatic amino acids on *Methanocaldococcus jannaschii*. Biochem. 43, 7618-7627 (2004).

Whitman, W. B. & Wolfe, R. S. Activation of the methylreductase system from *Methanobacterium bryantii* by corrins, J. Bacteriol. 164, 165-172 (1985).

Whitman, W. B. & Wolfe, R. S. Inhibition by corrins of the ATP-dependent activation and the CO2 reduction by the methylreductase system in *Methanobacterium bryantii*. J. Bacteriol. 169, 87-92 (1987).

Widdel F, Kohring G W, Mayer F (1983) Studies on dissimilatory sulfate-reducing bacteria that decompose fatty acids. III. Characterization of the filamentous gliding *Desulfonema limicola* gen. nov. sp. nov., and *Desulfonema magnum* sp. nov. Arch Microbiol 134:286-94.

Wise, E. L., Graham, D. E., White, R. H. & Rayment, I. The structural determination of phosphosulfolactate synthase from *Methanococcus jannaschii* at 1.7-A resolution: an enolase that is not an enolase. J. Biol. Chem. 278, 45858-45863 (2003).

Wolin, M. J. & Miller, T. L. (2006) Int. Congr. Ser. 1293 131-137.

Wolfe, R. S. Biochemistry of methanogenesis. Biochemical Society symposium 58, 41-49 (1992).

Wolfe, R. S. My kind of biology. Annual review of microbiology 45, 1-35 (1991).

Woo, G-J., Wasserfallen, A. & Wolfe, R. S. Methyl violgen hydrogenase II, a new member of the hydrogenase family from *Methanobacterium thermoautotrophicum* ?H. J. Bacteriol. 175, 5970-5977 (1993).

Wouters, J., Oudjama, Y., Stalon, V., Droogmans, L., & Poulter, C. D. Crystal structure of the C67A mutant of isopentenyl diphosphate isomerase complexed with a mechanism-based irreversible inhibitor. Prot. 54, 216-21 (2004).

Wu, N., Pai, E. F. Crystal structures of inhibitor complexes reveal an alternate binding mode in orotidine-5'-monophosphate decarboxylase. J. Bacteriol. 277, 28080-28087 (2002).

Xing, R. Y & Whitman, W. B. Sulfometuron methyl-sensitive and -resistant acetolactate synthases of the archaebacteria *methanococcus* spp. J. Bacteriol. 169, 4486-4492 (1987).

Yokoyama, K., Nio N. & Kikuchi, Y. Properties and applications of microbial transglutaminase. Appl. Microbial. Biotechnol. 64, 447-454 (2004).

Yurist-Doutsch, S., Chaban, B., VanDyke, D. J., Jarrell, K. F. & Eichler, J. Sweet to the extreme: protein glycosylation in Archaea. Mol. Microbiol. 68, 1079-1084 (2008).

Zeikus, J. G. & Bowen, B. G. Comparative ultrastructure of methanogenic bacteria. Can. J. Microbiol. 21(2), 121-129 (1975).

Zhang, Y., White, R. H. & Ealick, S. E. Crystal structure and, function of 5-formaminoimidazole-4-carboxamide ribonucleotide synthetase from *Methanocaldococcus jannaschii*. Biochem. 47, 205-217 (2008).

Zoeiby, A. E., Sanschagrin, F., Levesque, R. C. Structure and function of the Mur enzymes: development of novel inhibitors. Mol. Microbiol. 47, 1-12 (2003).

Reference is made to sequence listing submitted herewith electronically via a text file (.txt), which is hereby incorporated by reference herein in its entirety.

All publications and patents mentioned in the above specification are herein incorporated by reference. Where the foregoing description reference has been made to integers having known equivalents thereof, those equivalents are herein incorporated as if individually set forth. Although the invention has been described in connection with specific preferred embodiments, it should be understood that the invention as claimed should not be unduly limited to such specific embodiments. It is appreciated that further modifications may be made to the invention as described herein without departing from the range and scope of the invention.

LENGTHY TABLES

The patent contains a lengthy table section. A copy of the table is available in electronic form from the USPTO web site (http://seqdata.uspto.gov/?pageRequest=docDetail&DocID=US09441016B2). An electronic copy of the table will also be available from the USPTO upon request and payment of the fee set forth in 37 CFR 1.19(b)(3).

SEQUENCE LISTING (7685 sequences)

SEQ ID NO: 1 - DNA, 1167 bp, Methanobrevibacter ruminantium
atgactaatatttttgaggatttacaggaagaaagcgtgggagtgagtatttttaaagataaaaaacctttagatcatcgttttttacctgaaaatttgcctcatagaaagaaacagattactgaaattgctaaacattggattgaagcattaaatggaaacaccccttcaaacattacaatttatggtaagacaggaactggaaagactgctgctgctaaattcgctaaagagcagcttattgaagcatctagagataaaaatgtcttcattaaagtcgaatatatcagatgtacagacttcactacagaataccaggtccttacctatctttgtcaaaggctaggccgtgatgttcctaaccgtggatggaccaagggggagattgtaaacacctttagagacattttaagaagaaatgcctttggcagaaatcttattttaattgtcattttagatgagatcgatattcttcttgaaaaggacggcgacggaatcttatacacccttacaagaactgataatattgccattctttcaataagtaattatcttgactttaagcaattcattaagccaagggttgcaagcagcttaagggataaagaaatagtgttcccgccttatgatgcagagcaattagctgatattttacatgaacgttctgaattggcatttgaagaaaatacacttgaagaaagcgttattccattatgttcagctatggctgctaaggaagaaggtgatgcaagatatgctcttgacctattggagaacgctggagacattgctgttgaagaaggatctgaaatcgttaagggaaaatatgtgcgtcaagctaaggatgtcattgagtataataaggttaaagacgttattattacacttccaacccaacagcaaagggttcttgcagctataatgaaattaactcaagacaatgaggaaatcacttcaggtaagctctttgaagtctataaagatatttctaaaggagacagtgttacctatagaagaatctttgatttcattaacgaattggagatgttaggaattatctctaccaacaccatatccaggggcagaggtaaaggcaggaccaatattattaagttgcagactgattctaagttgattcaagataacttatctgctgttctttattag

SEQ ID NO: 2 - DNA, 705 bp, Methanobrevibacter ruminantium
atgactagacttattgagtttaagaatgtgaacaaggagtataaatctggagattacattttaaaagctatggataatgtgaactttacaatagatgaaggagagtttgtagtaattcttggaccttcaggtgcaggtaagtccacccttctaaaccttttaggaggccttgattcagttagctcaggtgaaataatcgtaaatggcagtcatattgaatcattcgatgacgatcagcttacaaactatagagcccgtaatgtaggctttgttttccagttctataaccttattcctaacttgacagccttggaaaacattgaattgatgaaggacgttgttgattttgacatcaatggattggctgtattggatgctgttgggctaaaggatcatgccgatcattttccagcacaattgtccggtggagagcaacaaagggtgtcaattgcaagggcaattgctaagagacctagtatgcttttgtgtgatgagccaacaggagctcttgattcaaaaacaggggctttgatattggctttgcttcaggacatgtgcgaaaagctcaatacaactgttgtcatagttactcataatgcaattctatcagaagctgccaataaggttattaggataaagaatggacagattgaaagtgtaattgtaaatgagatgcctaaaaaggtctctgaattagaattgtga

SEQ ID NO: 3 - DNA, 2238 bp, Methanobrevibacter ruminantium
atgaaaaatcgtatgattttaattatttcactattccttatttcattactcgctatcggtgcggcaagcgcatctgaagacataactgatacaattgaagcacctgctgctgatgaagtagtaacagttgatagtgaaatccaagaaatagaaacggttgataataaccttgaagaaatagaaaccgatacaaataatattgaagaggtggaagctgctgacgatgaagtcataaatgaaacagctgaaactgaaataaaagacgaaaccgaaattacagatgaaactatcatatctgaagaaaaggttcaaatcgctaatgatgaaaaaatcgtccaagacggtttgcttggctttagcatcaatttaacagacctacttggaggagaaagctcaagccttaatttgagcaaactcttaagtggagacaacttaaaccttaatttgagcaaactcttaagtggagacaacttaaaccttaactggagcgaactcttaagtggagatagcttcacccttaactggacagacctattaggaggagacagcctaacagtcaactggacagacctacttggaggagaaagcacaaccctcaactggacagacctattaggtagagacagcctaacagtcaactggacagaccttctcggagaagactttacccttaatttgacagacctattaggtagagacagcctaacagtcaactggacagacctattaggaggagacagcctaacagtcaactggacagaccttcttaacggagacagcttaaccttcaactggacagacctattaggagataacctaacactcaatatgtcaagccttttaggtggcgaaagcacaaccatcaactggacagaactgttaggtgacaatttaacattcaatatgtcaagccttttaggagaagactttaaccttaatatgacaagccttttaggagaagatttcaaacttaacctaacaaacatctttggagataacttaacagcaatctttggagaaaacttaacaaacaaactagaagaactcttcggagacgatttcacaattaacatgacagatctctttggagaagacttagctcttaacatgtcagacatcttcggagacgattccatattcaatctttcaaatatattaggcgaaagcacaaccatcaactggacagatctccttggagaaggttctacacttaacatatcaaaaatcctcggagaaagcctaacacttaacttgactgacctctttggagaaagttcaaccctcaattggacagaactattaggtggcgaaagcctaacacttaactggacagaactattaggcggagacagcttcaccatcaactggacagatcttttaggaaacagcacaaccatcaactggacagacctcctcggcagagacagcctaacagtcaactggacagacctcctcggtggagacagcttcaccatcaactggacagacctattaggaggagaaaccctaactatcaactggaccaaaatcttaggaaacgatacttcattaattgataacatcacttcattaattgatgatatcagtccattcgttgataaccttaccactgcagtcaaagatttaattaacaagttccttaaagaagaaaagactgtgagtgtcatcaactatgaagatatgaccacaactgctttcgactctaaaattgatggcagaatcggtaaatacttcgtagtaaaattaaccgatgacaagggcaaagccttatcagacaagtttgtacaaatcggattcaatggtagaatctacaacagaaccagtgatgaaaacggtacagtcaaattgcaaataaaccttggatataaaggtgattacacctttgctatttgtttcctcggtgatgaaaaaaccaacggatcatttgcagttgcaaaaattactgtcaaaaaacaaaaggctaaattaaccggaactgccgctagctacaaagcatccgctaaaaacaaatacatcagcgctacctttaagacaactgcaggcagtccaatagccggtaagaaaataacctttaccatcaataagaaaacttacactgctaagaccgatgcaaaaggtgttgctaaagttaaagtaagcattaccaataaaggcacttatgctttcactgctaaatacgcaggcgacgatacttatgcaactattaccagtgcaagtaaaaaacttactataaaataa

SEQ ID NO: 4 - DNA, 960 bp, Methanobrevibacter ruminantium
ttgtatttcaagtgtaaacttaaggagtgtaatattatttttggccataataatgtaatttcaataaaagactttgaaaaggaagatataaaattcatcctagatgaagctgaaaagcttgaagacatcgctcaatcaaaagaaaaatcagaagagctctctggaaagatactcggactattattctacgaaccttcaacaagaaccagattgtcctttgaaaccgccatgaaaagattaggcggagactgcatctcacttggagaaacttcaaacagcagtgtagccaaaggagaaagcattgcagacactgcaaagatgtttgaaagctactgcgatgcaatcgtaataagacacgaccttgaaggtgtttcacgatttttatctgatgtaatagacgttccaatcataaatgcaggagacggtgcaggccaacaccctacccaaaccctattagacttatacaccatcagaaagcacttcggcaagatcgatggccttaacatagcacttcttggagacttaaaatacggccgtaccgtacactcactttcatatgctttagggatgtatgatgttaaaatgacattcgtatcccctgaagagctaaagatgcctaaggaaaacctccttgaccttgaaaagaacaatataaaatataaggaaacatcaaacctgaaagacatcatagatgagattgatgtattgtatgtcacaaggattcaaaaggaaagatttccggatattgaagagtatgaaaagatcaaaggagcttatcttatcaacaaagacttgctcgaaggcaaggaactgattgtaatgcacccattgcctagagtagatgagatagactatgatgttgacaatacaaaatacaataagtactttgaacaggctgcaaatgcaattcctgtaagaatggccatattaaagaatctcattaggcacagatacgaatag

SEQ ID NO: 5 - DNA, 504 bp, Methanobrevibacter ruminantium
atgaaaacagccattatttatgcaagcaaaactggaactactaaaaagattgcaaaggccttagtggacaagatagatggagaagtcctaacaataccaatagctagagccaaatcagcctgtcttttaaaatacgactttgtaatcatagcaggatccatccattacggccgcattcaaggggaaataaaatcctttgtaaataaaaactataaaacattgcaaggaataaattacggcctatatatcacttgcacaaaccaaggcaaggctgaagaatatctgaacaaatcattttcagaggagatagtaaaatcagcatttgtaactgcatgctttggagctgaaataaaccccaataagggagacatgattactaaacgcataataaattccaatttaaaaaggtttaaaaaggaaaataaggagccaccaagtattgattgggagcttgtagatgaatttgcagataaaatcaataaaagaacaataaaaaagaaataa

SEQ ID NO: 6 - DNA, 807 bp, Methanobrevibacter ruminantium
atgaagtttttaagattcaaaaagaaaatcaatgaattgggcaaagacaattcaatcaaaataggattctacgatggagaaaagataatcgaacttaaaggagacatattagactattttaactctaatctagatgaaataaaggaaaatatgatagaatcatatagtctagaagatatagaaatagaagctccagtaaatccatctaaaatcatatgcattggcctaaactacaaagaccatgccaaagaattaaatttagagcttccaaaaaagcctgtaattttcataaagccaaattctgcattaaacagtacagaaaagaatataatcttccctaacatttcaaagcaagtggattatgaaggggaattggcagttgtcattggaaaggcaacaaaaaaggtatctaaagaagaggctgatgattatatattcggctacacaatcataaacgatgtcaccgcaagggatttcacccttggagatggccaatggacaagaggaaaaagctgtgatggatttgccccaatagggccttttattgaaacagaccttgacccattaaatcaaagaatcgtaacaaaggtaaacggagagataaagcagaattccaacacttccatgatgatcttctccccacaggagataattgaattcatatcacagacaactaccctcaatccaggagatataattgcaaccggcacacctccaggtgtaggtccaatggatgctggttcaactgtagaagtctctattgaagagataggaatcttaaagaactatttaataaaagaagaataa

SEQ ID NO: 7 - DNA, 750 bp, Methanobrevibacter ruminantium
atgatattctactatacaggaactggaaacagcaaatatgtagcagagacaatagctaaaagcaatgaagaagagattatctcaatcccagactgcataagggaaaacaaattcacatttgacgtgaaagaagatgaaataataggatttgtatgcccaatctattcgctaggaataccagattctgttagaatattccttaagaaactccgccttaactataataaaaagccatatatcttccttgtagccacatatggaagcactgttggaaacattaaaagcatagtttcaaaatactttaaaaagatagatggattcttcaatgtaaagatggtagacaattgggttcctaaatttgatctaacagaccaaaactacataaaacaggctgaagaatatggagagaaaagattagaggaagtgaacaatctaatactcttaagaaaaacaggaaaataccttgaaaatgaaaataaaatattcagcggattcatatacaaggttggatatgacttcatccgtaatacaagcaattttaagctagatgacaattgtataggctgcggaatatgcagaaacaattgtccaaccaatacaataaaaatagagaataaacggcctgtctggaagagaaaaaagtgtgacatgtgctttgcttgtctacatagatgtcctcaatttgccattcactatggaaaaaggtctatagagcatggccagtatttaaatcctaacgttaaattataa

SEQ ID NO: 8 - DNA, 864 bp, Methanobrevibacter ruminantium
atgaaaatcaaaatagcagtcccttccaaaggaagaataagtgaaccttccataaaaatactagaaaaggcaggactaggcttaaaggattcaacaaacagaaaattattctcatcaacttacaatgaaaatatagacgtgatgtttgcccgtgcagcagacattccagaatttgtagacgaaggaatttgtgatatgggaatatcaggctatgacctgatagaagaggcaggagcagatgttaaaatattaacagacctccaattcggtgcaacaaagcttgttttagcttctcctgaaaactccgaaataaacacaaaagatgatttgaaggatggaatgacaatagctacagaatttccaaaccttacaagaaaataccttgaagaaaacaatctgaacataaagatagtaaagcttacaggatctactgaaatagctccattcattggaatagcagatgctataacagaccttacaagcacaggaacaacactaaatatgaatcatttgaagatagttgatgtcatccttgaaagctcaattaaattgatagctaacaaaaattcatacacagaaaaaaataaccttgtagaagcggttagcaccagcattcaaggtgtgcttgaagcggaaagaaagaaactggttatgatgaacgtcgcaaaggaaaacctttgtgaggttcaaaaggtcatgccggcaatgagcggacctactatatctcaagtgctttccgaagaggaaaccatggccgtacaagcagtggttggagaggatgaagtctttgacctagttaacaagcttagaaatgctggcgcacgtgatatcttggtagttcctatagaaaggattattcaataa

SEQ ID NO: 9 - DNA, 204 bp, Methanobrevibacter ruminantium
atgagtattcctgtagctcctattggaagaatcattaaagacgctggtgctgaaagagtaagcgaagatgctaaaaaagaattaaacgcatacgtaaccgcacaagctgaagctgttgctaaaaaagcaatcgaattcgcagctatggcaaaaagaaaaaccgtcaaagctgaagatatcgaattagcaatcaaaaacttataa

SEQ ID NO: 10 - DNA, 1020 bp, Methanobrevibacter ruminantium
atgggaagaagaaaaaaacaagattctacacttgattcttattttccagattctgatttgatagaggaaaaaaagaagaaggatgaagcatgcaagatctgtggcaatcctatagaggacgccacctttcaaagatgtcgcaagtgcttaaacaagcttgcactgatagatgacttaagggaactattggaatacgtttctccaggtgaaagctttagggaaattgacctaatcaataaaggctttaaaagcttgaaactcaacattctcatttctaaatttttaaaagaacagctcattttaattaatctcgacggtttatttactcttaacaatattgattttttaaatgcctttattaaaaaatatggcgaaaaggaaaagccacttaaggaaacagattacttaatagtaagggatgacaagtctgccttttatattgatgtcaacaactattcagattatataaagataaggttcaatcctaggattaacaagtggcaggttgatttctttaatgaaaacggcctcgcaaataccaagtcctttattgattccaatgatgcaaataaggaagccatctattacattaagcagttaggtgttatcggatcttcagctgatgataagaaagaggaaaagtctgataaaagattatactcttctcatgagggaatctattacagccctagccgtggaatgtggggagctaaagtcaagggatataagggatttaagttcattggacacttcagcagcgaagaggaagcttatgaggcaagatgcaagtatttggaaaataaggaaagaaccagacaaaagtatatttctgaaaagagaggattgaaatccggccttaggaatcaaagctctggagagctgatttactttagcaaacagaagggcaaatggattgtaaggcttaaaaataaggaaggccaaattgttaatgtaggccagtttgacaccgaagaggaagctaataaagctaaagaggagtttattaaggataatagttaa

SEQ ID NO: 11 - DNA, 321 bp, Methanobrevibacter ruminantium
atgagtgaattaaagttggatttggtattcgatgactatcaaatcaaaagggcaaaacctgcaaggggttcatctgttattcatgtgaataagagatggataggaaaggaagtgtccataattccactgccatttgacgtggatgaaaagtttattgatgaaactaaaggggaagacggtttatatcatttagagttggctgttaaggagatcttttccaaaacagtatcagatcgtaaagatgtaggattcttttatcttaaggagtctttgcttggattgtttttcctcattatagaagcgcctgatattgtttattag

SEQ ID NO: 12 - DNA, 1464 bp, Methanobrevibacter ruminantium
atgtatgaaaaagaagatattttaatcgattatattaataatgaaattaacactgttccattcagcttaaatgataaacttaaaataagaaatgagaagtttcgttgtcgtgaggagttttatgagataaaaaattatgtggatgattttttagaaggtaactataccaatagatacatagtgttacctggactaaggggtttaggtaaaacaaccattatttaccagttatatcaatatttattaagagaaaaggaaatcaatcataatcaaattctttatatctcctgtgatgatttaaatgactatatggatattaatattttagatgtcgttaactgcttcttgaagcttcatcataattctaatttaagaactttagataagaagatctttatttttattgacgagtcacagtatgattctaattgggcaggggctggtaaaagaatttatgataagactaataatgtttttttaatatttactggttcatctgcattgaatttagaatataatgctgattctgcaagaagattattgaaaaaaagcatcactcctttaaattacggtcattttttaaaattaaaatatggttttcactatgatgaattctctgatgcattaagtgacctgatatttttaggtgatgagaagaaagccattcaatgtgaaagggaagtttattctaaattgtataatttagaaggctataatgataatgtatgggatgattttttaagaaatggaggatttcccatatccttttatgagaaaaatgatgataatgtttctcaaaggttaagggaagtagttaaaaaagtcttaataagcgatattgctaatatttccactatttcaagtgaaaagtatattaacagcattaggctattaaattttttagcggtgcaaaagccaggggacatttcacaaaataaattagctaattttttaaatgtatctcctacaactgttaagggtataatagaccttttggaaaagacacatttgatatttcatacagagccttatggttctgccgccaaaagatctaaaaaatcatggaaatatttttttgctagttcttccctaaaacatgctttagttaaggatttaggtagttctatgagagatgtaaaatcttatgaaggtatcttattagaaaatcttgtagcatccactttctttaattggacaaataggaaaaatatttccttcaatctattttatgatgcaaatgatgatgaaaaaaataagactactgttgattttattattaaggaaggttttaataagccaattcctatagaagtaggtattggaaaaaaaggcgataagcaaatttccaagtctattagtgattatagggctgattatggtattgttatatctaataagaccaagtttatagaaagacagggaaatgttatttatttgcctccaagaagcttttcttttttatga

SEQ ID NO: 13 - DNA, 1221 bp, Methanobrevibacter ruminantium
atggtgaaaatgaaatttaagcgtagtttaatattggcagtgattttgataatcctattttcacttggaactgttgcagcaagtgaaaatatagttattgatgagtcttctgattccaatttagttatagaccatgctaaggataattatttattcaatggacctataaaagataattatttatctagcagttctattagtgataattatttatctaaaggtgttcttgatgattcttatttatcaagaagcgatttggatgattcttatttatctatggatgatggcaaaggctctatcgatttgacgaatcataatcaactatctaattcagatgataaacagcttaaaacttctaatttagaggatgaaaaacagcttgaaagtgtaaataaaggagataagcttcttaaagattcaaatgacaatgtcgatttgtttattaatatggatgtaaagacatcattgaccaacaagcaatataaccgtgcaggaagcgaagttccatggattataactgtttcctctctcaatggaaccagctataatacccaagttcgtgacgttttatctgaaaatttacagtatttatcacataatgctacaatgggaacattcgatccggaaaatggaatttggactgttggtgacttggaatcttctaaaaatgcaagcttgacaatattgacaagattgaaaagagatggtacatatataaacaaggcttatgctactaccgattcaaatgatgttaatctattgaataacttcctaatcatttccataaggaccggttcatcaaagatcacttctaacattacagagacaagtgatgaaagagagggaattcagcataatgttcattatgctagtatggttgatacggactttatatatagatatgaagaggactcttcagaagacgatggcggcaatgaagaaggccaatctgaaggaaattcccataccaagactagatctttaggaaataaattgaaattattcaatgctcagaatatagattatcattctctttccaaaaacatcggtggagcattaggttttggatataattcaaatggaggattccttaattcaaaggacatttatgaggctttatttgtttatgactatacaagaatccctattattgtatttgcagcctttttagttgttttagcatctatagttggctatgataaggttaaatcttcaaaataa

SEQ ID NO: 14 - DNA, 6015 bp, Methanobrevibacter ruminantium
atgaggattatgataaataaaaaattgttttttgttttcttattaatggttctagtgattggaaccatttctgcagttagtgcaaatgaatgcgctaatgacttaacgatggagataagtgatgataatatagctattgatagttcttctgctttagaaggggatgatttagctattgatagttcttcttcagatttaagtaatgaaaataatataaattctatgaatgatagtgtaattaattctaattctattaattctgattctattaattctgattctattaattctgattctattaaccctaatcctaatattgatgatgaaataaataaccataaagatagctttttaaaggctgtacaggcctctaaaaccggaacatttacagagcttcaaactaagataaacaaggcaagcaaaggctcaacaatctatctggataagaattacctctataatgatgactttaaaggcaaatatggaatagtgataaacaagtctatcacaatcgatggaaaaggccatgtcattgacggtttaaagaaatcaaatctgattttcatcaatgatgcttcaaacgttgtctttaagaacataatatttagaaagggcgacggggacgagaatggagctataaatcttattggctctgatcatatcgagtttaacaattgcagcttcaattataactatggtgataggggtgctgtatttttatccggcagcgattactcctcctttgtaaattgcaagtttaatgagaatattggggagaacggcggagctcttatattggctgatagtgattattctcgccttgtcaactgtatcttttttggaaatgaggcatctgacggaggagccgtatttataacttatagtgattattcttactttttcaactgtacttcagagggcaatagcgtagattatacaggaggggccttttatttggattattccgataattcctctttcattgattgcgtatttgacacttccagcgctaaggatggcggtgccttttatttaggcgattgccataattcctctttcattaactgtagctattggaataatcaagttgattattatggtgctgtttgttatttggacaattgctatgactcctctttcatatcttgtaatttcactggaaattctggttctaaccctgaattagatgaaacaccttccattggcggtggcgtattttatataagcgagtctcacggcttgtattttacccattgtaatttttccgaaaatgaggcaaaaaatgatggcggtgccatatatgcttcagattccgatgttcatattgattcctctgtatttgaggagaattgcgctttatgcggaggtgccctttatgctatgaactctgatattttcattgactcatccctttttgagagtagcgttggagataggggaggttcaatatttgcaaataagtctaatgtttattctaaaaactcctcttttattcaatactatgaaattgaagatgaatatgtctatattcctgcttctggagcatatcaccttatggaaggaaatattggcggagcaatatactctcttcagtctgtcttgaatatttcttctaataaattcaataacaattttggcttgacttcagggggagatatctattcccaatacagcatgatctatatagatgactgctcattttcaaattcattctccaatggatttggaggctcattaagcttcaacaacgactatgtccaaatcacagattccagctttgaaaactgcagctcaagggataacggcggaggtggaatctactctataaattccattttgaattgctctgattcagacttcaccaattgctattcatatttcggcggttcaatctgttccttaaacactgatctatccattaataacaataatttttacaaaagctctgctgaatattatggcggatccatttatttcctttatggaactttagacattaacggctctctcttttcaaattcatacggtcagtatggaggctccatttatataagaagtcctcagacaataaagaacattacaaataatcagtttctattttctcaaggcataagaggcccaaggatatatatcgaccaatattatggagaaatctccaatagcggcaatgtttataccgatgaatatgaagaaaagggattgttttcagattatggaatgggaatttcttttgaaagcaatgaaggtttggtcccattgattcactattacccttcaaacgagtcattgccttcattctatgaccctagaggtggtggagattcagaagatgattatgaagatgaggatgatgattcagatatagctgttaaagaccaaggcattggaggcaactgttgggcattttcaggaattgcaacccttgaggcatgccttgaaaaggtaaccggagaggaattcggcttttcagagggcaatgctaaaaaccttatggccatatcatccatttatggcttgaacatagacacaaacaatggaggatatgacacaatgttccttgcttatcttgcaagctggctaggtcctatctatgaggaatatgatacatataatccattatcctccctatccatagatcttccttcagtattccacattcttgacattgatttcttggctcctcgtaaaaacagcttggataatgatgagtacaaaagggcgataatgaataacggagccgtttcagtgaccttcgattgggtggaaaataaggtttccaacggattccattcagtttccattataggatgggatgatgattatgatgacattgactccttaggaaactatgcaaagggcgcctggatatttaaaaacagctggggctatgaatggggagatggcggtttcggatacctttcctataagcaaaagctttcagaggagatagctccatatatgcatgcatatacattttcatttaaggaaaatgacattggatatactgacatatatcaatatgacttttcaggattaagcgatttcctgattttaaattccacaaatgcctattataagaacaagttcatagcagaggacaatgaattcctatatgcattttccacatattttgataaggagaccgatttcacctattcagtttccataaatggcaatgtcattacaaaaacagaggatggcaaagacatattgacttctatccatcattctccggctggatatcataccattccattaggctataacctgaccttgaaggagggggatgagtttgagataatcataaaattgctgaatgacaatcaaaacaggattcctgtttgccaagctgatgaattgtacagaacttcactgccttcaaatgcatctttcatgagtttaaacggcaaggattggattgacttgagcaatttagcttcatccaatgagttctcttcacttggcatcaaggcaaacacttcacaagtagcttgcataaaggcattcacttccaattggagaatgaattcggattcctctatagtgaactctaagaatcatagcataatcacctcagaaggaacagagttaagccaatatgaaatatgccagcttaaggtaggctcatttacaagggcttcagccaatgaaactatcattatagccatgagcattccagaatggagaaattatcaggatgaatatgaaaattatatagaggttcatatcaatgatgaattctattatgtaagggtcaatgagggagttgcctatttggatatcagctttgataagattggccattatgactttaaggcccagttcaagtccaatatatactcatctgatattgtagagtttgattttgaagtagtaaaggattcaatctttgatgttgatgatttggatgcctcaaacccaggaactttcaaggaacttcaggatataattagaaatgctaagaacggttccataatcagtttggataaggattatgctttctctagtggtgatgagtctgttgttgatgattatatagagataaataaatctctaattattgatggaaaaggccatataattgatggttcttctgattcaggcatttttagactaagttcaggtgataatcttactttgagaaacattaagtttatgaatgcagataatggtgcaatagtttctaatggaaatttgacagtttctaattgttatttcattagtaattgtgcttctggttctagttctacttctacttccagttctgattctagttctactgcttgtggaggtgcaatttactgtgaaggcacttgttttatagtgaattctctatttgaatctaattctgcagatgccggtggtgctgtttactgtgaaggcacttgttttatagtgaattcttattttgattccaattatgcagatcttggtggtgctgtttgttgtgatggcagctgttatatagtgaattctctatttgattccaattttgcagtttatggaggtgcagcttccatagttggaaatgaatcatgtgaaattatagattcaaactttattgaaaatgaggccatctatggcggtgcaatatacttagaaagctattgttatcttttagattcaagtttcaattataattatgcaaacaatggaggcgccatttattctatagctgaccttgacattcataccactggctttaattacaatgaagcctataaggatggaggtgcaatctatcttgtaaacagcacatcctatatcaatgaaggaaatttcactgaaaacagtgctaaagagaggggcggtgcaatatgcgcacttgaattctcaaatctaactattagatgggcttatttcatggataactctgcttcaaagtatggaagtgcaatcttttcagtaaatgcccttaacattacagattctgaagtgactgtaagttctggtaaggtggaacttatctgctttgcttatgattatgcttcaaatggccaggcatatggagatttatactttgatgaaaatagcttttatatcagtggtgctcctgagatttactacttcagagaaaagatagctcataaattagccttggatcttgagttcaataatatagagcttatcagaggaggaggcgttgagatatccagggacttgaatgatgatggctgggaggataaaatcaataacaatatgcttgagatatgcagattggttgatgacgatgattatatgactgtccttagaatgaaggagatagaagtgattctaataaacaagaacaatagatctgacattcaaaagtttaagattccatttaatgtcaagcttaatggctatttccttaacacttcttcattgaagtatggctcttatatccttactggaaatctttctaaggatcttgcaagcaattgtattgtaaagaatggaactttgaaagttttaaggaaaactaccctctcttctctgtctactttcactaaagtttatggaaatagtaagaatcttgtagttactttaaaggacagtagtggaaaagctatagttggtgttaatattgctgttaaattgaatggaaaaacaattaaagcaaagactaattcaaagggtcagatttccatagccattagtcttaagccaaagacatatactgcatatatcagctttgcaggcaatgactattatgcaagcgcaagcaagaaggtaaaggtagttgttaaaaaggcaaaccctaaattgactgcctctaaaaagacctttaagttaaggaatgctaaaaagtatacagtcactcttaagaacaaccttggaaaggcattgaagaatgctaaggtcactattaaggtggctggaaagacttataccgctaagactaatgccaaaggtcaggtaacattcaatttgaaattggctaaaataggcaagttcaaggcagttgttagctttgcaggtaataagctttataatggcttgaagaaggcggttgttttaactgttaaaaagtaa

SEQ ID NO: 15 - DNA, 558 bp, Methanobrevibacter ruminantium
atggaatatgagaatatactggacttgaagagctctgaagagtttagggagtggatgataaaaaaccattccagccaaagggaatgctgggtcaactgcaaaaggggaaaggccgataaggatgagttgtcctatgtcgatgcagcctatgtggcattgtcattcggatggatcgattccacctatgggctgatagatggaaagagaatgcaaagattctctccaaggagaaaaaacagcaattggtctcagcttaataaggaaagatgtcgatggcttataagaaatggccttatgacagatagcggatatgaaagccttcccgatttagaggaagattttattatagattcagatattttagatgaattgaagaaggataatgagacttggaataattttaagaactttccagacctttataaaagaataaggatagctaatattcaaaaggaaaaagatagggaagcatttgataaaaagttggctaattttattaaggacacaaaggacaataagatgaaaggaaactggaatgatgatggaaggcttatatga

SEQ ID NO: 16 - DNA, 255 bp, Methanobrevibacter ruminantium
atggcaaatgagataattttaaatatagatggcaatgagcatcaaattaaatatgataatatggaagtagatcatgtttctataatagatcttgaaaaattgggacgttcattgattttagaattggaaatagatggaaaggtggataggaactcattggatgatgctatcaacagctttttagatacaatctatgatgatattaagtattttgcagtagagtatgcagatgataatgaaatagaattaatatga

SEQ ID NO: 17 - DNA, 759 bp, Methanobrevibacter ruminantium
atgggacaagatggttttaaaaacgaagatttaatgttagaagctttaaataataaaaaatttatggatttgaacgataatttaaaacaaatgattttagatatgtatggtgaagaaatttctcaagattttattattaaggcttataaaaaaggtggagtaaataaaacagatttgactattgatattaattctcaaaattttaatgtcagtataaaaaaaggaactggaaatagtgtccatcaagaaaaattagaagagtttgtttcttttttaaaagaagaatatggtatttctaatgtattatctgatgatataaggttttttatttggggtgatggaactttagatggtactggtgaagtttcagatagattaagcgcttctgaatttagaaaacaattccctgaaaaaataagaaatattagagaatttttctatactgttaaaagagatttaatagaacgttttgtcattaaaggacctaaatctaaatctaggcctgattttatttattatggaacaccagataaaggtattattgttgaatctcaatccgttattgattggttatcggatgataaaaatgaaaaaagcagctcccctattcctataggcagattaacattccaagcatggaataggaatattaatggtggagataaatctgaaaataaaagaggggttattcaattaaaatggagttcagttggtaaggatttagttaagatttataaggagaaaaaagatgacaaatag

SEQ ID NO: 18 - DNA, 582 bp, Methanobrevibacter ruminantium
atgacaaatagaggaactgcagaaggtacagaagaagaaatatcctttgtaaaattattaaacaaaaaagaggacttatcttattgggatgtattaaatttagatcataattgtcattttgcaatacatgttttatatcaaaaatttagtaaaataagtaataaaaaagtttatcctaaagcagatgtttatattgctaaaggtaatgttccttatagctatttagaagataatgatttctatctaagcgaagataatacagaagactttgatttggaacctataaaatacactggcatttcagtcaaacttcaaaattctagtagatatcaaataacaaaaatgggacctaatacatttaaagatatttttggttgttatgaattgggggctggagcttcaatatattgtagagatgtggatgatttagaaaaaaatcctcaagtcttaactggctggaatactaattttgaagactttataaagtattttaaatcttttgatgtagtttccagctcagatttagatatttcttcatataaaaaattaaaagtttttctaatcaaaagattgaggaaatga

SEQ ID NO: 19 - DNA, 1020 bp, Methanobrevibacter ruminantium
atggtttcaaaaaaaagagcaatgcaatacacattagaagattttaaagagaaaaatcttgatgaaactgaagaaaacgataaagatttcacattcattgatttattttcaggtattggtgggttcagattagcctttgagtcagtaggtggaaaatgtgtctttagttcagatattgacaaatgggccaatgaaacttattatatgaactttggagaatatcctcatggagatataagtgagattcctgcaaatcaaatacctgatcatgacattttatgtgcaggatttccatgccagccatttagcataggaggatatagaaaagggttttgtgataccagagggactttattttttgaaattgaaagaatacttaaagctaaaaaaccccaaatgttcctactggaaaacgttaaaggcttaacaaaccatgacaagggaaaaacatttaaagttatcaaggaatccttatggaatttaggatattcaatattttaccaagttttaaattcaaaagactatggagtccctcaaaacagggaaagaatattcatagttgggtttaaagacaatgtaaatacattcaagttcccattaccttttgaaaataaagccaatattaatgatttattggaaaaaaatgttaaagatcatgagttaagtggaattgcttcagatcatctaaaaaagcattatgaagaattcttaaaaaataaaaaagttaataaaaattatcccattttcgctacagaaattaggccttcaagatgttctattaggaatgatggcaattctccttgtttaactgctaaaatgggtactggtggcaataatgtcccggtattagtaaatgaaaataggaaattaactgttcgtgagtgtttaagacttcaaggattcccagagaattataaaattaaagataattattctcaaagctataagcagattggaaacagtgtaactgttccagttgttactttgatagctaaggaaatgataaaatatttaaattaa

SEQ ID NO: 20 - DNA, 1029 bp, Methanobrevibacter ruminantium
atggaaaaaccaacagttattgatctattctgtggaatcggaggatttagtaaaggatttgaaatggcaggtttcgatgtgttatttggaatagatatttgggatattgcaatagaaacattccaacataatcataaaaacacagagggaatattagcagatttaacagaattagatgatgatttttttaaacaatacacaaataaagttgatgttatcatagcagggccaccttgccaaggattttcaatgtgtggaaagagagaagttggagataaaagaaatgaactgttccaagaggtagtgagagcagttaaaattattaatcctaaaattgttattattgaaaatgtagtaggccttctttctatggaaaatgttgatggtgaagatgttaaaggacttatagtctctgaattcgaaaaattaggctatgaaacaaactataaaatactagatgcatcagaacatggagttcctcaaaaaagaaaaagagtaattttcattggttctagaattggagatgttgaattcccaaaaccaaaagataaaaaagtttctgttatggaagcattaggcaacattccagacacaaattttgaatattatgatgagccaacaaatagctttcaagagcttatggctgatggagaaaagaaaatctataaccatgacgctatgaaacataatgaaaaagtgcttaaaagaattgaaaacgttcctcaaggaggtaattggcaagatattcctccagaaatctatgatgttggtggaacacatagtaataattacagacgtttagatccaaataaaccgtctataactatcaaacatgctattaaatctatgataattcacccaacattcaatagagtaattacagcaagagaagcagctagattacaatcaatacctgatagttttataattaaaggaaataaaactgcacaacatcaacaactagctaacgctgttcctccattattaggttatgagattggaaagcaaattataaaaaagttaaattaa

SEQ ID NO: 21 - DNA, 174 bp, Methanobrevibacter ruminantium
atgaaaagaatacaagtaaattttacaaaagaacagtatgaactattacaaaaacttaaaggagaattaggaaacagtgattcagaagttataaaaaatataactatggcttggctaagcgaaaaatcattaatatcaacaaccctaaaagaaaaaatatttaacaattattaa

SEQ ID NO: 22 - DNA, 753 bp, Methanobrevibacter ruminantium
ttgaatgaaatcataaagaccacattgattctacttttaaagcaagagataagaaaagaacaaagacggggcataaagaacatacttttatacttccgtgatgtggatacgctggatacaaattccataaattggaaaatccgctatgataggaataatcagaattatcagatgattgtcggcatttgctatcttacacttaaaggactcctccagtctgatagtaagggtgaaaagaagcttatgagctttttggataatcaaaggatgaataggctatatgagaaattcattttaaattattataagagagagcatcctgacatcaaggcttcctctcctaagatagaatggcaattggacgatgattttggtgaaatgcttcctcgtatgcagacagatatcactttagagcataaaaataagatattgattattgatgccaagtattattcaagcaccactcagacctattatgataaaaagaccattcattcacacaatctctatcagatttttacctatgtgaaaaataaggaagttgaagtggctaatgaagcaaatggagtggaacttgacaataaggtttctggaatgttactttatgcaagaacaagagaaaaaatatatccagacaatgattatttaatgagtggaaataggataagcgttaaaaccctagatttaaaccaggattttactttaattaagaaacaattagacagcattatagaggtttatttgaaggcttga

SEQ ID NO: 23 - DNA, 276 bp, Methanobrevibacter ruminantium
atggatgacctaattaccactgcaggaatgtatggagagccagtaagctcaagaaaaggaaactatatagtggaaggtctctttggaaagcctatttattatatagacggagatatagtaagagaaaataatccgtttggaaaacccgtctatagaatagaaggaaactatataaaagaaggaatgtatggaaagcctaaatactatattgatggtgacttgattagggaaaataatcagtttggaaaagtagtaggccgaaaaagaaaattttga

SEQ ID NO: 24 - DNA, 273 bp, Methanobrevibacter ruminantium
atgaaatactgttttaaatgcggagctaaattgatagaagagaaccaaaagttctgcatagaatgcggttccaatctggaaaagcgtaaagaagagcacaataaggatttaaaagagtcccataagaaatacaatccaaaaaagggcgaatcctataatgattatctaaatagaatcgactcaccaataaaagacaaaatagcaacagaagatgagataataaaagaaagcattgcctataaagaatacaatccgctaaaaaaaagagtctga

SEQ ID NO: 25 - DNA, 1344 bp, Methanobrevibacter ruminantium
atggaattactcgatagattaataccaaaatacaaagatatcaattggatgaaaagaattgatataataagaaaaacagatgaccaagcccttttagaggagattgcccgaaaggaagaagagggaatcgttcgaaaatatgccgtaaaaaagatcaatgaccaaagcgtcctaatcgacattgcctacaacgatccccattgggaaagctccagtgaggctgtaaagaaaatcgacaatcaagacgtcttaatcgatatagcatatagcaagcttaaggccagccctagaagcaaggcagcagaaagaatcaaagaccaaaatgtcctaatcgaccttgctcaaaatgacaaggaatatcaagttcgccgtgcagctgttaaaggaattgatgaccctttcgttttaaaagaactggccttaaacgacccggacagttctgttcaaatggaagctgcaaaaaaaataaatgatggtgaagccctagcagagattgccctaaaagaccgtagcgagtttaaacgattggaagccaccagacatattgatgatgagaagatcctatcccaaatcgtcctaaatgacccagatttctatgtcagactggaagcatccaaaaagatcacagatgaaaaaaccctagcagagatgggaaagaatgatttttattggcagattcgttcaaatgcccttaataaaatcaccgatgaaaaggtattggcatatatggcatgcaatgaccctaatccaagcacacgttacgaagcagtgaaaaaaataaatgataaagctatcttagtagatatcgccctcaatgcattcgattggaaagtcaggttatgcgcctgcagaagaatagatgatgaagaagttatgacaaaaatagtcaaaaaagacacatgttggagaataagaaggaatgcagtgggcaaaataactaatgaaacatttttagaagaaattgcctttaatgaacctgcctggagagtcagactggaatcaataaagaacattgaagatgaatctgcattgatttatattgctttaaacgattcaaactggcatgtcagaaggcaggcattaagcaaaataaaagataaaagtattttagaagacatagctcaaaacgacccaatatttgagcttagaaaacttgcagtaagaatgataaatgatgagtcagttctaagaaaaatagctaaaaatgacccagaatggaaaatcagaagacttgcaattagaaacatagaaaacacagatattttaaaagatattgcaatgaatgattccaatattgatgttcgtttagctgccagtgataaaattactgataaaagtgattaa

SEQ ID NO: 26 - DNA, 1917 bp, Methanobrevibacter ruminantium
atgacagctcctgatagtaattacgaaacaatggcagaaatgaccataagaaactccattatagaaaataacagtgcaaggaatggaggggcgatcctcaatgatggaaatctttttattgaaaagacgacttttaagaataatcttgcatttactgccggagcaataagcaatggaggatatgtttccttaaaggatgtttcaatggaaaataacattgcagttacaggggctgccttcatcaatggaggagatgcgaagatagaagacagctttataataaaaaacattgccataggtgaaaaaagaggaatgaacggcgaacatgatgtcggcggagcagtcggtaattcagataatcttttgctgaaaaacacttccttcattaataactcatcaccttttggaagtgcaatatacaatttaggcattgatattccaaaattaaaatatttatgtaaaataaaaatagaagactgcagatttgaaaacaatagctcccatataagcggtgagattcataatgagataggtgaaatatcaatagatgattccaaattcaaaaacgaaactgcaaaaagaggatcagtcatatacaatgacagttatctgacaatcacatcctgtgattttaaagacttaaaaaagatagttcataatttcaatctcatgacaatccacagctctaatttcgagtcaaatcaatcagacagcgcagttattgaaaatgatggggaaattggaatcttaagcattgaaaaaggaaaaatcgccaataatatcagcgattataccactgtctataatcatggaaaggattgcaacattacaggaactatttttgaaaacaatcactctaaaaaagaaaattgccataatatatgcaataggtccaatatggtcttaaaagaaataatcctaaaggataagactgtcagcatttttaatgagggaatcctaactgccgagaaaaaatataaaaactttattttttccgtaggcaaggttttttatcttggaatggaaaatgagtttaattttagctatttggatgagctgattcattctaatatatccgatacaatttcttttgatgaggacattagcttgcttagcgatgaattcgatttttatgaagggggaatcgaacttgacagggacaatatggtgattgatggaaagggcaagacaatcgatgcatcaggcaggtcaaggatatttttagttacaggaaacaatatcactcttaagaacataatatttaaaaatggacacgcttttgacaattatttcatgtcaaacaatgaagggggagcaataaaggtttataaaggccttgatttgaaaatagaaaactgcaaatttatcgataatatttccgaaagcaagggaggagccataaataataaaggacatcttacaataagcaatggattatttgaatccaacaaatcaaatgaagggggagcaatatacaatcatcagaaattatccataatagatacttgctttaagggcaatgaaggccatattggaggggcaatatataataaagaagatttagagattgtctcaactaaatttttaaaaaacattgtcaaagaatcattatttaaggccaggtttattccaatcctccaattagaagatgaatcctttggaggggcaatttttaataaaaaaagaatggtgataaagcaatcatcatttaagaaaaatatgggattggatgatactgatggcgcatggggcggtgcaattcgaaccattggcgatgaagaggttacaataattcagacagagttcattggcaattatttaaaggacagcaattttggaggagcaatatcttcctataaaactccaaatctgattgattgcactttctcggacaattatcctaatgatttaaattag

SEQ ID NO: 27 - DNA, 1350 bp, Methanobrevibacter ruminantium
atgggaatggtattgaaaatcaatgtaaaaatcggagattccgttaaaaaaggtgatgtagtctgtattttagaggctatgaaaatggaaagtgagatttttgcagataaaagtggtgtagttgaaaatatacttgtaaatcctggagatattgtaaatcaaaacgatttgataatgataataggggattctatagatagagatgagaataaatcaaacaaagaaaacaagcccaaaccaaacaaagaagaccctaaagataggaaaaatgaattttccaaatccaagaatgataaaaagataaacagtccaaatgaaatgcttgataagctaaaaaataatataaaagtggataaaattctttttgttgacggagcaaacatttccattagccccatagccgaagctatctttaataaaaaagtcaaaggcattaaagcttactctgcaggtttatctgcaatcagtggaaataaagccgttccaaatgcaataaaagtatgcgaaaatcatgatattgacctatctagccactgcacagcaaatattgaagattatgatttagatgattctacattaattttaagttctacaacctatatcagaaatatcttaaaatattattatcatgtttataaagttgtaaccattaatgaatttgcaggattttctaatttagatattcaagacccgttttggtctgatttggatgcctttgaaacttgctttagcaagatcaatgatgcaattgatgaaatttttggactaaatagtttagaaaaggacaatatggcctttaactgcgaaatagaagaaaataagaacatacaatccaataaagaagaaaacaagaacacaaccataacctccaataaagaagaaaacaagaacacaaccataacctccaataaagaagaaaacaagaacacaaccataaccgccaataaagaagaaaagaatacacaatccaataaagaatatctaaatgaaaaatcctccaaaataaattctttcaaatatttagatgatttaatacatagcaataaaaagaacatcactttagattcagatattattcatatggaaggagacagcccaatcattctagatgtggatgatactctaattgatggcaggggccatgccatagacgcaaaaggaaaatgcggaatctttaacatcacagggaaaaacatcaccatcaaaaatattgttttaaaaaacggatttgtcgagtctgatggagtcatttgcaataagggcaaagttacgctggaaaatatatcagtgcaaaacaataggggctctaaatatgagggcaatgcaatagtcaataaaaaaatatcctga

SEQ ID NO: 28 - DNA, 1236 bp, Methanobrevibacter ruminantium
atgccaagcaaaataatcaaacgtgaagcttacattcgtgatttaaaagattatgttaacactgattttgttaaagtatatataggaattagaaggtccggcaaaactagtttaatgcataatatcatagacgaacttaaaagagatggcgtaaatgatgaaaatataatattcatgtcctttgaatcaagagaatatatccacatcaacaacagcgagcaattagatgaactcgtctataagaaagttgaaaatcttgaaggcaaaatatatctattttttgacgaaatccagcaagtaaagggatgggaaaaatccattaatagctatagggtttccattgacagtgacatatacattacagggtctaattcaaaattattgtctggtgaactggcaacactattgactggaagatatctcacaatccatgtttatccattctcatttaaagagtttttacaatataaaaatgaaattgagggtgttgaaataactaagtattcaattgatgaattatatgaggaatacttcaactttggaggcatgcctggtattctctcattaggcagtgatgagtttaaaagattggctctgaaagacatttataattcaatattatttgaagatgtggtttcacgatttaatattagcaatattgacctactacaacgtttctctcgctatatgattagtagcactggagaaatattctcatctaaaagcataaaaaactatttaaaaagcaatgatatctatacttcagaagacacattgctcaaatataatgaatacttaaaacaatccttcttcatttcaaaatgcaaatgtttccatctaaaaggaaaaaaagaaatgaaaatccttggaaaatattatttaaccgatcatggctttcatcatgcattaatcgaagataatatattgaaagtaactaaaatattagaaaacattgtttatgtagaactattaagaagaggatacaaagtaaatgttggcagaaatgaggataaaacagaagtagattttgtatgtgaaaaatctggcaaatataaatatattcaagtctcctatagattgacaagcgagcaaactctaaatcgtgaaattaatccattattaagaatacctgataaatacgagtcaatattgataacaacagaaaatcatgatttttcaaaagacggagtaaggcatctaaacattgttgattttttatgtggtgatgatgtataa

SEQ ID NO: 29 - DNA, 3135 bp, Methanobrevibacter ruminantium
gtgtctgaaaaatatacagttgcagaactaaaatacattttaaaggaaaacggcttaaaggtttcaggaagaaagccagatcttgttgaaagggttttgcctatcttaaatgctgaagcaagtgaagaggccgttgaagaagttaaagaagaagttaaagaagaaactgttgaagcagaaattgtagaagctgaagaaaaagctccagtggatttgactttcccagatactgaggaagcattaagctccatacttgctctgtatggactaagctatgacgatttatcaattaaagatatagaatttgccgatggtaaaatttgcataaacggtgaagctttcattcaaaacggtttaagcatgtcagattctaccatgtcaataataaatgcagatccaactcttaatctgacaatgaatattccagaagtcgcctatagtgactttgaaagcactatctttagatttaaagaccttgatttaaatcttattcctactgatgatagtcttgagtttaaagcggctttgaaaggcttggacataatgactgatttgaataatataatcctaaagggccttgatttcgcattcaagtctttcccagataggggtgtagaaataggtattgatatagacgatttcatttatcctaatttttataacacaagctttaactttgaaaaccttgatttcaatatggcaataggagtggatggacaaagcattgccatatcagttaatttgcctgcattagacctactaaacaaagactatagggtaaaattatctgatttaagtctaaatctagtgctctctgatttgcaattatcagaccttgacttatccatagcaatatcagatttccattacacaaactttgatgatgttgtcatttatatggaggacataggtgtatcacttgaacatattccagatacaaacagcttcaatgtccttattggcttgagcgctatggatgcagttggtttaaattcatttgatgccttgttcccaatgatggaaatcactggagtaaactttaactctaaggattcagactcactaattaactttacaggtcttatatctcctatagatcttactcaaattgatttattagagcttggcgcccttttaggttcaggatttgaccttgacgcctacactagaaatatggcatattatccagacattgcaagtgaaggagcatcagatttaggtattccaggattggatttaggtgccatagttgcaaactgtgactattcatgtttaggcgcaatcgagcttaatctaactggactccttgattcagcagatattgatttatctgatttaggcattgacttgtctgattatgatatttcttcaatcaaattgtctgaccttatcggtgctgtaggagattctgagtttgttatgtctgccattccagctgtcttaaacatattctcacttgacttaactgacgttgacgtctctggattgatagctgactttgacgaagagaactttgatatctcttctttacttgctagccttaatttatcaagcacagatattgctgctattttagatatcttagataaatcagatattgatttaggagccatatttgcaggctgtgatatttcatgcttagatgcaattacccttgacttgactggattcattgattcattaggcattgatttgtctgcatttattgatttatctgaatttgacttgtctgcagttagcttaactgatattattgccatattaaacagttttgaatttgatatgtctaccatttcagctctcttaaagatattcggccttgacataggagatcttgacttggaaggattgatagcaagctttgacactgaaaactttgatctctctactttgcttgcaagccttaacttatctgacttggatattgatgctattttagctatcttcaataatccagacttcgattgggctggcatatttgaaaacagtgacttgtcatgcttagatgctattacccttgacttgaccggtcttctagattcagcagagattgacttatctgccttaggcattgacttatctgattatgacctatcttcaatcaaattatctgagcttattggcgtatttggaaatcttgactttgacatgtctgatatgatatctggcattgacttcgaaagcattgactttgagaatattgacttggaaggattgatagctgactttgacgctgagaactttgacatatccaccttattggaaagccttaacctatccagtacagacttatctgccattttcgacatgttcatcaattcagatgtcgatttaggcaaggtatttgaaggctgtgactattcatgcttagatgctattgtgcttaatttaagcggacttcttgattcaataggcattgacttggctgatttaggcattgacttatctgattatgacctttctgcaatcaaactctctgagcttatcggaatcttaaatggattcgatttagatatgaacactttatctgctctcttgaagatatttggaattgacttagaagagcttgacttgtctggtcttatagctatctttgacggcgacaactttgatatgactgcattgttatccagtcttaatttaggaggtgtggatatttccgctattgtagagctatttgataatttaggctttgatttcgatggcatgtttgaaaacttggatatttcatgcttcgatgcaatcacccttgacttgactggactcattgattcaacaggcattgaccttgctgctttcggcatagatttgtctgcctatgacttatctgcaatcaagctgtctgatcttattggtgttgtatgcagttctgagtttatcatgtctgcctctggtgctgtcatgaagctattcaatataaatgtggatgaccttgactttgatggattgattgccagctttgacgctgagaactttgacatatctcctttattagaaagcattgagctatctggatttgacatttcagagatgttggaaatgtttgatatgaatggatttgacttatctcagttcttgaatcagttcataagctcatttatggagaatgctcttttggaatctggtgatgaatga

SEQ ID NO: 30 - DNA, 294 bp, Methanobrevibacter ruminantium
atgctaaaaatcgatgaatttagaatggaaatggaagagcctaaaaggatctatacagaagaactaaagaaattcgctaaaaaatacgattttctaggggattttaccatagtggaagagcgagacattgatactgcagattatttcttttgtttcaataatctaaatggaacaagcgatgaaactctatattccacacgtgatgaaatctatgatcatatgattaaattttgcgaagataatggaatcgatgaatttagcaaaaatgcatacatcttttataagagcgattaa

SEQ ID NO: 31 - DNA, 501 bp, Methanobrevibacter ruminantium
atgtctcaagaagaaaataaaatgatagatgaagtggaaatgagttctgtagaagaaatagggagggattctgtagaagaaattaaaattggctctcaagatgaaatagggatgaattctgtagaagaaatggatttagactctgcagatgaaatagatatggacgatgtagaagaaatggaaatgaagatagaaaactatgaaaatagaatcaaattgcaagatatattaatagaatctttaggagaaagatgtgagggagaaaaggagagaaataagcaacttcatgatagaatcatccaattaaatgaagagttaaagaaaaaacaggaactggaaatggtaagcgatatcaattattggaggggaattgaaaaagcccatatagaactgcatgataagtactataagaggataatccagcttgaaaaacagaatttcctgcttgaagttgaaaacgatgagctgaaggatgaattagagaggataaaaaatgtttaa

SEQ ID NO: 32 - DNA, 306 bp, Methanobrevibacter ruminantium
atgactaaaatggaatttgatttaacagatgaacaaattgaaaaagtgaaagaattagaaaagagcggaattagtcttggagaagctatagaccttctttttgaaataaaagatgaagcatttaatcaaatggacgaagttgacgaaaatattgaaattgtcagccaaattactaaatcaatgaatggtgaaaaaaaaatagagataatagaaaaagcatatcgaaattatgaaaaaacccctgaaatgaaaatccaagaggttaaacgcaaccttagttggggtagggatttctttaaatattaa

SEQ ID NO: 33 - DNA, 1545 bp, Methanobrevibacter ruminantium
atgaatgaaaccattaaggagcactcttggattcccttaatccttgtttgttttgctacctttatcatagctttggatacaacattcatgaacgtcagcatttcctcagttgttgctgacttgaacactgatgtgagtaccattcaaacaatctcatcattctatactctcatcactgcctcattcatgctcttaagtaccaagcttcaggatatagttggtaaaaagaagctctttttaatcggtgctggaatttatggcgtcggtaccttgactgcagcattaagtgccaatactctaatgttatttataggatgggcattgctggaaggtataggcggtgcattgatgacacctactgcagtttccatcataagcggaacctatcagggtgaaaagcttacattcgcccttgcaattgaaagcgcactggttgcaattgcagcagctatcggcccgctcttcggtggggtcgttacaacatacttcacttggagattaggatttgcagtggaatttataatcgtcctgatcgtatttgcactgcagggcaaaataccttatttcgaagctacaggatccaaaagcgaattggacattacaggtgctataatctcatttgtaggtcttgtcctctttgttatgggtattttgatgctaactgatgataccactttcagcatagctataatggctgcaggattaattgttctagcactctttgcactctttgaaatcaaaagaaaaagaaaaggcaacgtaccgttgcttgatgttgaattattaaaagacagaaatctccgtgtaggtactctccttaggctgttggttaaccttgcaatgggcggtgcattgtttgcagtctcagtctatctgcaaagcgtattggccttatctgcattcaacacaggtttgaccttgcttccaatgaccttaggtttgcttctctttgcattgacagccccaaagctatctgcaaaactgaaccacaagatcctcatgtcaataggatgtataatatcaatcataggatgtcttattttaagccagcagtttacaatggcgacatcaatgcttgagctaatgcctggactcttcgtacttggagcaggacttggttttgtaatggctttaggtgtggacattgcattaagcaatattccgcaggaaggtcaaaacaatgcatccggtattgttacaaccggtcagactttaggtcagtctatgggtacagcaatcattggtgtaatccttattctgggcatcattggaggaatcagcaatgcagttgatacctatgtgccggatcagtccggtaatgcgacattcgaacacgatgtctatgagggattccaatcaataagcagcataaacgatgttaaagcagagaacagcactattcagaatattgtaaatgtcattgttagagattccatggcgtttgtaatgtatgtaacgatggctctgatggccataatctttgtcttgacattgcggctctcggataaggagattaaaaaaccagataaacttaaaaaacaatga

SEQ ID NO: 34 - DNA, 735 bp, Methanobrevibacter ruminantium
atgactactactaatgatcaagatgaatcaataagcgaacatataaaaaaagcgttctccttgaaggaagatacggcctctaatgaagagattcgctcccgccttttagatggaggcaaaatcacaggaacaaacatgcgcgttctggtatgtgctatggtgattgcatctgtagggcttaacatgagctcaactgcagtaatcatcggtgccatgctgatttcacctctgatgggaagcattcttgcctctgcctatgcaagcgtgaccaatgaccgtccccttcttggaaagcatttaaccggatttgcaatgcagattataataagcgtaactgcagcagccatcttctttttcctctctccagttaaggagccaacagtagagctattggctagaacatctccttcattttatgatgtgttaatcgcattcttcggaggacttgcaggaatcataggacagaccaggtcagataaggtaagcacagttatcccaggggtagctattgcaacagcccttatgcctcctctatgtacctgcggttattcaattgcaaacggaagatgggacatgcttctaggagcaggttatttgtttttaattaactgctatttcatattcctctcatcaagccttattttaagtgcattgaagattccaaaattgaaggagtatacagaaaaagaatggaaaatccataagtggagaatgagttacggaatactattttaa

SEQ ID NO: 35 - DNA, 1974 bp, Methanobrevibacter ruminantium
atgagagacattgaagaacttaaaaagacaccaggactgtcacttaaaagatatcttattctttttattgcaaatcttatcggattgtatctaatcagctttggattggatttcaccgtcaccaatctaggcagagtcataatattcatatttttcataagcatcttcaatgcagcaatatggcctctggtaacaaggatatacatgccccttatggtttggacctttggaatcggagcactccttttaaacggaggggtctttgccttcttcggcccatactttggcttagacatatcaggatggggaatagtccttgccccattaacaattgcccttattacaatcgtcctatcaacccttatggacgctgaggatgatggcacatattatcaggctgttcttagagaagcccaaactaaaagaaaaggagagattaaggattatcctgggctaatcattgttgaaatcgatgggcttgcatatgacgtgctcttggaagctgtagagaaaggagtcatgccaactgtcaagtcaatgattgacaacaaaacccatatccttaaaaaatgggagactgacctctcctctcaaaccggagccagccaagcaggtatcctacatggaaacaatgaaaacatcaccgccttcagatggattgaaaaggaaaacaacaatcagatgatgcagtgctctggagttacaaaggtaaaggttcttgaagagagaatatcagacggtaacggcttgcttgttgaaaatggggcaagcagatcaaacctcttttcaggggatacagacaatgtcatatttaccttcagcaaaataacagaccttagaaagctttacaatggcgcttggttttcaatcttttcaaatccaagcgaattcgcacgtatagtaattttagtcatagaagacatggtccatgagatctattcccaacttaagcacagcatactaaatatccgtccaagaatctcaaggggcatcgcatatattccaacaagggccggaacaaatgtcttcatgagggaaatcaataccgaaacccttattggggacatgctgattggagacattgacgttgcatattcaacatatctaggctatgacgagattgcccaccattcaggagtgagagatgaggatgtatggtttgcccttaagggaatggacaagcagataaggcgcttgatctatggaaacaaatactctccaagggaatatgagtttgtcatacagtcagaccatggccaaaccaatggtgcaacattcaagcaaagatatggccagtcatttgaggactttgtaaagtccttgcttcctcacgagaccaatatctatgcaaagatgtcctcaaacgaagaccactttgcagaggtctacattccatttaaagatagaatagataaatttaaaaacaggaacaagccagatgaggataagctgatttcagagtctgaagttattgtccttgcctctggaaaccttgcaatgatctatcttacccgatggagccataggctgacttatgaagagatcaatgagatgtttccagatatgataagtgaaatagtgaataatgaatatgtaggatttgttttagtccgctcatctgaaaatggtgatatggcaataggcaagaatggaatttattacctggatagcgatgagatagaaggggaaaatcctctcattggatttggagacaatgttacccaacatcttaaaagaaacagctcattccagtacacaccggacattcttgtaaacagcttttatgatgtggaaaatgatgaggtatgtgcatttgaagagctggttggaagccatggaggcgttggaggaagccagtcagagccatttattttatatccatcagattgggacattccagatgaggagattgtaggtgctgagaatatatataggatattgaaggataatttggctaagatgaaagaaaaatag

SEQ ID NO: 36 - DNA, 285 bp, Methanobrevibacter ruminantium
atggatgtaatggatatgattaaggaaatagaaactggaaatgactattggcaggaaggcttggattatcatatggattgtaaagtaacagtgaacaatgtccgcacaagatgcgatcaagtcagcatagtgcaatgtgatatgtcaaagtatggcaagggcatcgagcttttgctggaacttcgaagaggagatttcataagctggatatatcttgacgatgttgtatcatttgatgtgcagatgatggataatgtcttaagggaggagaaaaagaatcattaa

SEQ ID NO: 37 - DNA, 258 bp, Methanobrevibacter ruminantium
atgatcgatgaaatgatgaagatagaacaatttacaagccattgctgctttgtagatgaagagggcatgaattcagttgatggggacttcctcactgccatcgctctatgtgtgaactttatgtataatttcatagacattcaaaacattgaatccggcagcgaggatgaggatgacttgaactttcagctcatcatgaacaagatagaatactaccaaaagatggaagaaatatgcaaaaaatataaggaggaataa

SEQ ID NO: 38 - DNA, 687 bp, Methanobrevibacter ruminantium
atgaataaaatcaacatcctatcagtatctcgccttagaacatatacagatggagatggaataacaagccttgtagcaactatgggatgtccattaagatgtgcatactgccttaatccaagctcatgggatggtacggcctatccaaaatccttgactgtggatgagctatacgaagagctaaaaagagacaatatctactttctctcaacaggtggagggatagcattcggcggaggagagcctctcttataccataaattcataaggaagttcatagaaaagtacagctccaccaaatggaaattctatttggaaagctccctatcatataagacagattccttaaaagatataatcgaccttatcgactacttctatatagactgcaaggacatggacaagaccagatatgagctatacacaaaaggagactacgatctcttcttcggcaatctaatctatctaaaggaacatgtggacaataacaaaataaagataagagttccaaggataaagggattgcataaatctgatgaagctgaatcaaaccttaaagtgcttcaagagatgggatttacaaatatagaaatatttgactacattgatgatgttgaaatccataagccaatatctgataaggccataagaaacaaaaaagactttttagaaagaataaaagaataa

SEQ ID NO: 39 - DNA, 480 bp, Methanobrevibacter ruminantium
atgaatggcagggataaatgcgaacttctaaacgaagtccggcaaaggatagccaaagcgaacaatattgaatttgactttgaggaatgcacattcgaagggaactgcagcgggacatgccctaaatgtgaaagcgaagttgcataccttgaaagagagcttgaaaaaaaacaggacaatggcgaaaagatagacattgaaggaatattcacattaaaggaaaaagagcctactaaactattatgcaaagatgtctttgtgccttttggaaattttgaacctgtaagacctaaaatggagattctagaaaagagcccatattgtgaaactttcggcgatatagagtataaagattatgcttttacataccttaaaatcttttatttagggaatgatgaagagatagtgcttccatataatgagaaggaatatgatggagatataactgtttttgaaatcaaagaggacgaatatgaataa

SEQ ID NO: 40 - DNA, 552 bp, Methanobrevibacter ruminantium
ttgtatcaatggtgtaatctatttggaaaaatccatcgtggacaaaattatgaagatattaaagaggataattgcaggatgctcttagatcttgttaggaaatatccagaacattctgatattatttaccttaaaaaagttaaagatatcggcacatcttcaaaaatggataattctcttgatgagcgtattaatcaaatggaagaagctcttaagccagtccatgatatggtggatgatgtttattcatgccaaataaatgatgatttaattaatttagatgattttgtgccttttgaattcctttctgaatatgcatataaaaaaaggttttggttgacatataatgaaaaaccggatatatttgagctagaaacctcttatagggataagatttatagttttgattctgttacagaatcagtgatatttgttatggatgagatgaaaaatttcattgataagtatcctcaatattctagattgattccggattacagctcttttattaaatataaagaaaaacttatagaggagtttgagggtgaataa

SEQ ID NO: 41 - DNA, 177 bp, Methanobrevibacter ruminantium
atgaaaagtgaattagtgccaggttatgattttgaatacacttacgacggtgtgttgctgattgaatatgacacatatcattacaaaaactatgaaatcaatagggtttatttggaagatcacattgaaaagttaataaaattgcctgatgtttatgtgatttgcctggaacagtag

SEQ ID NO: 42 - DNA, 219 bp, Methanobrevibacter ruminantium
atgaatgaaaataataagaaaataaaagaaaagagcgctgaagactattctgatttagattcttttttagaagaggtttttggccctactgatgatatagagtggactgaagagaaacgcaaacgttttgaggaaataaataataagtgccctttttctcctacccgtaatgaatggccgaatataaaaattcatagagaagaattaaaagaagattaa

SEQ ID NO: 43 - DNA, 2058 bp, Methanobrevibacter ruminantium
atgaccgaagaaataaatgaaaaaataaacactcaactcgaagaagagatcaaaggattcggcacacgtgtagtagaaatatttaaaaacacaaaatcaactaaaaaagaaaatgaagatcctgaagatgataacactaaaaaatcacaggaattcataactgtagcagaatttaatgagttcaaaatcgaaaccctcgagtttgtaactgaaatgaacaataaggccaataatcttattaaagcctctgaaaaattcggagaccctgaagatgactatgctgagattgtcaataaagtagatactttgttgcaaggattgcataatgaacttttaggcaaggaaattacaattgaagaccgattggacaagaggaacacattagtaagaatgtcattgaaagtgcatcagtcaaaaaggattctaaaacttttagacaaacagtcacagatgcgttctgcagaagaaaataatcttaaaaaagacttgagcaaatggttccacaaactggaaagaagaatacagaacctcatagacatctactatgaaaatgaactgttcttcctccatatcaacaaggttaccactatcgtagaggatatgaagccagaatacaataccatactcttgaagcatgggttgacagtattctacaatgcccgggaaactgccaccacattgtacactattcaacagaaaaaggtttccagtaagacaggcctctacgaaccaaaaatcatgcgagaaactgatgtcggattgttccgtaccaacccagaaatagaagacagcctaaggtacagcacatttcaagctagtaattccacattgattcgtgttagtaaaaatatcaccaacaacctagcagatagctaccataaaggattaggaatcgaggatgttgggcataagattactgaggaattcactggtttgaaaggttggcaagcaaagcgaatagcaaggacggagattaattccgcaagcaatgtaggaacattcagtgtttacgatgaacttggtgtagaataccatatgtggtggacaggcaatgatgcccgtgtaagagattcacataagcctttgcatagccatatagtagcagttggtaacactttcagcaatggcttgttgcatcctggagacaaatcaggacccataaatgagtggattaattgtcgttgcactagtgtgccctatattattccgttgggtatgatggcccctccaggagtaaaagagtttactgaagatcaactgatacctattccagattatgattctagtaaagatagaggaaaaatcattaattcttcatcaaatagttttaataatgtgttgaaagttccaaataataaattaaaaaaagaaggacataattttagaaaaaaagaactggaagagcttttagaacttaaaattcgtgaaaaatctctaaaacaacccattataaaatccgataacactccattagttgaattagagcatcctatactaaaaagagaattagacaattttgacaaatttttagaagataaagatattgaatattttcaaatgtatacttttgatggtagggaagcttcaaaattgtatattggtaaaatgcatgaggttgatgtgcctaatgaagaaataattgaagcagttaggaaaggagggaaaatctcagtacataatcatcctactaattttgataatatgcattctatttcagatatttatactcaaattgaaacaggaatagaattaaatatagttaaatcatatactaaaaaatatattgtagttgcagaagatttatcttctaaagaaagaaaatatttacttaatcaattagaaaaaattgaaaaaaaatataatgaatttatagaaaaagaaaaaaaaccttatttaagaggattggataaaatagatttaacagttgctgaaagagaatatgccgaagaaattatacatcaatatgtagtaattaacaattatgataaatatgaaaaagtgatgagttatttctttaaagcgaatccaagtattgatttatatgtttatgatatttag

SEQ ID NO: 44 - DNA, 498 bp, Methanobrevibacter ruminantium
atgctacccgtattcataccaaacttaccggattgtgaataccaatatggggaaaagcccttgaccgcagatcaaataatccaattcgcaagggattatgaagaatggctgatagttgaccttgaacatgaattcctctatactggccaggtaataggaacagtaataaaatcacatgttaacacagaaccagtcaccgtgaaattcattgacagcacaccacgagaatatcctaccggcacatggtttgttacattgaaaattacaaaccaagatgtgattcaaggaatacataacgaacactataccggcggaagtgcaaccactatcgaaagagaagatactgacaagctaaggaaaatcttaaatgttccaataacatcaacaacaaagtcaaaaatcaaacgcatacccataagcgagattaaaaacccagtggtgatcactataagcattgttcattctccttgtgttcctcttgcaaattttgtagtttaa

SEQ ID NO: 45 - DNA, 1023 bp, Methanobrevibacter ruminantium
atggttgaatttgattcatttattaatgtagaaaaagttattgaagcaaaagatagtaattatgttactaaagaattatcttttgacgataaaaccatattaaacacaccatataagatttttaatgtgtctaaagtaaaattaaataaattagaattgcctcttaaaggaaatattattgaaactactaaatttatcaataataaaaaatcatatgatgcattatataatttacttgaaaattctcctaataatcaaaaatcaaaattaaatcaattttttaaggtagataatacatttaaatcatataaatcaattatatctttgactttctcaaaaaacccatttaaatctaataaatttactcatgggcacagtaaacccctttcattttctaatttcgaatatttattagattatatgtatgaatattcaactttatttgtattgattccagatattgattttaagtcatttgattctatggataattatatggagtatattgaaaaagcagtaaatgttgtttcttcatttaataataaacctatttttgttccattatctatgaaattggacaacagtaatcttgaaaaattattacatttttataaagagaataactatagcaatatttggtttaatttttattccaatcaaataaatactaaaatttctatcattcgttattctttaagattaatcaatcgtttatttaaaggaaatgcagtaacatatttttctaatatgaaaaaagaaattaataaacatcttgatgatgtttacactttaccatctgattttttagggccttttttcggttgtgattttctaggttcaaatagagagtcaggttttcctgggaaaaatattaaaagaaccgctaaagaaaaaagggaatttgaaagaaaaaatttaattaataaaaatcgtatttttgattcatcaagctattattattttagtattttagaatatccatctgatttaagaattaaattcaaagtcaattctacaaactaa

SEQ ID NO: 46 - DNA, 570 bp, Methanobrevibacter ruminantium
ttgttttttgcagatttcctaaggtttctttcatatggttttttagaggaactaaaacaaagcaattgttataattttttagattattataattttgctattggttcaaaagtttttgaagaaataaatcaacaccttgataataacttaattaataaattacatttttgtccaaacaataattacaattattctgctttaattgctcctcttttatctaacgaagaaaaaaataaaaataaaggagaatatgaagtaataggtttatctttacattatttgtctttaaatcaagtgaaatacataattattgatgataaaagagcaagaaaatttgcaaaaagaaattttgaagaattacaagagtatattactggaacaataggcattattatattttgttcaaaagataattttatttcaaaaattgatgctgcaaatatattaaaagatattgaatttgcaatcgaaaatcatgatgaaactcaagggaatttcatttgtagtcttgggaaacaaaattataaaaaaataatcgatgatgcgattaaaatgttggatgtagagtaa

SEQ ID NO: 47 - DNA, 573 bp, Methanobrevibacter ruminantium
atgactttatcgaatgcagaatataaacaaaaatatattgaatatttaattttattattattaggggactttaaaaataaattatctgtattgcatattcaaaaagaaatatatttgttatataactttgatgtagagttaaaaaaattattttcctttgtaaaacattataaaggaccctatctagatttaattaattcgtgctgtgaaactccattttatttagatggttgttgggaatattttgaaccgaaagaaaaaattagtggaggatttttaaaaatcactgataaaggttataaagaatatttaaaatttcttcaaaaaattaaagatgaaaatcaggaagaattacttcatataaataccgctataagtatgttaaataggttatatggttctttagattgtgaagaattattactgctgatttatactgagttcccagagtacactgaaaaatcagaagtgtattcaaatataatatctaaaaaaacaaatattgcaaaaaatttatttgaaaaaaaagttattagcgaggaaaaatataatgagttatcaggaatcttataa

SEQ ID NO: 48 - DNA, 2769 bp, Methanobrevibacter ruminantium
gtggaaccaacaatctcatcccgattgctaatttttattagaaatgatttaaaaaatgatataaatgagctacttggtgagccaaaatgtggtaaaggttctgcaggtataggtaatttagctcatatgccttggttagattttacattgcataatattgatgaaaacttaggtgctattaatgttgcttatttatttaaaccagatatgtctggattttatttaacatttagagctttattttatcaagaaattgagaaaaaacatggcaaatatttattaatttatttaaaaaataaatcaagacatattagagagtttttagaggaatctaacaaacttagagatgattttttatttaatatggacttctctgaagacacagctgtactaaaaaaacatagtgcaggaacaattgtagcaaaatattatgatgcaagtaatgtgccttccgatgaggaattaataaatgatttaaattattttttagatttatatgcttttgtcattgacaattatgaaaataaaacagatctttcagtagatgaatgggtcaaggttttagaaaataaagaattaattgatgataagatgtttagcattttagaaatcatgaatgaaatggataattattccgctactacaagccagatttctaaaaaaagggaagaattaggatttttggatgaaaagtcttataatagtattattatttctaattcaagaaaaattaaagaattcttaaataaaaaacctatttataatgacgatggtaccgaaaattattggacaaggttcttttatggaaaaaatgttgatggtgcttttgaatttaaaatgaaggatgaattagttgaagcttttaaaaaaactaatgtggaaaaacgaaaaaaaggtggggaagaagtgactaaaaactataactctttttatgatttccttttagataatggttatttgtttgataaaggaactattgagaattatttgctttctttaaaggttaagccatttgctattttgactggtaactctggaactgggaaaactaaattatctcaattgttttctcaatatatttctaataataatcctattttagtttctgaaatgaatagattatcaaaagatactgaagattttgtagaggttcaggttactacaagaagatcttcgtggaatatttttgaaaaaggtaaagaaatgaaccctggttggacaatatcaaatgaattttttagtaattatttgcctattgatcaatttagtggtgaatatcaaattgaagttgatggaattgaaggtaatgggattattagtcctgtaattcaagtatattatgataaaaatagtttaaaacttaaaaaagagtttgaaaaattgtatttatccgaattagaatcaatagaaaaagataaagaaaataaagtttcacacgaaattcaattagttggtttagaattaaatgttaattctcttgaaaatatggttaatactaattttacaaaatttaagggagatataagttttaaaaaagaaattacaacaacttctattaaaccaggagaattcattgttccttatgaaatatttgattatataccttttaataagaatcaaatggattgtaaaataatttcttgtggaagattttctaatgctaatatccatattaagtttaaattaagaaaattaagtaaaaatatccgagagtatttggaagagaagggtgtaggggctgaaattgatgttaaaattaaaaatattgacacttctttagaaagatttaatccagattggagttcagctaaaagatattcttcagagcaaattgcacaattaaacgaaaagaatattgatttaatcgactttaattctcaaaattacaaaataatccctgtaggtgctaattggactgaaaacagaaacatagtaggctattacaatgtaataaccaataaatatcaatccactccagcatatgacttaatcacacaggcacaaaagtctgatgaacctcacttcttaattcttgatgaaatgaacctttcccatgtagagcgctactttgcagactttttatcagctattgaaagtaaagaaaaaatacctctctatggagaagaagctttagaaatccctgataatctgtttatcataggaacagtcaatgtagatgaaacaacatacatgttctctcctaaggttctagatcgtgctaatgtccttgaatttaaaacatattctgctgcatcctatatgaatggcgatattaaactatctggtcctgatggaaacctatcatatttagaaaatccattggatggtaataatattcgtagtaagggaatagatgaattaagagagttatttgatggagttaaagtagaaaataaacctttctggaacattttatcttcagagattgaaaagttccaatctgtattaaaagtatctggatttgatttcggtttccgtgtaattaatgaaatagttcgtttcatggctgtagcatgggaatatgagaacaagcctgatgaatttagcaattgggaaagatattttgatgcccaaataaagcaaaagatgcttccaaaattacatggctccgaaaagatcattggagatacaattgatgagcttcacaagatctgcttggacagttccattgatgatgtggagatggctaaatatccagaatcctataagaaattaactgagatgagaaaagtgcttcgtaagcaaagatatgtttcattcattaactaa

SEQ ID NO: 49 - DNA, 1645 bp, Methanobrevibacter ruminantium
atggagcaatacattaaaataaatgctatcgataatgaatctaatcaattgggaacattcaaaatctcaaaagaatatgatggatacataccatctatagaaaactttaataaagagattattttagaaaaccttatcctatacaatgttccaatagttgaatattttgataataagactcccattcaatactataagaatgatagctttaatgcaaatattcttcttcttgaggaatatgagtatacaattgaatttgaaggcgatctgaatcttgatgtttatgaaagtttaaagaacagcaaaaacagtccattgaagttgctgtcaaacactaattctggctttttaaactttggaagctatgtaggcaagacatttatagacatttataaggatgaaggccttcttttcaaatgccctatagaggttcgttctcgcaagataaattatgctaaagactatgccactatgattggggatttgtctcgtttttcttctggtctaatctatgagcttaactcccctgtctatcagtcattggaagtaagtgacatcaataagactccatatgaggattttatgcttcttgagtatctatttgaggatgagaatcttccatccactgttgagtatttgtctcgcaatttgtatactttgcttgaggagtccagggaagaagttccaagctcccttgcatctaatattgggcctaatgagcttgttgaggtcttttctaacagtgataatttggaaaggtatgatggccttgataatggtcatttggattctgttttgtctagaactaaaggatatcttccattaaagataaatgaaataaagtatgtggacaatatagacactcctgagaatcgattctataaaaactttctattgtatatagatgacttgattgatgatttaataaaaaggatagatgaaggctactctttggataagcttcatgaatataaggaaacacttagctattatctctcttcacgctattttttagacatttctcctatggattatcctcctcttaattcacaggttttgcagaagaaagagggttatcgtgacattcttgaatattatcttttatttgagttcggtttcaagcttaactggaatcaggttgttgatgattttcgtggctatgagaagaaggtgtatcgtctttatgaatactggtgctattttgaactcttggatatagttggtgaattgacagatactgaaatacgttttgatgatctttttattgaagagaacttgaacatctcccttagggaaggggctatscaaaagatttgacttgaacttgtctgacttgttggacaatgatttgccttcatctgatgatttggacataaggatagacttgatgtataacaagaccttcaataaggatatggcttttcattcctattcagttgccttaaggcctgattataccttgtcaatagagtttgggggtaatgcttatcgcattcatttcgatgcaaagtataaattgaacatcaatgatgaatcctttaagaatgatgatattgtaaagatgcattcctataaggatgctattggggatacaattgcagcatatgtgctatatcctggagatagaaaagagatatttttatga

SEQ ID NO: 50 - DNA, 3537 bp, Methanobrevibacter ruminantium
atggagaaaactatgaaatctaaactttttatacttctaatcattatctctattctaataagcatttcatcagtttcagcaagtgaactccaagctgatgcatcaaatatagataatgattatcaaacaaacatggaatttgatcctatctgcaatgatgaatcaaatcaaaaccaggatttaaatctgaaaaacaataatgaacatattttaaaagaagagaacacaaaccccccagaaatagaagatgaaacatgctttacaactttatatcaggaaatcaatcaatcagatgatgagctaaacctcacacatgactatatattcaataaaagctatgacaatgccagcttataccaaatgtattacggcccattaatttcagtgaataagaccaattttacaatcaatggaaatggccatatcatcgacggaaatgaaatgggggcagaatttgattttgaaaacaataagggagaaattgtaattaatgacttgacatttaagaatttcaaccaaacagttttacaaatttacggaaagcttacattaaacaatgtcaactttacagagagctttgaatcacttgaaagcattatatttgtaagcaagggcgtcttgaatgtaaataattgcagtttttattcaaaccgcgcaaagaatatcataagcggatcccagtcaaatataaccgtaaacaattcaatcttttctggaaatggcaattatgaaagagcaatttcagccaacagatggcagctggtcatccacaattccagatttgaaaatttcactttcaagaacggtgcaataattgatttcaagggatattacctagatctagaaaactcaagtttcaataatatacattccaatttaagtggcggagcaatacttggaaaatacttccccgcctatataaaagtagctaataaaacccaataccttccatcagaccctatgataatcaaaaactgcagatttgaaaacatttcctgcctcaacgacgggggagcaattcactttgactttgactcaggatcccaaaggattgcccaaagcctaaacattatcgattccaatttcacaaactgcagcagcaaatatggaggggcaatatcaattctaggaggaggattgaatctcgaaaaaagcaatttactaaataactatgcaagcttcgagggaggtgcaatatactcctcatggaccaacattaacattacagattccagcataaaaaacaataaggcagaaaagaatgcaggagcgatatactttgacaaaggaaacctatcaatcaaatcctccgatatcatcaataacagcgctcttgaggaatccccaactaccgcaaatgcaatctatgcccatgacgttgcagcggatttcagtgactccacatttgacaatgggggaattgcagtctatgcagactttgcaagccattcaaatttcacaaacgtcaataagaatgatgacatattcctcatggacaatcataattacatcgtttcagttgaaacccctggaataaaactcaatctaacaaataatgaaataattgttgactccctcccatccaaattcaattcacaggattggggatggacaacacctggaaaagtccagggagacaatgacgactgctgggcatttgcaacaatagcctccattgaaacaggccttggcaaatccacaggagtgctctacaatctctcacagaactatgtgcagaagcttcaattgaaatattatgaagtgggggatttgagaaacagcctgacaggattcataaccagcggcttaggctatgcattaagctggtatggggtcttgcctacagatgcagcttatgatgaccgtggaatgattgcagatagtgatatgaatgttcctagaatccacgttcaggatgcaatgttcatatatacaggagaaaacaacacaatagatcaattgaaaaaagcgataattaaatacggcgctgtcactgtgcaatactgggcatatagagaaggtgaggaaatactaagcgaaggagaggacatttccattatggaacataacacccatttcatttcacttgtaggatgggacgacaattttacaaatgattttggcggagccccagggtgttggataaccaaggattcccttttcggatactcaaatacagaatacatcaatttcgcggacatagactattttgccattgtgcctttaagggttgcagtagcctatatctttgaaaacgacattgactatcatgtaaactatcagacagaccttacctgccttgcaggatttgaccaaaactatacaatctattcaaatgagttcacttcaaagtacgacgagctgataggagcagtaggaacctatttcaatgaatcaggaataaaatactcctttgacatatttgtaaacgacaaaaaggtccaaacccaaaacggaacaagcgaatatgcaggatttaggacaatagttttaaataattacatccctattaagtctggagaccagttcaaggtagtcttcaagagcaattcagttccttatcaggcatggtctagggtccattacctaaatggaacatcccttgtaagcgctgatggaagcacttggaccgactttgctcctttaaataagactgtctgtcttaaagtatacacactcaatgacactacaaaattagcagacgccaatgacatgattattgaatatggcgaagattcctatttcagcgtaagggctgcaacagagaataatatatctgtaggaccaggagaggaagtcactttcaccatcaataataatacaacaacagttaaaactaatgatgagggtgtggccaaaataaagataagcgaagctccaggaacatacaagataacaagcagctacaataatcaaagctatgaaaacaatataacaataattagcagagaaagaacaagcacaagaatcctatatcagaacatgagcacagtggctgtcaattccaaggtcgatggcaggataggcaaatactttgaagtaaacctaaccgacgatgaaggacagccgttaaataacatgccagttcaaataggattcaatggagcagtctataatcgtacaacaaatgctacaggcggtgtaaaactacagatcaaccttggatatgaaggctcatacacctttgcaatagcattcttgggagacaataaatatgcaggctcatttgaagttgcaatcatcaaagtcagcaagcaagctcctaagataaccgcacctgcaaagacatataaagccagtgcaaagacaaagacaatcactgcaacattcctatccgataaaggacatggagtaaaaggcaagaagatcaactttgttataaacggcaagacctatacaggcacaacaaatgataagggagttgctagcgtaaaggtttctttaaataaaaaaggaacatacacctgtacagccaaatttgcaggagatggaatgtataaggcaactagcactaatttcaaggtgaaaataatatag

SEQ ID NO: 51 - DNA, 1065 bp, Methanobrevibacter ruminantium
atgaaaggattggcaagaatcgaacaagatgtacttggctgggttgatgctgagctagacgaatgcggaccttatgatgctatctgtaagccattggctatggcaccatgtacctctgacgtccatattgtatggggtcatgcatacatgagcgatgcacctaaccgtgtagttggacacgaagcaactggtgaggtcattaaagttggggataaggttaaggacttcaagcctggagaccgtgtaatcgttcctgcaatcacacctgattggctgactgtgccagctgaacaaggattctcccaacactgttatggtatgggtacaggaatgagttttgtaacctttaagcatggggtctttgcagagcaattccatgtaaaccaagctgacgctaacttggctcacttgcctgataatgtaagccttgaacaggctgtaatgatttcagacatgatgaccaccggattctatgctgcagagcttgcagacattcaatttggtgatactgtagcttgctttggtataggtcctgtaggacttatggcattagctggtgctcaagttaagggtgcttctcacctcattgctgtaggaagccgtccagcagctatcaaggttgctaaagaatatggtgcacatgatattgtagactatcacaacggcagtacagtagaacagatcatggaattgaccgatggaaaaggagtagataaggttgtaatcggtggaggaggtaaggataccctctctgaagctttgtctgttcttaaggtcggtggtgtaattggaaacgtattgcactatgacggtattgaaaccatacctgtagacggtctttcatggggtcaaggacttgctgacaagaccattcgtggaggagtatgtcctggtggacgtgccagaatggaaaaattagctaatcttattgaatatggtcgtttcgactcttctaaattgatcactcataagtttgataagtttgaagacattgaagaagctatgattcttatgagagataagccaagggacatgattaagcctgcggttattttagatgaatag

SEQ ID NO: 52 - DNA, 1872 bp, Methanobrevibacter ruminantium
atgatatctaaactaaagaaaacaataatatcatttataattatgggagtggttagtttcgcagtcactttattgcccatatctggcggaatgtcaatgttagccccagatttaggattaatatatgttttaggattactattcggcccatatggtgctttaggtgtcgcattggcaatcgtgacattaaatttaataaacggattcacacttatggaaacactgccctttgaaatattcacctttggagtctcatatttaggatacaggctttggtactctggatttaaaaccgatacaattacaaagccaaaactagataacagctaccacatctccctatttttagtaagcatcatcatctgtggatttatctattcaacagtccaaggaatctcttttaaccttatattctgggttgatagattttatataatgatcctcttttatttcatgagctttaccacaatggcatttctctatggaataataggcatttggatctgcaacagatatgattgtttcgaaacaccaaaaaaatcaaaaagacatgttgacaagagaatatatcaggcaatattctgcatgataatcatcacatcaataatcctagccacatcatttataactactgatgatacaacggtgcgaatcatagagttgatagttttgggaatcttcctatttgcctatctgacaaagccattcgaatatgatataacaccgaatgacaaggatacaatcagcggaaggataatgcggaatttcattataatcacatttatccttggagttttgggaatagcaatttccatgatcagctacagtgcatatagtcaaagcgataacgtctacttagtattaatgtggggacctataataaccgatacggtattgctcctgttcctcattccttgcatttttatcttaagatatattgaagacaaagtagttcagcctatctcatcattttccaaaatcgaaggattcattaaggaaaatgagaagattgatgaagacggattggtaaagacctattccaagtataccgatgagaagacagagattggaacacttgcccgctcatataccgaactgataaagcacaataacaactatatcgaaaatattcgagaaatagaaggggaaaaggaaagaatcaatgcagaactggacattgcaactaaaattcaagagtcatcacttccagaaaatccaataaaaacaaatgactttacagtggaaggctattccattcctgcaaaagaggtagggggagacttctttgattactatatggtagatgatgaaaatctggctatagtcattggtgacgcttcaggaaaaggaatcccagcagccatactttcaatgataactcaattcatgatcaaaaactttttaaaacaaactttaaacccttcagaggttttatattctttaaataatcagttaagtgaaaataaccctgaatgtatgttcataacattatggcttggaatatataatacaaggactaaaaaagtaagatttgctaatggcggccacaaccctccattagtaaaagaagacaagaaattcaagtatttggacattgatacagggcttgttttagggataactggagacttcgactatataaacgaagagataatactaaaggacgagctgatagtatataccgatggaataacagatgccacagatgaggattccaatatatatggcgaagatagacttttaaaattcttaaatgagtttaaaggcgatgaagtccctataaaaccattgatatcagatgtaaacactttctctaaaggtgttgaacagttcgatgacatgacattgctatgcctgaagttgaataaataa

SEQ ID NO: 53 - DNA, 300 bp, Methanobrevibacter ruminantium
atgaatgtaataaaaaattacaatggaaaagaattaacaatggcagtagatggccgtattgatacaataagtgctaaagagctagaggaagaaattaatgctgaaatgggtaattttgactcattaattatggatttaggcgatttagaatatacttccagtgccggtttaaggattttgattgcaactcaaaagaaattaaaatcagaggacataccatttgtcatcagaaacgtcaatgatgcagttaaagaaatatttaaaatgtccggttttataaaaatcctaaatattgaatga

SEQ ID NO: 54 - DNA, 8064 bp, Methanobrevibacter ruminantium
atggatttgtttaatttgtcttcggctcagaagatgctattgttttctgagataaataatcctcaaaatgattctttctatcttaaatttagaaaagattatgatttaggagattatgaatatgttaaatcagctatagaacttatttctcggaaatatttgaatctgcagattaaatatgatgagaatgctgatttcaaacaatattttgtagatgctgatgaagtaaatgtcgattcatttgatttttcaggcagtgaccttgatggaatcgatggtgatattgggggctctggtgtcggttcatttgatggtgatattggtggatctgatgtctcttcattcgatggagaccttgatgagtttataaagaactatttggataagccttttgacgatatattcgattctccattatataaatgggctgttttaaaaacatctgattctacagtacttataggggttgttcagcatatcttgcttgatggaacatcattatattcaatcgttcctagcgaaattgaaagatgcattgactctcttaaaagcaatgaggaattcattccaattgactattcatatgagacatatgtcaatgacgaactggaatatctcaattcaagccaatcacaggaggataagcaatattggcttgatagtctaaagggctatagtcaggactggtattcctttgatgactctgaacttggattctacgaaattcttttagagaaggtcccggatttcggatattctccattcgtcactgcactggcacttagctttttatatttctcaaagtctaaggagggcaacgaatcatttaaggatatggtatttaacacttcagttcatggaagatacttctcccaaggggatgcattgggaatgtttgtaaacacaattcctttaaggctaagctatgatggggatatgacctttgacgaattgcttgcctattcaaaatccgtcttaaaggagggcttaggccatgcaaagctccagttcagcgagtatacaactgacttaagaaatgagggcattgaccctgattgcatttcaatgttttcaatcgtatccaactccactgacatgaactctaagtttttaacccttcaaaaggacattaagttcccattgcactttaggataaacaagaattactctgataagaagggactccagtcaatcttcatagagtatgataaggcctgcttccataagagggaaatagcttccattgcagagggattgaaatatttaataagacagcttattgacgattctgctaaaagatgtgccgattatattgtccatgaggctgaatttttcaagggagaaaactattataacaatctgatcaattcatttgacaatccgacagcaatttcacctgatttaagtggagataaggtaagatttgtcaatatatccaagcatatagacattgacaagctaaagaacttatctaacagatatcatctctcaaaggaaaagctgctccttgcgattttcttatatgacttaagcaaattctcattttcaaaggatatattgatagcatataaccgtgttgcagcaggatatcacttcaacacagatttgactgttgaagagtatttgaatgacttcaagcaatcctttgaggaatataataattatcctcttttaaataatagaaaattaaactttgaaagcgaaatattattcttcattaatgattatgacgctaaagactataagcttgtgtttaattttgaaagcggaaagatcaatataagctatgacgaatcattctattcaaaggaattgatggaagctttcttggattcaatggatgtcctattgggtagatttgattcatctgatgagcctcttaaggagatttcaataagacgtgagcttgaattggatgagggattcgagattgagcttgcaaatgaaggtacagtaaaggaaatgtttgaaaatattgcaagtgaaaatccggataagacaattctttactgtgaagatggccagctcacatatgatgaattaaacagaaaagcaaataggattgctaatggattactcaagcgtggagtaaagattgaagataagataatgtttatgatgagaaggaacagtgacttgattgcagctgttctaggaattgttaaggcaggagctgccttcattccgattgatccaaattatcctaaaaacagaatccaacagattttagatgatagtgattctaagtttgtgattacctcatctgaaatagattatgatggggataataggattgatgttgatgaattgcttttagatggcgattattcaaacgaggataacgttgattctaatcctgatgttgatttgactccagatgattctaatccaaaacttgatgctgattctaatccaaaacttgatgctgattctaatccaaaacttgatgctgattctaatccaaaacttgatgctgattctaatccaaaagttgacctgaccccagataatttatgcttcctgatttatacttcaggatccactggaaagccaaagggagtaatgataactcaccgtggaattacaaactatatcgcaaatgttaaggaaaatgttcctatttatgaattgaaccataaatgcagcggctttgtatcaatctcaacagtttcatttatcgttttcctaagggagatattgggaactgtcctaaacggattgcctgtggtctttgccaatgacgaacaggcagttgacccattggagtttgctgaacttttcaacaatagcgatgctgatgctttcggttcaacacctaccagattgcttgaatacttgcagcttgaagagattcaggatcttgttggaaaatgcaaggtcataatcgttggaggggaaggattccctcctgtattatacgacaggcttagaaagcatacagatgctgacatctataattcatatggaccaactgaagtgaccatcgcttcacattataagcttatcgattccaatgaggtcactgcaggttgggagatgctcaatgtggttgataagattatggatattgatggaaaccagctccctccttatgtcactggtgaaatctatgttggaggtgctggaattgcaaggggatacctgaacaatcctgaacagactgaaaaggtcttcttgacattaaacgatattccatattacaacactggggatttaggtaaaaaggatgcaaatggcgaattatatgttgcaggacgtaacgatactcaaatcaagcttagaggattaaggatagagctgtctgaaattgaaggggcaattgcaaattatgagaatgtctccctttcaaaggtccttgtcaagaagcttaataatgtggagcatctatgcgcctatttcactgcatcctctgagattggcttgggagacttaaagcagcaccttattgattcattgcctgaatatatggtgccatcatatttcacacagcttgagtcattccctaagacacctaacggaaagacagactttaagaatctgcctgaccctgaaatcgatgctgatgaattcataagccctagaaccgaccttgaaaaggagctctttgacattgtatctgatattcttggaatggatgagtttggggtaaacactgatctctttagcattgggctcacttcactttctgtaattaagctgacctctgcaatctataataagttaaatgcacagatgaatgttactgaaatattgaaatataagacaattgaaaggatcgcatctgaaatcaagattgaagatgatgagtcaagggacattatggaattgtatccattgacttcaaatcagcttggagtctactttgactgcattaaggatttggagaacactgcctacaaccttcctaagaaaattgaatttactgaaggaattgatgtggataggctcaagtcatcaatcataaaggctattgataatcacccatatttgaagactcgaattgtaatgaataacggtgaagtctatcagcaaagaagggatgagcttaaagttgatgatttaatcgagatttcagatgatgagaacctcgatgacttcgtaaaaccattcaagcttgatgagggaccgttattcagatttaagatagttggagactcaatactccttgccgacttccaccatatcattcttgatggaacttccttaaacatactgtttgatgaaattgcaaagatatatgatggaaaggattatgagctagaggagctggacggattcgaatactcattggatgaagtcaaggtagagcaatccagcctgtacaaggaagcggagctcttctttgcagataagattaaggaatttgataatgcaagcctgattccacaggacatcaacggagacgagtcaaaaggcaaggctgcaatctgtgacgtattccttgaaaaggattcaattgacgatttctgttctaaaaagaacatcagccagaacaacctattcctggcagccacatcctttgtaataaacaagttcgtattcaatcgtgacactctgattgcaacaattacaaatggaaggttcaatccaaatcagcagaagacattggccatgatggtcaagacccttccattggctttaaaattaaattccgattcaacccttaaggactatatcgaatatgtcaatttagaatggctgaatgtattgtcctattcctcatatccattaaccgaaatctcaaatgagttcgatatcacccctgaaatattctatgcatatcatggtaagatcatagaggagattgagattggaggaatgactgttgaaaggcaatccattgattatgagggcttgaaattcaaggtcaacatcaatgtcgttgaagaggacggccaatatagaattttctgccagtacaatgaccagctatactctgaaaccttaatcgacacattccttgactgcatcaggattgtcttagacaagttccaaagatttgatgagaatacattgatgaaggacatttcaatcattgaaaatgatgattggagcgttgatgatttggaatatgatgagattccagaggacaggctaaataagatattcgaaagtcaggttgaattgcatcctgacagagttatcttatatgccaccgatggggaattcacttatcgccaattgaatgaaaaggccaataggattgcacatagcctcattaaaaaaggcgtcggccctgaagatagggtaatgtttatcttaaatagaaacagcaatgttgtagcttcaatattcggtatcctaaaagcaggaggggcattcattccagtggattccgaatatccttcagaaaggattgagcatgtcctgacagacagccagtcaaaattcatcattgtggatgatgtgattcggaagaagggcattgacctatcagattacagcgaaaacctattggatgttaatgagcttctatctgaagaggatacctctaatcctgaccctgatgtccatggaaataatatggcttaccttatctacacctccggttcaacagggcttccaaaaggtgtaatcttagagcatggaaacattgcaaactttgtctatcctgatccaagaaatgtctgtacatatgaactggtccacaatcttgaaaaagaggattataaggttctttcaacaacaactgtcgcttttgacgtattccagcaagagattatgggctcccttttaaatggggttcctatggtatttgccaatgacacagaatacaaggaccctattgaaatgatggacctaatccataggactggagctaatgtttatattgcaaccccttcacgtctgcttcaatatttggaaatcgaagcgatgcaggagacaatgtatggatttaaggtatatatccatgcaggagagccattctctgcaagattatatgatttgctttcccaaaactccaagggtaagttctttaacatgtacggaccgacagaaacaacagtttactgtaacggacagctgcttgaaagctcagacattcacattggaaaggagctcttcaatgtccatgagatggttatggacttcgattccaatcctttacctccaaatgtcatcggagaattatatattggaggaaagggcgtttcaagggaatatctaaaccgtccggagaaaaatgccgagtcctatgaagtgatcaatggaatcagattctatcattccggagactttgtcagggtcactgaagagggaaattattatgtctttggaagaatggataatcagatcaagcttagaggattgagaattgaaatcggagagattgaagttggcctttcaaaattccctggaatcaagtctgttgctgttgtcgtcagaaagattaagggcaacgatcatttatgcgcttactttacagtccatgatgagtataaggatgaaaagcgtggagaaaacggatattccattgacatcgatgatttgaaagcctcccttgctgaaaaattagtatattatatggttccgacagtctatatggagcttgaagagatgcctcaaactgcaaatggcaagacagacttgagaaacttgcctgagcctgtcctaatcacagaatacgttgcacctgaaaatgacattgaagcattctttgcaaacttgttcggtgaaatcttaggattggatgaggtcagcgccactgataacttctttgaaattggtggaacatcacttttagttactaaaatcactatggaagcattgaatagaaattataacctaagctatggggatgtcttctcaaatcctactccaagggcattgtctgaattgattctatcagatgagaccgctgagaaaaaatcagagttgtcttatgattactcagaaatcaatgcgcttcttaagaagaacaatcttgaaaacataataaatggcgagattcaagaaagcttaggcaatacattgcttacaggagccacaggatttttaggaatacatgtccttagggaactgattgaaaatgatatcggagacatttactgtttcataagagccaataaggtcttaagcggagaggaaagattgaagtcattgctattctattacttctctgatgaatattccgacatattctctgaaaggctccatgtcattgaaggggacattaccagtttcgatgactttgaaaagcttgtccatgaaagaattgacactgtaatcaactgtgcagctaacgtaaagcatttctcctctggaaccgatattgaggatatcaaccttggaggggttataaacggacttaagttcgctaaaatgaagaatgcaaaatatgttcaggtatctacatacagtattgccggtgaaagcataaacaattatcctccagttgatgttaagtttagcgaaaatgacctcttcatcggtcaggctgtggataatcaataccttaattccaaattcctggcagaacgtgcagtcttagaggctgccgtcaatgatgacttggatgttaagatcatgagggttggaaacctgatggcaagaagttcagacagcgagttccaaatcaactttgagtcaaacggattcattaatcgtctgaaggcatttgtgacaattggaaaaatgccatattcaatgcttatgaacaatgtggaattttcaccgattgacatgactgcaaaatccattgtagctctttcaaaaactcctaaggaatgtactgtattccatccatatgatcatcatagcgtttgctttggtgatataattgaaattatcaaacctttaggattggatatcgaacctgctgaagaggaagattatgaaaaggctttagatgaggctcttgctgataaggacaagcaagacggtgtttctggacttattacttcaataggatctggaaaggttaagaagatctgggtccctgttgaaaatgtatacactattcaggcattgtatagattaggcattaaatggcctttcgtatctgaggaatacatatataattttgtaaaatacttgaatgatcttgatttctttagtgtttag

SEQ ID NO: 55 - DNA, 1461 bp, Methanobrevibacter ruminantium
atgtatgaaaggaattataaattgttgagggcaaaattctctgaatttttccttcccacattatttacatcaatggcaggtaacatatgcctatttgttgatggtttgattgtaagttttttaattggagccagtaatcttgctcctattcagattgtagctccagtaatcacatttgtcaatcttatttattggatgatcggattgggaggaagcgtcctatgttctgttgcaaaggcagaatttgatgatgaaaaaagcaatagctacttttcagtatcaatcatatccctcatatccatcggggtattgattacggttataggactcttgttttcaggaagcattgcccagttcctatgctcttcacagcctgaattggtttcacaagtgtcccaatatttcattgcattggttattggaatgccattcttatgttatatgatgagcttatcttatttcataagggcggatggtatcccccaactgccattcagggctatacttatagcaaatattgtcaatatttgctttgacattatttacattaagtttttcaatttgggcctaacaggggcggcgcttgctacctcaaccggttatcttgtaggttccattttaatttcatattacttctttaaaaaggaacgtactttggaatttataaaattgaaagctaacgctttctttaaattcattaaaaagatagttacttcaggattttcttctgcgtcaactcaactctatctgactttaaaattgcttgtcataaactttttagttggcctttacgttggaaagtcaggggttgtcgcattcggaatttgttataacagtctgttcatactatacatattcctgattggaactgcacagacaatgtctccaatcgtatctgtttactttaaggaggaagactattctggagttgactatattataaagaggtcccttaagatagtggttgcttcaagtttggctctgtctgttttattcatattctatcctcaggccttgcttttcttgtatagtgttaaagacccggcagatgttcctgtagtattgaatgcattgagaatttttgcaataagttatgtaggaactgcaattacattcttatataccttctatgctcaagcaattcaaaagaacagattatccacaatcatttcattgcttgaaggatttctattgccaatttcagcagcagtcatattgtcttttgcaattggtggaaatggaatttggatttcatttgcaatagctgagctattgacaatattattcatattcgcttattcaagaaacatcaataaaaagacaaatggggaatacactggatttttcataaacaagcacaatgatgatgaaagggtatttgaatatacaatcaatggaaatattgaagaggcagtaaatctccttcagaggaagtcccaaaaattaccttatctggggtga

SEQ ID NO: 56 - DNA, 237 bp, Methanobrevibacter ruminantium
atgcttgtaaatatcattaacattaatgatgtagtcgatacgattgatatcatcgttagaaagaatgttgataatattttaatttcagttaaggacactggggttgatttcaatcctgtggtggaaaatgaagagcttaaattcgataatatatctgtgttgaataaaattgcagataagattgattattctagagttttaggcttgaacagtacagtgataactataaagaattaa

SEQ ID NO: 57 - DNA, 1464 bp, Methanobrevibacter ruminantium
atgactgtaaaagtctttataagcagtaatcaaaatgaattctttgaagaaaggaagttaatcaaaaaagagctcgaatctgattccatgtttaaaaactatgttgatgtttttgtttttgaagaaaatgaagcaagatccttatctccacaggaaaatttcatcgaaggattatataattccgatgtatatatcggtcttatcggatcatcttatggcgatataaaggacaatggattatcctctacagaatatgaatatgagattttcagcagacttaagaacaaacagaatatctatttttttataaaggattccaatgaaagagaagataaggctctggatttcattgaaagaattaaaagcgatacaagctttaaaatttttcacaatactgtagagctcattgaagagataaaaaggagcctaaaggcacatataaatcagagtctaagcaatcaggaatttgactttcaattgttagcagaatccagttgtgacgatgttagcaaggaagctttagatttgctttttgattccattgattatcagcctatactggatttattaggtaatcgtgatatggagagcatattagaaatcttaagcttgggaaagaaagatttgtcaggaacttttcgtttaaacaatgccggtgccttatttttagcagaaaacattgaaaagtttaacattgagcatgaagtgaaactggttaggtttaaagggaataccaaattggaaatgattgacaaatgctataccaccagtcctttctttattcttttaaaggagtttgaacatttctattggaaaaacattaaagtgggctctgtcattaacggcttgcgacgtgtaaatattccagaatatccctttaatgccatcagggaggctatgataaatgctttggcccatagggattatagctttaagggcagtttcattcaattttatatctatgacgataggattgagataattagtccgggaaatcttttgtatccattaaaggtttctaatttgaagaatattgaagtccctgtgcaccgaaataagaatatttgtaatttgttctccaaaaccatttttatggagcacgttggctctggaattcagcgcatgtgtgatgagatgagaaagtctggcttgagggaacctgaatttataaacggcgagggattctttaaggtaatattttggggacctaatggaaaattgatctatccggaagaggctgtggataataatgttttggacctaactaaagtagggttgaatgataggcagataagagcattgtcaagaatagttaatgaaaaagtaaaatattcctatgaaagatattctaatgagtttgatgtgtctaaatcaacttctaaacgagatttaaatgatttggctaagaaagggctagttattgaaaataaatccaatagaagaaattattattttgttgaataa

SEQ ID NO: 58 - DNA, 528 bp, Methanobrevibacter ruminantium
atgatagacgaatcaatactcaatttatttaaagacgaaaaaataaggtccatttgggatgataagacaggagattactactattcaattgttgaccttatttcaatcattaccgaaagcaaaaatcctgataaatattggtctgatttgaaaagaaagatgaaaaaggatgaatacaacctattgaataaatatatagttcagatggaaatgccctcctctaatggcaagatgcgtttgacagatgcaggggatattgaaacggttttgcgaataatacaagcagttccatcaccaaatgcagagccttataaggaatggctagcccaagtggccaacgaatgccttgaagagtatataaatcctgaattagctattgaaatggcaataggcgcttatcgcaaaaagggctatagcgaagagtggatcagtcgaaagctctttagcatggagataagaaatggccttaagaaagagggttttaaagaaaagacaaatagggagcatgttttagatagtttagcttaa

SEQ ID NO: 59 - DNA, 1230 bp, Methanobrevibacter ruminantium
atggtgaaaagagaattatatatgaataaaatcaatagcttcattgataaggatttaataaaaataataaccggtgtaagacgtagcggcaaatcttacttttttaaattaatcattaatgaactaaaggaaagaggagtggctgaagaaaatattcttttaatagattttgaacttcctcaatacagacatataaaaacaagtgaagagttagatgagattgtattggatttcattgattcacatcctgaaaaaacatatctcttttttgatgagatacaaaatgtttccgagtgggagctgtctgtaaattcatattataaattatcaaaaagcgatatttacattaccggttccaattttaaattattatctaaagaattagctagctttttaacagggcgttatgtttcaattaacatgtatcctttttcatttaatgaatttattgattataaaaaggagattgggtctctgcctataaatagcaatgaattaaataccgagcttgaaaattatttcgatgaatattttcgctatggcggttttcctacagcgatttcttctaatgaccataaggagataatattgaatgatttatattcatcaattattttaaatgacatcgtcacaagatatgagataagaaatgtaggcctattcagtaggataatcaagtttttaattgaaaatgtaggaaatttgatatctgccaattccttgtataattatttaagaggacaaggtatggaaattaccaaaccaacaatatacaattatctaaattatttggaaagtgctaatatactatctaaaattacaagggaggatttagtaggcaaaagagaaattaacggttctgaaaagtattatttgatagaccaaggattttataggtcccagttggagattaaacaagaaaatactggcagaatcatagaaaatattgtttacttggaattacttaggagaggttacacaatcactataggatgcattggaaaattggaagttgattttgtatgcaaaaggaacaatgagaggatatatattcaagttgcatattatttaagcagtgatgaaaccattgaaagggaatttgaacctttaaggagaatatcagataactatccgaaatatgttttatccatggataagacagaccaatctcgtgaaggcattaaacatttaaacataattcaattcttaagatcttctgaagatatttga

SEQ ID NO: 60 - DNA, 9162 bp, Methanobrevibacter ruminantium
atggtgattatgaataataaaaagctttttattgttagtttgattatactaactattttgacaataggcgctgtcagtgcagctgatgatggcctggccacatcagatgagataacagtggatgattcgtcagtagccgtttctacggcttctgcagagtcagatatttatgaaactaatggagatatagttgctgactatcaaagtgattctatctcaaatgtaactgtggatgatgataatactaaagatgagataatacgctcttctcctgctaaggacaatcttcttcttgatgatgatgacgatcctggtgctgtaaatgatgatgatgaaggggatgacgatgaagactaccttgatgatatctcagtgtctatcacaaatgaatatgacgtaaccgatcaggatgcggttatagtttccatattcgttccagatgttgaagaaggagaggatggcattgaaggatattttgtcgtttgtcttgatgacgatgatgagatattcttaggtcctttcaatcatacaatcactcctgatgactatgggactgatgttacttttactgcttctgatttagagattacagaagctgcgaattattgggtacgtgttttctatgttagcgatctggctgaacctcttatcgataatgatgaggaagatggatacaatatgatttttgatggggattgtattgcaagagattacactcaattttatgtaatcgtccctccagatggcagaataagcatttttgacactagtgctatctataccgtttactgccctccaggaagtgaaggcacagtcaccttaactctaagggatgaggaggatgtagagacttcatttacccaggaaattgaagatgctgatgatgaaaatcaattatattgggatttagattatatgggattgaacactatagatgccgccggcaactatgaggtaacaatcactcttgaaaatggcactctcatttgtgaggatgatataagaattatggatcctatagaaattcctgaagtctcttacatcaactctacagactatgaccatgcaactttagtcgctctcattaagattccaagtgagcttgatgatgatttggaagaactcattgatggaacagtcattattcaaatagacgatgaaacagtcttcgaaaagacattaagcgaatttgtcgaaggagaaagccctgatgacccattttgggtttacccaaaaatacattggagtgatgaactagacacttcagttaaattatactatgtcctcaacaatcaattggatatagatttagagcctggaacatatgatgtgacagtcaagcttgaccttgacggatgggatgaagtctcaagtactgaagaggttcgcttggtagaaagcaatgtagtcatcgatgaggacattggcgcaagcattgaaatctttgaccaagaggatatcctcaatgataatgaggtaagaatcatcgctatcactgtaaccggcgataagagtggaagagttaatttagcagtagaaggatgtcctgaatgggaatgtccattagatgaattggagaatgaaggcgacatctattatattaattccggctttgatattgaaagcggtgaacatgaggttgtcgtctcctatgtcctaaatgatgatagatctgtttcaaacagcgctatccttaactttatcgtctatccaagaattttcatttgtggaaatggcggtgaagacatagtaaactatttcgctgatgaggatagtgcaattcacatatatcctaagggagatgacgtctccaccataaggattgtggtaacaattggagatgaagttgttctagattccactatagatgatttaggattaagccctaagataaacgattggggagaaacctattatacagtaggtcctgctaatttcaacaaaaagcttgaatttggccattatgagccagtggttgcttattattatagtgatgcatatgagcttagcactgaggatggggaactttcattcattgacattatcggaatggtccatgtagctgacattgaagatgatgaaactccagtactggctgtttgctctgaccgtgatggtcaaattggagtatatattcgccaatatactgaagatggcgaccaagagttagagccaaaatactttgaagttgaaaaacatggcttcataatgcctaccatagaccaattaggccttgatgaaggacaatatcacattgatgttgcatatgccgatgacgaatggatctttggcaacgatttaatcgttgtaaacagttccgaatactttgtgctctatggctgtgactggctatacactgaagagagtgtagtctatgtatggtgtccggatgatgctgaaggaatcattagcctcactaacaatgatggaacaataaatgtcgatcatgaaattacagatgaggataagggcaaatatgtcgaattcaccttagaggaattaggcataagcggacctggctggtatgaaatcagcgtaagggtaaatggcaatgaaatcgatcatattggatttgatgttccaagccctatctacatgcctaattataatgtatatcttccagaggaaggatacgaacctgattattcaatgattattgccaaacttgaactcaattcagaattagaaggcaacattaccataaaccttgatggaaccattgtcttcaataaggatattgaggatatggaagctattaaagatggctccaaatggatttacaccatctacacttctgatttggatgaagcagaagaaggaatgcatgatgttactgtcaccttcaacgatttaaatgaagaaagatccatagaattccttaatagaacaactgaatctgatggtaacttaagcatcataatgcttggaggaacctattgcattaactggaatgatgtaattgctgaggtcattgctccaactaactataatggcagacttgtcctaaggcttcaaggtgaaataatgcaatcttgggatgaattgcattgggtcaattgggataactacaatgacactcacaatatctattatatttatgtagataatttagataaaatgtgtattgaaaatccaggagaatacactgtttctctagagtactattcagatagggaagatgagaatccatcccttcaaaatagcgaggaatatagatttgtgagagatgaagagccttcaggtgactttgaatgggaggtctatcattgggcagactatgaagatgaaaacagcctgctcgttacagtcagatataatgataatatagttgacggcagaatagaaatcaacattgaagatccaaatggcataactttaacagattcaagggatgtcggcgaaggatatgaggacacttggcttgtttcagacttgggaattcaagaatatggagtttacacaataagcgcaaaacacattttaggtgatgatgaggaaatcatatttgaaaatgaacctgtatatgtaactaaaatacagattagaggtgaagaggaagtttatgtagacgacccattattcgtattggccatatatcatgccggcgataggactacagtatatctaaatggcgcaggaattgaaggcagaagattgcctaatggaggtcctcttgtatggtatctctctgatttgtatatcaatgaacctggggagtatgactgcaccattcaattgtttgatgaggatgacaatttatttgcacagaccgaatattacttaaatgttattgaaggggatgacggctatagattgattaaaaaccttgattgggactatttcacttcaagcactcctgttgctgcattatactgtcctgaaggttctgttggagacatatcaattgacatttacgctccagatgacaatgatgatgattaccgcagccgtgatatagtaaatacaatactagattccattggctctgaagacgttggtggcttcaagatatggactttaggcgatttgggaattaacgaaggtggctggaactatggatttgtccttaatgacgctgatggtgacaccattaccgatgaaaatggtgaaaactgtgaatttggcttcggagcagtgctctatcatggaatcggcattgccatatgggatcaaaatcctgttgcccttgataacgaatggcttgtggatatctactctcctttagacaatgacggtgatgtaattcttatgattggagatgaggtctacttcagtgacactttgcagaacttagcgatgtatcaatatgatgaagatatagagcaaggctgtgcccacttccactttggagcaaacagcttcaaccgcacaatagaaacaggccattatgaagaggtcatagtctactatgatggatttgatggatatagtacagacagtactgctttcgattgtccaactgtcttagactttggcaagcctatgaactttgactggtctgtcaaaggcgcttattatgaatattatgataataatgtgattaacgtttggtataatgaggagataaatggcggtcaaataaaaatcattgcaagagctgaaaatggcactgaatacgaatctgtaaaagattataatgacaatcgcaataacgagtggaccatcactgactttggcataagcgaaatcggaaaatacaaccttaccttgatatacattaatgaaggcgatgaagagattgtccgtgacgataaggtattgcaggttctaaccttcgaccctcgttttgctaactgggtaactgtggaccatccatatgacgtccttgcaatataccaagctacagaagaaatcagggtctatgtaaacggcgaaggcccatatgaaggtattaaaatgcctaatgatggtcctttatcctgggatcttgaggctttaggaataagcgctgcaggtgaatatgagattcttgtagagtcctatgacggagaaggcaatctcctcagcagctttgaagatgtattgtatgtaagtgatgagatgaatcctaatgaatacagggtagagtatgcaaatgattgggacttctactctttagacagtcctgtatttggattgtattgtcctgaaggaagcgaaggccctataacaattgaagtctatggtcctgatgataatgatgctcttttaaacacaatcaatgataatatcgaatctggagatattggcacaatcaagagctggactgtcggagaattgatcactaacttaaatggctgggactacagatttgtaatctccgatgcaaatggcatcattaagaatggaaatgatgaggatatcggagaatttaacagaggaatcaacttccatgactctatagattatataagtattaatgaatggtcttaccttgatgatgaatggtttatagacatctttgcatacactggaaatgatggagatgttgccgttgagtttgatggtgcaactgtatataatggcagattgagcgatcttttattcttccaatcagatgaagatatgcaaaggggcattgcccattaccacatccctgtatcatatctctctaatgaaggaaatccaattgaagcaggcctgtatttaaatataatcgttaagtattatggtgatgacggctataacactacaggctatacattacaatcatacattgatgaaaatggtttcgattgggctaatgtaaggttaagcgttggtgacgatcctaatacaatcattctcacattaaccaactcccattgggaacctttagcagataaggaggtatatatttctgtaaacggaggagaaagacaatggggattaactgatgagtatggtatagccattttcacaatagatggtggaaattgcacagttcgtggagagtatgagaatgcagagaatcaatggtccgcctatgaaatgactctatgtgtatttggggagcctatatatccaaatgctacaattagattagaatttgttgacggtgaggttattgtaactctaactgatggcgatggtgcacctctggctaataaaggtcttggtctagctatcgatggtatcgtagttattggccctagcactgatgattatggtatttatagaatgggtatagaaggcaatgcaactgttgaaattagctatcaagatgaaaatggaattgttgtttcaagttccattactatagtcaataatactgagactgaaactgtttatgttggccctaatgccacaatccgtcttgaaattgttgatgataatgttattgcaagccttagtgatggagatggcgcccctatagctaatgagtttattgatgtctctgttaatggagttcctgttaatggtgcaatgaccaatgccagcggtctttattccatctctgtagagggcaatgcaactgttgaggtcagctatactgatgataatggaattacagtttcaagctcaattaggataatcaacaatattgagactgttcctgagcctgttaatgttcttcctaatgctactatcggtctttcaaaagatggtgatagtgttgttattagtttgaaagatggttctggtgctgctattgctggtgctagtgtgaatgtttctgttaatggtggagatgtcactttagttggtcctactgatgctgatggtaaggctagtgttgaaatcagtggtaatgctactgttgtggccagttatgttgataataatggtataactgtttccagttctattgtgattaattctgagactgttcctgagcctgttaatgttcttcctaatgctactatcagtctttcaaaagagggtaatagtgttgttattagtttaaaggatggttctggtgctgctattgttggtgctagtgtgaatgtttctcttaatggtggagatgtcactttagttggtcctactgatgctgatggtaagactagtgttgaaatcagtggtaatgctactgtagtggccagttatgttgataataatggcataactgtttccagttctattataatcaccaataatacagaaattgtggtaattgaaaagtctcatactgctgatgctcttttcaatgtaattattcaagaggataaacttggagtatggctatacaataacaatgaggaagagcttgcaaataaaaacattacagttgtatttgatgatgatgaagaaggacaaaactaccttactgatggacaaggatatacatctattcctatcggcgatcattctattataaaactttcatacactgatgaagatggcgctagcgttttctacacagttcatctttttgaaaccggcgaggtagtcgatgctgattatgtagtcatatacataacccctcttgacgatagctcacttgaagtaagtgtctctgtcaatggtgaagaccttgaggaaggtgaaattacatattatcttggtgaagatgccgaaggaataaccgttgacctagaggatggtgtatatgtcattaattatgacaacactgtaaatcagacaattgctgttgaatacattgatgacgatgatgtaagttggtatgcctactatgaagtggtcgtatacaacaatactgtcactgaaacagtttacctaagccctaatgctactatcagcttatctaaatctggtaatgatgttcttgttagcttaactgataatgatggtaaagctattgctaatgctgacttggatgtattagtaaatggtgccaaatccactgctaagaccaatgcaaaaggtgaggctaccattgctattaatggaaatgctactgttgttgtaagctataaggacgctaataatatcactgttacaagttctatcactgtagtgaatgagactgaaacagttgtgattgagaagaacaataccataattgagtatgtaaatcaaacagttcctcctaatgctaccgtttccctatcccttgttgatggaaaggttgttgctgaagtaactgatggcgatggtgttcctttagctaataagcttcttgctgtaactgttaacggcgctcctaaacttggtgctgagaccgatgcaaatggtatctattccattcctgtggaaggcaatgcaactgttgttgtatcatgcactgacaataatggggtaactgtctcaagctcaatcactgtccttaacaatagcgagactgttgtagttgaaaagaacaatacaatagttgaatatgtaaatcaaaccgtatatgttcctgttgtttcaaactcaagctttgatatagttggagatgaaaatggaataagcgcaatcctgcttgatgaagatggcaagcctattagcggtgctgttgttgaacttgatgtaaatggagcaaaatccaatataactagtgataagaatggtgaaattgtgattccaacagataagaatggaaccataaccatgacctatactgatgagaacggcgctaagcttatctacacaaccaaggtgattactcaaacagagataatctatcaaaaccaaaccatagaggtccctgtttatatcaatgtaactcctaatagagcttcaacaaaggtcatttacaacaatatgtctacaacttcagtcaattccaatgttgatggaagaattggagaatactttaaagttcaattggttgactccaatggaaaggcattggctaataagactgtatacattggattcaatggaagagtttatgtgcgtcagacaaatgagaccggcggagcacagctacaaatcaacctcggttatcaaggagattacacatttgctatagcattccttggagacgatgattataatggatcctttgaagttgctataattaaggtaagcaagcaaagcgctaagcttacaactgctgctaaaacatataagacaagcgctaagaccaaagcattaagctctacattcaaatctgctaaaggtaatgcaataagcggaaagaaaataagtttcacagtaaatggaaaaacctatactggaaccaccgactcaaaaggtgttgctacagtcaaggtatctttatccaagaaaggaacttatagtttcactgcaaaattcgcaggagatggaatgtataaggaaactagtgttagctctaagctcactttaaaataa

SEQ ID NO: 61 - DNA, 849 bp, Methanobrevibacter ruminantium
ttgaggaacattttcaatgagggtgaattggataaggattcagtatgtgcaaaaattgcacatactgccagtgatggtaaaatctataaaaccaatttttacaatctcgacgccatgatttctgtaggatatcgtgtaaatagcattaaggcaacaaggtttaggcaatggtccacatctgttttaaaggaatatatggttaaaggatatgtcttggatgatgttttattgaaaaatggcactcgctttggcaaggactattttgatgagctcttggaaaagattcgtgaaataagggccagcgaaagaagggcatatcaaaaggtgactgacatattctcccagtgcagctatgattacaatcccaaatccgaagttgcaagagaattttatgctaagattcaaaacaagcttaattttgcaatcaccggacatactgcagcagaaatcattagtgagcgagcagatagtgaaaaagagcatatgggtctaaagacatggaaaaactctcctgatggaaagattcttaagtctgatatatcaattgccaagaattatttaagcgaagatgagataaaaagcttaaacagattggtcaatatgtatttggactatgctgaaaaccaggcttatatgcataagctaatggggatggatgactgggctttaaagcttgatagctttttggagtttaatgattttgaagttttggataataagggccatattagcatgaatgaggctcaaaagattgcagatgctgaatttgataagtttagagtaaaacaggataagttctatcagtctgactttgacaaattattggaagatgttaaaagattaaaataa

SEQ ID NO: 62 - DNA, 1461 bp, Methanobrevibacter ruminantium
atggagtataaaaagatgcttgccgaaattgatttttcaaaggatttgattggtttttttgaagataaaaacttatgcataattaatgaatctcttcttgatggtactttcggtctttcaagggatattttgtttgataaacgtattctctttaacaatgattctctaatcgatagttttctcttaaatgctaaagcttataatttgaataatgaattttttattttattaagcaatatcattagaaatgactttcaagaagccatttccaataaatctaataatgaaattttggattttgaagaaactcttgagaaagagagcccattttattctggaatacctgtatccaaagaaatgtttgtaggtcgtaaggatagcatacataagatattaagaaacttcccacatatttttaagggacagactagacatttctttttaactggggataggagaatggggaaaacatcccttattgattttataggagaatatatgaaatcatatggtgttgtaagtgtttatatttccaataagggtaatgattctgttgaatttttagcttatgagattgttgaagggcttattgatgaattaacccttcctgatgaatcccttaaaacaaagattgttgacttctttcaagatcatgtggaaagtgtggagtttaaaggaacaaaaataaagctaacggtagataaaaatctatctgtatcttttaaagaagatttcattaatcatttaaaatcaatctatgatgaatttggaatggataaaaaaggaattctgatagttgttgatgacattaatggcctttcaaattcagaggagtttgttcattggtataaaagaatggctgatacaatacaagtttctcatataaatttgcctgtttattttttacttgctgggtatcccgagaaattttataatcttacaaggcttgatgagtcttttggaagcatttttgcttacgataacttggatagattatccaatatggaagttttggaattttttgaaagttcttttggtgaaaaatccatgcttattgataaggatgccttattctacatgattttgttttctcaaggtcagccattaatgatgcaagagctaggagaatcagtattttgggaatgtcctaatggccatattgataaatatatagcaatcagaggaatcataaatgctgcaaatgttttagcaagcaggcagataaaatatactttaaatatcctaagtgaagatgataaggcaattttcaagtctttaatttcagatggaaagttttttttcaattcatcagatatctgtgatgagggatttttagagtctatgtttgatttaagtctgattgaagtttccaaaaaagaggattatgacttttgttttaaaaatactttggtctttatctatttttgggtagaagcaatacaaggtcttattgagaaataa

SEQ ID NO: 63 - DNA, 14478 bp, Methanobrevibacter ruminantium
atgcaagcaattattccagttaaagacaattttctaattttagtgacaaatatgaagaaaagtgattttaaacgtatattcatatgtttagttcttcttacttgcttgattggtgcagtaagtgctgctgaagacgtttcagtcgatgatgttagcacagatgctgtagcagttgacacaatcactgaagatgcaagtgaccctacagatataagtacggtcagcgagccagtctccaatgatgttcaagcaaacacaagccaagaactaaacaaagaacccgctaccaagtctacaaatgtcttgaaagatggcacatccactaacatttatgtggcgactactggtagcgatgaaaatgacggtttaactcaatctactgctgtagctagtcttgctaaagcagttgagattgtaaatgctaccgctggtacagattttactattaatgttgcaaacggtgactataatattagcaaaatcgaaagtcctgcagctaaaaacgtaaatcttattggtgaaagcaaagaaggagcgattcttcacgcttctgatacatatggtatcaacgtttacgaagataacattgcatggactattgaaaacttgactatctgtgatttcaatagtactaccagtacaagtgcggctgtaagatgctttgctatagacagtgttttcaatataaacaactgtatattcaaaaatatcggttctaaaaacggtgctatttacataacttccactggaacaaggacaatctccaatgttcttatagaagactgtttcggtacttattcaagttcatcttccataattcacttatatggtgaaggtccagttactttggataatattgaaatacgcggttcctatatggatccttctgtaggtacagcaacatatttaaggtctgttatctatgccgaccaagctcaaaccaatgttactttaaagaattcccgaattgttgacaatatcggtgctatgggttcattgatcgaagctaaaggagcatttaaagtcattaacaccacttttgaaggtaattatctcaatacttcttctaatggtgtaaatggtggtactttcatgttctatagtggaaccagctccaattctgcatccaacattgacattagccaatcagtaattaaggacaatgtccttgctggtggaagcatcggtctcttcaattgcgtatatggtactcacaacattgaccacaatgtaatcatgaacaacaaatatgcaaatggaaacgacgttccattaggtagcttcagcggagctgcaatcagcactgacgacaactactggggaaccaatgaaaggcctaacaccaaaacaactgaatgggttatattaactgtagatactcctgaaatggcatttgttggcgtatcagaagccatacctgttaatttaaacacctataaaactacaaacaatgaaacaggtgctgtggaaggcatgcctgatgttgactttggcgtaacatatgctcttaatcaagcaaatccatctactgtaaccgttgcaaatggtcaaggaaccattaactatcttgcaactgttgatggaaatgaaacattaaccttttccactggagatgctttctcctttgatgtgaaggcggatattgcaagtttaatctatgtagatggcctaaacggcaatgctacaggtcctggtgacagtgaacatccttataagaccatagcacaagcaattaatgtagctgccgatggaaagattatcgttatcaaatcaggcacttacacagaaaacagtttaataattgcaaataacattactttaaaagctgataaaaacgcagaagtaatcattgatgcaaacaacgaaggaagaatatttactgtacaaaaagacgctataatcagagacttaaccttaattaatggaaagtccactggcaatggaggcgcaatatctcttgatagcggcttattaactttaaacaatgttaaaatctacaattcaactgcccaatctggcggtgcaattgttagtttatcaggttctcaattatcagtttccaattctgagttcattgacaataatgcaagcaatggcggtgctatatatgtagcaggcgttgctgatattacaaacaataagtttatctccaatgatcctgaagatggaggtgccatatatgtagcaggcgttgctgatattgaatccaacgaatttacttccaaccatgctactaatggtggagcaatctacattgacagtgaaaacaatcaaactatcaaggataacactttcacttccaacactgcagataagggagaagccatttatattaaaaacgctaatgtgagcttatctggaaacacaatgggtgaaaatgattcaatatatcttgatggtgcaagcttaaaaaccactcttactttcttaggcggaaaaaccattgctgctgaatttggacaaactctcaatttaacagctacccttaccgatgaagatggaaacaatataaggggcggaattgtaacattcaccgctaacggtgaaaccattgcaactattgacttatccactgacgctcaattgaaaacccaatatactgttcctaatgatgccgctggtgatataacaatttccggttcatacagtttagacaatggcggagctgtcatatccggtaagatacaccctgcagttcctcattggttcattgaagggggaagcggatacgaaacattggctgatgccattgatggtgcaagcgctggagacattatctactacgaccttccagaggactacactgaagtgattagcagcaagaccatcaacaaggcattgaccattaaaaacaatggtaccggtgtcgttactttagatggtaatcttgataggatacttagcataagctctgcttcagtcaatttggaaaatctgattttcattaacggggccactgccactaacggaggccttatctatttatccggttcagcatctaatgaccttaatataagtggatgtacatttaaggattctaaatttaccactacaagtacttacacatatgctgtagccatttatgctaatggcggaaacattaatatcaaggacagtgaattcagaaacttaactgctcctaaaacaggaatgatctatcaatcttcaagttcaggtgctataactatagaaaactctctattcgataacattacaggcgcatatgatggaggcttaattaactcaaatggtgatgtatccctagttaaaaccaatgtgaccaacattttcggttccacttctacaagtgattatggtttaatttacattaggtcttatggaggctttttattcatatctgagtgtcaatttataaatataagtaatgctggtgcccatcctgtctattacagaggaagcggcggttataacattacccaatccttatttatgaatattaactcaaataagataatagatgcaagtgcaaaaggttatgtaaattataatatatttgcaaacaattccaataattatgttttatatggaagttcctcttcaaaaatttctgcagattataatttctttggaagcaatagcaagcctacaagttatgtaagcaatgttaattacacttactggactattgtagaattgtcctctgcaagcgatacagcatatgtaggaaatcctacagacattgctatacagtttgtaggaaccgatggaagcgaaaaccttactcttgaaggcataatgcctgaatacacattcactttaaatgttacaaacggaactatcgttcctaacactgtaactcttgaagataacgaagctaatgcagaattcactccaacaagcgtgggaaaggtaaacattacagccactccaggtcctgcccaattgactcttaatgtaatcgacccatccatattgctcgttgtatccacagatggttcagacactaatccaggtactttaaacagtccatataagaccattgcacatgctttaactcaagcgaatgcaacaagaaacgtcatttatctcttatcaagtgatgatgcttacgcagaacatggattaacagtttcagacaatataactatccgagctgaagacaatactgttacaattgatggcggacaagagggacctatattcactgtcacaggcactttaagcatagaagacattatcttaagcaatgctaaggttgatgaagataatggcattggtggagctatctatctaaatggcggtaatctaactgtcaatggcgtggttttctctgattgtattgcagcttacggtggtgcaattgctacaactgcaggttcaaatttaaccgttattaactctgtattcagtgataataaggctaaatatggtggagctatctatgtggctggtgaagctaatatctcaaatagcgaattcagcgacaataataatgagattacttatggcggtgccatctatgtaaacggtactggccctgtagttatctctgcaaacgaatttgataacaataaagcaaacaaaggagaagcaatctacattgaaaacggtgctgtaaatgtatctgaaaacacaatccctgcaaacgaaacaatttatcttgcaggaggcagcataaactctgttctcatattccttgctaatggcactataagtgcagaatttgaagaagaggttaacttaactgctacccttactgatgatcaaggaaatgccattaagggaggtattgtaacattcactgctaacggcgaaaccattgcaaccgttgacttatctactgacgctcaattggaaacccagtacactgttcctaatgatgcaactggagacattctcatttccggttcatactctttagataatggtggagtagttgctacaggtattgttcaccctgcagttcctcactggttcattgaaggcggaagcggatatgagaccttggctgaagctgttgatgcagcaagtgctggagatgtaatctacggtgatgctggaacttatgatgtaagtgatcttataattaataaggctgtaaccattaaagcaaatgaatcaggttctatcgtcttaaatggtaatggtaaccaaatattcaatacccgggctaatgtcattttagataatttgacattcatcaatggttcagcaagttccaacggtggatttatttatgtatacagcgattccttggtaataaacaattcagtattcaaggatttaaaagctactggaggattaggctctgcaatctatgttgctactggaagctcaaacatcacaattgaaaattcagctttcgacaatattaaggcagctactggtttaataaactgcagatccaaaacaacaacatttactctagtcaaaaccaatttcactaatattgatgtaagcactaatggattattctatttatacgaaggaggacttcgtgcatacgaatctcaattcataaatgtttcaggtggagacggtgcagtagtttacttctatggtcaaagtgataatatagttacaaaatgtctattcgacaatgtaacaaccacaaaaaccactggaattatttattccaacagtaaatctgctaatataacttataatgctttcttaaatgtcaattatggagtttactcttcatcatcctatggtgaagtcattactgcagattacaactattggggaagcaatgacaagcctggcacaagccttgtaaattcaaacagcaaattaaataactgggtggtcatgactgtaagtccagacactcttgacagcttggattcaggcgctactcaagcattcactgtagacttcactcactacactgatggcactgcaaactacacaatggctgacaccattccagagcttacagtctctgcaagtgcagtcaaaggcagcttagaccaaagcgaagttgaaactcaaaacaatgtcgcaacattcacttacactggaagccaaaacggtgaagaaaccgtaactttcactaatgcaaatctaagcattcctgtaaagttcgttgttggtgaaggatactttggaattgtttatgtagctaagaacggcagcgatgaaaataagggtagcgaagatgctcctgtagcaactattgcaagagcagttgaaattgctcaaagaggttctggccaaatcattatcactgaaggcgtctataatgaaaacaacatcactataaatagcgaaatccctatttccattaaaggtcaaggagatgtggttattgatggtgaaggattgtcctcattaagcattttcactattaaatccggtgaagtttcaattgagaaaatctcattcagaaacaataaggctaaatttggtgcaggtgtaaatgttcaaggcacttccggttcatcattattggatgcaaatgtcttaatcaatgaatgtaactttgataatcttagctcagatgcttcaggcagtcaaggtggagcaatatatgcaaaatacttaaaaggaaacctagtaatcaacaattccaactttacaaactctattgtaaaaagtgggggtggagctttaactgttgcatactgtgcatatgaagatgctcttgacttggtgatttccaattgtaactttgaaaacaacactgctaataatggtggtgctgcatacttaatggctaatacaatcaatattgtaaacactagctttattaacaacaatgctacatacagccctggtgcacttgaattgtataattgtactggaactatggacaattgttctttcataaataacagtgctaaaaatacagctgctgcatttaaacttgaatttgttaaagatcaacctataaccagtttaatagttactaactccatatttaaggacaatgttggtagagatgaagtcgctcctgcaatattcgttgacagggcaagcttaaacatctccaattccattctattaaatcctttgaatattaataccagcacagttaccggatacggtgctgtacctggccaaggggtaaccgttgcaaacagtaactggtggggaaccaatgaaaatccatctaacttaactgcaggcagtggtgacaatgtcaatactacaatagacaattgggtaatcatgaatgtcagcccaactgaagctatcggatacactggtgaagctctagaaataactgttgactttaaatacactatgagtgctgatggcactattgaaacattagcaggtactttaccagaagagtttactgtaaatgctaatgcggctaatggtactttagataaaaccacagcagataccagcaatttacaagctaaattcgcattcactcctgaatttgctggagaaaacatcgttaacatatacacaacagaatccaataccgtacctgttacaataatggtaactgaaaaatacgcaggccctatctatgtaactaaagacggtgacgatgaaaatgaaggttcagaaaacttacctgtagcaaccattgcaaaagcaattgaacttgcccaaggcaaatctggcttaatcttcattggtgaaggtacttatgttgaatccaacctcacaatcagcaaagacttaaacatcactgcacttggagaagtgatttgggatgctaacggtcaaagggcattctccatgtctacaggtagtgtatccatttcaaacattacattcataaacggtaactacacccgcaatggtcacttgatctactgtgctggtgacagtctcaaattcgatgaatgtaagttcttaagcaacggtggaaatgtaactggtaccaacggagtcatctatgtagaacttgcaagtgcaaacttcaacaactgttacttcgaaaacaacactgcaggtactggaacaagctatggtttgatttccgctaaagattcagttattatagtagatggctgtacatttgtaaacaactttaataaaaacggctgtatttatgtaagcggatctaatattgggtccatggctgtcataaataataccaaattcattggaaacaatgctacctctgcaagcggaggttctggtggagctatctatgcaagcggttcaatggcttaccaatactctaacggtactgtaagacctggtgctcaatctgctgtctatgtaattgactgtgactttatcaataacactgctttcggcggtaaatactacaacgctgaaggtggagctatctttgtaaatgcaaatgcaacattatatgcatctaattcaagattcatcgataatactgctcttgattatgaagaaactaataaatcaggtcgtggaggagctattgcggccacaacaggtaatgtacaaatttcaaattgtatattccaaggcaacactgctaacaatggttctgttatcgccatgaaatttgcaaacaaagaccttacaactgtaaatgtcttaagcataagcaactctgtaatcatgggccctggcgaaaaattaattgtctctgacttcactaacggttctttagttgccaacaacaactggtgggcagcgaatgaaaacccatctgatagggtaagcgaaggaatcactgtagacagttgggtaatcctaactgcagatccaagtgaaatcactggaactcttgatgaaattataccaatcgttgctaacttcagacacaccaacagcactgatggaactatcggtgatttggaaggagaattcccagaactagaagtattcggaatgactttagatgaaggtgaaattactgaatccaaccttactgtagacaatgtagctaccctttactacactccagaagaaactggtgaaaccactgtatatgctatttcaggcaatgcaatggttccaatcaaagtaactataaccgacactcctcaacctgttgcagatgttatctatgtatcaccatccggtgctgataccaatgcaggtacatatgaagctcctgttgcaaccattgcacacgcagtggaacttgcaggtgctgaaggtgcttcaggtttagtcgtcattgaagaaggtatctataacgaaaacggcattgtaataaactctgctatacctattaccattacaggtaacggaactgttataatcagaggaaacaaccatgtcgttaacggaaacggagctggaagatttggcgatgtaagcgaatccacaagcataataattgtaaacacaactgaagctgttgttattgcaaacattgcatttgaagacaacattgcagcaaacggtggtgcaatactcattgcaggaaccagcagttccaacttattcgatgctgatgtattggttgaaaactgtagtttcaataacttgcaaggaagaaatggtggtgctatctatgcatactacgctattggcaacctaactgtagccaattgtgaattcacaaacatcaacgcaacttgggctgctttatgcgcatatcaagctgcttatggcgaagggctcactgtagagataaaagattcaagctttacaaacaactctgcaaacaatgctcctgcactttacttgcaagcaactaatgttgtaataaaagattccaactttacagacaacaatgcaacctaccaccctggtgctatctacttgcagaacactactgcaacaatcgacaattgtattgttgcaaacaactctgctaaatacgataaggcagctattgcaatccatggaggcaatatccaatacaacccagtaattgtaaaaccttctgaagtaacaattacaaactctattattgaaaacaacatcggtagggataaagcagctcctgctatctacttggaaaactccatcttaaacatgtcttactcttctgtagtaaacgaaatcaacattaacaataccgttactgcaacctatggagatgaaaaacctggacttgttttaatcaacaacaactggtggggaaccaacgacccaagcactaccatattcggtacaaacatcactatggacaattgggtcatcatgaatgtagaagcaaacgctactgaaatccttgctggagaagaagtaaaattaactgttgactttaaccatgtaaacactaccgctggtgagattgaagaattaaccggtggagttattccaagagaatcctacagtgtagcactttctgtagataatggtactgttgcacctgaaacattaaccattgctaacggagctactggcgaagcaattttcactgcagctaatgctaatgcattaataactgtaacaagcgaaaatgcagttgaaactatattgattaatgttggagaacaaccagttccattcactggagttgtatatgtctccaaagatggtgatgacgctaatgaaggttctgaagatgagcctgtagcaagccttgcaagagctattgaaatcgctacagctgaagaaggatctggtcaaatcatcattaaggaaggcacatacattgttgacggatacaacattaccaaagacttaaccattactggtgaaggagatgtaatactcgatgctcaaaaccaaggcaacagattattcaatatggcctatggtactactgtatccaatttcgaattgcataaccttgttcttgctaatgtaactgctatgtatggcgcagttgtttacagctatgcagctaatgcagtcttagacaacattacagttgctggaatcaaccatgaaatggctaggctcatttcaaactatggtaatttaacaattaaagactctgtatttgcaaacaacactgtaagcggaataatcacccactctggaaacaataatttaaatattgtcaatacaatatttgaaggcaacaatgtaacatatgattcatctatcatgggtgtggtttatgtttcatcaggcagaggaaacataacaatcgaagattccaaattctatgacaaccttgtacgtcaatccacagtacgcggttacacagatactaacattacagtcaaaggtactgaattcattaacaacactgcagacaactctccatattactgctctggcggagctatttttgcacaagctaatttggatgtaacagaatccatattcatcaataacaatgctagaagagaaggaggagcaatttatattggaatcaatggtgtggcaaacatcaccaaatccgagttcatcaataacacaatctatgataatgagtactatggagatgcaatctacactaaaggtacaactgccatcaattactgtatattcttgacaaatggcacaagatatgcagtttacaatggcggatccaaagaagtaaatgctcaatacaactggtggggcactaacgacgatcctcaaggatttgcttactctgcagatgcatctaactggattattatgactgtaaccgctccaagcactcaagatattcaagcaggagacgaatatgaattgactgttgacttcaaccattacactgatggcagtgacattttagaattgccagatagcttagctcaagaattgactgtagaattcacttctaccacaggcacatttgacaatcctgtagtaactactgaaaatcaagtggctactgcaaaatacactgtagttgcaggtgaaaacagtatcacagtaaaatccactgatgctgtatggaacactagtttcactgctggagaaaaggctaaggctaagatgaatgtttcaatggaaaacaatacaattattgtaacccttaccgatgaggaaggagctcctattgcaggcaaaaccattagtgtgctcattaacgaagacacattatccaacgaaaccaattcaagcggtattgctgcaatttcacttggcactttagatgctggcacttatccagctacaatcagcttagctgacagcgaatatcaagctccagagctaactgtatttgtacttgtagaagagactcttgtagacaaccctataggtgcagtcattgaattggctcttgctgaaaatggcacttccattgaagtgaccttgaaggacattaacggtcagcctattggcgatactattgttagatattacattggaagcactgatggagctctccttcctattgatgcaaacggtaaaggatcatttgacattgacaatacagtcaatcaaaccattaaggtcagctacactaaggaaggcactgaatggtcttcatattatgactttattgtaaacaatgaagtaactcctgttcctgttgccaataacgctaaattcgatgtaattgttcgtgaagatagcattgatgtattcttatacaacgataacttagacgatttcgaaggcgctaagattatggttactatcggtgaagaagatccagttgaatatattgctggagagaacggaaatataaccatccctatcaatggcgataccactgtagagctttcatacactgatgaaaacggagctactgtctaccacactgttaaagtttccactagtggtgtggatccttctgctgaaattgaaattatcgtcgaatctcataacgacacttctattgaagtaagcgtaactgttgatggtgatgatgtcagtgatggtgaaattacctattacattggtgatgatgacgatggaacagttgttcctattgaagatggaattgctatcataccattcgacaatactgtaaatcaaaccatcgaaatcacatactcagatggtgacgctacagagtcagtatactacactatagttgcattcactcacgaagttcctgttgagcctcctgtagctaatggcagctttgatgttgaaacaactgatgatgctattgttgctactttagttgactctgatggtaaacctattgctgatgcaactgtttctgctatagtcaatggcgaagagcaaaacttcacaactgatgcggatggtaagctaagcgttcctattgatggcaatgcaactgttgagcttagctacacagatcctgaaaacggtgctgtcttaaaatatgtaactgatgtggtaactaaagaagttcctattgaagttcctgttgttgctaacggcactatgagtgtagaaacaactgatgatgctgttgaagctaccttagttgacagtgacggaaaccctattgaaaatgctactgtcactgctgtaatcgatggtgaggaacaaaacttcacaactgatgcagatggtaaggtaagcattcctgtaggtgaaaacgctactgtagagctttcatacactgaccctgaaaacggtgcagttgttaaatacagcactaaagtcgtaactaaagaagtggaagttcctgttgacgttcctgttgttgctaacggaacattaactgttgaaacaactgacgatgctattgtcgctacattagttgacagcgacggcaaaccaattgctaacgctactatcattgcagttgtagatggcgaggaaatggaaatacctaccgacgaagatggtaaatgcagcgttcttatcacaggaaacaacactgtagagttcagctacacagatcctgcaaacaacgctacagtttcatactccactaaagtggtcactgaagtcgaagaagtaatcgttcctgttccagtagttgctaacgctacaatctccttaagcactgaagacggcagctcaatcgttgcaaccctaaaggaccttgacggcaacgcaatagcaaacgctacacttgatgctaatgtcaatggcgaagaaactaagttaactacagatgcaaacggaatagcaactattcctgtatctgcaaacacaacagcagtagtctcctacacagattctaacaaagctactgtaacaagctcaatgagcctaacagtaatcgaaaccatcgtagaaatcaacaagacaattgaagttcctccagtaagaaacgcatctcaaatcgtttgtgaagacatgaacacaattgcagttgcaaaagatgatggaagaatcggagaatacttctacgtaaaactagttgacgcaaacggcaatgcattagtcaacaagtccgtacaaatcggattcaacggcagagtatacaaccgtacaactaatgaaacaggtgatgtaaaactacaaatcaacctcgcatacaaaggaacctacacattcgctatcgcatacctaggcgatgacaactacaacggttcatttgtcgtttcaaagattacagtaaaacaacaaagtcctaagattactacaacttccaagacttataaggctagcgcaaaaacaaaagcattgaccgctacctttaagacagcaaatggaaacctaatagctgataagactattaagtttactgtaaacggtaagacatactctggcaagaccaatgcaaaaggtgtagcaactgtaaaagtaagccttaacactaaaggaacttacagctttacagcaaaatacgcaggagacgacacctttaaggcaactagtgcaagcggtaaattaactattaaataa

SEQ ID NO: 64 - DNA, 10176 bp, Methanobrevibacter ruminantium
atgaagattaaaaatattaaatatctactgatatctttagttcttctcatgtttctaataggtgcagcaagtgcagcagatgatgctgttactcttgaaggggatgctgcagctgttgattcaattagtgaagatgctagcgctcctataactactacggttagtgaagatgctagcataggtactacttttagtgatagcgctatcgaaagcgattctattcaatctaatgatgatctggaactaaagaatgtaactgacgttaaacaaaaggattcctctgatgctttaaaagacggagaatccactactatttttgtatccactgggggtaatgacaataatgacggcttaagtttggaaactgctgttgccactgttgaaaaagcaatcaatataacaaaaactggtggaactgatttcaccctcttgatttcaaacggtgattataacattgaacaaatcaccatccctgtcggcaaatatatttctattattggtgaaagcaaggagggcacaattcttcatgcttccggcgattatggatttgacatttcatacggatgtaattttgaaaacctgaccatatctgacttaaacagcacttcctctacaagtgctgccataaggattattatggataattatgatattaatataaataactgcatatttaaaaacattggttctgcttatggggcggttcatgtttattccaatggaaaaacctccatttccaatgttcttatagaagactgctttgctaccaaatcagatgactcttccataatccatgtttctggaaaaggtccggttagtttggataatgttgaaataagaggctcttatatgctgcctcctgcttttccatggagtaccccttatttgggagccattatctttttaagcagcgctgatcctgatgtgactctaatgaattcaagaattcatgataataatggttctatttattccataatcacatctaaagggaaaattaaaattatcaacactacaatttccgataactgccttaacgcttcatatgcaagcatattttccagtggagtaaattccaatactgcaactgacataactgtcactcagtcagtcattgcagacaatattcttgctaataatgctgtaggtctcttagacgcccgatttggtgtctttaaggttgaccacaatataatcatcaacaataagaatgcaaatggcaatgatctgtcagtaggcgacctttctggagcctcttcattctccattgacgataactattggggtactaatgtaaggcctaacgataaaacaagcgaatgggtcatcttaactggagatgtagctgaatgcgcatttgtaggggtttgcgaaaacattaagattttcttaaacagctatgtgactgaaagcggcgaaataggtgttatagatggcatgcctaccgttgagttagctgtgggatatgctctcaatcaagagaatccatctgctgtgaccattaaagatggagtgggaactatcagttaccttgcttctattgctggagaggaaactttaatcttatccactggagatgtctttgaatttaatgtaagctctgagattggttctttaatttttgtcgatggctctgttgaaacatctggtgacggtacacaggaaaatccggtaaagaccatcgctgaagctttaaatatagctgcagacggtaaaatcattctcattaaaaatggcacttataaggaaagcaatttgcttgtggataaggacattaccataaagccatatgatggcgccgatgtaatcatagatggagacaatcaagacaggatatttacagtcacttccactgctaccataagtgatttaagcttaaccggaggaaatgccactggtgatggaggtgcaatctatctgaatggaggcaatttaactttatccttcttaaatatctctaactgtattgcaagtgacaatggtggtgctatcgcaactgctgccggatctgatttatatctttccaattcaatcttcactgacaatttcgcaagcaaaggccaatccattttcattggaggggaagctgaaattttgatgaatgattttgtagctcatatggatgtattaagtcctgatgcatctttcaatgccattagtataaacacagactctcctgtaagcatcgtttcaaataactttaatgacaatggcgcaattaagggacaagcagtttacattaaggatgctcctgtaagtttgtctggaaacattatggatgatgaaatcatttatcttgaaagcggaagcgtaaattccaatctcatttttatggatggaaaaacccttaccgttgaaccgggagctgatgttaacttaactgccactctaactgacgataagggaaatctcatcagaggaggagagctcactttcactgcaaatggtgtggctgttggagaccctattgatataagcggcgacaatgaattaagaattccttatactcttccttctgactcagagggagatattattatttccggttcatacagctttgacaatggcggaacaatcgtaaacggtacaattgagcctgatattccatattggtttattgaaggcggaagaggatataaaaccttaaatgagaccgttgagaatgcagttgctggagatgtcatctatggcagtccaggcacttatattgcaaatggcattttcattacaaaagaccttaccattaaggccaatgaaactggagatatcatattggatggtaacggatctagagtatttaccataaaaaatcaagccactctaagcttagttaacttagacttaagcaatggaggatctgaaggcggaggatttgtttatatatatgcggaaggtggaaatcttaacgtcatcaattccactttaagggatttgaatattgttggctatcctgagtctttcgaaggaggagctataaaaacttatgcttcatccacaataaatattgaatcttcccattttgaaaatattaactcttcagcttttgctccaattctttctggtttaggtggtgttaagcttagccttaccataaaggattccagcttcactgatattaagggcactgccatgtatggcttaatgaatgctccaggtaaagtgaatattgaaaggtctaattttacaggtataattggaaataccactaagcaaactggacttatctttgcagactccacttctaactatttaattaatgaatgtctcttctctaatatttcaacagattctgttatccgatttaagaataatggaaatataactgttaccaaatcagtattccagaacattcaagacacagggggagctctttatatatataatccagggtctgccaaggtaaattacaatttattcatagataatacaaatcttaatgccgatagcaatagggacatctattcctatggctcaaatgtcgatttgtcctataacttctggggaaataacagcaaacctacagaaagccagatctatgatgtttcaaaagctccttactggactatagaggaattgtccatgaattccgactatatatttacagacgaaactgcagatattgctgtacagtttgttggaaccgatggggaagaaaatctcactcttgatgatgtaatgccagaatatagctttaatctggaagccactaatggaactcttgatgcaaatactgtaactcttgtggataatgaggctattgtcacattcacccctccttctcttacaggaactgtaacagttacagccactccaggccctgctgaattgacatttgatgttattgagacttcaaaattgcttgtagtgtccactgctggtagcgatgaaaatgcaggtagctttgaaagcccttatagaaccattgcatatgccttaactaaggcaaacgaaacaagaaacattatctatcttatatatactggtgaggactacaaagaacatgacttgactcttgctggaaatctgactattatgggtgaaaatgatgaagtgaccattaatgcaactatcggcaggatattccttgtaactggcaatgtaagcattaaatctttaactttgtctaatggttttgatcaggactatggtggagcaatctatgtagatggaggtaatttaactctagattatgttaattttaattctaacagagcttacggcttaggtggtgctattgctactagttcagaatctaatttatatatttccaattctatcttcaccgacaatttcgcaagcttcttcggaggtgccattggaactgcttctggctctaacttaagcattgataattgcatattcagtgataataaggctagttacggcggtgccatctatcttgctggagaatcccttatcttaactagcacatttgatggcaatcatatcttgctggatgatggaagaggaggagccatttatgtaaacaccacagactctgtagtgatctcttcgaacgaatttgaaaacaattttgcatatactggagaagtgatttacattgaaaacggtattgtcacattatctgaaaatacaatagacggtgataccatttaccttgcgggaggtagcgtaaactccaatcttgttttcatggataactccactttaaaggtagaattgggagagacagttaatttgactgcaagccttagtgacgattgtggaaatcctataagaggaggaagcataatatttacagtaaatggcgaagccattggagaccctattgacataagcggagacaatgaattgaagaccacttacacagttccaattgatgcaagtgaagatatgatcatttccggttcatacagcttggacaatggaggaatagttaaggcgggttcccttcacccttccgttcctcattggtttattgaaggtggaatcggatatgaatatttatctgaagccattgatggagctgaagctggagacgtaatctactacgaccttccagaggactacactgatgtgattagcagcaaaaccatcaacaaggcattaaccattaaaaacaatggtactaatattgttaccttagatggggatggaaataatgtctttacagtaagcgctgatttggatttgattaacttaaactttgtcaatggtggaaataccaaaggcggattcatatcacaaagttcaaataaccttaatattatcaattccagctttaaaaatagtgcttccagtagctccgcagctgcaatcctaagctcaaatggtaatctaaacattgaatcctgtctatttgaaaatataagttccagcgcttcaagcaatggtggaattatctgttattctggaagcagcggaaatttaaacattaataattcagcattcaataacttatcaggtaaatatgacggtttcatcatatattccagcacttttacaaatattgcaaactccaatttcacaaaccttttaggtccaactagctctggctattggggaggcatttataacagcaaatccttgaatcttacaaattgccaattcataaatgttacaggccctaaaggtgcagccatctattcaacaggatcacttaatgtgacaaggtctgtctttgaaaatattattacaactaattcagtaatttattcatacagttccgattcctttataaattataacatctttgcagataacaataaggccattgattcaactagagcaaatgcagattacaacttctggggatctaatgatagaccaagttcagatattgtgagctcaagcatataccatgactgggtcattgtagagctttcttcatccaatgataccatattcttaggatcaactgaggatatttctataggatttttggcaactgacggagaggaaaactccactctagaggatgcaatgccaagctatggctttgaattgactgtcacagatggaaccattgaaccttcccttgtaattcttgaggataatgaggcaaaggcagtttatactccttctgctgtaggaactgtaacaattacagctagccctggttctgctgaattggaacttaatgtaatggacaaatccactatgcttatagtgtctgctgaaggttctgatgaaggagacggcagttttgaaagtccatatgcaactattgcacatgctttaagtcaagtaaccgaaactagaaacattatctatatcctatcctctgataaggcttataaggaaagcggattggtcctttctggaaacgtaattattatgggtgaagacaattcagtaaccattaacggtggaaatgaaagcaggatattccttgtaactggaaatgcaagcatcagtgacttgatcctatctgaaggaatggctgatgattacggtggagcaatctatgttgatggaggcagcttggccttaaataatgtgattatttcacagtccaaagcatctcttggaggagccatctatatcaacacaagctctgatgtcagcataagctcaaatgtctttgaagataacgaggctgaaaagggagaggcgatatacattgaaaacggcgctcttaccctaactgaaaatgctatgggtaatgaaacagtttaccttgctggaggtagcgtaaactccaatcttgttttcttggcaaacagcactctaaatgcagagtttggaaagaacatgactataactgccactctaactgatgattgtggaaatgttatccgcggaggtgctgtggtcttaacagttgatggcgaaactattggaactgttgatttaagtggaagcgatcctcttgaaattgatttctatgttcctcaagatgcaagtgaagacatgcttgtttcaggttcatacagctttgacaatggaggaactgtctccacaggagctatccatccttgcatattttactggataatagaagaaggtagatacggatttgaaaccttggatgaagcaatagacgcttcccgtgacaatgatgtaatctattatgaccttccagatgattacgaagaaatacttaatgacaaagtcattagccataacttggtgattaaaaacaatggtactggaattgtgactttagacgctgacagaagaagaatgtttgatttaagtggagatttggagctgaataatttagtctttataaatggggctactaataaggatggcggatttatctatcaaaattcaggaagccttaatattataagttccatatttaaagactctctttcatcatacagcggtgtggtagtcttttcaaatgggggtgacataagcatcgatggctccagatttgaaaatctgacttcaaggaagggacctattgactttgagtcaaatagcggaagagtagacattagaaattcagtatttgaccatataaccggcaactatgatggatttgttatctattgcaaatctgatttgaatattgaagattgcaatttcactaatctcaacagtacaagggctacaagtacaaattattatggagctatctgtcatgaaagcggcagcggtgatttaaatataagtggctcttacttcagtaatatttatggccctactggaactgctgtctactacaaaggttccggtacatataacataagtaaaaatatctttgaaaacatcagctccggagcaaatacttgcataatctatggcggaagctctggaaacattaactataatgtattcctggacattaactgtggcattaccacaagcggaggaaatattgattataattactggggaactaacgattatgccggccttggcataaatggaaccgtccctaataattggataattatgaatgtggtagcaaatgattccgatgtgattgctgaaaatgaagttccaataactgttgacttcaatcattacattgaaaatggcgagattaaggaattggaagacagtttggctaaggaattcactgttcaattcacttcctctacaagtgaattagacgttgatgaagtgaatacaaccgatcaagtggctattgcattctgcactgctgttgtcggagagaacaatatcacagtcaagtcagataatgcagtagtcgaaatcaccttcaatgcaagcgaacctcttgaatctcatatgtctgtagatatggatgatgacaacaatctcattgtcacaatcacagatggagaaggcaatggaattgaaggcaagacagtatgtctattcattggtgatgaagtcttaaatgccactaccgattcagaaggtaatgcagtaatcgctcttgatgaagtagatgatggtgcttacactgcaaaaataagctttaaggatccagagtataaggatatcaatgaaaacacttttgttgttataagaactaatgagcttattgaacctgtagcagcaaatattagcattgaattatctattgaagatggcaaggtcattgctaatgtcactgatcttgatggagttcctttagcagaaaagcttcttacagtaagcattgacggcgttcctgttcttggtgctaagactgatgagaatggtatctattcaattgatgtcagtcctaatgcaactgtgactgtttcctgcagtgatgttaacggtgctgttgctagtgcttctatcacttatgttgaaaacaacaacactgaagaagtggttgttattgagcctgtaagcgctaacattactattgtattgttagttgctgagggtaatgtcgttgcctatgtgactgatcttgatgacgttcctttagttgaaaaacttcttagcgtaagtatcaacgacatccctattcttggcgctaagactgatgagaagggtatttggtctcttcctatagaggctaattcaactattgtagtctcttgcagtgatgttaacggtgctgtagctagtgcttctatcacttatgttgaaaacaacaacactgaagttgttgttgagcctgtaagcgctaatatagttattggattatccatagttgatggcaaggtcattgctaatgtcactgatcttgatggcaatactttagcagataagcttcttagcgtaagcattgatggcgttcctgttcttggtgctaagactgatgagaatggtatttggtccattgatgcagaagctaattccactgttgcagtctcttgcagtgatgctaacggtgctgtagctagtgcttctatcgcatacattgaaaacaacaagactgaagagataattgtacctgttcctgttcctgttcctgtagttgcaaatgctacaatatccttaagcactgaagatggcaaatcaatcattgcaaacttaaaggaccttgacggtaaggcaatagcaaacgctacccttaacgctaaagtcaacggtattgaacaaaacttaactacagatgcaaatggaatagcaactatcccagtatctgcaaacactactgtagaagtttcatacacagattccaatatggctactgtaacaagctcaatgagcttgactgtaatcgaaaccatcgtagagataaacaagacaattgtagttcctcctattagaaatgcaagccaaatagtctgcagtgacatgaacacaatttctgttgctcaagaagatggaagggtcggcgaatacttcaatgtaaaacttgtagatgcaaacggcaagccattagctaataagtttatccaaatcggatttaacggaagagtctacgaccgtacaaccgatgaaaacggaagcactaaattgcagattaaccttgcatacaaaggaacctacacattcgctatagcatatcttggcgatgataattataatggttcatttgttgtttcaaaaatcaaggtaactcaacagactccaagcttaaagacaagctccaaaacctataagactagcgcaaaaacaaaagcactgaccgctacctttaagacagttggaggcaagccaataagcggtaagacagttaagttcacagttaacggcaagacatacagcggcaaaaccaatgctaaaggtgttgcaactgtaaatgtaagcctaaacaagaaaggaacttatagctttacagttaaatacgctggagacgatatctttaaggcagttagtgctagcggtaagttgactttaaagtaa

SEQ ID NO: 65 - DNA, 1323 bp, Methanobrevibacter ruminantium
atggaaagtcaaagtatattaatcaaaaatgcaagcatattaaatccaattggtgatggaaaaacagaagagtttaggaaggatcttttgattgttgatgataagatatctcaaattgatgaggatatagatgaatccaatgcagataagattatagacgctagtgataagatattgatgcctggatttgtcaacacacatactcatatttccatgtctttgcttagaggcatagcagatgatttggaacttgatacatggttgaatgaccatatatggcctatggaagcacatttaagtgaagagtactgctatatcggagctcttcttggtgcatgtgagatgattaagtctggaaccaccacattttcagacatgtacttctatatggatggagttgcaagagctgttgatgagattggaatgagaggggtcctttcctatggaatgattgattttggaattgaggaaaaacgtgaaaacgaatttaaggaaaacatatccttgattaagaagcataacaacactgcagatggtaggataactgctcgattcggtcctcattctatctatacagcttcagttgaccttttggaacgtgtcagaaaggaagctgacaagtacaatgtaggcattcacattcatatgaacgagacattgaaggaaatcaatgactctaaggaaaaccatgatggaaaaaggccttttgagctattggacagcattggatttttggctgatgatgtggtagctgcacactgcgtatggcttgatgatgctgagataaaattgattaaggacaatggagtttatgcttcccataatccatgtagtaatatgaagcttgcatctggagcagctcctgttgctgagctattgtctcaaggcatttgcgttggccttggaactgacggtgcaagcagcaacaataatcttgacatgtttgatgagatgaagtttgcagcacttcttggaaaggcctctacacttaatcctaaggtattgactgctgaagaggtggttaatatggcaactatcaatggtgcaaaggcactcaatattgatgcagggaccattgaagtgggcaaaaaggcagatattattcttgttgatgcaaatagtcctaacatgactcctatgagcaatacactttcatctaatcttgtatattctgctaatggatctaatgttgatacaactatctgtaatggtaggatccttatggagaatagaaagatggtgactgtggatgaggagttaatattatccgaagcaaaaagagctattaaagagatgaaagagttaagagaggctgatgaatag

SEQ ID NO: 66 - DNA, 1656 bp, Methanobrevibacter ruminantium
atggaaagtaaaattatcaaatcagatgttttgattataggttcaggaggagctggttgcagagcagctatagaagtatccaatgagggcaaagaagctttaatagtttctaaaggactttcattccgctctggttgtacaggcatggctgaaggtggatacaacgctgcacttggacttgttgaccctgaagacactatcgaagcacatataaaagacaccttaaaaggtggagcataccttaatgaccctaaattagtagacatattggttaacgagtcaccaaaacgcttgagcgaccttgaagagtatggtgcattgttcgacagacaagagtctggagaattaaaccaaagaccatttggaggccaaacctatagaagaacatgcttccagggagacagaacaggccatgagattatgactgcccttaaggaggaaatcctaaagagaaacataaaaactatggatgaagtgatgattacacagcttatacttgaccctgctgaatcctttatgccaaaggtcatcggagcagtaggacttgaccttaagacaagtgaaacaatcttcttccaggctaaggctgtcattcttgcaagcggaggtgctggtcagctataccctgtcagctcaaacacaacccaaaagaacggagacggacttgcaatagcatggaatgccggagcagacctaatcgacatggaagaggttcagttccaccctacaggaatggtctatccagattcaagaaagggagtccttgtaaccgaagctgtaagagcagaaggaggaaagctcataaacagcgaaggtgaaaggttcatgggccgctatgacgatagaatggaacttgcaacaagagatgttgtagcaagatcaatttataatgaaatcatggaaggaagaggaaccgagcatggaggagtataccttgatgtgacccaccttgacggagaactaatagaggaaaaacttgaaacaatgctagagcaattccttgatgttggagtggatataaggaaagagccaatggaagttgccccaactgcccaccaccatatgggaggacttagaataaacccagacgcaagcacaaatgtggaaaacctatttggagctggagaagtctgtggaggagtccatggagcaaacagactcggaggaaatgcacttgcagacactcaagtatttggtaagattgcaggatcatctgcagcatctgcaacagacattgctgagttcagatacaataatgaagcagtagaagatgaagagaacagaataaaatcattaatcaaggaaggctcaataaacccattggatatgaaaaaggaaatccaaaacctgatgtgggagaaagtatccattgtcagaaatgagcaaaaccttaagtccgcccttgaaagacttcttgagatgaaaaatgaacttaatgaccttaatgtagatgatagaacccaattcaatgagtctctcataacagctcttgaagtcacaaacatggttgagatatgcatccttatagttaaatcagcaatacttagaagggaaagccgaggagctcacttcagagaagacttcccagagactaatgacacttggaaaaagagcatagtcatgagcaaaagcaagataaggtttgctaaaagataa

SEQ ID NO: 67 - DNA, 642 bp, Methanobrevibacter ruminantium
atgaatcaagaagaaagattaaaaggaagtccaatagaaagagtagaaacagcattagaagcaataaaagcaggaaatggagttatcgtaacagataacgaagacagagaaaacgaaggagacatgatcttctccagcgaacatttaactgaagaacagatggcacttctcataagagaaggaagcggaatcgtatgcttatgcctaacccaagataaggctgatgctcttgaacttccattaatggttgaaaacaatacaagtacctatggtacaggatttacaataacaattgaagctgcagaaggtgttacaaccggagtatctgcagcagacagagtaactacagtaaaagcagcatctgcattggatgcaaaaccaagcgatttacaccacccaggtcacgtattcccacttagggcaagacctggaggggtccttgaaagggacggtcatacagaggcaacaattgaccttatgagacttgcaggacttaatccatgtggcgtattgtgtgaaatcacccttccaaatggaacaatggcaagaatgcctgatgtaattgaattttcagcagagcatgacatgcctgtagttacaattgaagacataattgcttatcgtaaggaaaatgacatctaa

SEQ ID NO: 68 - DNA, 384 bp, Methanobrevibacter ruminantium
atgagtttaaaaagtaaagcaaaaaagatcggtaaagcagtaattttcgtaaaattgtttgaagatttaatggcaaataaggacaaaagggaagaagacattgctaaattaagaatacacattgaagaatggaaagctgaagctccagatgatttaaatgctattttagcagctatattaatgaaagctccagattcttcaccagatgaaatcaaagcagaattcgaacaagctaaagccgaatatcatgctgaagatgaagatattctcccatggtttgaaagccaaatagaaaacattacaaaagagggagaagaagctgaagaagaggctgaagaagaagcagtcgaagtggaagttactgaagaagagcctgaagaataa

SEQ ID NO: 69 - DNA, 237 bp, Methanobrevibacter ruminantium
atggataataaatttataatattgctttgcttagtgactgtttcagtttttataagtgcttcatttgcttttggcaatgttctaagcaatgcagataacggatctgtgcaaacttacaatagtcataaggatatttcctctccaaatatggattataagcatcctggtgaacttatttatgggggctgtggtggaaatcaaaatattcaaaccgatgggcatatttgcgagaaataa

SEQ ID NO: 70 - DNA, 165 bp, Methanobrevibacter ruminantium
atgaatttgatatcagtcattatatatctcataattcttatttttggagtatgggtgctttataggggctataaaaaaggaatggagtttggaaagttccagtatgcatttattgtttgcttaagtgccctgtttatttgcttgctttatagcctatttaattaa

SEQ ID NO: 71 - DNA, 747 bp, Methanobrevibacter ruminantium
atgggccctgaagatacaatatatgaaagccaatcccttgaagatacaatatacaaaagaaaatcagtacgctcttatgaggatgctccattggataacgagacaataaatgaaataagagattttatagaaaatgcaaatcctctcaatcctaatatagaatggagctatgagattcttcctaaagaaaaaataagcacaatgatgagatggaaggctccacattatattgccatcttttcagaggataaggaaaactattatcaaaatataggattcatattccaacaggtggacttgtttctacaaagcaaggggataggcagctgctggataggaatgggaagtccaaaggattataagaatccacatggtcataagtttatcattttgatttcatttggaatgagcgaaagaatctacagagaaatgaatcagtttaaaagaaaggatattgatgcaatatccgataataaggatgaaagactgattccggcacagtttgccccatcttccatgaatacccagccatggtacttcactcataatgatgacggtagcttcgacttatacagggtaaaaaggggagtccttagaaacaggtttatgggaagatggaataagattgacactggaatagcccttgcacatctttatgtggcaaatagggacaactttagcttctatatgaaggacaatcctaaagaattgaaaggccatatatatgatggaagttttgaaatttag

SEQ ID NO: 72 - DNA, 672 bp, Methanobrevibacter ruminantium
atggacaataaactatttttacaggcatttagcaaatttttcattggcctaattataatatgcgcacttctttttattcccgctggaactctcaactacccgaacggatggctatttatagcattactcttcatcccaatgttttttgctggaatcatcatgtttatcaaaagtccagagcttctaagaagacgattgaatgctgatgaagaggaagaagagcaaaaaatagtgatcttaattagcgcaatcatctttcttcttgcttttattcttgcagggctaaactttagattcggatggtttaagctcaatagcttgattataatcattgcttcagtcatatttctccttgcatatatcatgtatgcagaggttcttagggagaatgaatacctctctcgaacagtagaagtgaatgagggtcaaaatgtggttgacacaggactctatggcattgtgcgtcatcctatgtacacttccacaatattcctgtttctatcaatgccattggtattggatagcatattttcatttatagtcatgctgatttatccaataatcataatctttagaataaaaaacgaagaaaagcttttagaagaagagcttgatggatatgtggagtatgaaaaaagggtaaaatatagattaataccatatttgtggtag

SEQ ID NO: 73 - DNA, 990 bp, Methanobrevibacter ruminantium
atgaagtggaagattggagatgtagaaatagacaatcaagtggttctagcccctatggccggagtatgtgactctgcatttagaaccatagtcaaatctatgggttgcgggcttatagaaaccgaaatggtttcagataaggcagtcatgtatggcaattggaaaactaaggaaatgttatatatgacagactatgagcgccctatctctcagcagattgtcggatctgatattgaatctctcacttttgcttccaaatacatccaagacaatacaaatgttgatatcatagatatcaatatgggatgtcctgtaactaaggtgacaaataggggcaaggctggaagcgcattgctaaaatctccggataaaataaaatctattgtagaatctattgtagactctgtagacattcctgttactgcaaagattagaagtggatgggataaaagctgcataaatgcagttgaaatagcaaagattattgaagatgcaggtgcatcagccattactgttcatcctagaacaaaggaccaggcttattctggaaaggcagattggtctataattaaaaaggttaagcaaagcgttaatattccggttattggaaatggagatgtaagaacttgttttgatgcaaaaagaatgttggatgaaactgattgcgatgcagtgatgattggaagggctgcactaggcaatccttggcttattagagattgtgtaaattatctggataatggggacttgcctatggaagttacaatagaagagagaatggatatgttaaaaagacatgtgaatctattgcttgaaaataagggagaagagtttgccattcctaagatgagaacacatgctgcctattatgttaaaaaattacctcgcactattgagctaaagcagatgatatttaagatgaatacaaaagaggatctttttaatctattggatgattatgtggattcattagatgaattaaaaaggtaa

SEQ ID NO: 74 - DNA, 939 bp, Methanobrevibacter ruminantium
atggaaattttaaaacctgaagagttaaaagagaaatttaatgacccatggattgctccatatgaaaaagtcataaccatggctgatggagataaagtagaacttatagaataccatccatgccctagcggttcaaactggctgttataccaataccaacacagcagcgaacttatcatagatgctaaaagggatggaaacaagcacacctatctttgtaaggtaggcaaaaagccattagaccttaaggcaagcataaatgctgctggaattgaagaggttgcaattgacgaagaaaagaatgaagtcaaagtcacccacggaggtctagctggcgctggagtaggtgctggaatgtgcagaggcatgggagaaggtgtcaaatacatagagcttcttgaagtcggaggaggaagcaaggaaggaaaagccacagtagtaactcctaaatacgaaaagcttgtaatcggaatagacgatacagacgttaaggatgcaggtgcaacctggactatggcacataatattggtcttcaattaaaggaagaaggctatgaataccttgaccatattatcgttcaattattccctcataatcctcataagactcaaaactgtgtttctatagcgcttacatttgctgtactcaaagaagaaaaagaaaatctaataaacaggcttattgaaatactcaagcacgacacattgtctgataagactgcaatagccatccttgaaggaattggaatcccacctaagcttagggaatatgctatggctacaaaaaccggcatgatggatgttgaaacagctgaaaagctagcagaagaacttaacattccacttcttgcagttacaggagaacaaggcaaagtaggggcacttgcagcacttggcctttatgatgatgttgatgaggctgttaaggtttattattaa

SEQ ID NO: 75 - DNA, 432 bp, Methanobrevibacter ruminantium
atggtaaaatataatataggagcagttgttgctgaatttaattatgatatcactcacatgatgttagagcttgctaaagctgaagctcaagttcgtgactgtgaaataacaaagattgtaatggtccctggcgtatttgacatgccacttgctatcaaaaaacttacagaagcagaccaagaaggaagaatcgaccttgactgtataatcactcttggtactgtaattgaaggtgcaacagatcatgaccaaattgtagctcaacatgcatcccgtaagatagctgacttatccttagaatggggcaaaccaatttcccttggaatcagcggtcctggaatgaccagattagatgcacacagaagagttagctatggtaaaaacgctgttgaagcagctgttaaaatgtgtgacagattacaagacatataa

SEQ ID NO: 76 - DNA, 1188 bp, Methanobrevibacter ruminantium
atgaattatgctttaatggtttacaactatacaacaaacttaggcaatgagatacagacaattgctgctagaagattcctgcctaagatagattactatatcgatcatgagaagataaatctcttcaatgaggaggataatgtaaagatgattatgaatggatggtatcttgactgtgaaaaggcatggcctccatctgaatcaatcgatcctctccttatctccatgcatttcaacaccacttcaagcaataaggaaaggttaaaagctcttttaagcgatgaaagcatagaatactttatgaaccatgcccctataggttgcagggattattcaacagttgagtttttaaatgagcagggaatagatgcatacttttccggatgccttacattgacattggataatggcaaaactaaagaggaaagggaattggataaaggacaggattatattgttgtaaactctgaaattgcagatgagatcatttcttttttaaaggataagacagataaaaagatctataggattcagcaagacatgataccatcatttgacacatcatttccagaatccatgccattatggctttataaccttagctccttttatgattatgaggaaaagctgtttatggctgaaaatcttttaaggatatatgagaatgcctcttgtgtaatcaccgacagattgcattgcgccttgccatctcttgccctagagactccagtgatgctattgaacaataggggatttagggaaaggtttgatggattgagcaatttattgctggagagtgacattgatagctatgaatccaattataatatctttgatgtggacaatcctcctgaaaatcccaaggactatttgaaaatacgtaaggatttgattgaaaaatctaagaaattcaccggacatatcaacaattcttattactctgatatttcacagagggaaatatttgaaagaaataacttattattgtctagaaatgccattggaactagggattatattaggaatgtcttaaaaagaatgaggcagcatgagaaggacatttccaaaaaggaagagatcattaaaaatcaggaagctattattgataagcagaaaaagatgattgatgagatgaaggggtccaatagctggaagataacttctcctcttagaaagattagaaaataa

SEQ ID NO: 77 - DNA, 1551 bp, Methanobrevibacter ruminantium
atgaaagacaataacaaaaaagaacaagcagaagacctattaatagcaaacaaattccctcctatgaatgatgtaagtggaatcatacttgcaaaaagagccctgcttagcggcaagagatatgatgtttgccatacagtgattaaagagccccttgataatgactttaacgaaattgcagaagagattatagataacagaatcattataaagaatttcgaatatgaaatgagtaaaaaggagcttaatgagacctttagaaattatataacagagggattgaaaaaactggaagagacaaatcccaactataaaacaataactacacgttcctggggattccagcctaattttttagctttggaatataaattaaagcacccagacacattctggactgctgaattctcagatcccttaactgtgaacattgaaaacaagccaagggatagaagattcaagttagacaataaggaatacatcgatagaatcaataatgaaatcgacaaggtcaatgaaagaaccggacaaaatctggagcatattaaggaaagcgacttcatatacttgatatgcgaatatatagcatatgtctttgccgacaagatacgctttacaaacccaaaccaaagggagataatgcttaatcaatgcccttatgatgtaaaggacatggtcatggcaaagtctgaaatcaatcctcaccctacccttgatgagaaatactaccacatcaaggaagttgactataagattgatgatgactgcataaatataggatactttggaacttattttggaaagagaaactttgaaacaatcttctatgcctgcgaaagcctaaatgaggacataaggtcaaaagtaaaattccatctcttcctaaaccatggagataacctaaaaagacttacaggcaacttaaagataagcaagaacatcatagtgaatgacaaggtttcattgcttgaatttttaaatctatctaccaaattggacattctccttgtaaatgatacagagacaaagggaaactttgagataaatccataccgcccatctaaaatagctgattatattggaagcggaagagacatatggggaatctgtgaaaaggacagcataatggatggattagatgaaataaaatataaatcttatattaatgacttctattcagctaaattgaccttcaatcagatagttaaagattctagtaagatagatgatggattgaaagaaaatccattcgaggataatgattatttagctaaaagagccagtgcaatgagtgaagatgagatagttgaactgataaatgaaaataattacctaaagggtagaaccaatcatttaaatcatctttttaatggaacaagaggaagaggcttgtttgcagatgaggcaaagaaactgaacttgaaaaatgaaaaattagagatggaaaataagaaactaaagaaagaaaacaagaagtataaaaaggatttgaagtatcttaagtcttcaaaaggctctttaaagtaccaaattaaaaagatagtgaaataa

SEQ ID NO: 78 - DNA, 987 bp, Methanobrevibacter ruminantium
atgtacgaaattgcagtaattcctggagatggaataggtaaagaggtaatggaagcaaccataaatgttttagaatcattggatgtggactttaactttacttatggtgaggctggagacgaatgtctggaaaagaacggagtggcccttccaaatgaaaccatccaacttgcaaaaaatgcagatgcctgcctattcggagctgcaggagagactgcagcagatgtcatcgtaagactaagacaggaactgaacctctttgctaacctaaggccagttaaaagctatccaaatacaaatgccctctttgaaaatcttgactttatgatagtgagggaaaatacagaaggaatgtatattgcaaaggaagaggaatatacagccgaaggagcaattgcaagaaggataataacaagaaaggcaagcgaaagaataatagaatatgctttccaatatgcaaaggacaacaataagtcaaaggttacaggagttcataaggcaaatgtgctaaaaatatcagatggtctctttagagatatatttaatgaaatagcagacaagtataaggatgaaatagattcagaggatttttatgtcgatgcaactgcaatgtatctcataacaagacctgaaagctttgaagtgattgtaacaaccaatctctttggagacatactatcagatgaaggtgcaggacttgtaggaggccttggaatgattccatcaggcaatattggagaaaacggagcattgtttgagccagtccacggttcagccccagacattgcaggtcagggaattgcaaatccattggctatgatgctttcagcagtcatgatgctgaactatcttggtgagagtgaagctgaagagaagttaaataatgcaatccttgaactattaaatgaaggaaaatgcctaactccagatttaggtggcagttcaacaactatggaagttagtgaggccataaaaagcaaattataa

SEQ ID NO: 79 - DNA, 483 bp, Methanobrevibacter ruminantium
atgaaaggaaaagtttggaaatttggaaatgatattgatactgacatcatacttcctggaagatatttaatctatactgatgaggaaaagctatccgagcattgcatggaaggattggaccctgactttaaaaataaagtaagcgctggagatttcatccttggaggaactaacttcggctgcggatcaagcagggagcatgctccaatagcaatcaaaggctgtggaatatctgcagtaatcgccgaatcctttgcaaggatcttttatagaaatgcaacaaatgtgggagttcccctcctagaagctcctggaataagttctgccattgaaaatggagaggaaatagaagtggatatggaaaaggggattatcatatctgaaagcggaaaggagtatgaatttaagaagctgcctccattcatgttggaaatccttgaagaaggcggattgattaattatcttaaaaaacagaatgaataa

SEQ ID NO: 80 - DNA, 1278 bp, Methanobrevibacter ruminantium
atgtcaacaattgctgaaaagatattatcaagagcttcaggacaaggacaagttgaagctggagatatagtcatggctgacattgacatagccatgatgcatgatttgactggacctcttgcagttgaatcatttaacaagataggaactgaaagggtctgggacaatgaaaagatcgtcatcccatttgaccaccaagttccagcagattctcttgactctgcaaacaatcatatcctaatgagaaagttcgtaaaagagcaggatataaaaaacttttatgatgtttatgaaggagtttgtcatcaggttctacctgaaaaaggccatgtgattccaggaactgttattgttggtgcagactcacataccacaacatatggtgcccttggagcattttccactggaataggctctacagacatggctatggtattgtccaccgggcaattatggtttaaggttccagaaaccattcaattcaatatagagggaatccttaaggaaaatacatctgcaaaggatgtgattcttaatataattggacaggtaggggcagatggagcaacctacaagtcctgtgaattcaagggagagaccatatccactatgaacatttcagatagaatggtattatccaatatggctatagagatgggaggaaaaaccggaataattgagcctgataatgtaacctatcaataccttaaggacagggtaaaggacgaaaacaaaaacagattaaaggcattcattgaaaagtccaatcttaaaacagatgaggattcatccagtcttgaaacaatggacattgatgttagcgaccttgagccacaaatcgcatgcccacataatgtagataacgttaagccagcaagcgagctaagcgacattgaaatagaccaagtgtttgtaggttcttgcacaaacggaagaattgaagacctaagggatgccgcaaagatattaaaaggcaagcatatagcatccggccttagaatgctcgtgattcctgcatcaagggaaacatatatgaaggcattggatgaaggattaatcaagatatttgtggaagctggagcccttgtttcagcaccatgctgtggaccatgccttggaggccatacaggactaataggtcctggagaggtcagtctttctacatcaaacagaaactttaagggaagacaaggaagtcctgaaggtgaagtttacctatcaagcgctaaagtagctgcacaatcagcaattgagggaagaattagtgttcctaaataa

SEQ ID NO: 81 - DNA, 2472 bp, Methanobrevibacter ruminantium
atggaaaaagaatttttcgaaggaatgaatttggaagaagacattagcgatgaggacttccagactattgtagaaggctgggaaaaagtccaagatcaaatgtccaaagaagaatttataactaaatttaatgaacacaaggcagaatttaaagacgcttctttcttcagcgacatagactttttaaacatgattgttaatccattagtgggtggtggcgatgatgagccaggacctgctattgtagaaggcgaattccagaagatatctgatgttgaaccaggcaatgaaggattcaatgttgttgcacgtataatgagcattggaaacagcagaatattcacttccagaaaaggaaagcaaggaaagctttgcaacttgcagattgccgatgacaccggagagctaagacttgttctttggactgaaaacatcaagcatctcaagcatgtcactgaaggagatattgtagagattacaaatatcgaatgtaaagaaggcttcagaggaggtaaggaattctccctacgtccaagatcatctttaagacctattgaagagggcagtgaaaactatccggaaaacattgctgctttccctgtctatgaggaaaagattactcagattgcagacattaagcctgatgaaaccgtaagcatcataggaaggctaatcagagttcctaagccacatgcctatgaaagcaacggcaagaaaggtaaggtaacctcccttgaaattcaggatgcaagcggaaagacctcatacacattatggaacaatgacgttaagctaatcgacatcttggaattgaaggaaggggacattgtcaaaatccttaatgaacaatccagagaaagaaacggagaaatttccttaagccattgggatggaagaatcgtcaaggctgaaggcgactatgacattccagaatatgaggaaaacatcattaagattgcagatgcccaagagatgcaggatgtaagcattatcggtcttgttacaaaggttcaggacgtaattcaattcacaagaaacgacggctctgaaggctttgtaaaatcaatcgagctttcagacgacgaaggaagcatcagagtaaccctatggggagacgacactaagatacctatctccaagggagacattgtcaaggtcattggaggaaatatagaatatgatgatttctcaaacggctacagggtaaacaccaattggaacactgagttaaaaatcaaccctgaagagcatagcgatttgatagaaaccttaaaaggtcaagcagaaaacttaggacctattccaatcagcgaggttcaatctattgaggaagacggtgaggaagttgacattatcggtagaatcatcaccttaaatgacacccacaccttcccaagggatgacggcactgaaggtgttgtccgctctggtgaaatggctgatggatcatctcctgacggacttgtaagggtatccttctgggatgacaaggctaaggttcctgaaataggaaaggcctacaaggttgaaaacgccagaacccgtatgggaatgtatgcagtggaagtcaatgtaggaaagaccacaagattcattgaaatcccagaaagcgaagcaggtgaccttccttcatttgaagagttagaagagtccatctacatcagcaaaaaaattgaagaattggatgaggatgacatgaacattaaagtcttggctagaatcctggaagttcatgaacctcgggaattcccaagggatgacggcactaaaggattggttggaaatatggaggttgcagacataaccggctccattagagtaaccttatgggatgataagaataaccttccatacggcgttggggacgctatcaaaatccaaaatccacgtgtaagatataattcaaatatggactatttagaattaagcgttggaaacggaacaaatatcttaactccatctgacagtgagataaatgatattccagacattttagagttacaaaatacattgtatcaaaccaaggagattgctaacctttcagatgacgacactaaaatcagagttacaggcagatttgtagacatctatggtcaaaagatgatcattcctaaatgtcctcaatgtaacaatacattagagcctgaagatatcgatgctgaggaatgcagcttctgcggcaattatattgacgagcctaagtaccttttaatgcttccaggtaaattagaggatgacacaggcgacattcaagttacattcttcaatgaattggttggagaattgcttggcatgaaacaggatgaaatctttgaactctatgagggagaaggtggagaccttggtccattggaaggaaagattgatgatttggaaggcattaccttagaaatccttgcagatgttacattcaatgaatatgatgaggaaaataggttaagaccaagaaagatctttaatatggaatggtaa

SEQ ID NO: 82 - DNA, 936 bp, Methanobrevibacter ruminantium
atggtagaacttgaagacttacctaatgttggagaaaaaactgcagaaaagttaagagaggctggatttgctgatatgatgagattagctactgctactgctaaagaattatctgtaaaagcggaaatcggtgaaggtgtagctgaaaaagttattgaagcagctcgtaaggcagaaaagatcgattttgaaactgcatttgatgtaatggaaagaaggagagatgttggccgtatcactacagggagcaaaaacgtagacgaattgatcggcggtggaatcgaaacccaatctatcactgaagtattcggtgagttcggttcaggtaaaagtcaaatctcccacgaattagctgttacagttcaattgcctaaggaaagaggcggacttgaaggggaatgtgtattcatcgatacagaaaacacattcagaccagaaaggattgaacaaatcgcagatgcttgtggaatcgaccgtgaagaggctttacaaagaatccacatcgcaagagctttcaactcctctcaccaaatattgatggctgaaaagattaatgagcttatccaaagtggagtaaatgtaaggcttgtaatcgttgactcacttatggctcacttcagagcagaatatgtaggaagggaatcattagcaaccagacagcaaaagcttaaccaacatttacatgcattgcaacaaatcgctaacacctataatgttgctgtattccttactaaccaagtacaagcaagaccagatgctttcttcggcagccctacaaaagctattggtggacacgttttaggacacgcttcaacttacagaatctggcttaaaaaaggtttagctggtaaaagaattgctaggctcgtagacagccctcacttacctgaaggagaagcagtatttaaggttactacagacggaattgttgactaa

SEQ ID NO: 83 - DNA, 1983 bp, Methanobrevibacter ruminantium
atggcagaagaaataaacaacgaagaaattagagtgggagtatatgtttgccactgtggtgtaaacgttggtggagtcgtaaactgtcctgaagtagcagcttacgcagaaactttacctaacgtagttattgcaaaagattacaaatacatgtgttcagaccctggtcaaagtcttatccaagaagacatcaaagaacacaacttaaacagaattgtagtagcagcatgttctcctagacttcacgaacctaccttcagaagatgtgtagaagaagcaggattaaacaaattcttatttgaattcgctaacttaagagaacaagactcttgggtacacatgacccaacctgaagaagcaactgcaaaagctaaagacttaactcgtatggctgttgcaaaagcaagattattagaacctcttgaagcttctaaagtagcagtagacaaaaaatgtctcgttattggtggtggagtagcaggtattcaatctgcattagacttagctgatatgggattcaaaacctacatggtagaaagaaacccaactatcggtggaagaatgggtcaattagacaaaaccttccctaccttagactgttccatgtgtattctcgcacctaagatggtagacacatccaaacacgaaaacattgaattaattacttatgctgaagttaaagaagtagacggatacatcggaaacttcactgtaaccgtagaaaagaaacctagatacgtcaaagaggatgactgtaccggatgtggacaatgtcaagaagtatgtcctatcgaaataccaaactactacgacgaaggtgtaggtatggtaaaagctgcatacatcccattcccacaagcagtacctctctgtgcaaccattgacaaaaactactgtattgactgtggtctttgtgaaaccgtatgtggtccagatgcaattgaccgtgacatggaaccagaagaaatcgaactccacgtcggtaccatcattgcagcaaccggttacgacccatatgacccaaccgaaaaatacgaatacggttacggcagatacactaacgtaattaccgctatggaaatcgaaaggatgatcaacgcatccggtcctaccggtggtcacgtacaaaaaccatctgacggtaaagaacctaaacgtgtagcattcatccactgtgtcggttcaagagacgaacaaatcggtaaatcctactgttccagagtatgttgtatgtactccatgaaaaacgctcaattatgtattgaccacgaacctgacactgaagtaacctgttactacatggatatccgttcattcggtaaaggattcgaagagttctacaaaacttcccaagaaaaatacggtattgaattcatcagaggacgtcctgcagaaatcctcgaaaacgatgacttaaccttaaccgtaagagcagaagacacattactcggaaaagtaactgaatacacctacgacttagttgtattatctgttggattagaacctccaaaaggatccaacgaactcagacaaaccttaggtttatccagaactaccgacggattctacatggaagctcacccaaaactcagacctgttgacaccttaactgacggtgtttacattgctggtgtagcacaaggtcctaaggatattcctgacgcagtagcacaaggttcagctgcagcatcaagagcatctatcccaatggctaaaggtgaagtagaaatcgaacctattactgctgacactgataccaccgtttgtggtgcatgtgaagtatgtgtagaattatgtccattcggtgctgtaagtattgaaggtgaaggcgctgacaaacacgcagctattaacgttgctttatgtaaaggatgcggtacctgtgtaggtgcatgtccatccggtgctatgaaccaaaaccacttcaagaccgaacaaattatggcacaaattgcagctgctcttgaagacgttgcaaaatag

SEQ ID NO: 84 - DNA, 666 bp, Methanobrevibacter ruminantium
atgaaaaaatttgaaagtgtcgattttgacaaaaccgaaaaaatagttgatggaattgctatcgaagataatgaagctatggatatagtggttatacttgaacccggctcagggcagtatgcattcttggcttcaagaaaggcaccatcaaagggtttcaacgcttttattgaaaccgaagctgcaaaagaccataaaacatttgtcactgcagtgctttttgacaatgaatatgaaattctccactctagaagggacattaatgaggttcctattctcaccactaatgaatactcatgcagaggatgcacagcattgtacgatgcaatcggaataactattgaaagtattaaagatgaaatcgacaataaagtcttgtttttaatcattaccgatggaatggaaaacgcttcaagaagattcaatgaagatcaaataagatcttatattgatgagcttgattacgagtttatctttgttggtgcagacatagacagttaccgtgaagcatctaaaataggaatcaggcaatcccacaccgcaagcttcaagaaaactggtgaaggaatagatgacttatttaaaacaatttctgatgtgtctgacattcatcgcgacaatatgaaattagaggatgtcgattggaagcacagacttgaagattag

SEQ ID NO: 85 - DNA, 1497 bp, Methanobrevibacter ruminantium
atggttaaaagaattcctgatgaagaacaaataaaattaggcattagaactttagattttaacattccagaggatcatatttctcgttttgttgtggatttcattgacgaatattatcctcttttaggaatcaaagaaaataaaaagaagaaagggcgtgacagttttcctgtgaaagagatgttaaaattgcttatttatgctaaaatcgagcatattgatagtatgagattcttagcagacatggtaaaatatcatgacgtatataaattcgttggaaatggaatttgtccttcagaacgatcattacaacgatacagagaaaaatacggcaaatattacaatgaattgttaaaagcaaccttaaaaaaagcttcagatgtggattacactgatttcaacgaagtttccattgacggaaccatcaaaaaagcatacaattcaaaaaataaagtgatcacagaaaaagaaactgaaatattaacccgttacttcgaaggaggccgtgtaagtcaggaagagctagataaactccataaaccggcccgagagattcttgaaaataaaaaaatcagcaaccaagaaaaattatacctcttggatgacattaaaacacaattcacactgtctggtcaaaaatcagtgccagtaaccgacatagaagcacgttggatgaaaagcaagaaaggaaactcacaaataagctataatatccaatctgcagtcgattacgatacaaaaatgatttgtgcaataaacgtcgtacaagcccctacagaccattaccaattgccaaaaatcgtagataaggcaataaacaacacaaacgtaataccaagattcgtattggcagatacaatctatctgaatgaagaaagcttatcatatcttgcagataatcaaataaatggagttataccagatagaaagcaatccaaggaaaaaatcggaagattgaacaagaacccatatcacaaggatcacttcaaatacttccctgaaattgatgcatttgaatgtccagaaggccaaataatgtattttttcaacaaatacactgaaaaaaatgatgatttggacaagccagacaaaattaagcgtttatattccaattatggtgcttgtaaggcttgcaattgccgtgaaaactgcctttcatccacccaaacccacagaacaatcaccgaatatggcggaagtttaaagaaagcaatgtgggaaaaaatggaaacagaggaatataaggaagaatatgcaaaaaggtcatctgtcgaaggaccttttggcattttaaaggaacaattccatatagaaagcgaagtagtgataggaaaaacaaagacagaagaaagaatactattagatgccgtggcttataatttaatacgattatttaacttagaacaagaaataaaaaatgataaagaagatatagttgatttctgtgagaaaatttctgtccaagagaaattagaggtcagagcaaccatattttaa

SEQ ID NO: 86 - DNA, 294 bp, Methanobrevibacter ruminantium
atgagttttgaagacttgattgaagactatgtcaaagctaagatagatttgaatgtcaagttcggatctgtattggatgaattgaatattgaatacgaaagcttttgcttctatgatgaattcaaatccgtctgtcttgatttggaaatgcataataaggaattgtctgatgaagagattgaaaatatcattgaaaagacaggatttgacttcctaaaggtggaaatcaaaggcaaaaagtttccttttggaaatggtgaagaaatcgattacacctatgtattcgagtgttaa

SEQ ID NO: 87 - DNA, 999 bp, Methanobrevibacter ruminantium
atgaaaattagtttaaataatgtatctttagatattgacttaaagaacagtcaaaaatttaaaaatatggaggtaattcctattgaggctttaagcgctggtaaaaaggaatttatcacacttaaggcgggcattcaagaagggtatgtgaagatttccgaatgtgaaagcagcacagtaaatactgtcatggctcaaaacaagtcttccactccacttgttttaatagatggcgaggaagtaattggcgctatgcaaaatagaataatgaacaggtctttaattgttcctggaaataccactatgcctatttcagtaagctgtacagaacatggaagatggcatactcgtggaaacagtcctaaagcaagggaattttctcattctgacttctttgcagactatgaaacacgtcatcgtaagtctgaaaccttatataataattctgactgccagtctgaagtatgggcttcaatcagcgaccttgaaattaagaattcctacagatctccaacaagtgcattgaatgatagctatgtccatcacaggccaagacttaatgaatatttaaaacatttcagcatgctttacaatcaaattggagctatattcataatcaatggccaaatcaaaggattggaattgttctataatcctttcctctgttcccagtactatgacaagattcttaaaagctatatcatgaatgctattactaattactacagtaattgtagttcaaatagttcaaatattgatgtaggggcatttttggcagatttaagcgactccaaattaaaccactctcctaatcaaggtcttggtcaacacattaagttttcaaacaatcatgggaccggctctgcattgattaatgatggggaattcgttcacttgaattactttaaaaccaaatatgatgtttcttacaagaagcagagaaaaaatgtcagaacttttggttccttcgatgacttattgagtaaaatggatgaataa

SEQ ID NO: 88 - DNA, 1272 bp, Methanobrevibacter ruminantium
atgtatcaatacgaaaatgaagttactaaactcaatgaattaatggaaactcataataactggatgagagatagcgtaaaccttattgcaagtgaaaacactacaagtaatgcagttacaggagctgttgcttcagacttagctcacagatatgctgaaggacaagcattcgaacgtttatatcaaggatgcacatatatcgatgaaattgaagacattgtaaaaaggctctcaagagaagtctatgactgtagttatgctaatgtacagcctgtatctggtgtaactgctaaccttgctgctttctttggatttgcaaaggctggagacaagatgatggctatgaacattccatttggaggtcacatctcccatgcaaacgtaagtgcagcaggtatcagaggattaaaaacccttgaacatcctttcaacccagaggttatgaacattgatattgatgcaatgaacaagatgatattggaagaaaagccaaagatcattctcttcggtggaagcttattccttttcccacaccctgtaaaagaggctgtagatgcagcaaacgaagttggggcaactatcatgtatgacggtgctcacgttctcggtttgattgcaggtaaacagttccaagatcctttaaaggaaggagctgaagttatgatgggtagtacccacaagaccttcccaggtcctcaagggggaatcatcctatcagacgaatcaaacaaggaactaatcgacaatgctgttttcccaggtgtagtgagcaatcaccacttgcaccacttagcaggtttaggaatcgctacagctgaaatgctcgagttcggtgaagattatgctaaacaaacaatcaaaaacgctaaagcattggctggagctcttgcagaacaaggtttcaatgtattctgtgaagatcttggctacacagaatctcaccaagtcgctatgaatgtaagcgatgtcaaaagagcaacaatattggctaaagagctagagcaaaacaacattatattaaacaaaaacctcattccaggtgacaatgtaaatgacagtgatgacccttcaggtataagaataggtacccaagaaatcacaagacgtggaatgaaggaaaaagaaatggaagaagttgctgagtttatctggaaagttgcagaaggcgacaaagtagatatcaaggatgaagtaactgaattcatgagtcaatacagaactattcattatgcttttaaagaagaagaaggttataagtatattcaatactaa

SEQ ID NO: 89 - DNA, 702 bp, Methanobrevibacter ruminantium
atgagaataggatgggcttttactggtgcaggacatttgcttagggaaagtgtagaagctatggaagaagtggcaaaataccatgatataaccgtatttttatcacaggcttcagaggaggtcttaaggatgtatggtttatatgaccgtgtggttgctgtaactggcggaaggtacagagagcttgcctgcgattccaatcagaaatttagctttccaataactggcaggctttctcttggaaaatatgatgctcttatagtttctcctgtcactgcaaatacagttgcaaagatagtttatggaatttcagacactcttgtgacaaatgcagtggctcaggctggaaaagggagagtcaaaacccttatggttccggtcgatattgaacccggggatgttgatacagttcttccttctaagctagagctttcaaaatgtcaaaaatgtgatgtgtgtgatgcagctgaagtctgtccaaatggggcaattgtggctcatcaggagattgatctcttgaaatgcattggctgtggtgcatgtaaggacatttgtcaatatggtgcagtttctgccggtaagattataacaatgcatatgagagacattgatatagagaatactcaaaagctatcaaaaatggaaggaattgaaatatttgcaagtcctcaagagcttttactccattttgattataaataa

SEQ ID NO: 90 - DNA, 402 bp, Methanobrevibacter ruminantium
atgaaaaataatagaaaaaataatcaaaataaagagaataatcatttaaaatcattgcatttaaaaaaatccaatgaaaaaataacagacctaagaatagcagatagctttttaagtcgttttcttggattgatgtttaaaaaagatatagattatcctttattgtttaagattccacagaatattaataataggcatagatcatccattcatagctgctttatgagatttgaattaaaattagtttttattgataagaacaatatcatatatgaaataagtgatttgaagccatggagatattatgcacctaaaaaaccagccaaatatataatagaatttgataaaaatggatttagtgattatgatttaaaaataggtgatgaagtagagttaaaataa

SEQ ID NO: 91 - DNA, 1209 bp, Methanobrevibacter ruminantium
atgagtagaaatatttttgttgaaaaattaaatcaaacttttatcgaagatcttgatattgaaattgtagaaagaaaaggtattggtcacccagacagtatcagtgatggtattgctgaatctgtaagtgaagctctctgtaagatgtacatggatgagcttggtggagtattgcaccacaatactgacgaagtccaaatcaccgcaggtgaatccaaccctgtattcggtggaggacaaatcatcaaaccaatcgatattctcttaaccggtagaggagtatctgaatacgaaggtcataaattgcctcttgattatgtagcaatcgacgcagcaaaagaattcttagacaagactgtaatcaacttagacgtaaaccgtgacacaatcgttgaatgtaaaatcggacacggttccggagaccttgtagacgtattcaaaagggaaggagcaccttcctccaacgacacatccttcggtgtaggatacgcaccattctccgaagttgaaaccatcgtctttgaaaccgaaaccttacttaactccaaagcattcaaaaaagaccaccctggagtaggtgaagacataaaagtaatgggacttagagaaggagacaagatcacattaacaatcggttgtgcaacggtatccaaataccttgcaaacagagaagaatacatcgcatgcagagacgtattaaaagacattgtagctgaccttgcagtaaaatacacagacagggaaattgaagtattcgtcaacacagcagacaacgacaatgcaacagacgaatcaggctactacctaaccgtaaccggaacttccgctgaaatgggagacgacggatctgtaggaagaggaaacagggcaaacggtcttatcaccccatgcagaccaatgtccatggaagcaacctctggtaaaaacccaatcaaccacgtaggtaaaatctacaacatcctctctaacgaaatcgcaaacgatgtagcaaaagatgtcgaaggagtaaaacaaatcaatttaatgattctttcccaaataggtaaacctatcgaccagcctaaagcagcttcagctggaattatccttgaagacggctatgaaatgggtaaggtaagcccacaagttgaaaaaatcattgacaattggttagaaaacattaccgacattactgaaaaggtagttcaaggtaaagcaagaactttctaa

SEQ ID NO: 92 - DNA, 3432 bp, Methanobrevibacter ruminantium
atgccaatagaagaggcagaaaaatcatatgactttaaaaaaatagaatcaaaggtccaaagcttttgggaagatgaggacatctatcaaaagaccaatgaattgaacaaaaacggtcctcaatattccttcttggacggacctccatactgtagtggtaaaatccatttaggtactacttggaataaggttattaaagacacattgttacgttacaaatcaatgaatggatttgcacttagaagacaagctggttgggacactcacggattgccaatcgaacataaggtagagcaattgcttggaattgaatccaaacaggaaatcgaagagaaatatggcatagacaagttcgtaggcaaatgtaaggaatttgcaatggaaaacaaggttgcaatgactgaacagtttaaaagccttggagtttggatggattgggacaatccttatatgaccttggatcctaaatatatggaatcagcttggtggacattaaagaagactcatgaaaagaacttgcttacaaaggacaaaagggtaatcagctggtgtcctcactgtcagactgcacttgctgcagctgagattgactatactgaagacacagacccttccatttatgtccgtttcccacttaaggaaaagttcctaaatgaagaaaactgcagtgaatttgcaaatgattctgatttggccaacttaaaacagtcattccttgtatggacaaccaccccttggacactccctggaaacttggctatctgtttgaatgaggatttcgaatattcatttgttaaggtagatgaaagattaaacgagtcagatgacgaaatattaatcattgcaaatgaacttcttgaaactgttttaggtcctatcgaaatcatacataagaataagattccaaatcctaaatatgatccagaaaataaggagtccaaagagaaaaaatacctcattgaagaggaaactgaagtgatgtatgaaataataaagacagtaaaaggctctgagcttttaggtcttggctacgtctatcctttagctgaagaagttccaaagcaaatggaaatagaagctgaaaacagtcttgttcacacaaccttccacggagaccatgttgaattgggagaaggtaccggatttgtacacacagctcctggacacggtcctgaggactttgaaatcggtcaagaagtaggacttcctatccattgtcctgtagatgaggcaggatgctttaccgaagacggaggagcatatgccaatggatacaccaaagacctaaatgacacaatcattgcagacttgatagcaaaaggattgatgtttaagaatgatacaataacccacagatttggggtctgttggagatgtaagactcctatcatttacttagctactgaacaatggtttattaaagtgcctgaaatcaaggaaaagatgctttctgaaatcgacagagtcgaatgggttcctaaatgggctggtgaaggaaggttccatgattgggtagctaacgctaaggactggaccatttcaagacaaagatactggggtattccaatccctatatgggtatgtcctgactgtggagaaataaaggttataggctctgtagaagagttgaaagagctttcaatcaatgaaatcactgcaagcgatgaggaattggttcacagaccttatgttgatgacattttaatcaactgcgattgcggatgtgatagcccaatgaaacgtattccagatgtattggatgtatggattgactctggagttgcaggatgggctgcattatactatcctcgtgaagaggaaatgtttgataaatggtatccatatgactttatctgcgaaggacatgatcaaacccgtggatggttctattcacagttaggtacaggtgtaatcgcattggatcaagccccttacaataaggtattgatgcatggattcgtattggacgaggaaggaaagaaaatgagcaaatccttaggaaatgtagttcagcctgaggaagttattgaaaaatacggtgcagatgtacttagattctaccttttatgggcttgcaagccatgggatgaccttaaattcgtttgggatgaattgaacaatgttaaaaagatgttcaacatcttatggaacgtttatgtattctcaacaacctatatggcacttgacgaattcgacccagcaaaatgcgtacttgatggccctgatgcaaatgtcacacttagaaatgaggacagatggatcttatccagagtaaactcacttgctaaggaggcaggagatgccataaatgacgtacacttccacttggctacaagagcaatcaataatttcatacttgaagacttaagcagatggtatgtaagattaatcagaggaaggacttgggttgaaagcgatgatcctgacaagttaggtgcatattatacactttacaatactcttaatactttaattcatttgatggctccaataactcctcacttgtctgaggaagtttatgaaaacttggttaaaaaccttgatgataatgcagttgaaagcattcatatggataattggatgtttgatgaatgcttaatcgataaggagcttgaagctgaaatggaccatattagagaaatcattgaggcagctgcaagggcaagagatgttgcaagatacaagttaagatggcctgtaagtgacattaccgttgtttctcaggatgaatctatcttaaacagtgttgcactccttgaagatgtaatcaaagaccaatccaacactaaagaggttcttacagcaaatgagtttgaaaaccttacattcattgcaaagcctaatctcaagaccttaggcccaaggcttaagggagatatgggaattgtccaaaagttctttgcccaagccaaggctgaaggaataggcaattcaattaaagaagagcttgactcaagcggaaaatacattgtcacaggtgaagacagagagggcaatcagaaagaaatcgaactcagtgcagatgatgtcctttatgaaactgagcttccagatgatgtagttagcgcagaattcaatggaggaaacgtatttgtaaatactaaaattactccagaaatcttatctgaagctatggctcgtgagaccatcagaagaatccaagacatgagaaaagacatggacttagatgttgaagctaatgttggcgtaatgatcaatactgatggagagtttaaggagctcattgaaaagcaatctaatttgataagcgatgaagtaagagctaaatcccttgtaatattcgatggaaaagcctgtgaagtctgtactgataagggtatgggcagagagtatgaggacatttctgtagaatattctaaagaatgggagatcgaaggtcataaggttattatttcagttgtaaaactttaa

SEQ ID NO: 93 - DNA, 2211 bp, Methanobrevibacter ruminantium
atgactttaacagattctgaagtaaaatatattgaaggaattctcggtagagaaatgaacgaattggaagagggaatgttagatgtaatgttttccgagcattgttcatataaaagtagtagaccatttttaagaatgtttcctactgaaggagaaaacattgtcctagggcctggagacgatgcaggtcttgtatctattacagatgaatatgctcttgctgtaggtatggaaagtcataatcacccttcagctattgaaccttacggaggagcaggtacaggtattggaggaatccttagagacattatctctatgggtgcaatgccaattgcccttttagacagccttcgttttggtcctcttgaagaccaaaagtcaagatacttgtttgagcatgtcgttgaaggaatctccgactatggtaacagggtaggagttcctaccgttgcaggtgagattgaatttgacgaatcattcagaacaaaccctcttgtaaacgtattatgtgcaggacttgtcaaaaaggatgagatagttcttgctgtagctccaaatataggagatgtcttccttcttatgggaggaaccacaggccgtgatggaattcacggagtgacctttgcatctgaagagctcacatcagacagtgaaaccgaagacagacctgcagtacaggtagctgatccattcaccaaaaagagagttcttgaagcttcccttgaaatcctagaaaagatagactgttccggagtaaaggacctagggggaggaggccttacctgctgtgtctctgagcttgtagataagtctaaaaacggtgcagttgtagaccttagagctattcctttaagggaagagggaatgaccccttatgaaataatgctttcagaatctcaagagcgtatgatttttgtcataaaccctaaagatgtggaattggcacaaaagatatgtgataagcatgaaattccttctgcagtgattggagaagtcactgaaggaagcaatatggttgtaaaggacttcgatgcagaagaagagttacaaaccttgtgtaatgttccaacaatccttttagcagatcctccttcaattgacaggccaacagtagagcctgctaaatcagaagatcttgttgaagtgattgacggacctattgatgaatcattaattaagatattgtcctctccaaacattgcaagcaaggcatgggtatataaacaatacgaccatgaggttcaaaccagaaccgttgtaaagcctggagatgacgcagcagtattgcagatagatgacgagacagctgttgcacttacagcagactccaacactgttcacacaaagctttccccatatgatggaggggcaggcagtgtagctgaagcaataagaaatgttgtttcaatgggtgctaaaccttatgcaattgttgattgtcttaacttcggaaatccggaaacaccagaaatcctctggcaattcaaggagtgcattagaggaatgtctgatatagcagagaaattcgaagctccagtcataagtggaaatgttagtttctacaatgaaacagaaggtattaaaatcaacccaactccggcagttggagtcattggagttgaaaagctatcaagcatcagaacacttccattcaagaatgaaggagataagataataatcattggaaaaacctatgatgagcttggtgggtccgaataccacagagcagtccataaccttgaacaaggagaagctcctaaaatcagaatagatgatgaattggctgcagctaatgcagttcttgacctcatagaaaatgatggagattatgtaaaattccttgaaggtgaagacaagctcaatataaaagccacacatgacgtatctgcaggtggaatagcaattgcattgtctgaaatggttatgaaaggcaagttaggctgtgaaatagatatcagcaatgtcccagcggaagaaaatattagcgataatgacttgttattctctgaatcccatggaagatacatcattgcagtagatgccgataaggcagaggaaatagtaaattccatagatattgatgctgcaattattggtgaagtcaaaggagattctttaataatcaagaataatgatgaaaccattgttgattttgctatagatgagttagataatgcttataatggtgttattgaaaagtatatggcttaa

SEQ ID NO: 94 - DNA, 1227 bp, Methanobrevibacter ruminantium
atgaagtttatatcaaatttaattccattagaagaagcattatcaaaaataaatgataatataaaacttatggatacagaaaccattgacttaaaggactctcaaggcagagttttagcacatgctgtatcttcttatcacaattcacctccatttgacaaatcagctatggatggatatgcagttattgctgaagacacttttggagcttccaataatgttataaaagagttaaaaatcatcgataggattggtgcaggtgatttttccaataagtcccttcaaaatggtgatgctatagttatagcaacaggggcacctattccagatggtgcaaatgctgttttaatgaaggaatacacttatgaggatggtgacaatcttgaaatccactctcaagtgactcccggtgaaaacatatctccaaaggctgaagacattgccaaaggagatgagattttaggagaaaatgttttaatcaggcctcaagagatgggcttgatagcttccgcaggatacagtgaagtggaagtctataaaaggccaagagtaaaactgctgattacaagcaatgaattggtggatccttcccctaatatagatgatgctaaaataatcaattcaaaccaatacacaattgcagctctcatcagaagtgcaggagcaacagtagatattgaccatggaatcgatgactttgatgaaattcgcgatgcaatcgataaggcaagcagggaatatgactgtgtaattacaaccggaggaactgcaataagcaaaggggatgttgtcattgatgcagttgaggacttgggagaagtattgttccatggtgttgcaatgaggccaggtaagccggtaggtgctggaatagtcaacggaacccagatattcatgctttcaggacagcctgtagctgcaatgggtcagtttgatataattgcaagacatttcctatttaaggttcaaggccttgattattcccataagattgtaaagaggacatcttcaactaagatacactcttccctaggcagaaccgattatataagggctgtagcagatgatgagactgttcatcatgttttaaacagaggttctggaatcataaggtctatggttgaggcaaactgctacataatcattgatgaaaaccatgaaggcattgagataggcgatatggtagacttgattttctttaatgatatggcttggcctagtctttaa

SEQ ID NO: 95 - DNA, 660 bp, Methanobrevibacter ruminantium
atgaataaaaaaataatttttttagcatgtgtaatagggatagcacttttgtcggtaagttacattagtgctgaaagtgatgtggacacctctgattgggtgaatataactgtaaacgatataaacttccaaattcctccagagtatggaggtggaaggaatgcaagcggagattatctttttaacaatgtatttaccttcggactcgtagctttggaaaacaataaaagttttagaaataattacggctatgaagcgacaaatgaagagaattatgatgttgaagagatggaaatcgacggacatcatgccgtagcctactacagcaatagaagcatagtcaatcatactgtaacttatttatattttgaatcaaatggaacattctatgcattgtcctatgatggagatgacgttaattcctctatgaaaaaaatcgtatcttatagtcctaaatccaaattgagtaaggaagagtttaatgaaaagctaaataaggctcaagaggagtatattgaagatcaaatagaacaagaagaggcttatcaatatgaacaggcatatcgtgagggatataatcaaggaagaagcgatagcagaggaggcgaactcttgggttattatttcttctataaattaggtcaaaggagtcgttattaa

SEQ ID NO: 96 - DNA, 1227 bp, Methanobrevibacter ruminantium
atgaaagcaaaagctgaaaaaatcggtgatggagtatactggatcggtgtacttgattgggacttaagaacttaccacggatataccttagacggaaccacttacaatgcttacattgtattcggcgaaaaggtagcaatcattgacaatgcatatcctggaaaaactgaagagatgatggcacgtatcgatgacgctttcgaacaagaaggaagggaaatcaaagtggactacatcgttcaaaaccacgtagaaaaggaccacagtggtgtcttatacgacttatggaaaagattcgatgcacctatctactgcagtaagatcgctcaaggaggattgctcagacactatcctaaattggaaggtgcagaattcaacattgtcggaaccggcgacgctcttgaccttggaggcaaaactttagcattcttagatgcattcttgctccactggcctgacagcatgttcaccttacttgcagaagacggaatcctattccctaacgatgcattcggtcaacacttatgctactccaaaagatatgataaggacattccagaatatgttcttatggatgcagcacaaaagttctatggtaacttaatcactccactatctaaaaaggttcttaacaagtttgatgaaatcattgaattaggccttttagaacaagttaagatgattgctccttcccacggtcaaatctggacagacccaatgaaaatcattggcgcttacagtgactgggcaaccggtaaaagagcagaagacaaagttaccattgtctatgacacaatgcactattccacccaaaagatggctcacgaagttgctgaaggaatcatggcagaaggatacgatgtggaaatgttcttcttgcacgaagacgaaagaagtgaaatcgtaaaaagcatattaaccagtaaggctgttgctttcggtattccaacaatcaacgacttcccattcccaagcattggagacattatctactacttgaaaggtcttcacttcaacagaacaggattcaagagacccgctgtaacctttggttccatgggaggaagaggtggagctgttgaattcattgcaaacgagctcaccgaatgtggatttgaagttctcgaccaacaagaaatctactatgtacctgcagatgaagacgatgaagctagcttcaaattaggtcaaaaattagtagaagaagctaaaaagttagaactttaa

SEQ ID NO: 97 - DNA, 795 bp, Methanobrevibacter ruminantium
atggaaaatgaagagaatattagtcaaccaaaagcaattcaaatttttgctaaggctccaggggagcttggcgtaaatgttgtaaagagcccagtgaaattaactatcctttccatgctaaaggacactgatatggaatttgatgaaatcgttaaaaacactggtaagtcaaaatcaactatttctgtacatttaaagtctttaagggaagatggaatcgtaagctacagatttgatgcaaacgaccacagaaagaaaatattctacatcagctccaaattcttaggagaagtagaatctggtgatgagaaggaattggaagaaagacaagccgaattcttggtaaagaatattttagatgtagacaacttcaagttctcttttctattgttccacaccttaagatccaacttgattcaagagggaattaacatcaacccagtattaaaccaaacaggaaagaatattggtgcagcaatgtatgaaaagctttatgacgatgacattaaagtcttctgtgacaatattactgaattctgggcagataatggattaggaaaacttgatatagttttaggagatatcattaatgttactgcatatgagtgttttgaatgcagtttgcttcctaagaagggtaaacctgcttgctacttagatgcaggtatatttgaagctcttttcgctaattatcttaaaaaagacatagcagtaactgaagttaaatgtttcacaatgggtgacgactgctgtcatttcttagttgaaggcattaatggtgaatctttaacttaa

SEQ ID NO: 98 - DNA, 1983 bp, Methanobrevibacter ruminantium
atgtcaaattcaatattttgtcccgactgcgggatgcttaaggaaaactgtgtatgtggaaggtacaaagcaaatcgtgataaggtaaagtacaccaaaggtactagatccaatccacagtataagaaacgaaaaacatttaattattctaataaaaaaagagcggaaaatatgaaaaatacatcatcaaacaaatcaaaaggtttattccaatatgaagagcccaaagggctctatcaatatgaggatcttgaacctgttaaagtagaggaagaggacgactttggaagttcaaaggtctatgacatagctgaacatgacttgcctaaggagataatagatggcttaaaagaggactatcctgaaattccagatagcattatagaaaacttcccatttgaaaggccaagggaaggacaattggatataattgcagatattgaggaggccatatcaaaaggattcaaatacatcatccttgaggcaggaacaggtacaggaaagtcagctgtagccacaacccttgctagaatgtatgagtcagcatatattcttacaatgaccaagcagcttcaaaggcagtatgcagacgagtttgactttccccttgtaaagggaagaggcaattttgactgtataaaagacggatttgaagtcacctgtgacatgggggcatgtaagacagctccaaagaattccaaattcttctgtccatatggaattagcaaaaacccaacacttacaggagacttggcatttcaggactcctatggtggagacattttcttccagacaaatgaccactgccattactggcagcagaaggcaaatgcaataaactctccaatcacccttatgaattatgactacgctattttggagttgaattatgtaaagcatttcggtaaaagaacccttctcattcttgacgaggctcataacattgaagacaagctgatgaaaaccatggaaatcaatctttataatcgtcagcttgaaaaggacataaagaaggtcataagccctcagactcttaaaacaagagagatgggcgaatggataatggagattgatgcaattcaaggccattatgcagatattgacataaaggacctccctacaaacaaggcagacaggatccgttcaacttcagcaaggctgaaggacctaaagaacaagcttgaaacagagcctggaaactgggtaatcgactcaaatgaaaatggagtttctttcaagccacttaaagtcaatcattatgccaacgattatttattcaagcatggtgatgttgtaatattcttaagtgcaaccatcctttcagctaagatgttttcaaaatggctaggcttaaatcctcatgaagtctatcatataaaggtggacagcccattttcagttgaaaaaagaccaattgaactaaaccttgcaggcaagatgtcaaaaaacagggtaaagcagtctgcccctaagtctatcgaaatattaaacaagattctaaaaaggcatgaaggagacaaaggactgattcacacccattcatacaaatgccagcaatatataataaacaacctttataactccagattgattgcacatggctctaacaatagggaaagggtcttaaaatactttgaggaagatgataaccctcttgtgctggtcagtccgtcaatgagcgaaggtgttgaccttccatatgacaagtgtaggttccaagtcatttacaaaatcccgttcccttatcttggagaccctcagataaatatgagaaggaagaaggaccaaagatggtatgcatataagacagtaatgacattgatgcaggcctatggaaggggaatgagagcagaagacgactcctgtgtaacttatatattggattcagatattcaaatgcttttaaagagcccattgtataggtcattgattccagagttctttaaggaagcgattattgttaatgatgatcgtattatttaa

SEQ ID NO: 99 - DNA, 699 bp, Methanobrevibacter ruminantium
atggttataaaagaaaagatagaaattgaaggaattccagtggaagtccatagaaaaagaatgaaaaatgtctatctgcgtgtattgccagatgccacccttcgtgtttccgccccagagagggtatcaaatgattatataatagaatatgtcacttctaatttggattgggttaagcagactcaagagagaattcttaaaaaccctccaaagcctaaaataatgtataagaatggagaggtccataagatttggggagaggaatacaagatacaactaattaccaatgacacaataaaacatgccttttatgatgctgacgaatctatagtttatcttcccgtaagaagaagatccacagttaatgaaagggagaaagcactatttgaactttaccgctctgaaatgaaaagaaacattgattgctttttaaataagtgcgttccaattgttggagagcaacctaaggaaataaaattcagaaacatgaaaaactggggaaactgcagaagaaataagacaatcacattaaacataaagttggcttcaaagcctccaatctgcacagaatatgttcttattcatgagctctgccatatacttgaattcaatcatagcccacggtttaaggcattgatggatggcttctgtcctaactggagagagattaaaaaacttttaaacgaatctgatgattaa

SEQ ID NO: 100 - DNA, 834 bp, Methanobrevibacter ruminantium
atgcttacaaaaagaattattccttgcttggattgtgacctgcaagtgcctgaaggccgtgtggtaaagggagttgaatttaaacagatcagatatgctggaaacccagttgagcttgctaccaaatattacgaagatggagcagatgagatagtcatcctagacattacagcttcccacgaacgtagaggaaccatggtggatgttatagaaaggcttactgaaaacgttttcatcccaatatgtgtaggtggaggaataagaaaggtagaagattataccagaatgctaaaggcaggtgcagacaaatgctccacaaatactgctgcaatccataacccacagcttctaacagacgcttctaaagtggttggatcccaagctgttgtaatcggaatagatgcaaagagaagatatgtggaagaggacccagagcaagctaaaggaaaaaccatagtggacacagacgatggagaggtatggtttgactgcagcatctacggaggaagagagttcactggcatggacgccattgcttgggctcaggaatgtcaggacagaggagcaggagaagtccttttaacctctatggatggagatggaacaaaggacggctatgaccttattctaacaaaggcaataaatgacaatgtggacattccagtaatagcctctggaggagttggaaacccacaccacatactcgaggcatttgagatagcagatgcaagtgcggcccttgctgcaagcatattccactttgatgagtatccggttcctgtggttaaaaaatacctgaaggaaaatggtgttccaattagggagactttttaa

SEQ ID NO: 101 - DNA, 1077 bp, Methanobrevibacter ruminantium
atgtctagtcaaaaaatcaattccttaatcgatcttaatcttacccaatattcaggccaaacttcacagtctccatggagacataattctatggaaaatattgataagtttgatgagctaatttacttaaaagttccttcaattattgatggacttgatgataaaactatcaatttaaatggacttccagttcttttaaacctatcacaagataaagataatataaatggttttgaatatacatatagtttacctcaaaaagtagaaaaacaagcattttctatagggcaagacaatctttcaaagaaggaacttcaatccattgaaagagaaatagactcaaatctaaataacatctatgacttggaatttgaccttgaaaagttctatgagtttcttttagaggatgagaagctggctccttcagttgatttttgtaagggattgagactatttattgcaaaggatccttttgaatgcataatatcctcaatttgttcagctaacaattcaattgctcgttggactgcttcaatagataagataaagttaaactggggagaaaaggtggaatttgatgaaggtatgttttatggttttccatctcctaaagactttttagacttttatgaaactcctattgaacagtcagaggctgatggacgtaggtatgaggtggattgctacacaaaaaatcttaaatcatgtggagttggatatagggctccatatatgaaaaaggcaagtcagatgcttattgatgagatagatatgaatgatgtttcaaaaatggcttatgatgaggcatttgatcttattttaagattgccgggagttggtcctaaggtggctgattgcatattgctgtatggatttggattccaggaggctttcccatctgatgtctggataaagaggatagtttctcatctttactttgatggggaagatatctctgcagataagactagggagtttggaatagagcgctttggtgattatgcaggatatgcacagctttatctattccattatgcacgtaaatctggtttaatggatgagattaagaataaatag

SEQ ID NO: 102 - DNA, 444 bp, Methanobrevibacter ruminantium
atgaaattagtcattcaaagagttacaaacgccagcgtagaagttgaaggagaaattacaggccaaatagaagaaggattaatggttttagtaggttttggccagacagatacagaaaaagaagttgattacctagctagaaagcttacaaaacttagaatattcccagatgaagagggcagaatgaaccgttcagtaaaagatataggaggaaaactcttgcttgttccccagtttaccttatacggcagaaccaaaaagaacagaccttccttccataaggccttagccccaaatgaggctaccaaactctttgactactttgtagaaaagtgcagcgaagaggttccctgtgaaacaggagtatttggtgcattcatgaaagtgagcttgttaaacaatggtcctgtaactatactgcttgaaaaagagtttgaagactaa

SEQ ID NO: 103 - DNA, 450 bp, Methanobrevibacter ruminantium
atgaatggtgaaagcttccagggaatatgggataattctcccttaattgcatggattcataatctctctaagaatcatttcaagtacctaaaggcaaaaatcaacgagtttgatttaggccatgagataaggtatatcatgatgatttacgacaatccaaatatttctcaagatgatttggtgataatgtctggtcaaagcaagggaaacattgccaagtcattgaagaaactggaggatgatggatacattaaaagagaggtaaatccggagaataggagaaagtacatgttaagaaccacttccaaaggtgatgagttggttcctaaggttaggcagatttctaaggattgggaaaaggaagttggaataaccgaagatgataaggaagttattgaaagaataaaagagatagctattaatggaatgaaattaacggaggatttatga

SEQ ID NO: 104 - DNA, 1017 bp, Methanobrevibacter ruminantium
atgaatgacttgacagacagactttttcacttttttaaggaagaaataatattctctatttctctgattttagctattatttcttgtttttttgttcctcccagtgtagattatttaaattatatcaattgggaaacaattattcttctttttataattatgctctttgtagagattttaaagaatctgtctgtttttgaaatattggttcgtaagctattgaaaaaagtaaaaaataccagaggactggttctatttttagtcttcacctgcttttttagctccatattcattacaaatgatgtttcattgattatatttgtaccatttacaatattggccttaagaaaggttgatagacttgatttgataatatttgcagtgtctatggagacaattgcagctaatgttggctgtatggttcttcctattggggctccacataatattgtaatgtatatggtttctcatattccattccagtcatttttcttgattcttttgccttatatcgttgtatctgcagtgtttttgattattctatccttctttgttccaagcgatgcagtaaacttgcctaaatttggcaaagttgagattaataaggaaggcttctttaaaagagtcttatttggtgttgattatttccttcttttgactttcatagcactatttgtattgataggaaacttggaaaacattacattctttaatctgttgtttaaaaagtggataataggcaatgaggttatttggggcgtagtggcatctcagtttatttcaaatgttcctgctgcaatcttgctcagtggattcagcactaattatgaggcgataattgttggaatcaatattggagggcttggaactcttattgcgtctatggcaaatcttatttcatataagattcttgtgagggagcatggggagtttaaaatcagatatttgattatatttacatttttaaatgtggttctgctctttatcctattgggagtttatgtttttattcattaa

SEQ ID NO: 105 - DNA, 591 bp, Methanobrevibacter ruminantium
atgttattcgaaaaggaaaataccgaggaaaagattataagagccacattcgatattgttcaaagggaaggattacaaaaggcaacaactaaaaagatagctgctgaagcaggtgtaaatgaagtaactatttttagaaagtttgaaaacaaaaagaacctcataaaaaagactaaagaatattataccaatcagctcatcgccaaactagaggaaagctttgaatttaacgaaaccgacagcattgaagaatatcttaaaagaagcttcaataagattttagaattttcagaagaggatttcaacataatcagagttgcaatgcaggaagttaagaatgatgatgacaaaaagctccttatcactacaattacagacacaataataaacaaattggatgagttctttaaattgcaattggaaaagggaacaattaaggatcttaattccaaagcagtatccctaatgtgctttagcataatattccagtctcttatcttatggcagatatataatgatggagatttagctgcagactattatgcagatgaatttttagatataatttttaatggaattaaggttcaatag

SEQ ID NO: 106 - DNA, 138 bp, Methanobrevibacter ruminantium
atggcaagatgtccaagatgtggttccgaagcacttgaagagatcaatttcaatacatataaatgccatgaatgcggctatatgattagaaatccggatgaccttgaattggttgaaagagaaaatggtgatttatga

SEQ ID NO: 107 - DNA, 429 bp, Methanobrevibacter ruminantium
atgaaaaaggcaattattgaaactgaaaaaggagatatcgtattggaattattccctaacgaagctcctggaactgtagcaaactttgaaaaattagcaaacagcggattctatgacggattaaccttccaccgtgtaattcctgactttgtaatccaaggaggatgtccaagaggagacggtaccggaggacctggctggaccatcaaatgtgaaaccgaaggaaacccacacaaacatggaaccggagcattatccatggcacatgcaggtaaggacactggaggaagccagttctttattacccacagtccgcaacctcatttagatggtgttcacaccgtatttggacaagttatcgaaggaatggatgttgtaaatgctatccgtcctggagataagatgctaaaagttactgttcaaggataa

SEQ ID NO: 108 - DNA, 276 bp, Methanobrevibacter ruminantium
atgttagaacaatatatgcaatttatgtggttaatcatttttgggaatatagagaacttgattttatcttcccaaggagttgtacagggagtggatcctaagattttaggtggattaagtattcttgtagttattatgtggtttgtaatcggtacagtcattactgatgttgcaatacaatattccaatcttattaattttattggcggtcttgcaatatttcttttaggttttcaagctgtttatgaggctgttaggaacataaggggtggataa

SEQ ID NO: 109 - DNA, 1041 bp, Methanobrevibacter ruminantium
atggctagaataatacttggcaagactggacttgaaatagagaaaaacggatttggagcactccctattcaacgtgttgactttaatgaaagtgcagagattgttcgaaaggcttacaataacggaataaacttcttcgacactgcaagagcatatacagatagtgaagaaaaacttaactatgcatttaaaggattcgataaagagtttccacgagaaagcatcattattgcaagcaagacccaaggggaaaacagaagagacattgaaaaggatatcaagactagtcttgacaatctaggaaccgactatatagacctttatcagatacacaacccatcattctgccctacagaaggggacggaagcggagcatacgatgcattgttcgacctctacgatgagggaacaataagacatataggattcacctcccacaaatatgaacttgcagaagaagcaatccacagcggattatacgaaaccatacagtttcctttctcttaccttacagggccaaaggagcttgcaattgtggagatggcaagggcaaacaatataggattcattgcaatgaaggcaatgagcggagggcttatcagaagctctaaggcagcatttgcatacatcaatcattttgataatgttgttccaatatggggagttcaaaaactaagcgaacttgacgaattcctatcatatatggcagacgacaccaaattagataagcaacttgaagagataattgcaaaggaaagagaagaattgcagggagacttctgcagaggctgcggatactgcatgccatgccctgaagacattcaaatattcatctgcgcaagaatgtcattatggattagaaggttcccagctgaaccaaacctaaatgaagagactcaagagaagatgagaaagatagaggactgcacagaatgcaggcaatgtgtcatgaaatgtccatatgaacttgacattccagagcttttaaagaagaactatgaggattataaaaagatcctatctggagaaattaaggtttaa

SEQ ID NO: 110 - DNA, 1176 bp, Methanobrevibacter ruminantium
atgaatacacaggaaatcattgatattgaagataaatatttcattaatacatttaacagggtcccaatagtccttgaccatggagaaggagtaaaagtatgggacatagatggaaacgagtatttggactttttagcaggtattgctgtaaactgcttaggtcacaaccatcctaagcttgtaagcgcaattcaagagcaagcaggaaagcttattcacgtatcaagcatctattataacgaacctgcaacagtttatgccaaaagattggtggatgcaactggctttgatagaatattctttgcaaactctggagctgaagccaatgagggagcaatcaagcttgcaatcaaatacagcggcaagcatgaggtcctatactgtggagactctttccacggaagaacaatccttaccctttctgtaactgatcaccctgaatacagcgcaccttatgttgaaaacctgccaaaaggatttaagaaagttgaattcggcaatttggacagcgttaaggaagcaatcacagatcaaactgcagcaatcatcattgaacctgttcaaggtgaaggtggagttcatgttgcttcagaagagttctacaaaggattgaatgacttatgcaaggaaaaaggaatcctaatcattgcagatgaggtccaatcaggatttggaagatgcggagcattgtttgcacatgaattatttggccttgagccagatataatgactgttgcaaaaggaatcggcggaggattcccaatggctgcatttctggccaaagaggatgtagctggcggatttgtaccgggagaccacggtacaacctttgcaggtagccctcttgcaggtgcagctgcaaatgcagtatttgatgcattcgaagaagagaatattgtagaaaacagtaaaaagatgggagaatactttaaggaaaaattagctcctcttaaagacaaatacgacttcataactgatgtaagaggttccggtcttttagtagggcttgaattaaactttgaaggagcagatatagttggaaagatgcttgaagaaggattcttaatcaactgtacagcaggtaatgtattaaggtttgcacctcctcttgtagttaaagaggaagagattgatgcacttgttgaagctcttgataaggttttttcttccttataa

SEQ ID NO: 111 - DNA, 438 bp, Methanobrevibacter ruminantium
atgacaaatagaaaagactggggattgacagtaagagggatagttcaacaggaagataagatattaatccttagaagacatcccaagtcaagaaacaatcctaataaatacgagcttccaggaggaaaagtggatcccggagaattctttgatgaagcattgattagggaattcaaggaagaaaccaatcttgatgtaaatatagtgagcttatttgagacagtacaagatgaattcataagtagaagaaccaatcagccgataagcactgttcagttaatgatgaatcttgagataatgggcggagaagtggaaataagttcagagcatgatgattttaagtgggtgagcatagaagagttgaaggagctttataaaaatgatatggttacacctacattaagattgactttagaaaaaagagattttaagatttaa

SEQ ID NO: 112 - DNA, 1284 bp, Methanobrevibacter ruminantium
atggatttaaacataaagacaaacgacaaaggccatttagatattggcggtgctgatgcttgtgaacttgtagaagagtatggcactcctatctatgtaatagacgaagaaagagttagagacaactacaacagattttataatgcttttactaaattttatcctaaatttaaagtattctatgcatgcaaagcaaatacaaacattgcagtgctcaaaatcctcgaagaggaaggatgctgtatcgatgcagtttcccctggagaagtctatatctgtaaaaagatgggattttccggagacaggatactctttacaggaaacaacattagaaacgatgagatggactatgtaaacagcgaagacgttatcctaaacatcgattccgtctctgcccttaaaaggttagctgaaagcatcgatccacaaggtaaaaagatctctttcagagtaaaccctatggtaggtgcaggccaccacggtcattgtatcactggtggggaaatgagtaaattcggtattatggaaaccgaagctgtagagatttacaaattagctaaggaattaggattcgagcctgtaggtatgcactctcacatcggttcaggcattcttgacccggaaccattcaaattagctatagaatctacaatgaacattgcaggtaaggtccaccaagaagctggaattgactttgagtttattgacttcggtggaggagtcggtattccttacactccagaagaagagcttttagacttagagcactttgcagaggaaaatataaaattattcaaagaaaaattagaagagtttgacatgggagaacctattttataccttgaacctggaagatacattgtaggtgacgcttctgtaatacttgttgaagtaaacagcgtaaaggaaagttatagaaaattcatcggagtcgatgcaggattcaacactcttcttagacctgccatgtatgattcctaccatcacattgtagttgcaaacaagatgaatgaagagcctacccaaactgtagacgttgctggtaatgtctgtgaatcaggagacctctttgcaagggacagaccacttccagatattgaggaaggtgacatattaggaatattgaatgctggcgcatacggttataccatggcttccaactacaattcaagaccgcttccagcagagatccttgttaaaaacggagaatcctttgttattcgtgaagcacagacctttgatgacatatttgaaaagcaatccattccagaacacttgaaatag

SEQ ID NO: 113 - DNA, 864 bp, Methanobrevibacter ruminantium
atggtagatttaaaaggtttaaaattctctaaaatgcatggaatcggtaatgatttccctataattgatgaaagtaaaggagaacaaatcaaagaagcagataagccagaagcatgcagacagttatgtcataggaactttggtgtagggggagacggagtattgttcgttgtcccatcagacgtcgctgacattggatacagaatgttcaatcctgacggatctgaagctgaaatgtgcggaaacggcattcgctgctttggagactttgtctacagaaacaagattgtggaaaaggaaacaatgactgttgaaaccaaatcaggtatcaaaaccattgagataactgtagaggacggagagcctgttctctttaaggtaaatatgggcaaatccacattcaaggtccctgaaattcctatgattgctgatacagatgaattcgttgatggggatttggatgtgatagataccactttcaaggcaacttgcgtaaatgtgggaaaccctcatgccattttgtttgtagacaatgtagatgatattgatattgacaaatacggaccggccattgaatgccatgaagttttccctgaaaagatcaatgttcattttgttgaggttttaagcaaaaatgaaggaaaaatgagaacttgggaaagaggagctggcgttacccttgcatgtggtaccggtgcaacttcaacagcccttgccggtgtaaaattaggtctttttgataagaatgtacttctccacttacctggaggagaccttgaatttgaggtctatgaggaagatggtgagcttggtgcatttatgaaaggccctgcagcattagtattcaatgctgaaatccaatag

SEQ ID NO: 114 - DNA, 171 bp, Methanobrevibacter ruminantium
atgattttatcaagaaacattttgaattatttgaaagaaggaaaaacacttgaagaagcttgtgccaaggcaggtgttgttcaaaatgagctgaatatttggaagctttgggcggataaaggtttgcagccctataaagatttctttagagaaattgaaaattatagatga

SEQ ID NO: 115 - DNA, 729 bp, Methanobrevibacter ruminantium
atgaatttggaagagagaaattcaagggaaatagaggagttcttcaaatcaaaaggagtgaaagtggtaggttttgctagtcttgaaaacattagaaatgttcctaaggagtatccaaacagcattttaatagggattccaattgaaaaggaagcattgaaaaccatctataccaatgaccaatcattgtatgttgaatccatgaaggaagtggctcaaaaactgaatgacattatccttgaaggtgaggattacatcaaaaacaccatgaattacaatgccttggccatttcaagagaaagggtggcgggggaattgaaagaccttgccagcaagattccccataagacaaccggaacaagatctggacttggatggataggaagatgtgcattgctcatcagtccggaatatggtgccgcacttagactctctacattgcttacagacatgcccattaaagtgggaacacctatagatgactccttatgtgaagattgcacagactgccaggatgcatgtcctgtagatgcgataaatgaagtgaaatggaactcaaggcgagaaagggaagagtacttcgatgcggaaaagtgctttgagttcataaagaaggaaatgaaaagaacaaacggcaagagcttatgcgccaaatgtggtctggcttgcccttacactaaagaatacttaggaatagaaaccgacaggaatctaattaaggaaatatga

SEQ ID NO: 116 - DNA, 651 bp, Methanobrevibacter ruminantium
atgaaaactaaaaacaccaaaacaagaccacaattaacaaaagacctgaaaagtgaagacttcatggaatactattttttaaaggaagagttaaaggaattctgtagaagagaaggattgaagattggcggtagtaaaaatcagttagaggaaagaatcatttactatctggatactggcaaatcattagatgaatctgtcaaagatggaaataaaaccaaaaatcacaaatctgtcaaagatgataataaaactaaaaattgcaatcataaaatcagtaattctgattctcaagaaatcacattggattccattttaggtgagaacttcagatgcagtgaagataaacgggaattctttgaaagggaaataggaaaaggatttaaattcaaggtaaaattccaaagatggctgaaggcaaatcctgataaaacatatcaggatgcaatcaatgcctactatgaattgcagaactccaacgagaaaaccaaaatagacaggcaattccaatacaaccaatacatacgggatttctttgaagacaatgagggcagatccctggatgatgcaattaaatgttggaaatacaagaaaagtcttaaaggccataaccggtatgaagactctgatttgaaaatattgaaatcataa

SEQ ID NO: 117 - DNA, 585 bp, Methanobrevibacter ruminantium
atggggaaatttgaaatagaaacagatgatttagtatacatcccttcagatgacacttttctattagctgaaaaccttgagataaaggaaggccaaagtgtccttgaaataggaacaggatcagggcttgtctctatgtatgcaagtctactaacagatgatgtaacagcaacagacatcaactacaatgcccttgagcttgctgagaagaacttcaagctaaacgatatcaacacaataaggcttgagttcggagacctatttgagcctgtaaaaaatgagaagtttgatgtaattctatttaataccccatatctgcctaccgatactgatgacattattgatgatgatttgaattatgcatttgacggtggaatagatggaagaaaagtcatagatagattcattaatgaagtgtcacattatttaaatgatggaggaattgtccagataattcagtcctcattatccaataatgataagacattggatatgtttgataggaatggatttattgcagaaatagctaaaagcgaaagctttttctttgaagagattgttctgattaatgcctataagatttaa

SEQ ID NO: 118 - DNA, 897 bp, Methanobrevibacter ruminantium
ttgaaggaagaaatatcattagcaaagcaaaccaaaaggatacttcaggaaaatgatattaagttaaacaagaaccttggacagaattaccttatcgacgactttaaaagaaagaaaataatcaattatgcaaatctaacaaaggaggatacagtcctagagattggccccggaataggaactcttacaatagagcttgctaaaagagcaaaaaaagtaattgccatagagcaagacgagactatttttaatatccttaaaaaacgtctagaaaaggaaaaaatcaataatgttgagcttataaacggcgatgcagttaaagtagactttccagagtttaataagatagtctcaaacctcccttatcagatatcctcacctatcagcttcaagttccttaatcacgactttgaccttgctatactcatgtatcagaaggaatttgcagacagaatgaatggaaaggtgggaacaaagcaatattcaagacttagcgcaatgctatactttaaggcagatgtcaagttcttaacaaaggtatctccagagtcattcattccatctccaaaggtagattcggcggttatccaacttaagccaaagaatattgattcaataagaatcaatgataaggaatatgaaatagataaagaaacatataagacatattcgaaagtggttaaggcattgttccaacacagaaacaagaaggcaagaaatgcattgattgattccagacatataattggctttaaagataaaaaggaattaaaaagcattttaaacgatttggaagatgaaaatccaagaataaaagaaatactattagagcgaaccattaatttagctccagaagagattatggaactaactatactcttaaaagaccaattataa

SEQ ID NO: 119 - DNA, 750 bp, Methanobrevibacter ruminantium
atggataatccaaacattgataatcctgctccaaagaaagaagaaaatgtgattatattagattatcttaaatttggatatataaatcccgaaagaccaactgctcgtggaaagccaattgcacaagctcttggcgttgataaattcacattaatcgaagtcacaccaaaacaaggaattgatttggaaattcatgaaaaagtttacataggttctggaaaaagagacaagatcaaccgagtaaagggattgcttgattatgaaaagcttactgctacaagcagaatcgaattggaatatgcaattaaggaaatcatccaatcaaaagaggagatttacattaagttctttaatgaaatagattccttaaacatcaagatgcacaagctagagcttattccaggaatcggcaagaaacatactcaaatgattcttgaagagcgtaagaaagagcctttcaaagactttgaagacctaaagaagagagtccctcttcttggagatcctgttgacatgcttgcaaaaagagtaagccttgaactcgacaccacacaagtgaaaagaggcaagaaaaaatactatatgtttactcaagttccaagcaaacatccttccaataaaaagagatatagaagaggaagaaacaacagaaacaggaacaacagaaacagaaagccaaataaaaataggaataaaaaacctaataataaggctaataataaagcaactaataaaccaaaaacagaatga

SEQ ID NO: 120 - DNA, 345 bp, Methanobrevibacter ruminantium
atgattgggaaaaaaacattagaaagtgaaccgataccagcagctaaagttaaagaaatattagaagagttttcagaaaaatatgagctcaactatgaacagaacttgaccttagctcatgtgactaatctaaataaactttccctagaagatgctgaaaaattaatcgaagagcttgaagcattcatgacccataaacaagcaatccgtgtagcggacttgcttccaagagacatggcagacttaagattaatttttgcaaaagaaagaaacgctccttctaaagaagatatggagcaaattcttgaaattattgaaaaatatgaaatttatgttgaggaataa

SEQ ID NO: 121 - DNA, 291 bp, Methanobrevibacter ruminantium
atgcaaagatccagaggatttaaaagtagaagtagaaaaaaattgaccaagaaagttagacctggtcgtgctaatccgatcaccagaagaattcagcaatttgaaaacggtgatatggtacacattatcatcgacccaagtattcaaaaaggccaacctcattccagattccatggaaaaactgctaaagtagtagataaaaaaggtaaagcttacatacttgcattaaaagatggtaataaagcaaaagaattaatagttactccagaacatttaaaattacaagagtaa

SEQ ID NO: 122 - DNA, 1269 bp, Methanobrevibacter ruminantium
ttgaatcaagaaatactaaataaagcagaagaattaataaatcatacaaatggaaatatctgtaatcactgtttaggacgtaaattctcagactgtgttgaaggagatggaaatgaagatagaggtgctaaaataagacaagcacttaatctagagccttacaaagcaaatgaagataatcctgcaaatgatgaaaaatgcctaatctgcaatgatttatttgaagacctcaacactgtccttgatttggtgaatgaaaaaatagatctccttaaggtggaatttgacacctttgtagtgggatgcaagcttccaaaggaaatagtggaaaaggaccaagagataagtgacgaatttgatttcaatgttgagataatcaaaaaggaagtcaacagagaaatcggcaagctccttgaatcaaatctagagcagaatgtagactttgatggagaggatgtccttgtaatggttgactttagaagaatattaaaggaagacattgaaaatccaatcaaggtccgccttcagataaacccaatcttcatagaaggaagatatagaaagcttatcagaacaattcctcaaaccaaatggccttgcagaaaatgcaaaggaaaaggatgcgaggaatgcaatttcacaggcaagcagtacccagaatctgttgaagagctgctctctgaagtggttctaaagcacaccaacggatacgaagccaagttccatggtgccggaagggaagatatagatgttagaatgcttggaacaggcaggccatttgttcttgagataaaagagccaaagataagaaagatagaccttaaaaagatagaagaagaagttgcaatctctgcaaaaggaaagacagaataccttaatctcaagtttacagaaagaagaagaaaggcagaaataaaggagtcatctccagatacctataaggtctacagagctcttgtaaaatgcgaagattacatcaaggaagaagaccttgaaaagcttcaaacacttcacataatccagcaaagaactcctataagagtctcccacagaagggcagataagataagacaaaaggaagtcaaggaaataaaggcagaattcattgactctaagacctttgaaatgatcattaaaaccgaaggtggattgtacataaaagagcttatctcttcagatgagggaaggtccaatccaagcgtaagtgaagttttaggcactcaagccatatgtgcagagcttgatgtgattgaagtggggattaaataa

SEQ ID NO: 123 - DNA, 1335 bp, Methanobrevibacter ruminantium
atgttaggaagtttaggagaaaaccttacaaacaccatgaaaaagctagctggaatgagtgttatagataagaaggttattaaagaagttgttaaagacattcaaagggctttaattcaatcagacgtaaacattcagcttgtattaaaattatcaaagacaatcgaaaagcgagcacttgaagaggagcctccaaagggaataaccccaagggaacatgtaatcacaatcatctatgaagagatggtcaatctcctcggaagcgaagctcaagagcttaagattacagaaaagccatttaaaatccttttcttaggattgcaaggtagtggtaaaaccaccaccataggcaaattatgcagatacttgcaaagaaaaggtttctcaccagctgtcgtatgtacagacacttggagacctgcagcatatgagcagttaaagcagcttactgaagaaatgcaaattcaactttacggagacccagacaataaagatgcacttgatttagctgaaaaaggtcttaaacactttaaaaatcaaaaaatcatcatcttcgatactgcaggtaggcataagaatgaggaagacctcatcgaagagatgaacaagttagacaagatcattaatccaagcgaatccatgcttgtaattgacgcaactatcggtcagcaagcaggggaacaggctaaagcattctcccaagcaactgacatcggttcaatcatcatttcaaaattagacggtacagctaagggtgggggcgctctctcagcagtagctgaaactggtgcgccaatcaaattcattggtaccggagaaggaatagatgattttgaagcatttgaccctgaaagattcatttcaagactccttggaatgggagacatcagaagccttatcgaaaaggctgaagaagtgattgatgaggatgaagccaccaagaccatgaacaatatgctcagcggaaagttcactctagtggatatgagaagccagtttgagatgatgaacagcatgggacctatgcaacaggtcatgaacatgattccagggcttggaggaaagatcccaaaagaggcaagccagatgaccgaggataagatcaatggatttaagataatcatgtcctctatgactgaagaggaaatgctcaatcctaagataatcaagcaatccaggattcaaaggatagctagaggcgctggcgtagaggaaagcgatgtaaaagagctattgagatattataacaataccaaaaaggctatgaaaggtattggacgaagaggaatgggtggaggagctatgaataggattatgggtcaatttatgaaatag

SEQ ID NO: 124 - DNA, 567 bp, Methanobrevibacter ruminantium
atgcttgaaaatttagttgaatcattaagaaatgcacctgttgttaaaaaaggagattacgattacttcgttcatggaataagtgatggaatacctgcccttaatccatgtgttctaaaagagatttctgaagttctcgctgaaaggattgatttggataaagtcgataagattgttggggttgaagctatgggaattcacattgccactgctttatccttagaaacaggccttccattgcttgttatccgtaaaagggaatatggattggaaggagagcatgaaatcttaaagcacacaggatatgcaacttccaaattatacatcaatgacttaaatgaaggagacaatattgtcttggtggatgatgttgtaagtactggaggaactctttctgttgtaataaatgaattaaaggctattggtgtgaatatccttgatacatttgttgtagttgaaaagggagaaggaaaaaagatagttgaagataaaactggagaaaatattgtaactcttgtaaaattggatgtagtggatggaaaggttgtagctgattctttaatctaa

SEQ ID NO: 125 - DNA, 1008 bp, Methanobrevibacter ruminantium
atgtcaatatacgatatggaattaaagaaggttattcgaaagattaactccttaaatgtaaagaatgtaggtttgcagtttccggaaggtctcaagatgcaggcggtagctattgctcgagagattgaaaagaacacagaggcaaatgtaattatatctgcggatccctgctttggggcatgtgatgtgtcagataggaaaatgaatggaatagttgactttattgttcattatggccatacccccctcccacttagatatagcattcctacaatgtttattgaggcaaaggccaatgtgaatataaagcaatatttagaagatgccttggaaatgcttgaggactattctaaagtggccattgcaacaacagcacagcacctacacttgcttgatgagatcgttgactttttagaagaccatggaaaggaagttgtaataggctcttcaagaagcacaaggaaaggacaagtattgggatgcaatttctcttcaatcaagaatctgggggcagatgtttatctgtttattggaagcggaaatttccatcctttagggatttatatgtttacaaattctcctgttttggcaattgatccttatagtggcgacattcgtgaaatgagcggatatgcagataggattcttaggataaggtttgctagaatcgtcaaggcaagggaagttaagaaatggggaataatcgtttcctcaaaggaaggccaatatcggatggccttggctaaagagctgaaaaaacttcttgaagatgagggaatggaagcattcatccttcttatggatcatatcaatccagatgttcttcttccgtatatggaacttgaaggatttgttgttacagcatgcccaaggatagcaatcgatgactctcagatgtataagaagcctgtaataactccaaaggagttggagatagttctaaataaaagggaatgggaaaagtatcaattagatgagatattatttgaggatcgttattatcagtaa

SEQ ID NO: 126 - DNA, 567 bp, Methanobrevibacter ruminantium
atgaaagtagaatctggagattttgtaatgcctggcgactttttaagtgtaagtgaagaattcctgccaggtcctggagcatatgaagatgatggaagtgttaaatcaggtgttcctggaaatgtatttgttgataatggtgaaaaggaaatctctgtaatttcaaaatccggcggtccaaacttattgaaggttggagatattgtatatggtgaagtgaaggacgttcgtggccaaagagccttgattagtgtatacgctaaaaagggaaccgatcgtcaattggctcttccttatatggcagctattcacatttctcaagtgactcctggatatattgacaagcttactgacgcttttagaatcggagatttgattgaagcaaaagtagttaagattatgggagataatttggacttgaatactgaagacattacttctggtgttgttaaggctatgtgtacaagatgcagagcatttatggagcctcgtacagagtctgaagtatactgtccggtatgcaatagaaaggaaaaaagaaaggtttcaaagaattatgattattaa

SEQ ID NO: 127 - DNA, 279 bp, Methanobrevibacter ruminantium
atggaaattgaagttattaaagaatcaaaattagaacttgaaatgattattcatggtgaaaaccactctctttgtaatgtcttaagaaaatatcttatggaagatgatgatgtggaatatgcggtttacggaatcgatcaccctcttacaggtgcaggtaagccggttatgaccatcaagaccaaaagatcaaaaagacctagaaactctcttttaaaagcagctacaagattaaaagaagaaactgctgaatttaaagagttaattgaagaattataa

SEQ ID NO: 128 - DNA, 417 bp, Methanobrevibacter ruminantium
atggcttataagattccatctttaactgtagacatatttatttttaacgatgagaaagagtttatactaattaaacgtaaaaatgacccttataaggatttctgggcattgcctggtggttttgtcgattatggtgagacaacagagcatgcagctgtccgtgaagctaaagaagagacaagcattgatgttgaattgattaaactcttcaatgtctattcagaccctgatagagatccaagaagacacacagtaagcgtattctatttagctcatggagatatgaatgatgccaaggcagatgatgatgcaaaggacattggcattttctcatttgatgacttggataatttagatcttgcctttgatcataggatgattttaaatcaggtcaaagagtattttgataaggaataa

SEQ ID NO: 129 - DNA, 396 bp, Methanobrevibacter ruminantium
atggagttctgtccaaagtgtaatggtatgatgatgaacacaactgtcaaggttaaaaaagaagaccttgaagaaaaagttgatgaagaaaatcaatcaaaccaagaaacagaagaagaaaaagttgtttttaaatgcatgacttgtggctatgaaaaagacccttctgaagttgatcaggaccaatataaagttaaggaaacagtagaatccagtgatagtgttattatgagaggagatgaaagcggaatgcgctctactgtaagagagatttgtcctaaatgcggtcacgatcgtgcttcctatgaattgttacaaacccgtagtgctgatgaggcaccaaccaggttctttacttgtgaaaaatgtcatcacaagtggagaggatatgattaa

SEQ ID NO: 130 - DNA, 735 bp, Methanobrevibacter ruminantium
atgtttaaagctgagttaagtgattctagtattttaaaaagcagttttgatgctatttcatctattgtagatgaagtgcagattcaaactgacagtgaaggttttcgtttagatgccttagaccgtagtcatattacatttgttcatttagaacttaaagcaagtttatttgatgaatttgtttgtgatgaacctgaaaaaattaatattgacactgatgaattgatgaaagtattaaaacgttccaaatccgatgatcgcgtattgatgtcattggatgaaggtaactttatccttacctttgaaggagaagctaccaggacttttaaaatcagattgattgatattgaatatgactctccagcacctccatccttgaactatcctactgaatttgagattccattctctcttttaaaggattccattcaagatatggatattttctctgataaaatcactttaatggtagatccagagtactttaaagcatttgctcaaggtgaattcggagatgcaaatattgaatatcttcacggtgaaaagatagatgcaagcgctaaatccattttctctttagaaaagataagagaaatgcttaaggcagataaattttctgatatcgttaacatcagccttggagatgacatgcctgtaaccttaaccttaagaagagttgcaaatgatggtgagcttagttttttgcttgctccaaggatagaatcagaagaatag

SEQ ID NO: 131 - DNA, 1614 bp, Methanobrevibacter ruminantium
atggatggagacttttttcaattattgcgaagggttcaaaaggaggaacggactaaatccactttagcaagagtggataaagatttctataaacaactctattcctatattagagatttagaacgttctgttgctcaaaatcctttcgatactgctcaatcaaatctattgaacaatgctcaaaggattgctactgagatttgtcaatggagagaatcaaagatcagtacggctgcaaacaataatatttataggtctttccatcttttcaaaaaaggaaaccctcagtttgatttgattgatacaactccattgcatcttacacctgaagaggaaactttatatttcgccttgatggacgctcttaagactcatagatataatatttcattggacaaattcggggatgaaaaagccgattggggtgctgatgattatgaggacgaagaagaggatgattttgaagaagtcgcttccgttgtaaaaagccgtgttaataaaggggttgtttctgatgaagagttcttcaatgaggggggttcttctaatgagtccgttactgatggattcagtggagagtctatttccattgaagagtccggtgctgatcctgtagttcaagagcctgctgtagaaactcctgttgaagaaagttctggcagtggttttaagcaagaagttcaagagtctgctgtagaaactactaataccaatgtaggtggatctgatgaggttttagataggttaaatcaaattaaaaattcaactgttgttacagatgaaaaatacgaacctattgaaaagcaaatcaataatcaggctaaagtagttccaaatgtctccatgtctaataatcttaattatgaaagtaaaaattataatggtcaagataatgagtttgattctaaacttaaaccagattatgaatctgatgtagaatcagaacctaaaatagagtctaaacctaaggtagaatctgcacctagaattgagtctaaacctaaggtagaatctgcacctaaaatagagtctgaacctagattagagtctaaacctaaagtaggatccgaacctagagtggagtctaaacctaaagtagagcctaaaactatcgaagataggcctaaaaggaaaagttcatcaacattagactttgacagcatctttgcaaatccagacagtcaatttgatagcatacacaattttgaacctgattatgaagcggatttagcaaacattcaagcaagttccagttttgcagagcctagcgaagcagatttaatgttttcaacaaaacctaggcctaaaaaagagcctaaacctaaatctcaagttggatctaaagaagagttcgaatctagacctaaagtagaagaaccaagtcatgctccaactgctaaagcagaaagaccaagatctcaatctataaaagcttttgctaaaaaggaagaattggaaaacactacagttgtaatatacaaaaatattgattcatttatgggaattgatgaaaagatttatggtccttttatagcaaatgatgtggttattttaccaaatataactgcacaaatacttatagacaataataaggcaggtctaattgatatttaa

SEQ ID NO: 132 - DNA, 279 bp, Methanobrevibacter ruminantium
atgaagatgcctaaagaaaaaagaacatactgtccacattgtaaaagacacactattcacgaagtacacacttccaaaaagagaaaagctagtgaattaaaatggggacaaagacaattcagaagagttaccgcagggtacagaggttatccaagaccattgccaggtggtaacaagccggttaagaaattagatttaagatacaaatgtaaagaatgtggaaaatcccacatcagaaaatctttcagagtaggaaaacctgaatgggtatctaactaa

SEQ ID NO: 133 - DNA, 180 bp, Methanobrevibacter ruminantium
atggctagtaatggtagaggaaactttttaagagttaaatgtttagattgtgacaacgaacaaatcattttcgatcgtgcagcttctgatgtaaaatgtatcatctgcggtaaaaccattgttaaatcccgtggaggaaaagctaaaatcatggctcacatcgatgaagttttagattaa

SEQ ID NO: 134 - DNA, 783 bp, Methanobrevibacter ruminantium
ttggtaagaaaaagtcaagaatggccaaatgaaggagaacttattgtaggaactgtatataaagttcttaactatggtgcattcgctaatttagaagaatacgcaggtaaagaagcttttattcatatttctgaagtttcttctggttgggttaaaaatatccgagatcatgtaagagaaaatcaaaagattgtagctcgtgttttaagggttaatcctaaaaagggtcatgtagacgcttccttaaaaagaatcagggaagaccaaaggaccaaaaagattcagcaatggaaaattgaacagaaagctgaaaaattcttggaacttgctgctaaatctttagataaggacttagatactgcttatgatgaagtaggctatgagcttatggatatctttggagatatctatggcgcttttgaaagtgcagctgaagaaggagctgaaactcttactgaagagggcattagccaagagtgggctgatgcaatcactgaagtggctgtcaagaacattcaacctcctgaagttcacattacaggatatgttgacattgaaagctatgctccacatggagtggaaatcattagggaagcccttttagcagctgaagacgaaaatattgaagttcaatgtgttggagctcctcgttacagaatcactgtaacttccactgactataagcttgcagaaggtcaattgaaagaggccgccaataaggctattgacattgtcattgaaaacggtggaaaaggagaattcttacgtgaaattgataattaa

SEQ ID NO: 135 - DNA, 171 bp, Methanobrevibacter ruminantium
atgaaaatgaaaatgaaaaagtgtcctgtttgcaatatttacacactaaagcctcaatgccctaattgcggcggagagttaagggtgatttatcctcctaaattctcagttgaggacaagtacggtaaatatagaagacaattaaaaaaagagatgcttaataaggaataa

SEQ ID NO: 136 - DNA, 789 bp, Methanobrevibacter ruminantium
atgagaacaacccaatttaaagtattagaagaagttaaattaaacaatccaatatttattgaagcacttcctggtgtcggtcatgtaggaaaattagctattgaccatgtaattgatgaattggaagccactaaatttgtagagatttattctccatacttccctcctcaagttcttgttggagaaggcggaattgttgaagatatgaagaatgaattatactacttgaaatctgctggcggagacgaaagggatttcattttccttgttggaaactgtcaaggattaaatcctgaaggtcaatacgaactctgtggttccatacttgattttgtagagtctcttggagcaaaagagttttacacattaggaggccttgctaccggtcagcctttagaaggtgtagaagaccgtgttttaggtgctgctactgatgaggaacgtattgaaatgctcaaagaagcagatattgaaatcagatctgctgatggcggtattgtaggtgcttctggtttattcttaggattaggaagacttagaggtatgaaaggcgcttgcttaatgggcaaaacccctggctatttcattgatgctgaagctgctgaagccattttggcaaaattagctatccttgtaaagcttgaggtcagcactgacgagttagaggaaagagctaatgagattcgtgaaatgatcaataaggctcaagagatggagcaggaaatgatcaatagggctatgggccaacagcaagcacaaactcaagacgaccttagatatatcggttaa

SEQ ID NO: 137 - DNA, 1188 bp, Methanobrevibacter ruminantium
atgcttcaaattgcagtaacaggtaaaccaaatgtaggaaagtcttctttttttaattcagccactgcatctcaagtagaaatggctaactatccattcacaaccatagatgcaaataaggctgtaggtcatgtcatcagtgaatgcccatgtaaggaattaggggtcacatgcaatccaaacaactcccaatgtatagatggaacaagattgattccaatagagcttatagatgtagcaggacttgttccaggggctcatgaaggtaaaggtttaggaaacaagttcttggatgacttgatgcaagctaaggtattcatccatgtaatagatgcctcaggaggtaccgatgcagagggaaacccagtggaactaggctcccacgacccattggaagacattgaattccttgagcatgagatagtcatgtggatgtatggaatcgtcagcaaaaactgggtaaggcttatccgtaaggttgaagcagagcacttagacttttctaaggtcatatttgagcaactgtcaggtacaggtatcctaattgaagatgtaatagaagctttaagaactgtaagtcctgattatggaaaatgggaagatgaagaccttatagaatttgtaagaaaccttttaaacattgcaaagccatcaatcgtcattgcaaataaggcagatcttcctggagcaaaggaaaacattgaaaggatgaaggaaaagtatcctcgtgtcattgcaacatctgctgaatctgagcttgcattggtaaatgcaacaagggccgggctcatctcatacatctcaggagacaacagctttgaaatcctagagaaggacaagctaaaccctaatcaaatcaaggcattggaatacattcaaacaaacattcttgacgtttatggaagcactggaattcaagaggcattaaacactgctgtatttgagcttttaaatatgatagtggtttatccggttggggatgagcataagttcactgaccaaaagggaaatgtgttgcctgatgctttcctagttcctaaaggttccacaccacgtgaatttgcatatatcattcacacagacattggtgataagtttatgcatgcagtggacgctaggaagaatatgagaattgcaagcgattatgaaatccaagatagagacattattaagattgtaactagataa

SEQ ID NO: 138 - DNA, 1119 bp, Methanobrevibacter ruminantium
atgatgcatccacgtccaagtccaattgccgcttctttatacactttaagagatttaaatgcagatgtaattattatgcacggtcctcatggctgctgctttagaacaggaaggctccttgaaagcgatggggtaagagttgtcacaactgctatggctgagaatgatttcatattaggagctgcagacaagctagaggaaacattgcaggaggcttatgacacattcaatcctaaattgataggaattgtaggaacatgtgcaagcatgatcatcggcgaagacctgaaggagccgattgaaaacttaaatcttgatgctgttgtcatacctgtagagtctcacggaggctttggagagggagacaatacagaaggtgctattgcagtgcttaacgctgctgtagaatgtggtgtcattcctcaagaggaagcagacaggcaaaatgagatgcttcgtttagcaactgtggttgaaaaaacaagaggcatggctcagggaaagtatataaagcctaattttggagacaataaggaaaaagttgcaaagattgttgtaaaagcagtaaaagaaggaaaaaatgttgcatttgtattaaatgcgaaaaaagaaacttcatatctttttgcagacattttaaattgcgatttctctaaacttttccaagatactgattcaaatataaagtccaataaagatatagaaaaccttcatttcattgcaaatctggatgagaacatcggccttccaagaataaggcagcatgcagtaaatattacaaaagaactgaatgaaacaggaatagatattgaatgcatcacaggtggccttgatgagtatccaatcactccaagaaaggcagaagagtatcttaacgagctaaatcctgatcttgttatcgttgcaggagttccacatgcattgtatgtagaggagcttgactgtgaaaccattgcagttacagatggtcctagacttgttcagccacttaatgaattaggctattctcatgtaatagcagaacttgatgcccattctaagacattaggtgtagatgagatagttgattcagactttggtatgatgatacgttcagctattgaatgggagcttgaataa

SEQ ID NO: 139 - DNA, 594 bp, Methanobrevibacter ruminantium
atgattacaattattgattataaaagcggaaatcttagaagcatttccaatagttttaaaaagataggttcaaaagcagtcataacaagcaatcccgaggacattgcaaatgctaatcatttagttcttccaggggtaggtgcctttggaacagctatggaaaacattgagccatacaaggatttgatttatgagcatatcgatgatggaaagccatttttaggaatctgtttagggcttcaagtgctcttgtcctcaagcgatgagactcctggagtcaaaggccttgatatatttaaggggcatgttgaaaagattcccgaaggcaggaagattcctcatatgggttggaatcagttaaaacaagtcaagccatgtcctatacttgatggtgtggatggcaaggacttttactttgtacattcctattatgcagttcttgatgatgaaagcaatttgtctggaatctgtgattatggtgttgacttgactgcatcagtttcaagggataatgtatttgctacccagttccaccctgaaaaaagtggagttccaggcttaaaaatccttaaaaactttgtaaatttagaataa

SEQ ID NO: 140 - DNA, 693 bp, Methanobrevibacter ruminantium
atgatttactcaaaagaaattgaaaatatgtgtcctgttcataagggagcagaccacggtcctgcaccaattcctgaagagggaagatgggtaaaatccaaggagatctcagacatttccggactaacccatggtataggatggtgtgcgcctcaacaaggatgctgcaaattgactttaaacgttaaggatggaataatcgaagaggcattggtagaaactcttggatgctctggaatgacccattctgcagctatggctggagagatccttgttggaaagacaatccttgaggctttgaatacagatcttgtatgcgatgcaataaacactgcaatgagggagctcttcctccagattgtatacggaagaacccaatctgcattttccgaaggaggccttccgattggagctggacttgaagacttaggaaaaggtcacaggtcccaggttggaacaatctattcaaccaaagtgaaaggcccaagatatttagagcttacagaaggttatatcactgaaataggtcttgatgaagatgatgaaatcattggatacaaatacattaatatgggggtcatgcttgaccttataaaggatggaacagatccaatggaagcgattgaaaaggcaagcgggcaatacggcagatttgaagatgccgttaagaaaattgacccaaggaaggaataa

SEQ ID NO: 141 - DNA, 999 bp, Methanobrevibacter ruminantium
atgagtttatttgaaagttatgaaagaagaatagatcaaattgttccagtgcttgaaaaatacggcattaaagaccttgaggaagcaaaagcaatctgcaatgaaaaaggattcaatccatatgacattgtaaaaagcgtacagccaatttgttttgaaaacgcttgttgggcatacactcttggagcagctatcgcaatcaagaaagactgtaaaaaggctagtgatgctgcaactgcaataggagaagctttacaggcattctgcattccaggaagcgttgcagatgacagaaaagtaggtctcggccatggaaaccttgcttcaatgttacttagtgatgaaaccgagtgttttgcattccttgcaggtcacgaaagctttgcagcagcagaaggtgcaattggaattgcaaattcagctaataaggttagaaaggagccacttagagtcatcttaaatggtttaggaaaagatgctgcacttatcatctcaagaatcaatggattcacctatgttcaaacagagtttgactactttacaggagaggttaaggtagttagggaaaaggcctacagcgatggcgaaagagcaaaggtaagatgctacggcgctgatgatgtaagggaaggtgtagctatcatgcaccttgaaggtgtagatgtgtcaattaccggtaactcaacaaaccctacaagattccagcatccggtagcgggaacctataagaaggaatgtgtccttcaaggcaagaaatacttctctgttgcttcaggcggaggaactggaagaaccttgcaccctgacaatatggcagcaggccctgcttcctatggtatgactgacactttaggaagaatgcattctgatgctcaatttgctgggtccagctctgtacctgcccacgtggaaatgatggggcttattggtatggggaataatcctatggtaggtgctacagtggctgtagcagttgccgttgaagaagctttaaaatag

SEQ ID NO: 142 - DNA, 1407 bp, Methanobrevibacter ruminantium
atgtatacatttttaatttgtttatttgcattaatattatcttattttgtatatggtaagttcttggaacgtatcatcggagttgatgaaactgccaaaacgccagcatatgaattagaggatggggtcgattatgtccctatgaataaatacagggcattattggttcattttcttaatattgcaggtttaggtcctattttcggagctattcaaggcgcattattcggaccttctgcattcttatggatcgttttaggtactatctttgctggtggagtccacgatttcttcgaaggggcaatgtctgttcgaaatgacggtctatccatgcctggaataataagcaaatatttgggagatagggttcgcaagttctttgccgttttaataattataacatgcattcttgtggcatctgtttttgcatctggctcagcagatttgctttcaagtttaacaaatatagatattcatatttggctcgttgcaatattcatatatttcctcatagccacattattcccagttgataagattataggtaagatttatccaattttcggagctttgttttttataatggctgttttgcttatttctgcattgatattaaatccaaattattcattgccagaatttacaactgcagggctttatttaactgacaaagccattttcccattcctatttgtaaccattgcttgcggtgcaatctccggattccatgcatcccaagcgccaattgttgcaagatgcgttaaaaatgaaaaggatatgcatatggtattctatggtgcaatggttattgaaggaatacttgcattaatttgggcaactattgccatgtcatttttccatggacagcctcaattagccagtatttatggatccagcccttccattgcagttaaagaaatgtcaatagcattgattggtactgtaggattggttttggcaatcattggtgttgtaatatgtccaatcacatcaggggacacttcccttcgtagtgcaagaataacaattgcagatgaattaggtttaaatcaggataaactaaagactagacttaagatatccattcctttattccttgtgtcttttggattgactttcattgatttttccttggtctggagatatttcgcttggtctcaattgattgtagctattgcagttctgcttgctgcaactgtttatctgattgataataagaagcatttcattgttacatttgctccagccattttctgtacggtggttgctatagcttatatattgcaggcttctgaaggtcttagattggatcctttcatatctaatgttatttctgttatagttgcacttgctttaagcgtgtattttattttaaagtatagaaaacagccaaatactacaacatag

SEQ ID NO: 143 - DNA, 246 bp, Methanobrevibacter ruminantium
atgggaatattttcattttttaaaaaggataaagataaagaaaaagtagagagtcatgaagaggttcattccattcaaataaatgcagaaaactgtcaaggatgtggaagatgtgtttctgtatgtcctaataatgcatatgaacttatagaaggcaagtctagcttaaaagagaattttacttgcagagattgtaaagtatgtttggcagcttgctcaaatgatgctatcacatttgttaattaa

SEQ ID NO: 144 - DNA, 783 bp, Methanobrevibacter ruminantium
atgaaaatttttattaatgcagacacttacaaggaaattgcccaaataacaaaagaaaaactgattgaaacagcaaatgaattaggaatagaaatatccgaggacattaatgaagcagatatcatatgttccattggaggagacggtacttttctagaatcttcaaaattagctctgcaaaagccaatcattggaataaactgtggaacattaggttatttgactgatgtgaatcccgaagggattaaaaaagccatgaaagatataattgatgggaattattatatcgaagagagaatgatgcttgaagcagagattatcaaggaaagcggagagataataaaaatgcctccggcattaaatgaaatgtccatttctaaaaatatctttggagtggttagatttgatgccatagtagatggaaaacttataaattcatacacagcagatggaattttaatctgcacacctacaggttcaactgcatataatctttcctgcggaggccctattgtagatccgactgcagagattattacaattactccaatagccccacatacaataataaataggagcatagtcttatcagataagtcaattgttgaaataaagattacagagcttagagagcacacttcatcatatgccctatccgatggaaagtcaagtgaaatagagactggagatatcttaaaaatcaagaaatcagatgcaaaaaccaagattataaaactgaattggcaaagctttattgataccgttcgtgacaagataaactag

SEQ ID NO: 145 - DNA, 1371 bp, Methanobrevibacter ruminantium
atggatatagaaggttttgtaagaggaagacttaccaaaggcgaagatgaagaagagcttaagtctatccttgcagagagaataagagaatttaaagacatttcagaagaacattccctcttaatggctgaaagcgttatagatgaagtaaagacaactcttgagctaaacaatactgaagatgagttcttaaaggacatcatcacagttccaaaggcaaatgttggcatgggtaagatgggtgtaggttcccgtggtgcaggtgacttctttgtacatagaaagatagcacaaatcgtaaaaagtacaaatacacaatctgttgtcgaccctaatgctcaagatgatggcggtgttgtcaaggtaccagctccaggtgacgatgtctatataaccactgcagtggatggaatacactcaagattaagcgaatatccatttttaggaggtttccatgtaacaagagctaccttaagggatgtttgtgttatgggagcagatcctgtcgctatcctaagcgaccttcaccttgcagatgatggtgacattggaaagctatttgactatactgcaggtatctgtgcagtttcagagcttattgatgttcctcttgtagctggaagcacattgcgtgtaggtggagacatggttcttggagataggcttgtaagttgtgttggaagtgtgggagtctcacagcatcctccaaccgcaagaaaaggagcaaccgtcggagacattattctaatgactgaaggtgccggaggaggcacaatcactacaactgccctttacaatggctactttgatgttgtatgggatacaatgaatatcagctttgtaaaggcttctaaggcattgtttgatgcagacctggttaaggatgtccatgcaatgactgacgtaaccaatggaggccttaggggagacgctcatgaaatctgtgaaaccactggtgtggggcttgagttctatcatgataagataaagaccactgtagcacctaatgtattgaatatgctggaagacttggatattgatcctttaggagtttctacagattctcttatgcttgtagttcctccagagattgctgatgacgttgttaaaactgtgagcgatgttggagtttacattacagagattggtaaggtggatgatgaaggcagtcctcgccttattaaggaagatggaagtgtagatactttggttcctctatttagggaagctgcttacacaaagattaaaaagttagttggagatacaactcctgaagactttgaaatcatgaaggaaaaagttcaaaaggctgcagatgattctataaggaaaaaagaaagagtcattgattatattttgaataataattag

SEQ ID NO: 146 - DNA, 414 bp, Methanobrevibacter ruminantium
atggcattagaaggtgcagaaagaatagatgaatttataagcgaagcaaaagtgtttttcttagcaactgttgacggagacaaaccaaaaaaccgaccattaggtttccatcttcttaaggatggtaaaatctactttggtgttggaaactttaaggacgtatacaaacaaatggaagcaaatccttatgttgaaattgtagcccttgtagaaactgatttcctaagatactatggaaaagctgtctttgaagaaacatacgacatggctgatgctatagttgctggaaacgaattcctgcaaggaatttataatgatgaaaccggttttaaattagctattttccacttggaagaggccactgcggaaatccgtgacataaccggtaaaatcaatgaatcatataatttctaa

SEQ ID NO: 147 - DNA, 396 bp, Methanobrevibacter ruminantium
atgagcttatttaaaaattttattggaaattttaaaaaatctgatgtattggatttagctaagggctttaaattagaatatgaagccaataatttggaaaatatgaaatcgattgtagataaatttgttgattttcatcctgattcctattttgcttcttgctctatggtgatttatataattcaattgtataagaaagatcctttaaaggtgtctccaaatatgcttaataatttaagcattatggaacgcaatataaaattttatgataattcaagcactgactctttagataatgaagagttggaactaaggcaatggtttaaaaaggaagtttatgaaaacgttaaatatatggaatctgcaggattaagattttctgctgatgataaatag

SEQ ID NO: 148 - DNA, 159 bp, Methanobrevibacter ruminantium
atgcaacttaataaaatttgtttagctgctatcgtattatttgttttattcactattttgaaatttgtgatgaaatggagttttaaattatttgctataggaattgtaatttgtattatccttgcaatatttggattcttcaaaggagatgacttatag

SEQ ID NO: 149 - DNA, 639 bp, Methanobrevibacter ruminantium
atgtcaagcaattcagataaagatatattaaaagaattaagagatataacaaaagacaaggaaagctggaaatcaaatataaatcatgtcgcagttaaattgaatgatgatttttccctttcagtaaaggcaaaggtcttatggcttcttggagaaatgggtttaaaacacccattggagatagaagaatatgtcgatgacattgcagtttatttggaggatgatcatcctaaattgagggaaaggtcagctaatgcaattggaagaataggcagggctgataagaacttagtaatcaattatatggataaattgatgaaactgagtgacgatgaatcagaaagtgtaaggcatgcattcatctgggcttgtgaaaacatagctgtaaatgctccagaattgttttgtgaaaaattggatatattttatgaaatgatttcagatcctggtgaaaaggttcgcatagaagctcctgaaatctttagggtagttggaaaaagaaatccaagttgtgtaaagccttatttggataaattagagcatatagcagaaaatgatgagaaccctgttgttcgcattcatagtgctggtgcagttcgaattacaagaaaagccttaaaagaaagtgataatgcttaa

SEQ ID NO: 150 - DNA, 693 bp, Methanobrevibacter ruminantium
atgggctttttttcaaatatgagaaaaccagaaggaaaattaggcaatattcaattaaaatcaatgaataaggaacatactccagtttcattatggggtttaaaacatctagacatttctccggaggatacaattttagatattgggtgtggcgggggaatgaacattaatcgtatggctcagactgcaaagaaggtttatggggttgattatagcatagaaagtgtaaatctttcaaaagaagtgaatgctgactttattaggagcggaaaggttgaagtttatgaaggaaatgtttcaaatcttccttttgaagacaatagctttgatattgtaactgcttttgaaacagtttatttttggccagatattgaaaaatcatttggagaggttaaaagagttcttaagccagatggaatgtttttgattggctgtgaatcaaatggggcaaacaatttagcaatgaagttctttgatcgtgtaatagacatggaactctatgaagataatgaattatatggatttttgaaaaataatgattatggtgatataaccatttatttaagggatggaaaaaacaaacaagagattattaaaaaggatgataaaacctttgtaattgatgatgattatgataatttttctatttcagatagatgggttcaatggatgactataactgctataaaatga

SEQ ID NO: 151 - DNA, 1359 bp, Methanobrevibacter ruminantium
atgcttaatgcaaacacttatgtaacagaggaagaaggtatcggcggaactataagaaacagatgggaagacttctatgttgaagagattccggaagtaattccagatggagaaggtccaaacatttatatttggattgaaaaattaggaagaaccacccttgacgttttgcttgatattgcaagagacctccatatagacaggaaaagaatgggctttgctggaatgaaagataaaaaggccatcactcgccaatggatctgcatagcgaatatggattcagaggaacagtttgcacaagttgaggcattagcaggcacaattcataatactgaatttttaaaagtaattagaggtcgaaaaaagttaagaatgggtcagcttaaaggaaataagtttagaattcttgttaaggatattgatggcatggaatcagataacgaagaaactcgtaaattagccattgaagatgctgcaaaaagagcagatgccatcttaaaaaccttggagaagactggagttcctaactactttggctggcaaagatttggaaagccaagaacaaatactcatttggttggagaggctcttattcataatgatttaaaagaggctgtcagacgttatattggaaatcctagcgaagaagaaagtgaagattcaagaaaagcccgacaagcctttgatgatggaaattgggaagaatcccttgaattgatgcatcctggaatgcgctatgagaagatgatgttgaaagtgcttttaaaagaaaaaagaagagcaatcaggaagattgcagaggaagaaggaattgaaattgaagaagtagatgaatccaaagtggaattatcagataaggcttataaaaatgctattcatgcacttccaaagccacttcaaagaatgtttgtccatgcttatcagtcattcctattcaatgctgcagtaagtgagcgtgtagcaatgggtatggataaatatatcgaaggagatattgtcattgataaggaagagagaattgtaagagataagactcctgaggagtttcaggaaatggtatcttcctttgaaataaatcagacttgccctttgtatggtacaaaggttccatttgcaggtggagaagttggcaagatggaagaggaaatcttaaacagctatggattgactagagatgactttgaagtacctaaaatgcctcgtttaggaagccatggtcttagaaggtctatgagattccaggtatgggatgcaagtgcaacagcaactgaagatggtgttatgtgtgagttttccattgataagggatcatatgctactgctgttcttagggaagttatgaagaaggatgtttactag

SEQ ID NO: 152 - DNA, 675 bp, Methanobrevibacter ruminantium
atggactggtcccctatttttatctcaatgaaaaccgcaagcctatcaatctttataacctttttcttaggtttgattgtagcttggcttctcgttaagataaaaaatgacactacaaaaattgtactggatggcattttcacacttccaattgtattgccacctacagtagtagggtttttcctgctttatatttttggtatcagaggacctataggaagcttctttttagacttctttgctgtaaagatagcattttcatggcctgcaactgttatagctgcagtggttatgtcttttcctttaatgtatcgttctgctagaggtgcatttaaacaagttgattccaatttattggatgccggccgtacattaggtatgtctgagtggaagatcttttggaaaatcttatttgcaaatgctttgcctggaatcataagtggcggaattcttgcttatgcccgtggcttaggagaattcggtgctaccgcaatgcttgccggaaacattgccggacaaactagaacactccctatggcggtttactctgaagtggctgctggaaatatgggaactgcctttgattatgttatattcatagtggccatatcatttatagcgatttttattatggactatttttccatacgcaaggaaaaccaatggaaaaactag

SEQ ID NO: 153 - DNA, 390 bp, Methanobrevibacter ruminantium
atgattgaatgcagaaatatttctaaaggaaaagcagaaggggaattaatagtatcagatgaagcaatcagctttttaggaggcgtagatcctgaaactggtgtggtaattgatcctaatcatgaattgaaaggccaatccattaaagataaaatactttttattccaggtggaaaaggctccacagtaggatcttatgtaatatttcagatgatgaagaataatacagctccaaaagcaattatttgccttaaggcagagcctattatagcaacaggagctataatgtctgatattcctatggttgattctccatcaagtgttgaagaattggttaatggccaaatggtagaagtagatagtgataatggtaaaatagagattttatag

SEQ ID NO: 154 - DNA, 1239 bp, Methanobrevibacter ruminantium
atgccttctttatacattaaaaacgtaaatattataaatccattcagtgaagagcctctagatgaaaggcatgtcctaatcaaggacggcagaatcgaatcccttcatgcagaggagtctgcattatatgccaatcatatagtcttggatggtgaggataattacctccttccaggctttatagactcccacgctcatgtcatggcaaacgggtttcataaagaggatacaatgaaaaatccacttgcattgcacttttacaatgctatagagaatatgaaagctacaattgatgctggggtaacaactgtacgtgacactggacttgcagatattggagtaaagatggcacaggaaaggaagatattccctgctccaagattaaacatttccattaagccattggctatcactggaggtcattttgacttttatctcaattcaggctttgatatggaacttgcatatcctggctttccaatcggtacctgcgatggggtggaggatgtcttgaagaaaacccgtgaggttattagggctcgtgctgactttattaaaatcatggcaagcggaggaattctatctcctaatacaagccctgaatttgcacagttcaataaaaaggaattgaagacaatcgtctctgaggctgaaaactataaccttaaggtagctgcccattgccatagcttagaaggaatacaaagatgtgtaaaggctggaatcaagtccattgaacatggtactttcattgatagaaagacatcagagctattggctaaaaagagaatctaccttactccaaccttaatcgttcatcaaacccttattaaggaaggtttccctgtttgggataattttgcagatgataaggttaaaaagcttaaggaagtcgttaagattcaaaaggaaaatatcgaaacagcttaccagtgtggggttaagttcctgatgggctctgactgtggtgtgattgaccatggaagaaaccttggagagttaaagcaattggttgatattggactaagccctcttgaggctattcaagccggaacaatagaaggtgctaaattcttcaatcaagagaatgacttgggatccattgaaacaggtaagattggtgatgttattttagttaaagagaatcctattgaaaatattgggtctttagttgataatgataatattttagctgtaattcaggatggaaaaatacttaaggataaacctatctattaa

SEQ ID NO: 155 - DNA, 249 bp, Methanobrevibacter ruminantium
atgaatgaagcagattttattcaagaaattatgaaacaagctaacttaagtgaagaccaaggtggccaagtcaacgatattttccaaagcacctttttagctggaaataagaacaaagatactattgttaacttaattgcagaaaaattaggtgttgatgcagcacaagctgaacaaatctatgatatcgccataggtcttcttgctagtggtgttttaagcaaaataaaaggcctttttaaaaaataa

SEQ ID NO: 156 - DNA, 207 bp, Methanobrevibacter ruminantium
atggcagaaaaagaattaaatgttgtcggtatgcactgtccttcatgtgtaatggctgttgaactttccatgaaagatttaaatggtgtagacgacgctaaagcaagtttagacactaactctgtaacagtagaatatgatccagacaaaattactgatgcagacttagttggcgctgtaaaagaagcaggatttgatgtagaataa

SEQ ID NO: 157 - DNA, 1479 bp, Methanobrevibacter ruminantium
atgagaataaaatacctatcaaagcaagatattaaaattatcttacattatcttggatacatcatgatcggcataggggcaatactgctatttcctctgccaatcgacttattctatagagaattcaattatgtttatggagtaattccgcctttaatttcaatcatattaggagttattttttctcaaggattcagagaatatgacaaacttaaattcaagcatgggatgatcatatcaagcatatcatggctatgggcaggtcttgttggagcaataatcatgatgctgattttagatgtctcattcgtagacgctttttttgaaaatatctctgcatggaccggaagcggattgaccatgttcagcgatgttgaatccttgcctatgtcaatactatttttaagaagtgtggaacaatggatcggtggacttggagtggtaatcatcttcataagcctactcattaagcctggaacttctgcattcaagctatacaagtctgaagcaagggaagatagaataaagccaaatataaaaaatacccttaaaaaaacaatgcagatatatgccatttataccgttataggggtcatcttatatcttatagcaggacttcccctctttgattccataaatctgacattcactacaatatccgccggaggaatgtcaataaagaatgcaaatatcggattctaccaaaatgatattgtttatataatcactatctttctaatgatattaggggctacaagctttacagtccattataaaatggctaaaacaaaaggaaaagccatattaaaggatatacaattccaactattgattgtaagcatcatacttagtgcaatagcaattgcaatcattacaaaacttgctcctatggatgtggttttccatgtcgtttctgcaattacaacaacaggagcaaacattgcccctccaagtgagatggcagcatgggctccccctgcactgataatcataatagtcttgatgctgatgggtggttcttcaggttccactgtaggtgctataaagcttgttagagtaattacactcttaaaaagcacacatcttgctgtgacaaatatagtttctcctggaaggtttgtaaagatcaagatatctggaaaatcaataaatgaaggagaaatgaaagaggcatcttcatatatggcagtttatatattctttttagccatatcttggataataatgacttattatacaaatgatccattcaatactttatttgatgtggtgtccactttaggtaatgtgggattaagcacaggaataatcagcggagagcttggcactattccaaaggtagtgttgatatttttaatgtggctaggaagactggagataattcctatacttttaactatccaaataggatttgagacatttaaccaaagtttaagatttgttaaaaggagaatgatgaggaaaattaagcctaattaa

SEQ ID NO: 158 - DNA, 1656 bp, Methanobrevibacter ruminantium
gtgttttaccccaaaatagaagaagtaaaggaaatagcaaaggatgattcgtataaaagaatcccaataagctatgaaatattttcagacactaagacttcaatagaagtcttaagaagacttagaatcttaagcaaccattgctacatgcttgaaagtgtagaagattctaaaaattggggtagatacagttttcttggattcaatcctatccttgagttgacttgtcaggatggagaactggtcattaaaggaaaatcaagcttcagtgattgtggaattgaagatgaaaaagataaatgctttagcataaaaactgataatcctggagaatatattagagaaataatagaagaaaacaaatctccaaagcttgaaaacatccctccattttcaggtgggcttgtaggctatttctcatatgattatatcaagtacagcgaaccctcactgatattggatgcacagaatcaggacgcctttaaggatgttgacttgatgctctttgataaggtaattgcatttgacaactacaagcagaagatagttgtaatcgttaatatgaaagtaaacgatgaagatatgctaaaaaatgaatcaatcgaggaaaactatcaaaaagcctgcaatgacattaaggacatagtgaatattataaaggcagataatatagtggatctcttgaatgacgactttaaagaccagctaacaaacaagaagacaatcaagtcattagaggaaatgaaaggactaaaaaccttagaggaattggacagatgcagaaaggaaattaccaaacaccttccgattgaactcaagtctgatttcagatatctcttttcaaaagaagaatactgtgacatggtggagcgggcaaagcattacataagagagggagacattttccaagtggttctttcaaacagaatagaagcagacattgaaggaagcttgtttgatgtatatagggttcttagaacaacaaatccttccccttatatgttctatttctccagtgatgatatagaaatagcaggtgctagtcctgaaactcttgtaaagcttgtaaacaatcaggtttacaccttccctcttgctggaacccgtccaaggggaaaaacagatgaagaagacagacaactggaagaggaactgttggcagatgaaaaggaaagagcagagcataatatgcttgtcgaccttggaagaaatgacataggcaaaataagccaaataggctctgtcaaggtaaacagatatatggatatagtaaggttctcccatgtgatgcacataggatcaactgtagagggaattttaagggaaaattatgactatctatccacaatagattcaatcctacctgctggaaccttatctggagcccctaagataagggcatgtgagataatcaatgagcttgaagacaataaaagaggaatctatggtggagcaattggctatattgacttaacaggcaatctggacacttgcattgcaataaggatagcttttgcaagagacaataaggtatttatcagatcaggtgcaggaatagttgcagatagcgtccccgaaagcgagtttgtagaatctatcaataaggcacaggcagttatggatgctttaagattagcagatggagggatagaatga

SEQ ID NO: 159 - DNA, 627 bp, Methanobrevibacter ruminantium
atgattctattagtagacaattatgacagtttcgtttataatttatatcaattcattggagaggctttagcaaatataaagggatacgatttagccagcaaaggagatttgtataaaatctatgaagagattaaggtaattcgaaatgatgaaatgactgtagaggaactaagagagttaaatccagattatattatcctatctccaggtccaggcaaacctaaggatgcaggaatctgtaaggatattgtaaaagagtatattaattcagatgttccaattttaggtgtatgccttggccatcaagccatttgtgaagcccttggcaccaatatcatacatgccaaggaattgatgcatggaaaaacctctattattgaattggatgaggataagatattcaaggacatttcagacccaattcaaatagcacgatatcattccttggctgtagagaatgatagtttgtctaatgatttgattgtattggcaagaacagatgataatgagataatggcggtaaggcataaaaatgctaatatttatggtctgcaattccatccagagtctgtattgactcctgagggattaaagataatagagaattttttaaatattaaaaattag

SEQ ID NO: 160 - DNA, 1008 bp, Methanobrevibacter ruminantium
atgattaaagaagctattttaaaagtatacaaagatgaagatttgacttatgatgaagcttatgcaactatggatgaaatcatgagtggtgaggcaagcgaggttcaaatgagcgcttatctgactgccatgtctatgaaaggagaaacaattgaagaaatcacagcatctgctgaagccatgagggctcattgtgtaagattattaaatgatgaagaggttttagagattgtaggaaccggtggagacggttcaaatacattcaacatatcaacaacctcctctattgtcatttccgcagcaggagttcctgtagccaagcatggaaacagatcggcttcaagcaaatgcggtgcagcggatgtattggaagagttaggagtcaatattcatataagtcctgaaaaaagcttagcatgcctaaaagaaatcaatctatgtttcctgtttgctcaaaactatcatctttcaatgaaatatgttgcaggggtaagaaaagagctttcaatcagaacaatattcaatattttagggccattgacaagccctgcaggggcttcaatggaagtcttgggagtttatgaaagggagcttatagagcctcttaccgatgtgttgaaaaatcttggagtaaagtctgcaatggttgtctatggattggatggaatggatgaaatctctgcaagcgataagactgcagtatgcgaacttaaggatggaaagacaagaacatatgaaatttccccagaggatttctctatggatattgcatctaaagaagaccttgttggtggagatgcaaatgaaaatgcagaaatcacattggctgttctaaatggtgaaaagggaccaagaagaaatgcagttttattaaattcagctgcaggtctttatgttgcaggtaaggtagattccatagaagatggagttaagctagcagaagagataatagattctggaaaagccttaaatcagcttgaaaagttcattgaagttacaaacagataa

SEQ ID NO: 161 - DNA, 777 bp, Methanobrevibacter ruminantium
atgttaaagaagatagttgctaaaactgaagagagattaattgaagctaaaaagattaaatccttagataagctaaaagaggaagtatcaaagttagaaataaataatgaattcccttttaaagaagccttaaaagaccctgaaattgctatcattgctgaagttaagaaagcatctccttcaaaaggattaattgccgaagactttgattatatcaagatagcaaaggaatatgagcaagctggagcttctgcaatatcagtcctaacagagccatatttcttccaaggatccaacgatttcctaaaggaaatttctcaaaatgtatcaattcctcttttaagaaaggattttaccattgatgagtatatgatatatgaagcaaagatattaggtgcttctgccatccttttgattgtttcaatacttgataatgttcaattaaagaattacttggatttggcacatgatttaggtctctccgcaattgttgaaacccacgatgcagatgaaataagaactgcagtagatgccggtgcagggataattggagtaaacaatagaaatttagctgattttacagtagatattgaaaatagcatcagattaagaagtcttgtaagcgataagatcctattcatttccgaaagcggtatcaaaacagctgaagatgtaggcagactaaagaaaaacaatgtggatgcagttttaatcggtgaaactttaatgagaagtgatgataagaaatctatgattttggagttgaagaatggttag

SEQ ID NO: 162 - DNA, 654 bp, Methanobrevibacter ruminantium
atgcttaaacttaagatttgtggactaagaagaaaagaggatatagatattgtaaataaatacaatattgattatataggtttcgtatttgcaggcagtcctcgtaaggtatcatatgagcaagctaaagaattatctgctcttttaagagaagatattattcctgtaggtgtatttgtaaatgaacatatgaaacttattgtagacttatacaaggaaggaataatcaagattgctcagcttcatggagatgaggatgaggattatataaagaacctaaaagctaaatcattagagcaaactggccatgaaataccagttattaatgcaattgaaatcaataatgctaataattatgataatttcaatgataagttattggagtggcgagattcagtatctgactattttatcttagacagtggcaaaggctctggaaagacatttgactggagtcttcttgataaaaatagcgaattttttaaaaattccatctttttagctggtggtttaaacagtgaaaacttagactctgctataaaagagttcaacccatatgcagttgacttaagcagttcagtagaaacagatggctttaaggatgaagagaaaatcaaagagatagttgaaattgtagaaagatatagaaattaa

SEQ ID NO: 163 - DNA, 1185 bp, Methanobrevibacter ruminantium
atgagtagaggtcgatttggagttcatggtggacaatacatgtctgaaaccttaatgaatgaacttcttaacttagaaaaacaatataatcattttaaagaagaccctgaatttatagaagagttaaacactcttttaaaggaatatgcaggaaggccttctttattatactatgcaaaaagaatgacagaggatcttggaggagcaaagatctatctaaagcgtgaagacttaaaccatactggtgcacataagataaacaatgttcttggacagtgtctgcttgctaaaaagatgggcaaaaccagagtgattgcagaaaccggtgcaggtcagcatggtgttgcaacagctactgctgcagccttattggacatggaatgtgaagtctttatgggtgaagaggacacaaagcgtcaagcattgaatgtattccgtatggaacttctaggagctaaggttcatacagtaacaacaggctctaaagtccttaaggatgcagtaaacgatgcttttagagaatggatttcaagagtggatgacacccattatgtaataggttccactatgggtccacatccatttccaactatagttcgggactttcaggcagtgataagtcaggaaatgaaagaacagattctagagctagaaggcaagcttccaaatatggttattgcctgtgtcggtggaggaagcaatgcgatgggttcattttacaatttcctggatgatgaggaagtggagctggttggagttgaagctgcaggaaagggaatagacactgaataccatgcggctacaattgcaaaaggagagcttggaatattccatggaatgaaatcctatttctgccaaggcaattatggtcagattgctcctgtatattcaatatcagcaggtcttgactatcctggaattggtcctgaacatgcctatttgcatgatataggaagagcaaaatatgtctcagctaccgacgatgaggcagtggaagcctttgaatacctatcaagaacggaaggaatcattccagcaatagaatcctcccatgcaatagcccatgcaatgagggttgcaggagatatggataaggatgatataatcatcattaatgtttcaggtcgtggagataaggatgtggcagctattgcccgatataagggagttgaattatacgaataa

SEQ ID NO: 164 - DNA, 783 bp, Methanobrevibacter ruminantium
atggagaaagatataaagattagcgatgcatttaaagatggaaaagctttcatcggatttttaaccgctggagatcctacaattgaaaagacagttgaatatgtgctggcaatggaagaggcaggttgcgaccttgtagagattggaattcctttctcagaccctgtagctgaagggccagtcattcaggaagcaaatataagggcactatcaaacaatacaaacactgatgatgtctttgaggcaataagacaaataagagaaaagtcagatgttcctttagtatttctaacttacatcaatccagtgttctattatggatatgacaagttcttcaaaagatgccaggaacttaatgtctgtggaataatatctccagaccttccatatgatgaaaaggatgagatattggaggtaacaaagaaatatggtgttgatataattagcctgattgcacctacttcaaaggaacgcatacaaatgattgcaagtgaagcaagtggatttatctatgttgtttcatcattaggagtcactggtatgagaagtgagattaggacggatttaaaatcaataattagtgatataaaggaagttactgatgttccaacagctgttggttttggtatcaacactccagaacaagctaaaaatatctcaaaagttgcagatggtgttattgtagggagtgcaattgttaatattattgcagagcatggggaaaatgcaagagagcctcttgcaaattatgttaaatcaatgaaagatgctatttccaagtag

SEQ ID NO: 165 - DNA, 1389 bp, Methanobrevibacter ruminantium
atgcaaggtaaaacactagacacaagaacacgcaacttaatactcattctatttttaataggcgtattcatgggctcattggacacaggaataattggacctgtccttccctcaatcgaacagagcttccatctgacaagccgagaatcaagctggatatttacattatttgtaatcacattcatgattggttctccagtaatggccaaattttcagacttctatggaagaaaaaagatattcatccttgacgttcttctttttggaataggatcttgcctaatagcagcatccataagcatagaattaatatttttaggcagactcatacaaggattcggctgtggaggaatattcccagtagcgggggcatttgtaggagacggattcccattggaagagagaggaaaggcattgggaattcttggaagcgtatttggaatatcagcaataggagggcctcttgtaggagcagcattaatcccctatggctggaactggtgttttacaataaacattccaattgcaatatttctaattatctttgcatggtacatactgccagactcagataacgatagaaaactaaagatagactatttaggaatactaatattaagcttgctagccatattcttatcctacgggcttaatcaaatagactcaagcaattttatagcgagcctactctctctaaatgtacttccattcttagtaatattcataattctaatcccaatattcctaaaggtagagaaaaaagccgaagagtcaatcgtgccaatccatatgctaaagaataaggaaatatcaattgcatgcatagaaaccttatgctatggaataatctactcttcagcaattttcataccatcactggtaatcctttcaatgggattggacgaccagcttgcaagccttatgctgattccaatacttggagcaaatgcagttgcagcaccgattcttggaaaaatcctggataaaacaggctcaaagaagcttatggcaatgggaacaatgattcttgcaatagggcttattgcaattgcaatctatccaagcaatctaatattcttcataatagccggatgccttattggagtgggacttgtaacaataataggagcgccgttaagatatatagtcctcaccgaagcaaagccatatgaaagaggagcaggccaagccatagtaaatatgctatcaagtgcaggacagctgataggaggagccctgattggaggaataatcgcatcatttacaggaattttaggctatcaggtcagtcttatcatagctgcaatagttgcactgattgcatttgcattcaccttaagattaaaaggccgtgatgagcagatagctactatgaaggccaatcaataa

SEQ ID NO: 166 - DNA, 414 bp, Methanobrevibacter ruminantium
atgccttttattgcattaatacaccacatatcccaaaataaactaagatatgcaagaaaaaaccctaaccatatagacatggttcatgagggtcgctatctaatggagatacacaaaagaaagaatttatcccaagatgatcttgcaaacatattcggtcaaagcaaaggaacaatagcaaaagcacttagaaagttggaagataagggatatgtagagagaatcattaaccaaaacaatagaagaaaatacattcttaaaacaacacaagaaggagaaaaactagctattttattagaagaagatttatcaagctgggaagaagctgttggaatagacaaactagatgatgaaacaaaaaatcaattaagaaagatagctagaaaaacagaagaaatactaaaagaagaataa

SEQ ID NO: 167 - DNA, 684 bp, Methanobrevibacter ruminantium
atgattggaaacgattgggacaatgcattggaagatgaattcaataaagactacttcataaagataaaggaatttgtagaagccgaatacaaaacaaaaactatctatccacctaaagaagaagtcttcaatgcatttaagttatgcccattagacaatgtaaaagtggtaattttaggccaagacccataccatgaaaagggacaggcccatggccttgcattctccacccctgaaggccatccaatcccaagatctcttaaaaacatctttaaggaaattaaagaagagtacaactatccaattccagattcaggatgccttgaatcatgggcaaagcaaggagttttccttctaaacacagtccttacagtggaggaaggaaatgccaactcccatagcaaatgcggatggcagacatttacagacaatgtaataaaaatattaaaccaacaagattcccctatcgtttttctattatggggaaaacaggcagaattaaaaaaagaactcattacaaatcctaatcatttagtactaatttcttcccacccatcaccattctcagcaagaagaggattttttggatgcaatcatttcaagttagctaatgaatttctaaaggacaagggcttagaagagattgattggcaaataaaaaatgtgcagaccactttgatataa

SEQ ID NO: 168 - DNA, 732 bp, Methanobrevibacter ruminantium
atgaaatatctaattattaacggttccccaaggaagaaaaacacatgggccatggtaaagcaagctaaaacaaacctagaaggtgaatttgaagagattcaattaatgaaaacaaaaataccaatgtgcaatggctgctttaaatgcataatggaaggggaagataaatgccctcactttgaaacagtacatccaatcgtagaaaagataaaagaagctgacggactcataataacaagcccagtttatgctatgaatgtcacaggacttataaagaacttctttgaccatactgcatatatctaccacagaccagaattctttgataagaaagctctaatcatagtatcaactgcaggggcaggtcataagaatgtagccaaatatatggatgaaacccttagacattggggatttaataagaaccataagataacttatgcctgcggcggaaaagacacaataaacacagaagagataaataagacagcgcagaagttccaaaaggacgttagctccaaaaaactccactcccctaaatttatggatattgtattttacaatgtttggagagcaatggcagtaagtaaagatccaataaaagcagataaggaatattgggaagcaaccggacttgtaaattatgattttgcaccaaatgtaaaattaggattctttaaaggaatatttgctaaaatagtctttgccatgatgaaaaaagtaattaaataa

SEQ ID NO: 169 - DNA, 1344 bp, Methanobrevibacter ruminantium
atggctaaaaagaatacaaaagaaaagatatttgactcttcaattgatttattctcccaatatggatatacaaacacatccatacgacaaatcgccaaagaagtaggaataaaggaaagctcaatctataaccactaccaaagcaaggaagcaatattggaatcaatattaaactattatatcagcgaaatgctaaaggaagaagctcctattatgcaatccaacgacaatctggatttaggatttgaatatttctataagcagggcagcgacagattcctatcaaaactctctgaagagagaatgatgaaaatcacaagaatatttctggtaggatcgtatcacaatgaaaagatgaaggcttttgtaaaggaaggaatcattgactatgcaataaaaggttgggaagagctgttcaatctaatgaaagaaaaagaaatcataagaaaagatgcaaacagcaaacagcttgcagaatctttctattcatatggaatattcctattatatgaacatttcatattcaactatcctgaagatgatgaaaagttcctaaaggacttcgaaagaagaacaaccgatcatatgaagataatatttaactcagttaaaataaacaatgaagaatctaaaatagacaataataaaaacaatccatcctccaatcacgataaagaaaacaaagaattagaaacagaaatcatgagattggaagaggaaaaggactacaaaaaagttgaaaatcttgtaagagatgcattttggaacatatatcgtccaggagcttatgaacactttatcgtctacaatctaagagaagacccaagcttcataaaggacctggcatacattatagaggaagatgatgaaataataggacatataaactattctaagggaaatctgaacctttataagaaaaacaatcaaggaatggagaagataaacgattggaatgaggaagcagttgttcttggcccaatagcaatcaatccaaaataccaaaaccagggatatggattcagattgataaagcataccttaagacttgcaaaaaacaagaacattccatatgtctttgtaataggggatgagaactattataacagatttggatttgaaagcgcatctaaatacaatctatttctggagggaacagatacaagcgaggaaaatccattcttcatgataagaatatttaaagacctttttaaagacaaggactacgacagaggaatcttctacaatccaaaagtctttaacgtcagccaagatgacgtagataaatttgatgaaaactttgagtataagcaaaagagggttcaagaaggacagttggaatga

SEQ ID NO: 170 - DNA, 1029 bp, Methanobrevibacter ruminantium
atgtttgatgcaaagtttcaatataccaataaaatcatcaataatttgatggaaatttccaccatcaaggaatttattttgaattcccaaattttgccttcctatgacattttactaagaaataaagcaataatcacatcttcttataattcaacatccattgaaggaaatccattggattttaaacaagtaacaaaattatttaatttaaaacaggaaaataaattagatgagcttaaattaaataaatctgaaatagaagttttaaattactttaaaacacttgaaaatttagataactatgaaaaaattgatgaagaaactattttagatattcataaaaatatcactgaaggaacccttaaagatcctaatatggcaggaaaattcagagattctccagtagtaattgggaatataaaaacaggccaacttaattatgtgcctccaagccctattaaagttccttatttaatcagggaattattggattgggcagacgttcaagaggatttaaatccaatcattcttgcaggaatcttccactatgaattcgttagaattcatccttttgtagatggcaatggaagaaatgcaagagcattagctactttaatacttcttttaaaagattttgacataaaaagatatttttcccttgatgaatattataatcaggataggcaatcctactacaatgcattgcaatctgcagataagtctcaagatttaactgaatggctagaatatttttccacaggatttttagtttcattatccaatgttaaaaaggatattgaaagcatatcccgttttgatataaaaatgaatggcaaaattaaattaaacgaaaaagagattaaaatattggagtttattgaaaaaaacaattccataaaaaataaggaagttcaggatctgcttaacttatctgcccaaaggtcccatttttatattaatgaattagttaaaaaaggattgattaagtcaaaaggcaaaggcagaagcactgtttatatatttaaatag

SEQ ID NO: 171 - DNA, 750 bp, Methanobrevibacter ruminantium
atgattatagatacacactgccatatctacaatagcgaaatggaaaatgcaaaggaaataatcaaagaagctcaaaaaaacgacatctgcctcatattaaacggcactgatcccaaaagcaataaggagattttagaactttcaagcaaatatgataatgtctatggagctttaggatatttctatactcttgcagatgaaataagtgatgaagagattgatctattggacagtcaactcaataatgacaaaataatagctgttggagaaataggacttgactattaccatacaaaagaaaataaggacagtcagaaggaactctttgaaaagatgttagatcttgctgaaaagcataaactaccagtcatagtccattctagaaaggcatcacaagacacctatgacatactaaagaatcacaatgcagttggatcccttcattcttaccaaggttcagcagaaatggcaagggaatttgttaaattaggcttttatataggaataggagggacaatcacctacaaaaacagcaagaaaataagaaaagcagtaaatcaagtaggaattagccatatacttatagaaacagattcaccatatcttccaccagaagataaaaggggagagaataatacaccactgaacttaaaatacattatagaagaattagcagaagaattagatattaaagaagagaaaatcattgaaataacaacagagaatgcaaagaaactgtttaaagtatag

SEQ ID NO: 172 - DNA, 717 bp, Methanobrevibacter ruminantium
atggatgaaaagttttcaagaacagaaatgttagttggaaatgaaggaatggaaaaattaagaaatgcaaaggttgttatttttggtcttggtggtgtaggttcctttgtttgcgaaggacttgcaagaagcggtgtaggtaactttgtcttggtggattatgacaaggtggatgaaacaaatataaacagacaagtaattgccacaacaaagacaatcggccaatgtaaggttgatatcatgaaggagaggattctagatatcaatccagatgcaaatgttgagatttataaggaattctatttggaagattgtgaaatagacattattactagtgatttatcctatgccgttgactgcgttgacacaatcatggcaaagattgcaattatctgcaagtctaaagagcttggcgttccagttatatcatcaatgggaactggaaacaagttggatcctactatgtttgaggttgctgacatttatgagacttcagtatgtcctcttgccagaattatgaaaaaagaccttagaaaaagaaatataaaagattgtaaggtggtttattctcaggagcttccaaaaaacactaatgattgtgatataaataaaaataagggtaaggtaaaggtaaaaggaagcatctcttttgtcccatctgttgcaggtttaataattgctggtgaagtaataaaagatattgtcaatgctaaataa

SEQ ID NO: 173 - DNA, 471 bp, Methanobrevibacter ruminantium
atgtttagaaaaatgagaagagcaaaacaagaattatccaaagaggaatgtatcgatatcctaattaacgaacctcgtggagtcttagcagttttaggagatgatgaatatccttatgcagttccattaagtcatgtctatgtagatggaaagatatacttccatggaacaataaaagacagccacaaaagagatgcaatcaaaaaacacgataaagtatccttttgtgtaatggataaaggaacaaagtcagatagttggtggtacacattcaaaagtgttattgtctttggaagaatgaaaacaatcaatgacaagcaaacaaaaatagaaaagctcacctatttaggaaataagttcttcccaagcgaagaggaaacaaaagatgaaattgataggcttttggatgtaacagaactgtatgaaatcagcatagagcatatgagtgggaaagtagttaaggaaaaataa

SEQ ID NO: 174 - DNA, 1350 bp, Methanobrevibacter ruminantium
atggcaatacatccaattgaatttagatacggaactccagaaatgaaaagaatctgggagcaggaaaacaaacagcaaagaatgttagatattgaatctgcattggctcaagctgaaggtgagcttggaataattccaaaggaatatgcagatgaaatcaaagcaaaagcaagcattgaatatgtaaccttagagcgcgtaagtgaaattgaagctgaaaccaaacacgatatcgcttccctatcaaaaggattaagcgaagtatgtgaaggtgaggctggagaatacgttcactttggagcaacctctaacgatattgtagacagctctaactcattgcttttaaaagactccattgaagttttagaagaaaaaatcgaaagattaaccaagataattcttaaattagcagatgaaaacaaaacaaaggtatgcataggccgtacacacggacagcatgcacttccaaccacctacggcatgaaatttgcaatctgggccgatgaattgcacaggcaatatgacaggttgcagcatgcaaaggacaatgtatgtcttggaatgatggatggtgctgtgggaaccactgcagctcttggaacccaaggatgggaagttcataagaaggtatctgaaattcttggccttaagccagccccaattacaaaccaagtccttcaaagggataatcatgtagagttcatagctacccttgcaaacattgcaacaacccttagcaaaatagctcttgaagttagaaacctacaaagaactgaaattcaagagttaggagaatatttcgaccctgaaaagcaagttggaagtagtacaatgccacataagatgaacccaattacagcagaaagaatctgtggtgttgctagaatagtaaaatcatatgtaaatgcagctatggaaaacaaccctctctggcacgaaagagaccttacaaactcttcctgtgaaagaatcatgttccctgaagcttgcattcttacagattacatcttaaaccttacaatcaagcttatgaacaatcttatcttctatgatgaaaacattgaaagaaaccttaatttcacaaatgggctcatcatggctgaaagattaatggcagagcttacaagagctggaatgggtaagcaaacagcttatggggtcgctagaaagaatgcgataaaagcaaataaggaaaagcttctccttgcagaccttatccttgaagaccctgatgcaagtcaattcctaagcaaagaggacgttgaaagaatcatggaccctcacacttatattggttctgcaccaatcatagtagatgagattctagaagcttctaaagactggttctag

SEQ ID NO: 175 - DNA, 807 bp, Methanobrevibacter ruminantium
atggatttcagcgtaaaggattttaatgtacggctccggacaatacgtatttgggaagtagtcatagctcttgttgtagcattctttttaaccggatttacatgcgattattttggaatctactctggagaggcagagtatatcatattcttcttgtatatgatggtcttctttgcaatagcctccatcgggacacatgggtttaaagatgacatatacggtgtattcaaggcctccaatctgtttaaggtcattatgatagtcataccaaatatgctcttggctttctttatacagcagcatcttgctggttttgatgctatgtttaataatatcaatttattagctcttccagtttcagatttggcttatgaggcttcaaatcctctcttgttcctttttgaattcttttcagcaatcttcattgcgcctatttcagaggagctcttctttagaggaatcttattcaataggcttaagataagaaaaggagttatatttggagtggtggtatcttcaatcatctttggattatgccatttcaattatccagaccatttggctcatataatttacacttgcctatttggaatgtgcttatgcattctctatttgagaacagacaatctattgataaacatgtttgcacacttcctctataatctattgtcttatgtgatagtatacactccaataggggatctcttcttaggaggtccgtttatggatttcactgtcatagtcttgttgttttcaatagtatttgttccggcgtatatattttatttctctataaagctgaaatga

SEQ ID NO: 176 - DNA, 243 bp, Methanobrevibacter ruminantium
atgaaaacaataatacgatatctaaggcaggaggttaagatgagtcagcaggatttagcaaaatctgctggagtaactcgtcaaacgattaatgctttagaaaatggacgatataatccctctttacttttagcatataatataacaaggattctaaataaagccacttatggtgacgatgtagattcctatctaagtattgaggacgtatttaaatttgatgatgatgaaatttcagtttaa

SEQ ID NO: 177 - DNA, 630 bp, Methanobrevibacter ruminantium
atgttcttgatttacggctattcctacagggttacaaaggtctctgtagaagggatgattaacggtaacgatccattgccagaatttgatgatgtgattggcatgtttgttgacggcataaaggtttgcctggtctatctgggatatgcgctggttccaataataatattcatggtctttgctttagtctccagcgctattggaggatatggcgaatctgtattgatggcatttggctctattattactcttctagccataatcggcgcttatgtgatgagcatgtttggagttgcaaacatggctaattacgacggcgcattggcaaaggcatttgacattaaggagattattgaaatcatacagtccgtcggcgttgtaagaagcgtaggggcatatattggattggctattatttgcactgcaatctttatgattgttggactattgctcttctttgtattcggattctttggaataatcactggaaccttagggtcctatactgcagcaggaggcatattcattgcaggaattatcttaggttacttcttaatgctattcattgtaagtccttatattttgattatgcaatcaagagttgctggattattatataaccttcattaa

SEQ ID NO: 178 - DNA, 384 bp, Methanobrevibacter ruminantium
atgtccaataactatcttccaaaaaagctagaaattaaatattctcatcaaatcgatggaacaaagtcaattaagctattgaatggcactcttttagtgaataatccaaatccagaattaatagatataaatcaaatagatgaagaaaagtggattgaattttgggatgccgttgaaaagataggcctttgggacttggaggaagtctatgaaagctgcacattagatggaggattcacctggaagatagaaatagaatatggcaatcgagaaattaatagctatggagccaatatggagcctaaaataattatgggagataaggtttattctgttttagaagagttatataaatccattgaagaattaatctctttagattga

SEQ ID NO: 179 - DNA, 777 bp, Methanobrevibacter ruminantium
atgatatttgactttcatttgggaagtctattttttaaatttatcctttatcttgtaatgcttctattttttatttataaatttaattctatctctaaaaagaattctagttcaaattttaattataattcaagttcgaatagggattctaattcagtaaataactcttctctttcagatgcttttagaaacgatttaaacagcatattcaaggtttctaagatttatcacattctatttattgttttagcaaacatactatttgtatctgcaatatactttgtattaagttatttgggatccatatccattattcagtttaatgcccctttattcggtgatttcactggtttaggctttgatgtaacgctcctttaccttataactgtagttatcctatctccaataatcgaagagtttctctttagaggaatcttcttacgaagattcaatcttgagcttgacaatttgacacttgctatcttgatttcctcagtcttatttggaatttgtcataactttggaggaatattgggagctattctctttggaatctgcgtttccattctttatgtcaagtccaggaatgtattagtccctattttggctcatttcattaacaatctcatttcctttttgctggcccttattggaatagagaatttcattcatggaaatagcattgtcattgctttaataatcattttggccattataagtaattttgtgctctttagagctattgtattagagtggcctaaatcttttaaagaatag

SEQ ID NO: 180 - DNA, 3564 bp, Methanobrevibacter ruminantium
atggattctggaatggattattttgaaagattggaaagtgaaacacaacgtctctacgagatagcaaatgaagcaagatctaagggttttgatgtagagcttgaaacagagattccagtggcaaaggatttagcagagcgtgtggaagggcttgtaggtcctaaaggcatagctcgacgtattaaagagctagaggctactggcatatctcgtgaagaggttgcatttgaaattgcagctgagattgcatctcaagagtctagcgaaactggagcaaagcttgaagctgagaaacaggcttttgcagatcaaggccttcgtacagcacttgctatcatcactgaaggggtggttgcagcgcctttggaaggtatttcaggtgtaaagattaaaagtaattcagatggcacaaaatatgtggcagtatactttgcaggacctattcgtagtgcaggaggtactgcagcagcattatccgttctccttggtgataaaatacgtgtagctactggacttgacagattcaagcctaccgatgatgagattgaaagatatgtggaagaggtagagctttacgaatctgaagtaacaaaccttcaatactctccgactccagaggaagtaaggtttgcagcaagaagcattcctgttgaagtcagcggagagcctaccgaccagattgaagtttcccacagggaccttcctcgtgtagagaccaataacattaggggaggagcccttcttgcgatggttgaaggggttattcaaaagtccaagaaaattctaaaaatctctaaaaaactcaatttggatagctgggaatttttagcagagtatgctaaaggtatcggctcatctcaagaggaagaaaagtcagaagaggaaactgaagaaatcgttgaggaaatcgacgataatattattgataaggatgaattgtttgcccattcaaaatacgcccacgatatcattggaggaaggcctgttttaggatacccttctgaaaagggcggtttcagactaagatatggaagatctagaaacactggccttgctacaatgggggttcatccggcaactatggaactattggaatttttagctgtcggaactcaacttaagatagaaaggcctggaaagggtaactgtgtagttccagttgattccattgaagggcctacagtaaaattaaagtctggtgaggttcgcagattagattccatagctgatgcaagggaagtcaagggaaaagtggttgaaatactctttttaggagacatgcttgttgcattcggcgaattcttaagaaacaaccagcctatgttaggctcttgctggtgtgaggaatggtggattgagtgcataagaaacagcgacaaatacaaatcattctccaatgacagcgagctttatgactatcttatagagagaggaatcgatttaagcattgaacatttcatctcacatgaagactcttcaaagtatatggactttgatagggaaagcttcaatcttaatttccttgagaaaaagcgttatactgccgaagaggcctttagaatctcatatgactttagtgttccacttcaccctgaatacacatattattataatgacatatcccgtgaggacttggcttatctgaatgaatggctagacactaaaagggattatctgtcaactgactacttgaatggagaggatttaattcttgatttggctcctcaaaagagaatccttgagatattgggattggttcataagctgattgataaaaaggtagtcattgatagggatcatgcttatgccctaatgaaaaccgttggaaacggctctgcattagaagataatgatggggacttatcatctgaagttaaaacaatagattattccaaataccttgatgatgaccattataagtcaaaggttgttgacatactcaacgaaaacatcgactttgagattatggataaggctccatgctatataggcacaagggtaggacgtcctgaaaagtctaaggaaaggatgatgcgccctgctcctcatgtccttttcccaattggaaacaatggaggaagcagacgtctagtggctgaagctgccaaaaagagaaaaatcaatgttgaaattgcaagaagacaatgcacaaaccctgattgtggattaagctcattcatggcaatttgccctcactgcggcgctccaactgaaatcaccaaagcaagtcaaaaggacattaacctgtccaccatgctatcaaaggcttcaaataacattggagttcgtaaggttgatgaggttaaaggtgtaattggtcttatttcagaggataagctccctgaacctttagaaaaaggtattcttcgtgcgaaaaatggtgtcttcacatttaaggaaggaaccattcgtcatgactctacagacttgcctcttacccacttcattccaagggaaattggcgttactgttccaaaattaatcgaaatgggatatactcatgactgctatggacaggaaatagtgagcgatgaccagataattgaactgaaggttcaggatattgtagtttcagacaattgtggcgattaccttgtaggtgtagctaatttcgttgacgatctattggaaaagtattatggaatggaccggttctataatgttgaggacaaatatgaccttatcggccatctcattgcaggtcttgcacctcacacatcagcaggggtgttgggccgtattgtaggattcactaaggcattgggctgttatgcacacccttatttccattctgcaaaaaggagaaactgtgacagtgacgaagattctgtcctattgcttcttgatgctctaatcaacttctccaaatcatatcttcctagtacccgtggtggaagtatggatgctcctttggttttatccacacgtatagacccagaggaaatcgacgacgaatcacataacctggacatatttgaacgtttcccattgggattctaccagaaaagccaagagcctttaaagcctgcagatatgctggaatttgttgataatgttgaaatgcatcttggaactgacagacagtatcatgatttgatgttctcacaccatacctcaaacattcatgcagggcctaaggtttgcctttacaagcgtttaggctctatgaaagaaaaggtggaggctcaaattcatttggcagagctcatccgtgcagtagaccaaagaggagttgtagaaggtgttctttcatcccacttcctgccggatatcatgggaaattcaagggctttctccaagcagaaggtcagatgccctaaatgtggcgccaagtatagaagaatgcctcttacaggcaagtgcaaatgtggaggggaccttattctaagcgtttccaagggttctgttgtgaaatatctggaaatttcccagaatcttgtaaacaggtatcctgtttcacattatcttgagcaaagattggagattcaagagtttggtatcaattcactctttgaaagtgataaatccaagcaaagctctcttgatgtgttcttcggcaaataa

SEQ ID NO: 181 - DNA, 2343 bp, Methanobrevibacter ruminantium
atgggtttaaaaattaatgaaggtgttaaagtggaaaatgtgtataatgtagaaaatgatattaggaaagctaaaatcactgttaagaaaaacaacggtgtctgtgaagctttcagttatgaaaaattgttaaagtctttagttatggttgaagccccatattttgagtctgaaaagattgtttcaactgttgtagaaaacttatacgacggtatcactactaaagaaatcaagaagatcgtttacgaatgcttagaagaggttgactctgaggcagctaacaaatatctcgctaagactaccttgaaggtacgttcctcaagagataagattgaaccattcgacatggctaagattgcaagcacccttgtagaggaaaccggtgcttcccaagagactgcttttgaaatcgcatctgaagtatggaaagaacttaaaaagctcaatgtagaatacctcactgctcctatgattagggaaatcgtaaacacaaagcttgtagagtatgggcttgaagacttaagaagcagatacacccgtttaggaattcctgtttataacattacatcattgattgaaaatggtaacagagacaatgcaaacatgatgcataaccctgaatccattcacaaatatgttgctgatgaagcattgaagcaatatgctctcttgcatctattgccatcacacttggcagatgcacacatgtccggtgacattcacattcacgatttggaattcttcgctggaagaccattaaactgtctccaacatgatataagggcattcatcaaatacggccttaaagtggacggtacaggtgaccacacttctgtagctgcacctccttcccatatggaaaccttgatgaaccatactggcgaaatcatgcttgcagctcaacagaacatgtctggtggacaagctatgtccctttggaacgtatttgtcgctccatttgcaagaggaagaacctacgaagaggtaaagcaatccattcaaatgcttgtctacaacttgaacatggcttatgcagcaagaggatcacaagttccatttaccagcatgcaattggaattcggcgttccaaacttcttaaaggacgtaactgcatacggtcctaaaggacaagtcgtaggtacttacgctgactttgaagatgaaaccagaatgattcaaagggcattcactgaaatcttgcttgaaggagattcagaaggcaagcctcacctattcccaaatactatctacacattacgtgaagagaccttgaatggtgactatgatgatgacatgctccttgttcacgagctttcagcaaaatacggatcttcctactttgtaaacatgttgcctgactacagaggtcaaatggctaactatatgggttgcagaacctgtctccaggacacttggaccggtgactgggaacaagactgtttaagaactggtaacctcgcttatgtaaccttgaacatgcctagaatcggttaccaatccaatgatgaagatgatgtattcgaatacttagacaattatatggacttagctgtagaaaccttgatgattagaagaaagcaaggtcttaactgcttgaataactttgacatcctaccgttccttgaccaagaggttgacggagaaacctattacagaatccaaaactcaaccttatcctttggtttctgcggattgaacgaaatgttacttgcattgttcgatgaaggcatagaaaaccctgatgctaacaagttcggtatcaaatgtttagaatacatcaatgcaagagcaaaagcattgcaagaggaaaccggactcagatggtctgtactccagacccctgctgaatctaccgcttacagatttgcaaccttagataaggaacagttcggagataaggcaatcttgcaaggtgacaatggagctaactactacactaactcctcacatgtccctgtaaactctgacattgcatttgctgacaagatcaaaatcgaaggccaataccataagctaactcctggaggacacatcttccatgcattcatgggtgaatcctactctgatcctgaagcattgatgagccttaccaataagattgcaagaaaatcagacattggtttctgggcttacagttcagcattcagtttctgcttaaactgtaaaacattgatgaaaggattaagcaacaaatgtccttcctgtggtgaatctgcagatgtagaatggtatgacagaattactggttacgtacaacaagtaggtcatgctaaatctgctaacggcggatggaatgcaggtaaacgtcaagaattaattgacagacgtagatttgaacaataa

SEQ ID NO: 182 - DNA, 1587 bp, Methanobrevibacter ruminantium
atgaaacattggattgaaagaatcgctgatgaattaaatgaaatggatgtagaaaaacatgtcattgcaagtggtacatctatctcaggttctatacatataggaaactcttgcgatgtatttatagcaaatgcaataggaaaggctttaagagaattaggcaatgatgctgaaaccatttggatagcagacgatcatgaccctcttagaaaggttccttatccacttccagaatcctatgaccaataccttggtatgccttattccatgataccatgtcctgaaggatgctgcaagaactttgtagaacactttgaaaaaccattattcaatgttcttgatgattacggcatagagattattcctaaatctggttttgagatgtataaagatgggtcttatcttgaatcaatcagaatctcccttgaaaagcataatgaaatcaaggctatctttgaccaatacagaagagagcctttggcagaccactggttgccttataaccctatctgtgacgaatgtggaagggtaaacaccactgaagcatatgactatgacggagacattattaagtataggtgtgaatgtggccacgaaggtgagatggatataaaatcaggcaatggtaagcttacctggagagttgaatgggcagcaagatggaagatctttggaaccacttgcgaaccatttggaaaggaccatgcagcagctggaggatcctacgatgtaagtagcgttatatcagaggaaatctttgattatcctgctccttatccagttccatatgaatggatcacccttgacggtgaagcgatgagtaagtctcatggtgtattcttcactccagagcaatggctagagattggaccagctgaaagtcttaactactatctattcagaagcaaaccaatgaaatctaaagacttttcacctaaaatgccttggttagactttatggacacttttgatagggtggaaaaggtattctacggcgaagaggaagctccatcagaaaaagaaggcagaaaattcaagagcatttataagatggctcaaatcaatccagattctccattacctttcagacctccatttaggttcttggtaaatgcttatcagattgtcggtgaaaaggaccttgagaagatttttgctattgttaaaaagaattctcaactcactaaaagctttgcagataaggagtttgaagacttaagcgaacttgaagtgtctcaatttagtgaaagggtagataatgtaatcgcttggttagagaaatatgctcctaaatttgtcaagttccaagttcaatatgattccattccaaacttgcctcttccagatgatcagattgcattcctaaaggatcttgcagacttaatggaagagaaggagttctcatctgctgaagaattgcatgatagcatgtatgagattttggaaagccatggattaaaacctcaaaaggcattccaagctatttataaaatgattcttggtcaaaagcaaggtcctagagcagcttcattcttgctgtctttagataaggactttgttgttaagaggttaagacaggaagcttaa

SEQ ID NO: 183 - DNA, 861 bp, Methanobrevibacter ruminantium
atggtgatttttatttcagaagaagaaattgaaactttaaaaaagcaattagctgataaagacacaaaactcaaaaaccaagcaagcgaattaaatcatttaaccaatgaggtaattcctgagttaaaaaaagacaacaaaaagttaaaagcgcttaaggaagagcttacagatgcattggaaacaagtaccaaaaaatacttcgatcaattggaaatcaatgcagacttaagtgaaagcgttgcaaaaaaaggagctggtcttcaattagctaaagtaagattaaacgaaatcgaaaaattagttgttgaacttgagactgcaagacttgaagaggaagagaaaaaagcagctattccaactgaagagactgacgaagatgaagtaaccaagatttatcaagaaaaagaggaagcaattgaacaattgcattctgaaattgataaattggaaaatgaaatcaaagaaaaagacgcagaaattgacagaaaagaaagcttaatcaaaagcaaagattctaaaatcaaagagaaaaatgatgaaatcaaagacttaaatgacaatgtcattccttctcttaaggcagaagtagctagcaaaaatgcagaagtcaaagccactcaagaagaagctcaaaaagaaattgatggtgtcggaggcaaaattgctaaattagaagctgaaattaaaaatcttaatgaaagcttagacaaaaagaaaagggattatgatagattatacaccgaattaaacgctaaggataaaactatcaactctcttaaaaacaaaaaccaacaattaactgagcaactcgaagaagaatctagcaaaggtttctttagcaagcttactggtagataa

SEQ ID NO: 184 - DNA, 240 bp, Methanobrevibacter ruminantium
atgagttttggtatggttttttttagttgtttggggatttgtttgttttgtaatgagttttggtatggtttttttttagttgtttggggatttgtttgttttgtaatgagttttggtatggttttttttagttgtttggggatttgtttgttttgtaatgagttttggtatggtttttttttagttgtttggggatttgtttgttttgtaatgagttttggtatggttttagttaattaa

SEQ ID NO: 185 - DNA, 918 bp, Methanobrevibacter ruminantium
ttgactattaaaaaagacttattagcgataggacatactgcattggattatataatcacagtagatgaatttccaaaggctaacaattcagctcctatgaagaccatgctaaacttgaatgggggagctgcagctaatgtggctatgattggcgcaagccttggattgaaatctggattggtatccgctgtaggtaaggaatttattgactctcattatcataaggaaatgaccagattaggtgttgacactgaagcgatgattatttcagagactgaaaacacacctactgcttttgttatgacaaataaaaatcaggaccagattagctatttctactggggagcaggtaaggatttccatgatagtgaagttccaagggaaaagataaaggaatttaaggcagttcatttggcaactggagatcctcatttcaattgcaaatctggaatcgttgcaaaggaagaggaaagattggtttcattcgatccaggtcaagaccttggaatgtatagtcctaaaaagcttaaggaagtcattagcaattcaaacattctttttggaaaccatcatgaaatcaaaaggattcaagagtcattggctgttgacattaacggtttgatggaattaggtccggaaattgttcttacaacttgcggtaaggaaggaagcataatctatagccttgatgagggcaagtttgagattgattccatctataggcctgcagttgatcctacaggtgctggagactcctataaggcaggattcctatcccaatttattaatggaaagacattagaggaatctgctaagtttgcatcttctgtttcatcctttgttgtggaaaagcaaggatgtcaaacaaacatgcctagctatgaagatgcttataatagaatgatggacttttattag

SEQ ID NO: 186 - DNA, 1299 bp, Methanobrevibacter ruminantium
atgacacagataagcgatgcaaaaaaaggcatattaactgaagaaatgaaacatgttgcaaaaatcgaaaatgtttcagaagactttattttaagatccgttgcaaacggtactatcgtaattccaagcaatgtacacagagacattgaagcatcaggtattggtgcaggacttagaacaaaggtcaacgcaactgttggaacttcaacagacattgtaaactttgatgaggaagtattgaaggcacagattgcaattgaccatggtgcagactgtcttatggaattaagtatcggcggagacttggatgtaataagaagaagagttcttgacatgtccccattgcctgtaggatctgtacctgtctatcaggctgctattgaaagcattagagaacatggctctgtaatttatatggatgaagatgatttattcggcgccattgaaaagcaagctaaagacggtattgactttatggctgttcacagcagtatcaacattgaaaccttgacccgtcttaaacggcaaggacgtgtaactggtcttgtatcccgtggaggatccttcatgtctggttggattgtagagaatgaaaaggaaaatccattatatgctaactttgattatgtattggaaattgcaaaggaacatgatgttgtactttcccttgcaaacggtatgagagctggttccattgctgactctactgaccgtgctcaaatccaagaattgattatcttaggagaattgattgacaggtcccgtgaagctggagtccaatgtatgattgaaggaccaggtcacattcctatcaatgagataccaaccaatgttatgattcaaaagaaaatgtgttcaaacgctcctttctatatgttaggacctattgtatgtgatgtggcacctggatatgaccacattgtatctgcaatcggtgcagcatcttcagccaaagccggagccgacttcatctgttatgtaacccctgctgaacacttggcgctaccttcccctgaagatgtgaaagagggagttattgcaactagaataggagcatatgcaggtgacttagctagcggtcaaatagatggttcccaagaccttgcaatggctgaagcaaggaaaaaactagattgggaagctcaatatgagtgtgcaatgttccctggcgctgcacgtgcaaaaagagaccaaagacctcctgaagaggaagacacttgtacaatgtgcggtaactactgtgctgtaaagattgtaaatcaatggttggatcagtctgattctgatcttattaaatag

SEQ ID NO: 187 - DNA, 930 bp, Methanobrevibacter ruminantium
atgagggatattatgctagagaatactgataatgaaaagggcaaagccatcattgaaccggaaattggaatcacaatcaatggaatatcctttaatcataaactatttgaaaccttagaatcattatctcgaacatattctcaaagaaaaacagcaaaagaattgaaaatagcccattctgttttaaatagaagaataaaaaatgctgaagacaaacttggtgaaaaattagttgttacaataggttcaggctctgaattaagtccaaaaggctatgaattgcttaatgcataccacaaatataagaatcgccttgaagacagagaagagattgtcattgcaggaggccacatcataacaggcctgcttcaagcaatcagctacgacttgccctttaagacattaatctacagcagtgacgatgaaagcgcttatgaacttgcaaaaagcaatcagattgacattttagcattagacgatccattgcttgcatttgaaaatgacttgaactttacagcaatagcctatgaccatcttgtcttaatctccccaaaaaaggaaaagcctatagaaaaaataagagaccttagcgatttggaattcattggagttaagggaagtgcccaaaggctagcttggagtactctaaaacaggaaaacattccattcaatatagtaaaagaagtaaaatcccaatttgatgcatttaagatagttaaaaactcagacgagtattatacatttttaaatgcaagctatttcaatggaaatgaaatattgaaaaatgaaacccgtcacgtaattagcttagttcaatgcaatgatgaaaaggaagacatttataatttaatggaatatttacttatggacgggcaaagtcaaataggagaacaaggatttgttcctatgaaaccttggaaaacaagataa

SEQ ID NO: 188 - DNA, 591 bp, Methanobrevibacter ruminantium
atggaatatatgaaagacgctatagaagcaattttagataatatacgtgatgctgaagactatttagttgaagaggatgttgctacatttattgatattataacctcttgtgagaatatttttgtaactggtgctggaagatccggtcttgcagctaaagcatttgctatgagattgatgcatttaggattaagttcctatgttgtaggggaaaccatttctccagctatcaatgctgatgactgtattttagctatctctggttctggagagaccaataccattgtaactgcagcgaaaatctccaaaaacagaggggctaaggttttagctttaacaagttatcctgaaagcactttaggtcaattggcagattgtgttattcttgtaaaaggtaggacaaaagttgaagcggatgatgaaaactatcttaaaagacaaatcaagggaaattatacttccttaactccacttggaactgcatttgaattgacttcattggttttcctcgatggtatggtttctgaattgatgaatgctatgggaaaaactgaagctgatttgaaattaaggcacactgtcttagaatag

SEQ ID NO: 189 - DNA, 831 bp, Methanobrevibacter ruminantium
atgacaaaattagtagaagttaaagatgtttcattttcctatgacaaggattctccgattgtctttgagaatattaatttctcaattgaaaagggggatgtattatgtattctcggtccaaatggaacaggcaaaacaactttgataaagacattgaacggtcttcataaggttaattccggtgagatactcttaaatggaactaatatcaaggagctttcattcaatgacattgcaaagcttgttggatatattcctcagggacatattccttcttttccttttaaggtattcgatgttgtattgatgggcaggtctccttatatcaatcttacagcttctccaagggaggaagataaggaaattgctcttaacgctcttaagactcttggaatagaagacttgaaggacaaaagctataccaatctaagtggaggagaaagacaattggtctttttggcaagggtattggctcaagagccagaccttttaattcttgatgagcctacaaatcatttggactttggaaatcagataaaacttcttgaaatgattgaacaactgtccgagcttggccttgcagtcatcatgtcttcacattatccagatcatgcatttttagcagcttctaaggtagcaatcatgaaagacaagagctttattgattttggaactccagaagatgttttaactgaagagaacttgaataaggcatatggcatagatgttaagcttgttgaattggaagacgatagaaaaatatgtgttcctttaaggactaatttggagttggttatgtctaattattctaagaagtactctaaggattga

SEQ ID NO: 190 - DNA, 573 bp, Methanobrevibacter ruminantium
atggtaagtgtagaagactatgaagaacaattagctaaagctggtgaattccacggagaaatctgtggtggaatagctatcggcactaaacttgcaatgtatggtatggaattaatgggctttgaattaaacaaacgtcataaaaaccttattgtatttttagaaatcgacagatgcatgtctgatgcagttcaatcagtcactaaatgttctatgggtaaaagatctcttaagcaaatgtattatggtaaatttgcagtgactttctataatatggacacaggggaagccattagggtttccgatgcagatgccaataagcaagaaaagaaaagagaaaccagagatgaaatgattgaaagatttaaaagaactcctgctgaagagctattcaatgtggaaaaggttcatgttgaattgcaaccttctcaaatgcctggaaaacctcataccagtgtattctgttcagtatgtggtgaaaaggttactgacggtcgccatgtaaaccgtggcggtaagcctgtatgtattccatgtgcagaaggcgcttattatgagttaatagatgaataa

SEQ ID NO: 191 - DNA, 1341 bp, Methanobrevibacter ruminantium
atgggagggatatatatcatcatgaagacttttagacaacagctattggaagaccctgaattccagaactacctgttgcagagaccgaacctgacggagagcagcctgcagtcatacctcaatgccgccaccaacttcgtgaggttcacaggggagccgttctacaagaccgtgcatgagctcagaagccagcagaacgataggattgagaacaacatcatcataaggttcaacccgaaccagtcaaggataaacatcatgcagtttgagttcatagaatacctcaagggaaggggctgcaccgaggtgagcatagactcctatgtcaggtacatgaggaccatactgagcaccttgggaatcatactgcccaagtctccgaagctggacgacactccacaggactggtatctcctgacaaaggacgacataaagtatgtcctcgacacagcaaatctgcagtacaaggcggtcatcaatttcgctgccgttacaggactgagagtgagggacatgaggtcattgaccatcaaggacttcatgactgcgaccgaggagtaccatggctgcacggaggtcgaggacttcctggattcagcacctgacgggatgataggcttctgggagcttttccctcaaaagaccagaaagttcaggcttccctgcaaggtgtgcaacacccctgaaagcagcgaccttttgcttttctcattgaatgagcgtgtgaagtactttgaatggaagaacgagaaggacggcactgacctgaagatcaccaagaatgaccctctctttgcaagccgccaaaggaagtacaagaacttcatagcgcccaacagcataagctggaccctgtcccaatacagcgagaagctgagcgccgagagggaaagggtcttcaagtacaagctggagcatggcgagatcagtcaggagacctatgacgaaagcgttgcgacaatccccaagttccatgcgcatgggctcaggaagttcttcatctcaacattggctaagaaccgtgtggatgcaaggataagcgcacttatggaagggcacaaggctccgctggtaacggatagccactacatcaacaacgattacctgaaggagacaatcaaggaggagtacatgaggtgcattcctgacttgagcttcgagaatgttgaggtccgtttccttacaagcgaggaaaggaaatccttgcagcagaagatagatgagcttcaggaagagaacgagaacatgaagaaggacatggagaagtacattgacgatgccgtccatgagaagatgaaggacgccttcgagaactggctgaacattcaggactcaaaatga

SEQ ID NO: 192 - DNA, 885 bp, Methanobrevibacter ruminantium
atgggaatgaaaaaagttaagatcgaaagtaaagcaaaaaataatatgacaagaaacgaaaaactcttctataaattatatgacgatttatataatgaagatagattaattttattctccacatattttaacatatatgataaatttatttttaaaaaagatataatccattatgttttaatgaactactctgaaaatgaaattattgaagcaatgaaaaaaattgatgaaattcagtcagaaggcattgatattaaaacattcatacctaaaaagtattgtccaaaatgtaaaaaagtaatggacagttatgggaaaatctgcccagattgcggtacaatattaatagaagatgaaaagaaaattcaagagcttcaagcaaaagataaagcatatgaagaatatctagaaaaagagtataatatttatttacaaaactcttatcacaatatgattcaagggtcatatactattaaaatacgaactcgaaagcctaagactgaaactgagatagtgcgcatacctgctcaaacagtaacatcaagaggcaagttcaattcaattagccagcattatccaagtgaaacctatacaagacaaaaagtgactcgtgcaaagtataaagagtgtagagttctttttgacaaagagaagatgatattaaatattgatggaaccgcaactaaactttattatgatgaagtttgtgaattggaatatcctgaacaggaagtgaatgaactagttactttaacattgcacaatggcacagtacttacttttaaaataaaaaatggatggtttgcttctgataatgaaaaaaaggcaagatttgacgctttcgtaaaaacctttattgaacaagggaaaaatctgcctctataa

SEQ ID NO: 193 - DNA, 219 bp, Methanobrevibacter ruminantium
atgcaatattggcgtattgtaaattactctccactagctgttgcatgtaaaaaaagaaaacattggacgtgtaatcattctttttatgcaacattttatatattgaactttcaaatatttaaaatcttgctttttatggctaaacagcagctattaagccgtattgatttgaatctactttttttaatatatttccaaaactttttgcttattatctaa

SEQ ID NO: 194 - DNA, 225 bp, Methanobrevibacter ruminantium
atggttgcagagatggttgaaaacatcaggaaaggagaaggagatggatattccatctaccctcctttttcctgcattgttttcctacaaggcaaaaagtattccgaatgctgctgcaaggctgaggcaagggatcagaagtttgcacttgtgaaccttgtaggcttcagaagagaggatgtcaaggtcatagacccaaggaccaacgaggagctgttcgtatga

SEQ ID NO: 195 - DNA, 435 bp, Methanobrevibacter ruminantium
atgatggctaacaagattagagttaatctcacggttgaccctaatttgtggcaattagcaaaagacaagttaccttgcagcagaagcgaattctttgagaatcagttgaagatgttcttagggattgaagatgacgagtcggaaatcattaaggacatccaaaccaaagaaaatgagattaacgcactaagagacaagttatgtcatgttcgcaaatcaaagcagttgaaattggaatcaaacaaatctatggagaaggctatggcaagcttaaacagaatgcacaagaaatatgggaaaatcggagagaaccagattaggaacctcgcccatgttcacaaggttgactttgatgacttgaagaaggaatgtcaggacaactgcatgaacatatttgaatttgcagaagttcctaagcatgatagcgtaatgtga

SEQ ID NO: 196 - DNA, 420 bp, Methanobrevibacter ruminantium
atggagttgtttttgatgacaattggaagtttggacaattttggaaagtcagatggagaaaacatgaaccctgaagatttcgactgttctgttttctttgaaatgtacaaggcactttttgagatattggatgttgaagttggcagcttcgctgaactcttggatgtgtacaagaatgtcgagatggattacaccttgaagagacatgccctcaagcagaaggaaatcctttactggttcaataccgactggaaggaggaacttggaaaggaaaagccgaccgaaaaggacaaggagaaatggatcaggcagaagattggttatgactccttcgtggtcgagcagctagaagtcaagctcaagcacatcagaagaatgtatgaaaccgctttgaagcattcctttgaggcaataaaatga

SEQ ID NO: 197 - DNA, 276 bp, Methanobrevibacter ruminantium
atgaatgtgaaaacagtcatgaatgaccttataggattgtcaaaggagttcgagggagtggaatatgagattgaatccaaaaattcaatctacttctattcctttccaaagtacatgaaggaaggcattgtgattctgaaatattccgcaatctatgacctgcacaccatattgaaaggcatggatggaatcatagtggacattctggaggttgaggacaatcctggtgatgagaagaaggatttgctatatgtgcagattgaggtgaaggaatga

SEQ ID NO: 198 - DNA, 336 bp, Methanobrevibacter ruminantium
atgttaagtaaaaaagaagccatacagatgacgctggacaatgagaagcactatcctgttaagtgcaagtactgcggaaagccgttcaccaagtctcacaacaggcagatgtactgttcagacagttgcagacggaatgccttgagggaacagaaggcaagataccaggctaaaaggaggctaaaaataaagcagaaagtgctgattgtagatgaatacaagaaatacggtttgggtagctatggaacaagtgcgaacggacacagaaagaacaatttttcacatgagtacatggctattcaaaaggagatgaaaagaataggattgaagagataa

SEQ ID NO: 199 - DNA, 237 bp, Methanobrevibacter ruminantium
atgatgatttatgataaagcgacagttacaagcctcatagtggctatcctattgccattgatgagcatgttaggaatcggagaattgactcagaactacatattggcaatagtgagcggtatgatagcccttgtggtttggtactacaacgagaagcacaacagcgatttggtgagcggaaccaccaagtgcgactgcgagctttgctatgggggagacgatgaagcacttatatga

SEQ ID NO: 200 - DNA, 339 bp, Methanobrevibacter ruminantium
atgaagcacttatatgagataatcccttacaggaggactgtttggattacagggttcctgaagacaacagtctcctcggcaatgataaccactggcgtagtgatattgttcaacagcataaccgagcacccttacttcatggagtgggacgagataggaatcgttcttggaatcgtttccatcaccatcgcctgcatttacatagcgatgatagacagatggaaggaacgcaggaagaaggaggagcttgacacgatagaggactacataaacaggaaggctgaggagatagcgaacatgaaggtattgaggaaacttgaggaattggaagaggaatga

SEQ ID NO: 201 - DNA, 621 bp, Methanobrevibacter ruminantium
atgactatgatagaaatcagcaccataaagatcaccgacataaagcctgccgaatacaatccgaggataatgagccagcttgaacacacaaagctcaggaactccatggagacattcggagtggttgacccaataataatcaacctgaagaacaaccacatcataggagggcaccaaaggtacgaggtccttctggacaagtccatggaggacaacgagttcataaaggagctccacctcatcaggcttggagatgtaggctgggcattccctgagtcagacctcgaggtcgaggacgatgaccatgagaaagccttgaacctggctctcaacaacatcgagggtgagtgggacctgccaaagctggaacccatattgacagatttaaaggatgtaggattcgacattgaacttacaggattcagcgacatcgagcttaccgagctcaatctggagaacaaccttgtctttgcggaggagttcgagcctgacgagagcgaggaggatgtcgacttggaggacatttacgatgagcctgtaaaggaaatgctccaatgccctgcatgcgaccatgttgatgttgtgaaaaggttcaagagagtcgattcacaaggagattag

SEQ ID NO: 202 - DNA, 201 bp, Methanobrevibacter ruminantium
atgaagatctacttggcggcagcggacaccatgagcgaggacatcataaggctcctgccggttgccaaaaggcttcactggaacctgttcagctactactatctcctgacccttaagaagatggaggactatgacatcataaggaaggcttcaaaaaagcgtccttatagacagcggagcgcacagcttccagaagggtaa

SEQ ID NO: 203 - DNA, 657 bp, Methanobrevibacter ruminantium
atgattaatgaaaggataagaccttatttgaattttagcttcaatgacaagaaagtcattttcgtcacattgttcgttgtgagcaatctgataagcaacctgttagccatcaaggttttcaacttgggattttggggattgacaaccgattgcggaaatctcctgttcccgttaggataccttatggcagacgtgattacagaagtctatggagagaggacagctcgaagggtcatattgcttgggctctttgcaaacatattgctgattgtggctaccacattgactgtctacatgccgtatccaagctattggacaggacagggagcgtatgcctacatgttcggattcactcctagaatcgtgcttgcagggttcatagcatacttggtgggacagttcgtgaatgcgagacttatggtgctcatcaagaaatggaccaacagcaagtacctgttcatgaggacaatcggatctacacttggaggggagctttgtgatagttgcatatgcagcagcattgcttattacggtattgtgcctaactctggcatattgctatttattcttatgcagtatgttgttaaggttacttgggaagtggtgatgcagcctctgacatacaagtcaatcgcttgggctagaaaagacggatag

SEQ ID NO: 204 - DNA, 1476 bp, Methanobrevibacter ruminantium
atgacagctgcaagcagggtgaatgctcacggaacaatgggtcttggaagatggagcatttacataaacaacggattctggaagcctagggactttgatgtcctgataatagagcttctgcaatatgcaattcagggacgggtgagcggcatattgctgggagttccctcaaggcacggaaagtccacacttatcagtaagaacttttgcagctattttttatcatatttccctaatgagcaggtcatcctttcaagctattcgcaaggattggcaagtgagttcggaggacaggtgaaggacattgtcaatcattacggctacctttcaccgtacaagccgaccatcaggtctgatagtaaggctaaaaacaagttcaagctcaatgagccttatcgtggacagatgttgagtgcaggtgctggcggttcaatcatgggatacggtgcaggtctccttattgtcgatgaccctatcaagaacgtcgctgaagccgaatccaaggtacgtcaggcaaagctcaaggactggtggggaggaaccatcaagtcaagggtccagaggagaagcaacggacttcctcctatcaagattgtcattgcacaaagacttcatttaaaggatttgcatggaatcataaaggagacagagccgacaatacctgcaaatgacgcattcaggattttaaggaacggaggctcaatcgaccctaacacatgggttgacttcaaccttcctgcaatctgcgacagcgaggacgatattcttggaagaaagataggtgaagtgctttgggaagagcagagagactatgaatggctcatggctgaaaagagaagcatgggctcatatctctttaatagtatctatcaaggacagcctgtagagcgtgatggtgagatatttaaaagagaatggtttcaggatgaggtcaatcacaagctcacatgcctcattgaccctaaggacattccgaaggacttgcctcagctcagatattgggatttcggtgcaagcggagacgctggtgacggaacctctgcaatcttgactagctatgatggagaatatctgtatgttctggatcttgttgcaggaaagttttcaagtcttaaagtattgaaaacatttaagagactttgtaaaaaggacggaaaacaaactcgtgtaatggtcgagcaggagcctggaagtggctcaaaactattgattaagaagtttaggagagaagaggatttaagaggatacaatattcgtgcagataaggttcaggtcagtaaaaaagtcagggcttttgaccttgaaggtcttgcagaggacaggagaatcaagatggttccagcccattggaacaataagttgattgaccagttggtggcatttacaggtgaagatggtggagaggatgatatagtggatactattactggctcttgcaggttctggacaagacctagaagaagagttaaagcgtga

SEQ ID NO: 205 - DNA, 1326 bp, Methanobrevibacter ruminantium
atgagtaagaaacaagaaatgatgagaattgaaaggttaaaacactatgcatatcaaacaggactaataatccctatttttaaaaatcatgatttaattaaaaaaatagaaaatggaaaaataactaatactgacgaaataaagatatatattgaggaaaatgaaaagcagataaaaagaagaagagaatttataagtattatttatgataattgcaaatattttaaatacgacagcatatgttataaattaatatccaaagtaaataattttgaaataaagagcctagaagaattaatgaatgaaatagaaagtgaaaaaaagaaaaatggttttagaaagaacatagaagaaaaagaattaataaaagaaaatgaaaataaaggaaggctaaaagaatatgtgagaattgttaggagagaatatggcttagattttacatcagtaaagaaattaaaattaaaaatcgataataataaaataagaagcaaagaagaattaaatgaagaaataattgaagaaaaaaagaaaactgaattgaggagaattgtttatgatagtgacttaaattgggacttaaaatgggaattagaatccaaaataagacataacgaaataacaactaaagaagaattaataaaagaaataagaagaatagaatttataaatattatttatgataataacagagattttaaattagactatgtcacaatacaaaaattagtatcaaaaataggaagtaacgaaataacaactaaagaggaattaataaaagaaatgactgaagaaaaaaagaaaggcatagaaagaagaacggaatataagaaaattgttaatgaagcgcatgccttagataatacatcacaatggaaattagaattaaaaatcaataatgatgaaataagaaacaaagaagaattaatgaatgaaatagaaagtgaaaaaaagaaaactgaattgaggagaattgttaatgatagtgacttaaatgatacctcacaaagaaaattattatcgaaaatagatgaggatattgaagtaataactaaagaaaaattaaaaaaagaaatacaaaaagaagaaagaataatagaatataagaaaattgttaatgaagcgcatgccttagataatacatcacaatggaaattagaattaaaaatcaataatgatgaaataagaaacaaagaagaattaatgaatgaaatagaaagtgaaaaaaagaaaactgaattgagaagaaaatcagaagaaataataagaagaaaaaaagagcggagcgactcatatcatccaaatgctaataaaccatggaaattttaa

SEQ ID NO: 206 - DNA, 1659 bp, Methanobrevibacter ruminantium
ttgagtaagaatgctaaagcagacgcctttgttgtgaccactgaagacggatcctatgacattgtcgatgcagatgtcttggagaggtatgcaataaagagcgaatctgacgagacaggaagcaagcagttgaagactgatggttgggaatatgatgatacattgcttgagccgttgtatgacccattgcagttgtgtgagctattggagataaacacatatcatgagaactgtgtcgatgttgttgcaagggacagtgcaggaataggatatgacatagttccagttactggagagaaagaaaaggaacttaacaagccaaaattgaccaattttctagaaaacatcgagcctaatatcaatgaattgctgtaccaaatgaactatgacagaagggctactggctacggagccttggaattaatcagaaaagataaatcgaaatcagagcctgttaacctatcccatatatcttcttacactttaagaaggacaagtgatgggaaaagagtaaagcagagagtgggaacaaagacagtatggtttgtaatctatggaaagaactatgacaaggaaggcaatctgtgcgatgtacactctgagacaggagagttccacccttacaattccttaagcaaggaagaaagggcaaacgagctgttgtggactatggaatacaccacaaaaagcaagtactacggattgcctaagatagtgggtgcaattccagccatttatagcgacataagccgttccaagtacaataccagcttcttcaagaactacggaatgccatcattcgcagtcttggtaagtggagacttcgtggactatggccaggaggagttccttgaggacggaacaaagaatcctgaatatgacgttacaaagactctgaagtggaagatttcacagcaattgaagcaggcaataaagaaccctcacagtgcagtaacaatccttgtcccatctgagggagaggaaggtaatgtggagattgaactgaagccgctgagtgtcgagaccaaggaggcgagcttcagactcttcaggcaggataacagggatgaagtaatccatgcacacagggttcctccatacaaggtcggaataaacgagacaggcagtttgggtggaagcaatatagagggagccaccataaactacaagaacgatgtggtgctaccaatcagattcaacgatgagtttctaattaaccaagtgataaagaatgactttaagataaaggactggagattcaagataacggaacatgacacaagggactacaccacagacattgcaataatcaaggaactgttccttatggcttcaatcactccaaggcagatcatcgagaacattggcgaaaggttcggtctgacagcttcagacaatccttttttagatgaatactacttgaacaatgttcctttggagaatgtatggaatggcggtgatgtgccgatggaagcggagacagttcttgacagcttggagaatgacttgatgaaggacgcaggtgttatggatgaacagcttagagagaagagacagactcgtgatgatggcgctcaaggtgcgtcattcaaagaggcagattcagaatatcaagagagaatacagaaggcgtttgatactcgaagagcagtgcagtag

SEQ ID NO: 207 - DNA, 2328 bp, Methanobrevibacter ruminantium
atgatggcgctcaaggtgcgtcattcaaagaggcagattcagaatatcaagagagaatacagaaggcgtttgatactcgaagagcagtgcagtagggagattgcggacttcttcagaaggcttgagaggaaaatccacaaggtcatggatgagcactgggaaagcgaattgggtcttttccatctgaacaaggtttcagacatcatacaggacagcaggcaggagtactatgacatcctgttcaagtactgcaaggactcctacatgaagggaagggaagctaccgaaaggagattcaacagaaaactggaaaacattagcatgaaggcagatgtcaacatcacaagacttgaggacctgttcaagcccgaccctactataaggtacaatctcaacaataaggtctttcaggcttcagcccatacaatggacagggtcgacaataggataatggagaacataacccaaagctatgatgacggattaggcattgatgaggctaaggacaggctgaccgtcgagtacaatggattgaagtcttgggaggcacagaggattgcaaggaccgaaatcaattcagcccagaatgacggtgcctttgacgtctatggagagcttggagttgagtaccatcagtggtggactgcccaggacgaaagagtcagggagacaccgcaggcagaccacagggaacttcacggcaagatagtgaaggtgggcaactcgttcagcaacgggcttcagtatcctggagacaggacaggcaggatagttcactggataaactgccgttgcacaacccttccgttcctcatgcctctcggaaagatggctcctccaggaatgattgagttcaccgaagaggacctgattgacattcctaacttcgagatgcctacaatagatgacctgatgaggagatacgaagctgttgaacccaaatcccagtggatacttgatgactttgaggatttgatcaacctcaatgaagatgaggaaagaaggcttgctgaaatacaggaaatctttaagaggaatgctagagacaatgttcctccatcatatattgtccaaaggcagtatgacgaattcatgcttagaaagaactttgcagagaatcttagaatgcttaaaagaggacagaatccgttcctcaacgagtctgaaaagcagatgttcataaaggattacagcaggttcctaaagcagtacgaaaacgagataagaatgaacaaggaacttcagaaaatgtatccgaaggagttttcaaaggttgcaaaggatgtcgacctgcaattctacagggagaactacaacaatcagttcagcatttaccatcctgatgacatcaggtcatttgaagtaacctccaaaaccttgacttctgaggagagggctaggctgaaggaaatcgagaagctctatcctaaggaatccaagagaatcgcaaaggaaatggacttgaagtattatgagaaaagacatcctgaaagatttggcaggttcatggaggaagaggaaaggaagaggctggcaaaaattgagaggatgtatcctaaggaaacctccaagatggcaaatgaatttgctcctagagatgtcagcaggctgagaaccaaggaggacattgacctgtacgagaaaaacttcatcatgaacaagtcatacaggaagaaagccgatgagattgtgaacggcaatggcatgacaataacaagaaatgtgaagtatgacctgaagggaagatacgaggactacatcaacataactgacgatacgttcgatgttttgaggttcaaggactacaattgcgaaatctggatcagcagcaaaagcgaagtgtccacagtcgaaatcatgcaaactcttgacaagattcctagaaagctcatgaaccaaaaccacaacagaataatattctctgctgacagggatgtctataatctcaagaagaaccatttcgtcggaggagttacaaagagaaaggacaatgaaattgtgatcttcaaatgcaaggaaggaatcctttcacaaaccaaaacccttgctcatgaacttggacatgcttgggacaacaatctgagcaagattgccaatagaggaggagcctactataaggttgccgaagaggaaggaggatttgtaacctcatatgcaagaaagggctttgaagtcttcaagacccattacagcgaagactttgcggaagcaatggaactgtatgtaacaagccctgaaaaactgaggagaaaattcccaaaaagatatgagttcataaagaacatgatggaagacgatttgttcgttttggggctcatcccttattga

SEQ ID NO: 208 - DNA, 291 bp, Methanobrevibacter ruminantium
atggacgcgataaacgttatcaaccaaaacaagatattagtagatgttttgtaccgtgggactgtaaacctgattgacatcgtcatcggtgatgcattggtctatgacaatccgacagttgtagtcaagtgctacaccacagatttggcttttgcaaccacagagattgatgagattgtattagagaacgaagaatttgagttattaataacttacgaggacggagagttctcaattttgttgaagtcccacaatcttggggaattaggatacattgaatgggtaatttag

SEQ ID NO: 209 - DNA, 330 bp, Methanobrevibacter ruminantium
atgggtaatttaggtggttttcgtatggtttttgtcgatttgtgcgagaacgaaatagcagacatggtcgagagcttctatcgcaatggagacggtagcagcaggatattgaccaacagagcagttggagagatagtggagcactactgttcctttgaagtagacggtagaatcaccactaatctccgagatttcctattatatagtgttgtcttatatgacaccattggagaggctgtcgatgacggagtcaaccttgaggaagtgttcatcatagaagacaggaactgctacacagggaagtctcaagtcatattgattggagggtga

SEQ ID NO: 210 - DNA, 567 bp, Methanobrevibacter ruminantium
gtgagaaaagtggtgaattggttgaaggctattggagataacttctcagtggattatctccttttagcattattctctagtggagatttgatattggttgccatcgttctcaattcttatggtgtcatctcacctgagaatgtaagggaactggtgattgactatataagttacaggaaagttgatattttttggagacatctaaggagacctagaatgagttttgaagattatgtcttagacaattttgaagagatggaaactggtgaactcaccagagagcaggttgttgaatttgtctctcgacaagagaggaaaggactcaccttctgcaatgagatcttcattgctgtgcctttgaagaaggggagcaaggacgatatcgttgagatattgtggaatgagtattttgtggaggactataaggagaactggttagagcaacacgagaatcttggttggaatgactggaagaaacttttgaagaaagagatagttgagaatggtggcgatgacttccaaatctttaggaatcacctgattgactgtgtcttaatggagtattga

SEQ ID NO: 211 - DNA, 282 bp, Methanobrevibacter ruminantium
gtggacgaattcgttgagaccctgttcgacacctactggaaggtgaatgagaacggagagtacatgagccttaccgattgcggtgatttctacatcgcaaaggttgctccctgtgttcgcaactggagcatagtgatagaatgcaattgcttctgttttcattgcaaggaatttgtctaccatgagaacggagcaatacttgagataggtatggagattagctctctttacctaagccaaatggagataaaagatttgaagatatacatgatagattgttag

SEQ ID NO: 212 - DNA, 198 bp, Methanobrevibacter ruminantium
atggaatgcccttgcgataattgtgagatgttaagagagaacgaaccaatcaaggtgattgactggaagtccaattctccatttggaatggatttgtatcactttgaggacggcttcagatgttgctataatggtgaggaaagcttgagaaaagaggatctaagcaatcatggttgcagattaagaggaggaatttag

SEQ ID NO: 213 - DNA, 189 bp, Methanobrevibacter ruminantium
atgattgaacggaggagattaggaatgaagtacgatatttttactatcttggatgaaatttcaaggaagttagatgacggtgaattatccgatgagcaggttgatttcctgttgcagatggagattctagtagaggaaggcactatcacagacgagcaggcacaagatgtcatgaatggagattattaa

SEQ ID NO: 214 - DNA, 207 bp, Methanobrevibacter ruminantium
atgtatttggaaattgacgaggtcaagtgcgaaaacattgacagaattgagtttgacgatgtcgcaatggaaatcgtcctgacagacgaaaaggtgtacgagagaataaagagatggctcaagtccaatgagattgactacgattgcagggaagaccggtatttcgccaatctcatagaatatgtcattaggataacttggtggtaa

SEQ ID NO: 215 - DNA, 696 bp, Methanobrevibacter ruminantium
atggtagtcaaatgtcctaattgttttagtccacgtgtttcaaaatgtgaagatactaatattaaatggcaatgtgataaatgcaaatgcaaatttaaccatggtgctttcgatattaatgctgaaatggagaaagtagaacaattaacaatagaaaaaattgaaagagaacgagaaagaactgaacaatttgaaagagctattaaagaagcaaaggaacaatttgaaagagaaagaactgaacaatttgaaagagaaagaaaggaaagactagaaagagaaaagagagaaaaagaaagagaaaagatagaaaaagaaagagaaagaaaggaaagactagaaagaaataggattaaaatagaagaaagagaaagagaaagaataaaaagaaatgaaagaattagaagagagaatgaaagaaataggattaaaagtgataagagagaaagagaaaagagtgaagaaaaaagaataaaaaggaatgaaagaattaggaaagcaaatgaaagaaatagtattaaaagagaaaagagagaaagagaaagagaaagaaacgtgatgactattgatgaatattacaggtcaataggatacgggtcaacaggaaaaagtaaggtatggtcagcaattattattccaatattattggttatatgtattatattgattttaatgttttatggaggaggaatgtga

SEQ ID NO: 216 - DNA, 405 bp, Methanobrevibacter ruminantium
atgatttcgcatatcattgtgcttctcatttgctttataggattggttgaggcgatactgatggcattggttgattgggaggacttggcaatatccgttcgcaagtctcctagaaagctttataatgttttgaaggatgagttaggtcttcctgaatggaacgaactgtctgtgattgaaaggagaagcatgaagaaaaggtatgctgtcataagagattcctttcctgagttgcctccatgggaagaactttccgtcatagacaggagaagccacaagagactctacaaacttatcaaatcagtttatgatggagactatgatgacagtccaagcttggaaggtccaccagcagcagtcggtcctcagaaggagattccattggaagaggcagagtatccttga

SEQ ID NO: 217 - DNA, 3300 bp, Methanobrevibacter ruminantium
ttgccgtcaagcaatgtaatgaacataatagtcaaggcagaggacatggcatcatctgtcgcccaaaaggttgaaaacagcttcaggaaattgggaaacacaatagacagcaccttcaccacatctctttcaaacaccaagttcaatcaggaactcacttcttttggaacagacttggacaaggtaacccaaaggctgaagcaggtaggcgtgaacggtcagtccagcttcaaccagcttacaaatgctgaaaggagaaccttggaaaagctgagcgaatttgatccagtatcagcacaggttcttcagcatctgtcaagaatcggaatcaccggtcagcagacattcaaccaattgtcggtttccgagcagaagtcattgatgaacatgaagtcaaccgctcagcagctggaggaagtaaattccaagctgagagttgtgggaatcggtgcggctcaggcagcgaacatgctgaaccagatgaagcttgacccaagcgttggctccaatctggacagggctaagctgaaggtttccgagatgggctattcccttgacagcacaaaagggaagatacttgtcttgggcacagcaatccagaccagcttgggcaacaagtgggactcaatcaagaccaaggttcagaccacagccacaaacattaggacagcattgggaaatgcactgacttccgtgaagtcaaaggtccagaacttgggaaatgccttcagcggtcttggaggaataatatcctctgcaatcggtgcgataggaatggcttccatctcacagctgactgttggcttggctatgaaccgtgagaggatgactgccttgacaaacgccacaatgggaggcgctaaggcaggagatcagctgctcaacggattcacaggcgtgaacaaggtcttcaaggacttgaatggaaactcaacaaactacttcatgggtcttgacgagatgactaaccacagccttgtctcattggacgatttgggacaggctatgtcaacaatcaagatgtccacaggaatgagcaatgaggaattgatgatgttctcaagcaccgtgaacgatgttggacagagagccattttgatgggaaagagcggtgaggaggcgatttccctcatgcaagcggcaggaagaggtctgaacggcgagtttgacatgctgaagacaaacttcggaatcaccaaggacacccttactgaccttggatggagtggtgccgctgacgatgtcaagggctatcaggaggcattggacaaggctcttgagaagggtggagacatggacggaatgctcgacaccacaacaggacaccttgagacattgaagaagaacttccgtgttgcaggaaggcatgtgggagagatgttcactccatacatagacatggcagtccagaaactgaatggcttgaaggagacatgtcctggcttgtttgagaaccttgtcatgatagcgggtgcagtgagcggatttgccactgtggctccaagcattgctcctatgataagcgtctttggagatgtgggaagtgcgataaagaggacagcaggattcttgggactgatggaggttgcagaggacgcagtaaccttgaagtcaacattcctgacaatagctcagattgcaggcgctgacgcagctgtgcttcagactgccgcaaacagcggtttgactgcaagcttctgggcaatggctgctgcaatcttggctaaccctttgacttgggttgcagttgcacttatagccattgcagtagcagtctatgaggtcggaaagagtttcggatggtggtctgatataggctccatgattggtgctgtttgggcaggaatccaaaggctttggagcgccttcataaacaatcctaacgtgcaaggattcctgaaggacctgtctaacgcatggaatgacatatgcgaggcattggcaccagtcatcgattgggctaggaaggcttgggctgagctgttccctcctagcgccacaggaagctttgacattgtcagggcgataattgacgttttcggacagttgggagacttcttaggcaaggttgtgaatgccgtaaaatctgcttggaacgcattgggaggatttgccggattccttcctatgctgttgggacctgtaggaatggttgtcatggctttgagaatgattgtctgcatacttttaggttgcagtccaggcatagttcctgcattgcagaaaacacagtcagtgttcatgagcgttttcggtgcaattgcagagttcattggaggtgctgtaagcaatgttgtagccattctcacaaggataatatctgcattgacaggaatcttcactcgtgtgagttcaatagtgagcacatatctggctaagatgataagttccgtgatctcttgggcttcatccattgtcagcaaggcaaagagtgcaagttccaagttcctgacaaatgttgtgaattacttcagcaagttgccaagcaaggtctggaaccatctgaagaacatcattcaaaaggttaccagttgggcgacttcaattgtctccaagggaaagaatgctgccagcaagttcctgactgctgtggtgaaccatttcagcaagttgccaggaaaggtcggcacctatgtctccaatactgcaagcaggatttcatccggtgccaacaagtgggtttccaatgctcgaagcaaggcttcaagcacagtgagtgccgttacaggaccaatcagcaagttgccgggaaaggtctacaatgagttcatgggaataggctcacgaatgctgagtgcaggaagcgcacttgtttcaaaggctcgtcagataggaagcaacatagtcagcggactgttgaatgccatgaacattcactctccaggtacaattcagcagaaggttgttgcagaatttgagaacaccctttcacgtgtaggtagcatggattcaactgctcttgatgtcgggcaatccgtaggtaacagcattgtccgtggattcactgatttcggcttggataccggtagcttcaatgcggactattccacagactacaatctcaacaggaaaaatgacgataaccttgacgtgaacataaagcaggaactggaattcgtgtttgacttcaagaatctgcctaatgatgtagatgaggacaagctattggaaatgcttaaggaaatggttaccgacaagagcgtcatacaggctctcgtgagcaatcctgatttccaaagcatggacacaaaggtgaagaacagcataatcgcaaaggtcaagagagcaagaggtgtctag

SEQ ID NO: 218 - DNA, 1518 bp, Methanobrevibacter ruminantium
atggtcgagaagattacagtgagtcctcaggaagtcagaggatacggaaatgttgttgatgagaaggaattggaagattacggaagctacaggtgtgatgtgagcgagagctcggaggtgatcaagggagttgaggaaaggatattcagcgtttctggtgttcctgctcctgctctgagcattgccaatgttactgaggacactcgcaggggcaggtgcgcccacatctccgcctcatttgaggatggggaaggcgatggcttggatgataaggcaatttcccttaaaagcggcgatgatgtccttgcaaccattacaactggaagtggagaaaacgtgtttgatgtggtcctttatgatagcgctcagctctatgctgtctttgatggagatgactattatcctcctgctgtcagcgaagcaatcacagtcaatcctgcaaagtcattatgggatgtcgagttcatccttgacgaggaggagtatgaggttggagacacagccatactgtcagggaccgtcggaacgattgttgacgagattgttgacggagagattgttacccgcaggcaaatggaggcgaatgttacattgactctagtaacggatttaggaataaggcgctgctccaccaatgccaacggagagtttgtgcttcaggtgccgaacattcagcagaaccaatggagagtagtcatagccgccactagcacccatctggtcttcaatggcttgattgatgttcctgtccatgactattccttagtgatttcaggatccgaaaattcaactgccgcctccactatattggtggtcggtctcaccgacttcaacagcatggtagagggagcaacaatatccatcgctggaagcgacggctcatcatacaccgctgtaacggattcgatgggaggagcaacagtgaatgtgggcagactgaacggagccacaacattcactgccacttacggcaatgtctcctcaacggttacggttgtgcctcctttggactggtacgatgcgtcaaactacaccgcaggctcaggcagaatgccttcctcaagggcaagttcaatctatttgcaggctgtgggcggaagatggctcaacaaggagtttactgacagtgagtcatatgtcctcgagttcgaccttatcctgagcaagaacaaccgtgagggtttctacttcggtgcaaaccctaactcaaacacaaactcaggaatctcaatcttcaaggacatctcaaacaccatgattgagacattcgattccacaggcactgcaataaggcttgaaagctcattgtcaggaagctatttcaacacaggcactcatcacataaggattgaaagggactatgatgtagcctacatatactttgacgaggacctgatattcgagtttgatgatgagatattgagctatggtgcggaggatcagatgtacaataccgtcggaatcctatcttggggctcaggcatcatcgagttcggaaactttgagttgagtgattga

SEQ ID NO: 219 - DNA, 687 bp, Methanobrevibacter ruminantium
atggttagattcagcagagacatgctccaggacggagcgaagagaatgttcaagtggctaagaaagggcgaagggttgcctaactacttgataatgtatgacatggacaggaataaggagtataagttggttccaaaggaatatgcaggactgtatgagtccagaaacatattctggattaagaacggaagggagcctaactatgttacactgacttccgttgcaaggaatcctcttgtgatggactaccagaacaccaattacacctgttgcccaaccagtttgtcccttgcctcacaaatgctatatcactataagtcagaaagtgaatgcgctaaggctttgggaactagcaagggcagtggaacaagccctgcacagctgatagccaatgctccgaagttagggttcaagataattcctatcaaaagagacagcaaggaagtgaagaaatacttgaagaaaggtttccctgtaatctgccattggcaagtgaaccagagcaggaactgcaagggagactatactggaaacttcggtcattacggtctcatttgggacatgacctcaacccactatgttgtggcagatcctgccaagggagtcaacaggaagtacaaattcagctgcctcgacaatgctaacaagggctacaggcagaactactatgttgtctgtcctgcatag

SEQ ID NO: 220 - DNA, 261 bp, Methanobrevibacter ruminantium
atggacgatgaaacattaatcctaattgaatacatcagaaacgcgccaacaagagaaatggtgcttaagtcatttgaaggagtggactttataagaccaatccaaatttctaggaaaacaggcattcacccaaacaatgtcagcaagaaattaaaggatcttcgcgaacatgaactggtctatgtcataaatcctgagtaccatgttcctaaactttacaggcttactgaaaagggtaaaaatatgcttcaattcttgtag

SEQ ID NO: 221 - DNA, 684 bp, Methanobrevibacter ruminantium
atgatggatttaatttttgaatatctgattgtttttattttattatttgccacaaatatagcatttttactaagatattctagttttaataaaaataaatttattccatttgttttaggctatgctattatagtatttgcattaacttttgtattttcttccttgaatttacaaaaggaatccatagattttattccgtatattttatttgctgttagtgctttaatgctaattatttcaattcgatatgtgggatttggaaagaattatggaataaatgatgataaagttgttttatatggcactattttatcttcattcttatctattggggcattggctttaggtttaaaatcagataatcttttcttatctggtcttgaattagctattctttctgttgtagttatctttttagtttataaaatctcaaaaatattcaacaatgctaaaagaccatattatgcagtcattggtgaatatatgtttttagaatttattttgcttcttattttagctttaaccttctctagcgtaagagaattggattattcaatgtttggatcttttctaattcttactcctacatataaggtgctatatatgattatagcaattgtcattttgcttgttttaggggttttatataatgattgggttttaaaaaggctaaaaaggaagtaa

SEQ ID NO: 222 - DNA, 2052 bp, Methanobrevibacter ruminantium
atggttgagataaaatatgtaccatctatttgtccttactgtggtaccggctgtggtattaactttgtggtcaaagatggcaaaattattggtgtagaaccttggaaaagacacccagttaatgaaggtaaagtatgtccaaaaggtaactttggataccaattcattaaccacccagacagattaactactccgttaatcaaagaaaacggtgaattcagagaagcttcctgggatgaagctttagatttagtagctagcactcttaaaaaatatgctgacactgatcctaacaaattaggattctacgcatgtgctagatctcctaacgaaaacatttacataacccaaaagttagcaagagctggttgtggaacccaaaacgtagaccactgtgcacgtatctgtcacggtcctactgtagctggtctcgctaccaccttcggttcaggtgcatccaccaacggttatgacagtattgaagaagctgacttcattttctgtatcggttccaacaacatggaagcacacccattattcggacgtaaaatcatcagagctattaaaaacggtgcaaaattagtagtagctgacccaagattcactcctactgcaaaattagctcacgaatacatgcaattcaagaccggtactgacgtagctttaatgaacggtatgatcaaaatcatcattgaaaatggtttacaagatgatgagttcattaaaaacagaaccaaaggctacgaagaaatgaaagaagtagctatgaaatacgaccttgacaaagtagctgaaattaccgaagctgaccctgaacaaattgaacgtgtagctttagaatatgctcaagctgaaaacgcagctattgtatactctttaggtattaccgaacactctcacggtgcagataacgtaatgtccaccgctaacttagctatgttaaccggtaacgtaggtaagattggtggaggagtaaacccattaagaggacaaaacaacgtacaaggtgcttgtgatatgggtgcattaccttctgactatgtcggataccaaaaagttgcaaaccctgaaattaccaaaaaattctcagacgcttatcaaatcgaattaccaaccactcctggtttaaccttagtcgaaatgatgaacgctgctcactctggtgacttaaaagtattatacatccacggtgaagaccctgttctctccgatgcagatattaaacacaccaaagaagcaattgcaaacttagaaatgttaatcgttcaagaattattcatgaccgacaccgctgctgaagcagacgtagtattacctgctgcaggttggggtgaacaagaaggtaccttcacttccggtgaaagaagagttcaatggttacgtaaagctcaagaaccacctgaaggaaccatgcttgactggaagatcatggaagaaattgctgttagaatgggcagaccaagagaattattccactacgaaaacgctgctgaaatttgggaagaaatcagagaactcgctccttcctactacggaattactcacgaaagattactcaaacctgaaggtgtccactggccatgccttgacccagaagatccttgtgaaccattaatgcacaaagacaaattcgcacacccagacggtttaggtgtattccaagcattagaacacagaggtcctgtcgaagttgtagatgatgaatacccattattattaactactacccgtatcttgttccactatcacgctgcaatgaccagaagatgtgaaaccttagataaggaagtacctaccggattcatcgaaatcaacactgaagacgcagcagaaagaggaattcttaacaacgaaatagtaaaagcttactccagaagaggagaaatcgaaattcctgctcgtgtaaccgacgacattaagaaaggtatcgtaaacattcctatgcactttaccgaatgtgcagctaacatgttaactaactccgattctttcgaccctaaatgtaagatggttgaattaaaagcttgtgctattcaagtagaaaaattataa

SEQ ID NO: 223 - DNA, 1209 bp, Methanobrevibacter ruminantium
atggctgtaaatgtaaatgatatgttttatgcatactctggtaatgaagcaattaaagaaaaaggagaatatggtggtgtagtaactaccatcatgaaatacttactcgaagaaggtattgtcgacgctgttgttgctgtagaagaagcagctgacctttacgacgcaaaacctattctcataaccgaccctgaagatgtaatcaaatctgcaggatcccttcactgcggtacattaaacttagcaaaattcgtatccaaatacttagacggtgcaagagatatgaaaattgcagttaccacaaaaccatgtgacgcaatgaccttaaaagagttaatgagaaagagaaaagtaatcgaagaaaacgtaatcatgattggtgtaaactgtggaggaaccatgcctcctgtaccaactatgaaaatgattcgtgacgtatatgaattagaccctgcagatgtcatcaaagaagaaatttccaaaggaaaactcattatggaaaccgctgaaggcgaaaaagcaatttctattgatgaactcgaagaagaaggtatgggtagaagagaaaactgtcaaagatgtaccatgaacatcccaaccaacgctgatttagctttaggtaactggggagttatcggtgaattagcaggaaaagcaacctttgtagaagtttgctctgaaaaaggtgcagacatcttagataaagttattgaagctggtttaattgaaacccaagaaccaatcgaaaaaggtgtaacaatccgtgctaacatcgacggaatcatggttaaacaagcaatggcacaaagagaaaaagactttgctggaacctccggtgacattttagaagtatttgcagaatacaaagaagaattctccaaatgtatgaaatgttacggttgccgtgaagcatgtcctctctgtttctgtgacgactgctgtcttgaagctgaaggtcctgaatgggtacctggcggatacactcctgcagctccattcttccacttaacccgtatggtacacatggttgacgcatgtactaactgtggtcaatgttctgaagtatgtccttgtgaaattccagtatccaaagtatgggctactgtaaaccaaaaggtcagagacatcttcggttactacagtggtgtagacaacgaagaaccattaccattcactgaatttggtcctaaatcatacagacaatactaa

SEQ ID NO: 224 - DNA, 708 bp, Methanobrevibacter ruminantium
atgagaattatttcaattgtaggcttaaaaaatacaggaaagacttcacttacaagcaagataatcaaggaattgaccaatagggaatttaaggtagcaagcataaagcattctcatcaccaaatggaaatggatcatgagggtacagacacctacaagcaaatggagtcaggctctgattttgttgtgggaattggaggccgcacctatttcaatatcaatgaaagacttgacttggaacgtattctattcttaataaagcttattgaaaatcctgattttgtggttatagagggattcaagagctatccttatgcaaagatagcaacctgcaaagaggtggaagacgaatacacaatcaaaacagtaaattcatttgaaataacagatgaagagcttctagatcttgtagaccttatagaagaaaggtcctatgacatcctagatacattattcgttagtgactgtggctataatgatgcaagtataataggtcaggcatttgcacaaggaaaactggattataatcccgatactcaagcggaagttaatttagccatcgatggaatcaatatagggctaaataagtttgtaagcaattatattaagcaaactgtattgggcatattgaatccacttaaaatcaaggaatatggtgtggaagactttgagaatattgacctaacaataaaaaacaaaaaggattaa

SEQ ID NO: 225 - DNA, 186 bp, Methanobrevibacter ruminantium
atggcttgtaatgatgattttgaaaacaatgtgactttagcaatcaatggcaatgatattgaattaaacaaatttacagatgatattattaaagaaaccattcttggattattgaaagctattaaaacttctgaatatggtgtagatgaagttaaggatgttgaaataacaataaagaatgaatag

SEQ ID NO: 226 - DNA, 936 bp, Methanobrevibacter ruminantium
atgaaggataaagttagagacgattatgaaaggccaattatttcacttaggatttctataaccaatcgttgcaatgtcaattgcatatactgccaccacgatggcatgctggactcatcttctgaaatgactcctgatgaaatatacgagatctgcagaattgcaaagaaattaggtgttgaaaagatacgcctatctggaggcgaaccacttgttcgccctgacatagttgaaattgtagagaaggtcaactcacttgactttcgtgacatttcaatcacaagcaatggaatatttttagacaaattagcaggtcctctaaaggatgcaggattagacagaatcaatgtcagtttagacacacttgatgaagaaacctataaaatgattgtggggaaaaacgttttagagagagtaaagaaaggaatcattgaatcttgtgcagttggtatgtatccagttaagataaacatggtagttatgaacaatatcaacaatgatgagattatggacatgtttgaattcaccaagaaacatggtgttatccttcagcttattgaaataattgagtctgaaagctgtgatgacaatgacttcaattccaagtatcactatcctttagctgaatttgaaaagcatcttgctgaaattgcagatgagataaaggttagggagtttatgcaggataggaaaaaatatttcattgacggcggagagatagaggttgttcaccctgttgacaataccaatttctgcaagaactgtacaagacttagaattactcccgagggaaagatcaagccttgccttcttagaaatgataatcttgtaaatcttattgaatttattagagaaggagcctctgatgaggagctcattgacatattcttaaagggaattcataatagggaacctttttataaggaagaaaattag

SEQ ID NO: 227 - DNA, 6930 bp, Methanobrevibacter ruminantium
atgaaaatccaaagaggtatatatataatattaactttacttgttctctttagcctttctgctgcaagcgcagcagacgatcttacagatgatattattagtgctgatgagaatgaagaacttattttagatgaaacagtcattgatgacgtttcaaatgcaaatgacaactatgatgaagaacttattaaagcaaatgatgaaaaatttgtatatgctggaaatgattcagatgaattaagggaggatccagggacatattccgggctatctagcgagattggcgctggaggaaatattgtattgacacacgattactatacttatgatagtggcgatacaatcataatatcaattagcaatagtgttattgatggtaatggtgcgattatagatatggccggatcaactattcgagcatttaaagtaactgcttccggtgtaacaattaaaaacctaaccattaaaaacgccaatgtaactacagatgatctaggcaatacagatgatgagggcgctgcgattgactttgaaaagtccggtaccattgaatattgtaattttattaataactctgcaaacgctgccggtgcagtatacttttataaagataacagcaaagcaataaattgtaatttcagctataaccaagcggtatactctggtggtgcagtttgctttgaggaaagtggtactatagaaaattgtacttttgtcaataacactgctgtttatgatattttaggaggaggcggtgctgtttgctttaatggtacaggtaatgcgataaattgtaactttaccaataacaccgctcaagggtatttttcatgggctggtgcaatttgctttaatacaaatggtaatgcgataaattgtactttcactaataataaggctcatgactctggaggtgcaattgagatttatggcaatggtaaattggaaaattgcagttttgataagaattctgccaacgatggtggtgcagtcaagatttatggagctactaagatatcaaattgtaattttactgaaaacaaagcagcagaactttcaggtgatggcggcgctatctattggaatgccagcgctggcaaattagaaaattgcagttttgctaaaaactcagcttttcacggaggtgcagtttcctttgaggaagatggcgaagtaacaaattgtaattttactgataacctagcaggagacagcggtgcaatttggtttacagcggatggtactgtagaaaattccacttttattaagaatgaagcatgggatgagtatggcggcggaattgtcttttatacctccggggatgtaagaaattgtaatttcactgataatgaggctgataagcaaggtggtgcagtttactttaatggagcaggtactgtagaaaattctaatttcaccaataataaagcacaggatggcggtgcaatcttcttttcagaggacagtactgtaaaaaactgtatttttgttaagaattgcgctactgatatacgttctgataggtattttgagaggtgcaaatatgtattttataagaatggtgaagtaacaaattccagctttactgaaaacaatgctactgaaggtggcgcaattttatttaagggcaatggtaaagcaacagattgtaattttaccaataactctgctaaatttggtggtgctattgactttgagagccatgccactgtagaaaattctagctttaacggtaacaaagcatcctctaacggcagtgccatctggatgaatcgtgcgggaggcattgtttccagcagtgtttttgtgaataaccgcgctaataccggtaccatatttttcagaaatgataattccacttcccatttgacaatcaatgataatattttcctgaataataatggtgttgcaatctattttgataaaaatgattctgattccaatacagattacaactggtttggaaacaatgcaacaaattatgatatagcaccagtagctaataatgctgaaataaatacttggcttttcctgaatacaactgtaaatccggatatgatttctattttagattcattagacatcgcgtttaaattatatgcttacactccttctgaagtatcagaatatgacaacatccgtttgaaagctgtcgacttgacattaactccaacaaatggaatattcaatactaccaagacggagcttggaaaaactgttcagtacattccagagagtgatggaatcggaacactaacagcatcaatagaaaatgcctcctacactacaacattaaaaatcacagatggaacaacattctttgacttagattatatcataaacgccaataataataacactattgttttggatagagattacacttataactcaacattcgactataattttacagatggaatagtcattgatcgtcctgtgacaattatcggaaatggacatacaataaatgctgctgaaatggtcagaatattccatattcaagcagacaatgtaaaaatcaaaaacattacattcacaaatgccatctcaaacggatacggtggcgctatctactggcaaggagccaatgctaatctttccagttgtctttttgaaaataatagtgctgtaatggctggtgctgtagcgttctatggaagcactggcagtattgtttctgattgcagtttcatgaataattccgccaataatggtggtgcaatcatgtggcaagtcagtgatgacagcgttgtttctgattgcagtttcatgaataattctgccatacagggcggtgctatctattggagcagtaatgatggtgttgtttctgattgcagttttgtgaataattccgctgtgcgtaatggtggagcaatatattgggaaaaaaataatggtaatgtttccggctgtatttttgtgaataacagtgctgataacggtgccatctatttcaataatcaaaactttggtcaaaatttaacaatcaatcataatattttcctgaacaatgatgccgttgcaatctattttgtgagaaatgattccgcttccaatgcagattacaactggtttggaaataatgcaactaattgcgatatagcgccaacaagcaataatatggaaatgaatacttggctgttcttgaatgctacatcagaaccggaaggaatttctattcttgattcatgcgacattatatttaaattatatgcttatgctccttctggagtatcagaatatgatagcagccgtttgaaagagattaacttaacagtgactccaactaacggaaggatcaatactacccaagccaaactgggagaaaaggttcactacactccagagagtgccgaatgcatgctaacagcatcaatagaaaatgccttctacactacaagattaaaaatctcagatggaacaacattccgtgacttgaacaatctcataaaccgcaacgataatgacactattattttggataatgatttcatctataactcactttttgacagtaaatttaaaaatggaataaatattaatcgacctttgacaattgttggaaataattataccatagatgctaccggaatggcaagaatattccgtattcaagcagatgatgtagaaatcaataacattacattcgctaatgctaaaatagacggcaatggtggtgctatctattggtattccggcgctagaggtattgtttctgattgcagttttgtaaataattcagctaagatgtatggagctgctatctattggaatggtgctaatggtaatgtttctgattgcagttttgtgaatagcactgttactgatgaacatggtggtgctatctattggcacggtgccaatggagttgtttctgattgcagttttgtgaacaattctgctaagaaatatggtggtgctatcttttggaacgctgccaatggagttgtttctgattgtatctttgtgaacaattctgctaagagctatgatggtggtgctatagtatggaatgaaggtttgaacggtgctatttctgattgcagttttgtgaataattccgccaatgatggtggtgccatcttatggaatgaagctgctggcggtactgtttctaattgtagttttgtaaataattcagctaataagagtggtgctgctatctattgggattccggtgctaggggtgttgtttctgattgcagttttgtaaataattcagctaataggagtggcgctctatactggtttgctaatgatggtgttgtttctgcttctatttttgtgaataacagtggcgataatggtgttttatacttcaataatacaaataagcgaaatttatcaatcaatgacaatattttcctgaataatgatgtcgttgcaatatattttgttaatagtgattccacttccaatgcagattacaactggttcggaaataatgcaagcaattttgatactgaaccattaactactaacgtggaaattagtacttggctcttcttgaatgctacagcagatccaaatccagttgaaattttaaattcatcagatatctcatttaagctatattcatataacgctacaggaatatctgattatgacaatagccagttacagcctgttaatttaacattgactgcaactaagggtgatgtcgatagcattgctaaattaggggaaactgtcatatacaatccaactagtttaggaactggaagcgtaactgcaaaagttgaaaacgtcgcatattctattgaaataaacaatataaaatcaaatccaaacctatcagttgaatccgatgaacttacatacggcaacaacatagcaattgctcttaattatgagtctgctgctaccggcaaagtcaatataacattaaaaggcaaaaaatcagattatacatttgcagatttggatttaaatgaaacaatttcacttggaattcttgctgctgatgaatatgaggtcattgttgaatattccagagatgagatttataccaatgcaagcgcaaggggaactttaaaggtcaataaagccaattcaacattgacagtcagtgatattgaatttgattataaggatatgggatctggtgaaatatcattcactaacgcaactggtgttgaggccaaagtaataaatcatgatgaagccattgttttcgttagaggaaatactataactgtattaaatttaagtgcagacagctatatattggaagtaacaactattactgatgaaaatcacaatgaggtaagcaagaatgcaacaataacagttagaaaagtcaattctaccattaatgttaatgatattgtcctttattatggcgaatccatcaaccttgctgtaacaactgatggtgctattggaatatctgctgatatcgatggcgagaacgttgagcttaatgaaaacatcgttacaattccagatgatttggaatctggaaatcacacattgaccataacaacagttcctaatgacaaccataaggaagcaagcaaaaccgttaatattgttgattgcaggattggcaatatcactgttgttgttgatggcgttgaatattctattcctgctgtaaatggcactgccattacaaccaatatgccggaggagattgaaaagcttaaagaaaatattactgatttaactggtcaattggaagaagcacaaacaaacgcaactaacctggctaacaatctaacaattgctaatcaaatagttgataaattaatcgcccaattggaagaagcacaagccaatgctactcaaacaatcaatgatttaactcatcaattgaatgaagcccaaaccaatgcaactaaaatagctaacgaccaaacaaatgctaatcaaatagtagacaatctaactggccaattaaatgatgcccaaaccaatgcaactaaaatagctaacgacctagaaaatgctaatcaaatagttgatgatttaactcgccaattagaagaagcacaagccaataatgatcaaaccatcaatgatttaactcatcaattggaagaagctaaagttaatgcaactaaaatagctaacgacctagaaaatgccaatcaaacagttgacaatctaacaacccaattggaagaagctaaagttaatgcaactaaaatagctaacgacctagaaaatgctaatcaaatagttgacaatttaactgaccaattagaagaagccttggctaatgctactaaaatcgaaactgttgttgtcgatggtaaagaataccctatagaatatgtgaacggcactgcaacagtaactaccaattctacaggtcctcaaaacataactcatgagagaaaagccacccaaatcatttataaggatatggaaacaactgctatcgacactaaagttgatggacgtatcggcaaatacttcaatgtcattctcaaggacagtgagggtaatattttagcgaataaacctattcaaattggattcaatggtaaggtctataataggacaactgatgaaaatggatctgctaaattacaaatcaacctcatcaaagcagacatttacacatttgctatatgctacctcggcgatgatgattataacggttctttcgttgtatcaaaaatcaccgtaaaagcgcaaaaaggcactctaaccgttccaaacaaatcttacaaagcaactacaaaaaccaaaactttaagtgcaacattcaaggcagcaagtggtaaagtacttgccaataagaaagtttcattcgttgtgaatggaaaaacttattctgctaagaccaacgccaaaggtgttgctactgtaaacgtcagtttgaataagaaaggaacatatagcttcgttgccaaattcgctggagacaatacatacgctgcagtaagcaaaaaagcaaaattaacaataaaataa

SEQ ID NO: 228 - DNA, 303 bp, Methanobrevibacter ruminantium
atggtcaaggaaatacttatggacccagatgatattatagaatatgtaagaaatgaagtaaaagttgatgatatttttgaattgtcttataatagggtgtttgctccaggaactgtgcttggaatcactcctgaagatgaggaaaccggtgaaggattgattctttctcttcagcttaatggtgaactcttgaatcaggcagtagacattgatttgcatgcagttaaggatgaaatcattgaagcacgtcatttgcctggtggagatgaggataaattgattgtcattgaagctacattgtag

SEQ ID NO: 229 - DNA, 303 bp, Methanobrevibacter ruminantium
atggtcgataaggaattaacaatgacttctgatgaagttctagattatattaaaaataattttaaagaatttgataaagtggatattgcatacaatcgtgtttctgcaaaaggagacatattaggtgtggatctttctgattataaaggaaaaccaagttgcagagtgatgatagctttagatggtgaaatcatttccgataccattgaagtggactttgaggagtataaggaagacattattgaattgcatcactggcctaaagacgaatcaaaggaatctgtttatattgaggtaatttag

SEQ ID NO: 230 - DNA, 1038 bp, Methanobrevibacter ruminantium
atgagtgaaaaattcttaaaagtaaatatccaaaaggaacttaaagaatttgaattagatattgattttaagttaaataaaggatgtttaggcattctcggcccttcaggatgcggtaaaagcatgaccttaaaatccattgcagggattgtaaatccagacaccggaatcattagcctaaagatggatgaggaaaacatatattttgattcagaaaaaaagatcaatctaaagcctcaaaaaagaaacgtaggctacctgtttcaaaactatgccctatttcccaatatgactgttgaggaaaacatcggaatcggtgtatccaaagagaaaagggaaaaaacagtatctgaaatgataaagagattccatcttgaaggacttgaaaagagatatcccagacaattatccggaggccagcagcaaagggttgcattagctagaatattggcctatggacctgatgttatcctattggacgagccattcagcgccatggacaccttcctaaaggaacaattgcgtatagaacttgttaattcattaaaggactttgacggattttcagttctagtaacccacgaccgtgacgaggcattccagttctgcgatgagcttatcatattggataaaggaaaaatcattgcaaagggggaaactcatgaaatctttgaaaatcctaaaaaactcgatgttgccagacttacaggatgcaagaacacatctagaattgaaattatagatgattatcatctcaaatccctagactggggactgacattggaagtctctgaaaaaatctcaccaaacataacccatattggaataagagcgcatgactttgctccagccaaaaaagatgaagtaaattcatttgacactgaaaattcaagcctattggaaatgcctttcgaatgggagataactttagcaaacggcttatggtggaaacgtgaaaagcaaatccgcgagcatgagtttgtagttccagaccatataaaagtagatcctaaaaatacaatattgctggaagaatag

SEQ ID NO: 231 - DNA, 1695 bp, Methanobrevibacter ruminantium
atgtcagagtccgaacatagaatgatagaaatcctaagaatcttaaacacccatgaaaagccaataggctcaaaggtaatagcagacgaacttaagaccaaaggatacaaccttggcgagcgtgcagtccgctatcatatgcaaattcttgatgaaaagggatatacagaaaaacaaggatactctggcagagttatcaccgagcttggaaaaagcaaactggaaaagggcctaatctacgaccaggtagacttcacactgtccaaattcaaggaaagaatctatctcaccgactttgactataagaaaaaggaaggaaatgtaatagtaaacacttcaaacatccttgaaaataaggcattcgacataattaaggaagtatttgcagcaggagtctgcgtaagcccactgataaatgccaaaaagactgaaatcaacggcaaaaagggatatgtgatgaaaaccatctgtggtacaaccatagatggagtcttcttaaagaacggaatcccttcaatcccacaatatggcgggcttgtagatattgaggattactatccaaccaagttttcagagcttatctcctataggaaaacctccatcactccattggatgcattcatagcaaaaggaatgacctctgtccttgaagttgcggagcatggtaccggaacaattcctgcaaacttcagaataattccagaaagtggtctagaaaaagctaaagaaatcttcgaaaagcttgaaaaagcaggaattggaggaatccttgaaatcggagaaatcagcgaaaacattttaggaattccagttccagaaggaatggttggaatatccataattggaggaatcaccccattctgcgcagctcaagagatgaactataaggtggatataaagacaggtgaggaattcataaactacaataagctaaaagagcttgaatcctccaagcataagataaagcatgctaaaaaggtggattacaagaaaacaccattcatacttaccaaatcattaaacagagtgaatcaggtcgattatgacattgaaacaggtcatggaaacatagtgtccaacatttcatacctccagaaggaagatcttgacgatgcaataagcattatgaaaaagacatacaaggcacttccaaaatacatgaattcccatttcagcatagttgaccatccagatgacaaaagcaaagtgggaatagctacagtctgcagccttagcattgatggaatcctaatcaaaaacggaataatgagcacaccacaatacggaggacttttagagcttggaaagccacctttatttgttgaaatgatttcatacaacgggtcatcaatcgatccacataagatattcatctttaaagatttgacccaaatagccaaacgaaaaaaccctaagaaaatccttgcatcaatcaaagaggtcccatacatcgcaaggcctgaaacagaggaaatattggagaagataagcaaagaaggattttccatatttaaagtaggaaaaccaagagaattagtctataatgcaaaggtagataattataactttggaatagttacaggaagcggattgaatttaattgctgcaatcaaggaaaaaggaataaatattgaagcaaaagccgttgaaactgtcttaccaatagaagacatgagcctgatttatgagcaataa

SEQ ID NO: 232 - DNA, 1347 bp, Methanobrevibacter ruminantium
atggaaaaaagaattcaaaatattatggaaagaatgaaagcagacaatatcaagtttattagactccaatttgttgatttacatggaattccaaagaatgtgtcaattccttgtgaattggacaatatggaagacttattcactgatggaatcctatttgacggatcatccatccctggttttgttggaatcgaaggaagcgacctcgtcttaaagccagatatcagcacttattcacccctttcatggagacctgaagagtctgcatcctgcagattcatatgtgacatctataatcctaacggagagccatttgaaggggacccaagaggaatccttaaaaaagctttagcaaaaatcaaggaagaaggctacacctacaacataggacctgaacctgaattcttcattgtagacacagacgatgacggatacccaattcctcacgatactgcaggatactttgatgtagagcctgtagataagggaactgacttcagaagagaaatcactaccaatttacaggaattaggctttgaagtagaagcaagccaccacgaagtgggttccttggccaaaacgaaatcgcattcaagttccgatgatgcattaaaaactgcagatgcagtgattacattcaagcaagcaatcaaagcgattgtggcaaatatggctgatttcgatggattcgactacagagtgactttcatgcctaagccattctttggagaaagcggaagtggaatgcactgtcaccaaagtctattcaaggatggtgaaaacatcttctatgatgaaaacagtgaaactggattgtcccaagaagctatgtggtttattggtggattgttaaaacactctgcagcaataaccgcagtgaccaaccctatcgtaaactcatacaaaagattggttccaggatatgaggctccagtttacatcacttatggtattcaaaacaggtcaaccttaataagagtgcctgcagcacgtggaaaagccacccgtattgaatacagaagcccagaccctacctgcaacccttaccttgcatttgcagtaatgcttgaggcaggtatggatggaataaaaaacaaaatcgacccgggagaatctgttgagatcaacatttatgaattgaccgatgaagaaagggaagagaaaggcatagaattgctcccttccagtctatgggaagcataccacacctttgaagaaagtgaaatcatgaaagaagctcttggagaacatatattcaatgcattcttatctgcaaagtatgaagaatgggatgaatacagagtccaagtgttcaattacgaacataagaaatacttaaattactaa

SEQ ID NO: 233 - DNA, 12564 bp, Methanobrevibacter ruminantium
atgaatgataaaacaaatgattttttcagtgaatatttatcaggattatgtctggattttgatgaatccactttaattgctccaaataagaatggagaaaaggaaaaatgcataattgaaaagtcagaatatgaaattaaaaaagataatttagttggatttgcaaagtccaattcaatttcaatcaatgagcttatattggcaagtttaactttaacacttaataaattcaatttttcaaatgaaaccttaattttcaatcaaaataatgttccatttgctgctaaatttgaaaacagacaaatttcaattagggaatttttagaaaaaattcatgagaattatattaaaacattggaattcgatgagtattttgataaggatgaccttcctttaaatccggaattttattttacgttcgatgaggatttaaaatcagatgcagaatattccaattatctaagcattgttgaaaatgatgaaactgtttctctctttttatcttataatgatgaattatatacaaaggagttcatcaatctattcatatcaagccttgaaaaaatccttgaagaaatagccacttcggatattgataagacaaatatctgcgacattgctattgtaggtgaaaatgaagatctcatcttcactgaagttgaaatgcctttgattcacaggcgttttgaaaagcaggctgtggagaagggggatgagattgctcttgttgcaagcgatgccacattgacttacaagcaattggatgaaaaggcaaatgtcattgcaaatgcattgatagctaagggagtcaagccgaaaagcaatgtcttagttatgctttcaagggatagcaatctgattgcttccattttaggtatccttaaggcaggctgcgcattcattccaatcgatcctgaataccctcaagagagaataaactacatctatgaaaacagtcaggcagattatattattgccaacgaatctggagaaaagtctttagacattgaagagttgcttaaggatggcaattcagatgatcctgagcttgatgttgacccggatgatttggcctatatgatctacacttcagggtccacaggaaatccgaaaggtgtaatgatcagccacaaaaacatctgcaatcaggcttcaaatccaaaatccacttatgaaagtttgctttgcattacaaccatctcttttgacgtgtctgttgacgacatattgacatccctttcaaatggattgaaattggtacttgctgatgatgttcaaatcaaaaatattccagctctaatcaagttaattgatgaaaacaagcctgaaattttagaaattactccttcaagaatggggtcttatcttgaggtaaaggaattctgcaatgtcatatcctgctttaagtgtattttcattggaggagagaaattttcatcaaaagtttatgaagatttaagaaaatatagtgatgctgtcgtctataacagttacggcccaacagaaacaacaatcacctcaaacaacaaggcggttactgatgtaaacgatttgactgtggggcttcctcatattaattatgtcaccgatgttcgtgacattgacggcaaattggtccctgatggtgtaatgggtgaactgtacattggaggtaccggtgtaggaaaaggatactacaacatgccagaaaaaactgcagaagtgttcctgaccatcaataacattccatattacagaagcggagactatgcaattaagcttccaaatggcgaaatcgacattaagggaagaattgacaaccaaatcaaactcagaggattaagaatagaaatcggcgaaatcgagtctaacgttggcaaatatccaaatatcaaacaggctgtagttgtaattaaagagattaacgataatgaacatctatgcgcttattacactgccgatgaagagattgatagtgatgatttaaaagagtttttaaaagaccgccttactcgttatatggttcctactgtcttcatgcagcttgatgagatgccacaaacaccaaacggcaagacagacttgaaacaactgccagtgccacagcttaaattgtcatttacccttccagagagtgaaactgaaataatcttgcatgaaattgcttcatcaatcagcaaaacaaaggaattcggtactaccgatgatttgtatgctattggatttacttcattgacactgatgaaattaaatgcaaggatttatgaggaaatgggtgttaatttagatattatttcattattgaatgatcctacaattaaaaatattgcaaaggaaatagaaaacaatgatattctggacttgaatggtgtaatagaatcatctaaggatatggtttattatccattgacagaaaatcaaatgggaatctattatgagtgcattcaaagcggcgagcttgcacaatataatctcccatcagtaataagatttggcagtgaaattgatgctgacagattacatgacgctatcatcaagacaattgaggcatatccttatcttaaaaccagaattgttctagaaaaaggtaaagtgatgcttaaacgtgatgattcaatagatattgatgatattccaattattaatgttgatagtatttccgatgagcaaatcgaaaaggaaaatctaaagctatttgatttgcataatgaccagttattcagatttaaaatctataagactcctagcgaaacaattttattctcagatgtccaccatatcatttccgatggtgaatccttagataagctctttacaaatatttccaatgcatatcaaggaattgaaattgaaaaggaaacaatcaacggttacattaacagcataattgaaagtgagaatgagaacagtgaaaaatatgaactgtctagaaagttcttccaggataagttaactcaagaaattgattccactgtactcactccaaatctcaacggcaattttgaagagggaattttaaaatcaatttccaaaaatatcgactccgaattggtcaacaggttttgcagtgaaaacaggataacccctaatgttttattcatggcagtaaccatgctcaacctaaacaagtacacattcaatgacaaaactttgattacaaccattttcaatggaaggtcaaactcatcctacatcaacacacaggcattgctggttaaaacccttccgattgtttcaatcaatgatgataggacattgtcatttaaggaatatttaagttcagtcaatgacatctggatggaaaccatcaatcattctgattatccttatactaagatctctgaagagtttggattgaaaccagagtttttctatgcctacaataatcttgatgctgaagaaattgcaattgatggcaagacttataaagtcaaatatttgaaatcacttgaagtcaattataagatatctttggaagttaatgagacttgggacaatattgaattattccttgagtacaatgaccaattgtatagcgcagattacattgacaccttcttaaattgcatcatcgatgtaataaatcaattaattgaatcggatattgaagaattaagcattggtgaaatagaattgggtaaaggtatagagacacccttatcatttacacctgttgatatgcctattttacataagcgatttgaaaaacaggtaactgataaaggtgatgaaaccgctcttgttgcaagtgatgccacattgacttacaggcaattggatgaaaaggcaaatgtcattgcaaatgctttgattaaaagaggagtcaagccgaaaagcaatgttttagtgatgctttcaagggacagcaatctgattgcttctattttgggaatccttaaggcaggctgtgcattcatcccaatcgatccagaatatcctcaagagagaataaactacatttatgaaaacagccaagcggattatattattgctaacgaatctggagaaaagtctttagacattgaagagctgcttaaggaaggcgattttgaaaatcctgatgttgatgttggccctgatgatttggtctatatgatttacacttcaggatccactggtaatccgaagggtgtaatgattagccatgaaaatatctgcaatcaggtttcaaaccctaaatcctcttatgatagtcttctttgcattacaaccatatcttttgacgtgtctgttgacgacatattgacatctctttcaaatggattgaaactgatacttgctgatgatgttcaaatcaaaaatattcctgctttgattaggttaattgatgagaataagcctgaaattttggatagtactccttcaagacttgcctcctatcttgaggtaaaggaattctgcaatgtcatatcctgcttaaagtgcattttcatcggaggggagaaattttcagcaaaagtctatgaagatttaagaaaatatagtgatgctgtcgtctataacagttacggtccaacagaaacaacaatcacctcaaacaacaaggcggttactgatgtaaacgatttgactgtggggcttcctcatattaattatgtcactgatgttcgtgacattgacggcaaattgcttcctaatggtgtaatgggtgaattatacattggaggtaccggtgttggaaaaggatactataacttgcctgaaaaaacccaagaggtgtttttgactatcgatggcattccatattacagaagcggagactatgcaatccaacttccaaatggcgaaatcgacattaagggaagaattgacaaccaaatcaaactcagaggattaagaatagaaatcggcgaaattgaaaccaatattggccaatatcctgatataaggcaagctgttgttgtaattaaggaaatcaacaacaacgaccatttatgtgcttattacactgccgatgaagagatcgatactgagaatctaaaagagtttttaaaagatcgcctcactcgttatatggttccgactgtgtttatgcagcttgatgagatgcctcaaaccccaaacggcaagacagacttgaaacagctccctgaacctcagcttaagttggctttggtgatgcctgagagtgaaactgaagaaagattatatgatattgtctcatctcttgtggatgctgatgagtttggtattacagatgacttatatgccattggatttacctctttgacattaatgaaattaaattccatagtctatgagcaaatgggggcgaatttagacatttccatattattcaatgagccaacagttaaaaactttgcaatagaaattgacaattcctttgaaaaggattctggccttgaagagcttatagaatcagctaaaggcttggaatattatccgttgactgaaaatcaattagggatttactatgaatgtatgcaaaatccggatgtgattaagtatacgatgcctacaacagtaagatttgacagtgatcttgatgcaaatagacttaaacaggcagtcattgacactattgaagcacatccatatattaaaacaagaattgtaaataatgatggtgaattaaggcagaaaagatgtgatgatgtggcaatcgacgatattgaaattgttaaagtcgatagcattagcgatgaggacattgtccgaaatgatgtgggtccgatttctatagaggacagtcaattgttcaaattcaaaatatatgaaacccctgatgagattgtcttattctcagatttccatcatataatcactgatggagtatcccaaaacaatttatttagagatatagccgatatctatgaaaatagagaaatatccgaagagataatcgatggatatatctacagtcttttggaaaaagaagccgaaaacagtgaaatatatcaatctgcagaggcatttttcgatgataagttaactcaaggaatagaatccactgttctgactccagaccttaatggaaatcctgatgagggtaaaataaaaaatctttcctatgcttttgattcagaattgattaatgagttctgcaatgataattccataagcaaaaatgccttgtttatggcaggcacaattttaaacctgaacaaattcacattctctgataagacattgataacaacaatattcaatggaaggtcaagtccaagctatttcaatactcaaggatttttggtaaaaaccgttccgtttattatcaataatgaaaacaggcaggcatcacttagggatttcattaaatccattgaccaaagctggaaagataccttgacaaacagtgcatatccatatattaagatagctgagaaatatcaattaaaacctgaattcttctatgcttatcatgaattcctagagtctgatgaaatgatgataaatggcaaggagtacattccacaagaattagctggggttgatatggttacagttgaatccaaaatcaatctagctgtttatgataatggtgatgagtttaatcttattttggaatataacgaccagctctacagtgaagattatgttaaaacattcatagaatccctgaagagcattttagttcaattccttgaaaatgatatggacaattatagaatctgtgatgtaaaattaaaggatgatgaggaagtgcatgaatttgttgatgtggaaattccatttatccataagcgttttgaaaagcaagttgatgaggctcccgaaaagattgcattaattgcaagcgatggctcatggacctatggtgaacttaaccaaaaggcaaatcgtgttgccaatgctcttataaacaagggaatcaaagccaacagcaatgtcttggtaatgcttccaagggacagcaatctcatttcagctattttaggtgtcttaaaggcaggctgtgcattcatacctattgatattaactatcctaggggcagaatcgattatatttttgaaaacagtcaggcagattatcttatagcagataggggaattgaaaattcaattgacattaatgaattgctccaagaggagaatgcctcaaatcctcaagtggaaattgatccagatgatttggcttatatgatttacacttcaggttctacaggtaatcctaagggagtaatgaccagccatatgaatattacaaacttattctccaaagatgagggtagtgtaatttataatgcatattcaaaaatgaaaaggactcttgccctttcaacagtatcttttgatgcatttctgcttgatttcatgccattgaccttcggtttggaagtggtgctggctaacgatagtgaaataaagaatattaaggaattggctgaattggttaaaagagaaaaaccggattcacttacattttccgcaccatcaaggtttaagcaatatctggaatatgaggaattcgccaaacaagtacctgacttcaggtatattggtcttggtggagagatggtacctcaagacctaatttcacgacttttagagtatcctaatttagaattgtataatatttacggcccgactgaaacaacagtgacatgcaatacccataagcttagtgatgcggagaatataactgttggaagggccctccacaattgcataactgaagtcagggatattgatggaaaactggttcctaatggagtgatgggagaattatacatcggaggtaaaggagtatctagaggatattacaatatggaagaaaaaaccaaggaagtattcctatctattaatgatattccatattatagaagcggtgactatgcaattgaacttccaaatggtgatttagtaattaaaggaagaatcgacaatcagattaagttaaggggattgaggatagagcttggtgaaatcgaatccaatattgccagattcccacatatgaagcagattgtagttgtgattaaggaaatcaataatgctgaacatttatgcgcttatttcacagctgatgaagagatagacataaagctcttgaaaaggtatctgggaaataagctgactgaatatatggttccaaccgtatttatgcagcttgatgagatgccaatatctccaaatggcaagacagacattaagagacttccaaagccaaaattaaatctggattatgttgaagctgaaggggaaactgaagaaaagttagttgaacttgtttcatccattgccaatacaactaacttcggcacaacagacaatctatatgaattgggcttctcttccttaacattaatgaaattgaactcaatgatcttcaatgaaatgaatgtgaatattgacataacttcattgtttacaaatccgacaatcaagtcccttgcagataagattgacaataatatagaatttgaaatagacattgatgaaatcattgagactgcaaaggatatggattatttcccattgacctcaaatcagatgggaatctactatgagtgcatgcagactgaaaaaatcaaatacaccatgccatatgcaataaggtttgaaagcagcatcgatccttataagcttaaggacgccgttatcaggactgttgatgcacatccatatctcaagacaaggattatcaatactgatgatggaaagatattgcaaaagagatgtgacgacgttgaaatcgaggagatagaaatcgtcgaaatagattctatcagcaataggcagataatggacagggacataaagccaattccattggatgataatcagctattgagatttaagatttataagacacctacagaaacaatattgtttgctgatttccatcatatcattacagatggagtttctcaaggcattttcttcaatgatttggctaaggcatataacaatgaggaaatcgaggctgaaaaaattgatggatatgaatacagcctgattgaagagaaaatttcccttagcgaagtctcagagaatttcttcaagaaacagtttagtcaaggcattgaatcaactgttctaactccaaatatgaatggcaatccagatattggaaacattaagctcatttcagatcaggtaggctccagttttgtcaggcacttctgtaaggactattcaataagtccgaacgttttatttatgggcgctacacttttatgccttaataaatttacattcagcggaaaatcattgattacaacaatcttcaatggtaggtcaaactcaaattatgacaatactcaaggaatgttggttaaaacattgcctatcattgtaaatgctgaaaatcgtgacatgatggttgaagattatataaaattggttgataaggcctggaaagatgcattgacccatagcaattatccctacacaaagcttgcagaggattatcagttaaagccggaattcttctatgcattccatgaatcattaaaaagtaaagttgagcttgatggcaggacttatgaggcgattgaccttgacggtactgtttcaactgattataagataaacttggatatctttgatgatggggaatttattacattgtatttggagtataatgatcaaatctatacagaagagtatgttaatcagttcatacgttcaataaaatatatcttattccagttctttgtacatgatatggataaattgagaataagggatattgaattggttgaaggggaaattccagagtttgaagagattgacactccgattattcataagcgctttgaaaagcaggttgttgaaaagccaggtgatgtggcattggttgcaagtgatgccaccttaacttatggggacttgaatgagaaaagcaataggattgcaaatgcattgattaggcggggcgtaaagcctagaagcaatattctcataatgcttaagagggatagcaatttgattgcttccattttaggtgtcctgaaggcaggatgcgcatatgttcctatcgatcccgaatacccttccgaaagaatcaactacatttatgaaaacagccaggcggattatatcataagctatgagacttcagagaattcattaaatgtttatgagcttcttgaagaggaaattgttgtaaatccaaatgttgaggttcttccggatgatttggcctatatgatctacacttcaggctcaacaggcaatcctaaaggtgtgatgattagtcataagaacatctgcaatcaggctcaaaaccctaaatccacttatgatagtcttctttgcattacaaccatctcttttgacgtatctgttgatgacatattgacatccctttcaaatggattgaaattgatattggctgatgatgttcaaatcaaaactcttccggaacttattaaattgattgatgagaataagcctgaggctttagagatcactccttcaagaataggctcttatcttgaattggaagagttctgtaatgtgatttcttgtttaaaatgtattttccttggaggcgagcagttttcagcaaaagtctatgaagacttgagaaaatatagtgatgctgttgtctataacagttacggtccgaccgaaacaacaatcacctcaaacaacaaggcagttactgatgtaaatgatttgactgtagggcctcctttaaaaaattatgtcaccgatgttcgcgacattgacggcaagttggtccctaatggggtaatgggtgaattgtacattggaggtatgagcgttggaaaaggatactacaatatgcctgaaaagacagaaaaagttttcttaaccatcaatggcattccatattacagaagcggagactatgcaatccaacttccaaatggagagattgacattaagggaagaattgacaatcagatcaaactcagaggattgagaatagaaatcggtgaaatcgaatcaaacattggcaaatatcaggatataaggcaggctgttgttgtgattaaagagattaacaatgttgatcacttatgcgcttattacactgctaattgcgaaattgactctgatgatttaaaggagtttttaaaggaccgccttactaattatatgataccgacagtgtttgtgcagcttgatgagatgcctcaaactccaaacggcaaaacggatatcaaaagacttccgcagccaaaagtggaattgaattatgtggctccgaaaacaaggcttgaacatgagatctgtgcaatattttcatctatattgaatatagaaacagttggtgtagaggataatttctttgaaatcggtggaacatcacttattgcatcaaaattaattattgaacttcttaaacagggatatagtgtaagatatgatgacatattcaggaataaaactcctagagcactggcgaaattattgtctggtgaagacattggcgaagaggacttggatttaactgatgatatcatcaaaaactacaattatggcgaaatcaatgagcttctccaagagaatacatgggaaaacttctttgatggtgaaaatctggaattgggcaatgtcctattgactggagctacaggatttttaggaatccatatcctatatgaattcatcaaaagtgaggaaggaaagatctattgtatgttaaggaaaggcaagtttgattcctgtcaggaacggttgattgatgtgatgaatgattactttgatgaggatttcactgatctcgtcggctcacgcatcattccaatcgaaggggacataactgaaatcgatgattttaaacagcttgaggatgagcctattgatacggtgataaattcggccgcacttgtaaagcattatactgccgatgattatatcttcagggtgaatgtcgatggagtaatcaatggacttaaatttgcccaaactagaaataacataaaatatgtacagatatcaacaatcagcgttctttcatcatactccttaaatgaagaggcatatccgaatcaggaatatgatgaaaggacattatattatgagcaggatctagaaaacaaatatgtatgcagtaagtttttagctgaaagggcggttctgcaagctgcaactaaagggcttccagtaaagataatcagagttggaaatcttatgagccgttattcagatggtgtgttccagaaaaattatgatacaaatgcatttttaaataacattaaaaccattaaaaaattaggagctatgaatcctgcaatggctagtgaaaaggttgacatgagtcaaatagattatgttgcaaagggaatacttgcattgtctaagactccagagaaatccagggtattccattgtatgaataatcattatatttcccatagggatattgttgatgcattgaatacatacggttacggaattgaagaagtggatttcgaagaattcaaacagatttacgaacaaaacatgaatgagaatatacagggtataataactgccgatttttcaattgatgactttgatgaggaagacgatttcgaggagaatgtggaaattgaacagactgttgatattcttcattcgttaggatttgattggcctgaagcagatgaagagtatcttaaacgattgtttgattatttgaataagtttgattattttgaataa

SEQ ID NO: 234 - DNA, 750 bp, Methanobrevibacter ruminantium
gtgccagaaagatataaaggatttggatactgggatatagcaacccgtcaaatgggcattgtaagtaaaagccaacagacaagatttaaagatgctaaagtagcagtcataggatgtggaggcattggaggagaaacaattttaatgcttgcacgtatgggaataggagaattaatcattgtagataaggatgaatttgacttatccaacttaaacagacaagcgatgagtagcatagacacattaggactttctaaagcagatgtttcaaaagaaaaagtaagattaaccaacccatacacaaaagtaactgcaatcaacgaattcatcaatgaggataatgtggaatacttcaaggactgcgatgtaatattggatgcattggacaatctctatacaagagtgatcctaacaagatttgcaagggaaaacggcattccttatgtccatggagcaatccacggaacaaaaggacaggttacagtatttacaaaggacaccaagtcctatgaagagatgttctcacttccatcccttggaaaggaactgggagaggaaacaaaagaggaaatatcaaaattaacaaagggagttcctcctgtaattggacctaccccaaatatagtggggtgcttggaagcatttgaagcttataagttaattacaggcattggagaagtcacctatgctccaaagatacttaattttgatctattaaacttagaatcttttagtgttttagaattataa

SEQ ID NO: 235 - DNA, 1170 bp, Methanobrevibacter ruminantium
atgaaatatagaactttaggaaaaactggagaaaaagtttccattttaggatttggagcaatgagattgcctcattttgaaactaatgatcaaattgatgttaaaacatctgatgaaatcttaagttatggaatagataatggaataaatattattgatactgcttattcatatcatgcaaataacttatctggaaaaggaaagtgtgaagagtacattggaaacttcctaaatgagcattcttatagagacgaagttttattgactgcaaaaatgccaagctggctgatagagacaaaagaagacatggaaaaaatctttgaaagccaaatgaaagatcttcaaacagattgcattgacttatacatgcttcatagccttaatgaagactattggaaaatgtatagggaaattggtgcatttgaatttatggacagtcttttagaaagtggaaaagtaaagcacattggtttttctgcccatactgaaatggattggatagtagacattgtagatgactatgacaagtttgagtttggccttacccaattgaactatctggacgagagatatcagtccggaagggaaggggtggaatacattcacaagatgggccttggaactatgattatggaacctcttagaggaggacgactaatccagaacattcctcaagacattatggacctttgggacactgcagaggaaaagagaactcctcttgaatgggcatttcaatatctctggaatatggaagaagtcgatacagtactcagcggaatgaattcaatccaacaggtcaaggaaaacattgagatagcaaataagtccgaaataaactcaatcagcaaaaatgacttgaacctaatcaaggaagttgcatgggaatataagcaaagaaagggaaatgactgtacaggatgccaatactgcatgccatgccctcacggagtggatgttgcaggatgcttcagggagtacaatattgcaaaaatgctgaataaccctgcaggaagcgccatgcactatttctcattggaaagcgacacaagggcagacaaatgcatacactgcgatgactgcctatatcattgcccacaaatgattcacatctctgaagacttaaagaaggtagatgagttctttgggcgaaaatacgactatttctag

SEQ ID NO: 236 - DNA, 1497 bp, Methanobrevibacter ruminantium; identical to SEQ ID NO: 85

SEQ ID NO: 237 - DNA, 246 bp, Methanobrevibacter ruminantium
atgaaaagaacaattaatgaaagatgggaattatggtataatcgaatcttgccatatattataatttttgattttatattgattacagtttcactcatactaaatgtttcagaacctacaatggctcacattgaacattttgaccttttagtctgcataatccttttgggagaattcttttattttttatacaaggcaccgtcaaagaaaaagttcctgcttgacagggatatcttctgcttttga

SEQ ID NO: 238 - DNA, 270 bp, Methanobrevibacter ruminantium
atgcccgttaattttccaggaaccattttaggataccttagaatgttaaggttaataagggtgataagctttgcccgaatggggtcctttgaagatttcttcaaaaagacagagtttcacaaaatcataattgcaatagcaatcattataatgacattcacagctctgttttacgtgtttggaaccagctacaatccttttgattatttctattttgttatagtggcactgacaactgttggatttattgacaaaccccttaaaaaataa

SEQ ID NO: 239 - DNA, 387 bp, Methanobrevibacter ruminantium
atgacaattaaaagaaaatttgataaactgcccccatactgtcaatttgaaaaaaatctgaatcttattaaaaacaaatggacagtatacattttaagggacatgattcttggaaaaaaatatttcagcgatttcaaagaggacaagcctgaactgtccaataaaatcctaacacaaagacttaaggaactggaagaaaacaacatcatcgaaaaaaacatcaaagataatgaaacatcatatcacctgactgaaaaaggccacaggcttcaaaacatattatacgaactcgccattttcaatcttgaagaggaatatcatggagaggaactggaaaaaattaaaaaagaatttgaacagttaaaatatgggggaaaccaaaaatga

SEQ ID NO: 240 - DNA, 801 bp, Methanobrevibacter ruminantium
atgaaagaaaaaatatttatcaatggaagaggaggatgtggaaagagcacattcatatcattaattgcaaaggaattgtcaaaaaacaataaagtattaataattgatatggatgagggaaacctcggattgaacaagatgcttaatgttgatgttgcagacacttcattaatggaatattatggtggaagagataagataatgggtgaaattttaaaagtaggaattaaaggtatggttttagaaaaaatcaacctgaaagatgacgcagcctcagattcaatagatattttggataatatgaaattatcagatttaccttccgattatgtgacatggaacggaaatataggattcattgaatccggaaaaatcaacgaccctgatgaaggctgtgcctgtccgatgggaaatcttacaagagacttcctaaatcacattgaattacaagacaatgaagtaatattggtcgacacctcagcgggaatagaacacattggaagaggagtaattgagtctgcagacaaactcatttcaatagttgacccgtcaagcgatgcaatattgttggcaaataaaataggatcattatcaaaagaggcatccaaagaatatatggtaatattgaataaaattgatgaaaatactaaagatttggtattggaacaattggatgatgacatatctgtcgttggggaacttgaatataattcacacatagctcaaagcaacctttcccaaaaagaaattaaccttgaggaagtagaaggtgaaattaaggaaatctgtgcaaaaatttaa

SEQ ID NO: 241 - DNA, 219 bp, Methanobrevibacter ruminantium
atgtataaggtatggaaaaattgtattggttgtggggaatgtgcaaaggcatgtgattttaatctgattcaaacatttgatgattatattctgatggatattgaaaagtgcaggcattgctcaaaatgtgtagaaacttgtcaaaacaatgtttttacaaaatcagttatttttaaacactttttatatctattatattataagattaaaaaatcttag

SEQ ID NO: 242 - DNA, 408 bp, Methanobrevibacter ruminantium
atgaaaattgcaataagatattattcaaaaactggaaatactgaaaaacttgcagaagcaataggtgaagctatcggtgttgctccaaaaacaatagatgaacctttaaacgaagatgttgacatattgttcttgggaaatagtgtatataatgctggagcagattcaaaagtcaaggaattcctcaaaaatattgatgtgaatgttggaagtattgttaatgtctcatccgcagctcttatcgaatcaacctataagcaaataaaaaaagaagctgaaaaatgtggattaaacatggatgatagagaattccattgcagaggacaatttaaattcgttcatagaggtcatccaaacgaagaagatataaacgaagccgtaaactttgctaaaagtattgtcagatag

SEQ ID NO: 243 - DNA, 546 bp, Methanobrevibacter ruminantium
atggcaaaatatatcgttataaatggaagtacaagaaaaggaaactcatatgcaattgcaaatttcatcaaagaaaaaattgatggagacgttgaaatattcaatataaaagataaagaaatcggattttgtcaagctgataatgcttgtaaggcaaaagacgaatgcatagttcaagatgatgcatatgatttaatcaatgatctggaagaatgtgacggtgcatttattatcacccctattttctttggaaggcttcctggaatggtcgatgctttaattgacagattctattccaaattcaatcctgcaaaagagatgaaagcaccagacgaatcaaaaaaaataggtatagtattcagctatggtggaggagaagcagattacacacctgtagctgaacatgtcgcatttgaatttggagtattaagatttggtgctcacaaaaatgttatgtgtagtgaaaacaatgatcctaaaggatttgaaagtaaagacgaccaacaaagccaaattaatgagttaattagttgggtttgtgagtag

SEQ ID NO: 244 - DNA, 702 bp, Methanobrevibacter ruminantium
atgagtgaaagtgatgaaataatcaaaagactggacagaatagaaaatgaattgattacaataaaagaaaataattacaatcaaaaccttcaaactgccattgaaagcattagggacacctactctaattcaatcaagaaaaattttgcagacaatctgggggagaagtgtagtgaattttatctcccaaattgcaaaaatgaagagtgcaaacaatttatagtccaagagttcaaagaactttttttaaatactcaagaaacagacctcaacaaacttaatgaacagctggatgaaaaattttattctgtatgtggcgtagaatgtagtccatgctacaataactttaaggaatacttctttgaagagttgaagatgatcaattccattaatgtgtcatatgaacttaatgaaaatgaaccgattgaaaagttggatgtggatatgttaatttccgatgtatttgaaccgttatcgagcaagcaaagggttatcataatagaatcgttatatgtagaaaacaaatcatatactcaactttcacatttaactaaattaaggggaggaaacctactgttccaccttgaaaaactacaggatgcaggtttaatctcacaaaaacaagaccgtggcgaatacctgctcacaaaaaaaggttatacaactttgtccttaataaatcaatttcaaaaattaatgtaa

SEQ ID NO: 245 - DNA, 1896 bp, Methanobrevibacter ruminantium
atggaaataattgatttgttcggtgcggctttgactggagtcaaagaacagaacgttgatttgcttttcaaatcaggattatatatgttaatgtataccgtcatttcaatgattgccgtttatgtcatctcttttctcacaacaagagtggcttcaaaatcagcatatactgtccgtgagaaaatattccatattctgatgaacttgcctcgtgaggaaattgataaatttaaaatttcagggctagttacaaggtcaaccagaggtatgtcctccgaacagggatttatagtgatgatactcgaacagttaatgcttattccagttacattcgtagcaattgtatatgaaatagcattgattgatggaacttatgcattatttttcttaggatttattggtgttctttctgcaatcataatttttagaatgaaacagattgtggaaatatttttcagagctaaaaagacatatggtaaactaaatttattattcttatccaaaatcaatgatatagctggcaggattccatttaacaaacaggagtatgaagtcgaatttgaaaaggcatgtgagaactcctatgataaaaatgtcatctatattaaaagtcaatgttacctcggaccaatattaatgtggggtttatatgttattgtcctggttacattggcaatggttaattcaggatacaccattggatttgaaactgatagtgtaattgattcattcattattctggtatatgttgcctacttcatcactactctagctaatattcctgcattaattgacagatggccacgtgcatatgccacttctgtgcgtttggaggaagtcttgaatattgaagataaaatcataaaatccaatacaaatgataatctgaaggaaatagagattgttgaggaggatattgctcaagaggctaagggcatatgggatgaaagaaagggtatctctgaaaaattcactgcattgttaaaagaggataaggccaaagtaagaatatcaatgattttacttacgatatccacattgtgcatggtttatgccccaaaagttgccggaaaaacagttgatttattggcttccaattggaattcaactaatgaccctgctatctacattagtcttgccctgttgctggtattgtattcagtaggatatctgtttaaattacctccaaagagaatcatgggggccacaggtgaaaaagtagcatatgatttaagagtgaaattatttgataagcttgatgctgttggttccgatttcattcaggaaaattcaaagggtcttgttctatccagactaaacaacgatgtgatgaacatcagggagtttgtttcatctaaatttactgaaatttatgcgcagattctatttatagtctttgtaatagtgttgattgtgatgacagacttcaggttgagcttaatataccttgtgatattgccggtttatgccgtttgcttttatgtatgtgatgtcaaatctaaaaactattacgatggtcatcaaatgcagttggggagattgatgagctattttgaaagaggcctgtcaaatcgtgattcattccatgaaaaagggtttaaaaaaatgaatcaaactgtaattgactattatgtcaaatccaaaaacgttactaattttatggtgcctgttacaacccttttaacaaatataagtaagataactgtttatattgcggggatttactttttagcaggtaatgagattcagatagggactctattggcagttattatgtatgggcaattattaacagatcctattaaaaagctaagttcctcgatggccactattgaaacttcattttcaagcatcaaaaggatatttgcaatcattgactataaaaacgataaataa

SEQ ID NO: 246 - DNA, 1044 bp, Methanobrevibacter ruminantium
atgcccgaattcaaacttattgaaaagttactatacaaaagcgaacagaacgatatagaagctgagtttataattggaaacgaaacattatggtcaagtcaaaaagtcatagcagaaatatttggaacaacatcagccaatatttcaatgcatttctcaaatataatccaagaaggagagctagatgaaaaagaagtaagcatatcttctaaagacctttttaaagacaatcccaattttattaagaaatccttaaaaaaatcaaataatcgaggtaggccccaaaaatggtataatcttgacgcaatcatatcaataggatacagaataaacagtaaagaagcaacacagttccgccgttgggccaataaaatattaaaggaatatatgataaaaggatttgtcatcgataaagaacttctgaaaaaaggtggaagatttacagaagactatttcgatgaattattagaaaccatacgagaaataagggcttcagagagaagattcaatcaaaaaatcacagacatttatgcaacaagctttgattataacaaagatgcagacataacaaaagaattctttgccacagtacaaaacaaactgatatttgcaataagcaaccatactgcagcagaactcatagaaacacgaagcgatattgaaaatcctcatatgggcttgacaacctggaaaaaagcaccaaatggaaaaatactacaaagtgacgtggtcatatccaaaaattatttgaatcaaaatgaattatcaagattaaatagtttagtagaaggttttttgaatttagccgaatcacgcgcagaggatagaatcccaatgggtatgaaagattggaaagaactgctggatgactaccttaaacttcgaaggctgccaattcttgttggcaaaggtaagatatctgctgaagaagcacgagaacatgtgcttgaaaaatatgaaaaattcagagtagtgcaagatgaaaacttcatttctgactttgatcaaatgattttagatattaaacgtctagaaggaaaataa

SEQ ID NO: 247 - DNA, 135 bp, Methanobrevibacter ruminantium
atgaagttggtcaaaaggaaccagaagttgcatgatccagattcaccgttgctgattggggatgttaaagatggggatgttgtaaatgaagttaatgaacctagctatattgatttacaaactaagttgttttga

SEQ ID NO: 248 - DNA, 333 bp, Methanobrevibacter ruminantium
atgaataatattgcttatcttttacttgcaattctatttgaaaccagtgccacatcactgttaaaagttgctgaaggtttcactaaaccattgccaacaatagcatcaatcatattatacatattatcattttacagtctcagcaactgcctaaaaacagcaccaataggagttgcatatgccatttggtcagcattgggaatcgtgcttgtgacaattgtagggattatcgctttcaaacagacccctgattgggctgctatccttggacttttacttatcattataggtgtaggggtgctaaatctattctcaaaaatgagcttacattaa

SEQ ID NO: 249 - DNA, 387 bp, Methanobrevibacter ruminantium; identical to SEQ ID NO: 239

SEQ ID NO: 250 - DNA, 801 bp, Methanobrevibacter ruminantium
atgaaagaaaaaatatttatcaatggaagaggaggatgtggaaagagcacattcatatcattaattgcaaaggaattgtcaaaaaacaataaagtattaataattgatatggatgagggaaacctcggattgaacaagatgcttaatgttgatgttgcagacacttcattaatggaatattatggtggaagagataagataatgggtgaaattttaaaagtaggaattaaaggtatggttttagaaaaaatcaacctgaaagatggcgcagcctcagattcaatagatattttggataatatgaaattatcagatttaccttccgattatgtgacatggaacggaaatataggattcattgaatccggaaaaatcaacgaccctgatgaaggctgtgcctgtccgatgggaaatcttacaagagacttcctaaatcacattgaattacaagacaatgaagtaatattggtcgacacctcagcgggaatagaacacattggaagaggagtaattgagtctgcagacaaactcatttcaatagttgacccgtcaagcgatgcaatattgttggcaaataaaataggatcattatcaaaagaggcatccaaagaatatatggtaatattgaataaaattgatgaaaatactaaagatttggtattggaacaattggatgatgacatatctgtcgttggggaacttgaatataattcacacatagctcaaagcaacctttcccaaaaagaaattaaccttgaggaagtagaaggtgaaattaaggaaatctgtgcaaaaatttaa

SEQ ID NO: 251 - DNA, 828 bp, Methanobrevibacter ruminantium
atggatttgcttttttatgttgttttgctgttgattggaggttgctttgcaggtttcatggcaggccttttggggattggcggtggaattgtaatcactccaatccaatattatcttttaacctcaattggatgtgatcctaaaacgtccctaacggttacctttgcaacaggtcttgcagttatctgtgtcacgatgataaacagtacacgaaagcacaaacaaaacaatctaatagtaaaacagcacctaaaaccaatgatggtctttggttttgtaggtgccattctgggtgcagtcatatctcaatacatagatgttgaggttttaaagattttgtttggtgtaatatgtatagtatcaacagtatttttagttttaataaaatctcctacctctttagataatattaaaactgatgcaggattattttactctattgcatttgcatgtggtcttgcaagcggattgataggtcccgcaggaggagcatttatcataccgattttcgtggcatatttgagatatccaataacaaatactatcggaacaacttcagcattaagcatcgcaaccacacttgcaggggtaatctgttatattgttttaggttggggtgttcaaggattgccggatttttcattaggttatgtcaacttgcttcaattcgtatttttaacaataactagcattattgtatccggatatgctgctaacctatctaaaaaaatcaatcctacaaaattaaaagcgctgcaggtaatcgtaatatcatatattggccttcaaatgatgggtgtattcgacataatattaagcataatataa

SEQ ID NO: 252 - DNA, 219 bp, Methanobrevibacter ruminantium; identical to SEQ ID NO: 241

SEQ ID NO: 253 - DNA, 117 bp, Methanobrevibacter ruminantium
atgaagctggttaaaaagaaccaaaagttgcataatcctaattcgccattgctgattggtgaggtaaaagagagtgatgatgtaaaggaagttaatgaacctagctatatttattga

SEQ ID NO: 254 - DNA, 828 bp, Methanobrevibacter ruminantium
atggaaataatggaaataattaaagattcttttctatttccatctaaaaacttaggaaccttctcaatttatgttgtattgtcagtattagttgcaacatttacttttggaggaatattctcctatttattagggtttattggctctgagtacattttaataggcggattaactcttgtatttgcaatgttaattggatgggtaatgtctggttatgaaatcagcattattaaatctggtattgaccttgatgatgaagttcctgagtttaaatggtgggataattttattacaggttttttaaactttattgttgcaatcgtttactttataattcctgcttttattgtgggagttgtaggatatcttataaatattaatgacaaacttatggcagttgctcaagagatttcttcactctatccaaatattttcttgacaagttctccggatattgcatttgaggcattgtctcaagcaataattgaattaatagttcctttagctattctcattattgttgctctaattgtatttgtaatctttttattcctccaatccatggctgaagcaagattggcaaatacgggtagtttaagtgaagctttaaacatttttgaagcagctaaagatataaaacgaattggtgtacgtaaagtaattatagtaatcttattagtttttgtaattattggtgttattgggatggttacatctgttatatttaactatgtgccaacattatcaattctttcaattataataagcccatacttagtattctttgctcaaagggctactggattattatattctgatatagcttaa

SEQ ID NO: 255 - DNA, 1521 bp, Methanobrevibacter ruminantium
atgaatgaaaccattaaggaaaattcttgggttccactaatagtcgtggctcttgcttcctttattgtagctttagacgctacattcatgaatgtgagtatttcacaggttgttgttgacttgaatactgacgtcagtacaattcaatcaatcatgtcattttatactctcatcactgcagcatttatgctcttaagtgcaaagcttcaagacatagtggataaaaagaaactgtttttaataggtactgctctttatggtgtaggtacattcaccgcatcaataagttcaagtgctggaatgttatttgttggatgggcagcaattgaaggtgttgctggtgcattaatgatgcctgcaaccgtttccatcataagtggaacatattctggtgaaaaacgtacagttgctttggcgattgtaggtgttatgggtgcagttgcagccgctgtaggcccactcttcggtggggtcatgacaacatttttaagttggagatatggatttgcagttgaattgataatcgttttcgttattttaatattcagaaatagcatacctcatttcgaacctactgaatctagaagcgatttagacatttcaggcgctataatttcatttatcggccttgttttattagtactaggtatcttgtcactatctaaagatttcacaacaagcataggcataattgtagtaggattaattgcattagttgcctttgcatactttgaaatcagaagaaaaagaaatggcaaagtaccattacttgatatggaactatttaaagacagaaatttacgtgtaggaactataattttgttattatcttaccttgcaatgggtgggggattatttgcagtttccctattcttgcaaagcgtattgcagttaaatgcattcaatactggtgtgactactcttccattaactttaggtttgcttatttttgcagtattggctccaagtttaacagaaaaattaagtcacaagaaaattatggcaataggatgcataatggcaattattggatgtttaatgttaagttatcaatttagacttgatacaacactttggacattattaccaggattattagtattaggtgctggacttggtttcattatggctttatgtactgatatttcattaagcaatattcctgcagaaagtcaaaataacgcatcaggtgttaattcaaccggtacctcattaggtgaatcaatgggtacagcagttattggaataattttaattctcggagttatgggcggtatcagcactgctgtcgatacctatgcaccagatcattcaggagacgaacaattccaacttgaagttgcaaattacttccaaaaagttgctactatagatgatcttaaacaggacagtacccttgtagatgttgcaaacatcattattcaaaataccatggcattcgtaatgcaggtaacagctctcattatgggagtggttttccttctaacgttacggctaaaggataacaaaattaaacaatga

SEQ ID NO: 256 - DNA, 1251 bp, Methanobrevibacter ruminantium
atgagcaatgttaaagacatgtctcttgcggatgaaggtattcgtaagatcaaatgggttcaaaagcatatgcctgttcttgaacatattaaaaaacaatttgaagaagaaaagccttttgaaggaatcactattggttcatgtttacatttagaacctaaaactgttaatttaggtttgaccttacaagctggtggcgctgaagttgcaatgactggctgcaatccattatccactcacgatgatgctgcagcaggtgcagcagctctcggattacacatatacggctggagagaacaaactgatgaagaatactacgaagctatcgacaatgtactttcccacaagccagatgtaatcatcgacgacggtgcagacatgatcatgtaccttcacgaaaaacgcccagagctattggaaaacatcaaaggggcttgtgaagagacaacaaccggtgtacacagattggaagcaatgcatgcagacggagcacttaagttcccagtcatcgcagtaaacgacgcatacaccaaatatttatttgacaaccgttacggaaccggacaatcctcccttgacgcaatcatgggaaccaccaacatgcttatcgcaggtaaaaacgtagtcgtctgcggatacggctggtgcggtcgtggagtagcatcaagagcagcaggactcggagcaaacgtaattgtaacagaagtagacccaatcagagcacttgaagcaagaatggatggttacagagtaatgaaaattagagaagcagtgaaaatcgcagaccttgtagtaaccgtaacaggaaacatagacatcatccatggagatgacttcaaatacatgaaagacggatgcatgctctcaaactcaggccacttcaatgtggaaatcaacagaggcgaccttgaagcacaatcagtaagctgcgaagaggttagagaaagcattgaaatgtttaccatgaaagacggcagaaaaatttatcttttagcagacggaagacttgtaaaccttgcagcagcaagaggacaaggacaccctgctgaaatcatggacatgagttttgctgtgcaagcattatctgccaaatacattgtagaaaatgacttgtcattaggtgttgaaaaggcaccggacagcattgatgatgaagttgccagattaaagcttaaagctatgggaattgaaattgacgacctttccgaacgtcagaaagattatcttgcggactggagagaaggtacttaa

SEQ ID NO: 257 - DNA, 666 bp, Methanobrevibacter ruminantium
atgtcttattttcgctatattgataatggagaaggccctacaaagctatttatcggaggagttcatggggatgaaggcaagcatgtccttcctttaatcaagcttctaaaaagagaggatttttcctctggacagatttacatttataattttgacaggactccatatatctctacaatacatagggaattttatcaatcagaacaaggcaagaagatattggatttggtagattattacaagcctgatttttatacagaacttcattcatataatattaagcattttgatagattgactagtcttgataggcttgacagcgaagggattcctcctttaatcgattgtggtcaatatgtattgtgcagttctgtttctcctttgattagacgtaagcatttcactaaagaagcaatatgtcaaactttagagtttcctatattcagaggagaagacttaaagcttagtgatgatgaattgcttgaaaaatacgattttgattatgacttgtctgtaaaggagtatatggcctttttaagactgattacccttagcaagaatagggatgactttgaaaaaagagttttaaaggattataagaaacaggctgatcttgctttaaaatacgttaaaataatttatggattgaattttccacgttattag

SEQ ID NO: 258 - DNA, 987 bp, Methanobrevibacter ruminantium
atgggagttaagtttaaggatatagttactgccgaagagataaacctaaaggatttagaaggcagaactgtagcaatagatgcatataacacactttatcaattcctatctggaattcgccaaagggacggcagtcccttaatggatgcaaatggaaatgtaacatcccatttaagcggaattctatatagaacagcttcaatagtggataaaggaataaaaccagtctatgtatttgatggagatgtctcagaatataagacaaaaaccgttgaaaaaagaagggccttaagggaagaggcaaaccagaagtatgaagaggcaaaggcagcaggaaacattgaagaggccagaaaatatgcaataagaagctccagattatcaccttacattatagaatcctctaaaaaacttcttgaatatatgggaatcccctatgtacaggcaaaaggagagggtgaagctcaaggagcatatatggttaaaaatggagatgcttgggccgttgcttcccaagattatgactgcttactctttggagcacctcgtatcataagaaaccttacattaagcggaggactatcaaacctcgaatatcttgaacttgataaggtcctaacagagatagaccttagcagagaacaattagtggatgttgcattgatggtaggaaccgacttcaatgaaggaatctatggaatcggtgcaaaaactgggcttaaattaatcagacagaatagtcttgaagacatattggttcaaaagggaattactgatgttgaagttgaaccagatgagcttagagaaatattcttaagccatgatgtcaatacagactataagattaagtttaaaagcgcggataaggaaaaactctgtgaattcatgtgcgaagaacatggattctctgagactagagtcctaaatgttgcagacaagctaaaaaaattaagttcaacccaaaaaagcttagaagattggttttaa

SEQ ID NO: 259 - DNA, 564 bp, Methanobrevibacter ruminantium
atggcaactacagataatgacatcaatgtaagattgattgaaaagattaatcaagttgaagaaaagtacaatcaaaacttttcaaacactcaaaaaatccttatgaccacagatggctcaattacagccattttagatgtgctttatggaaaaattgctttaaagaccctagagcaacatttcgaagaggcaacagccgaaagcgcaaagcttgtcaatgtggatgttggcgatgaggtcaactttagagaaatcataatgcacaaggacgaacagcctttgatttatgctaaatcctatattcctttaaaaagattgagtaaagaaatcaaagaggacttggttagggcagacatccctataggaagaatattgaagaaataccatattgaatccagaagagagataaacattatcgatatggaaaaggcaaacgacaaattgattgaaatctataatacagatgaggatttccttgcaagggattatacaataatcaaagatggtgaaattctaatgtggattaaggaatacttccctattagttattttactgaaatctga

SEQ ID NO: 260 - DNA, 1254 bp, Methanobrevibacter ruminantium
ttgaatattacagaaaaaatattatctcaaaaagcaggccacgaagtcgaaccgggagaaataattgaaattggcgtcgatttagccatgtcccacgatggaacttcacctcctgcaataaaaacctttgaaaaaatcacagataaggtatgggacaatgaaaagatagtcattgtctttgaccacaacattccagcaaatacaataggatctgcagagtttcaaaaggtagcaagaaactttatcaagacccaaggcataaaaagccattacattcatggagaaggtatatgccatcaggttcttcctgaaaagggacatgttgagcctggaatggtcatcgtcggtgcagactcacacacatgcacatacggtgcattcggagcattttcaacaggaatgggtgcaactgacctagcaatggtctatgcaactggaaagacatggtttatggttcctgaagcattaaagatagaagttgaaggaagcttaaggccaggaataacatccaaggaccttattctaaacataataggagagataggaattgccggagcaacctacaacactgcagagttctgcggagagacaatagacaatctggatgttgaaagccgaatgaccatgacaaatatggcaattgagatgggagctaaaaacggaataatggagccaaacaaggcaacaatagagtatgtctgcaatagaaccggcaaaagcaaagaccaattgaatataataaaatcagacaaggactcaaactatctcaaggaatatctcttcaatgtagatgatatggaagcccaaatagcctgtccaaatgatgttgacaatgtcaatcctctctcaaaagtggaaggaacccatatagaccaaggatttattggatcatgcacaaacggaaggctcaatgaccttgcacaagctgcagcagtcctagaaggcaagcaagtccatgacgatgtaagattaattattatccctgcatccaaggaaatctatcaaaaggcaatggatttaggttatatcaaaacattcctggatgctggagcgattgtatcaaatcctggatgtggaccatgccttggaggacatatgggagtcttatccgaaggggaaacaagcatctcatctacaaacagaaacttcaagggaagaatgggagatcctaattcatcagtataccttgcaaatgcaggagttgtagctgcatctgcagtctctggattcatacaaaacccagatagcttataa

SEQ ID NO: 261 - DNA, 1179 bp, Methanobrevibacter ruminantium
atgcaatattatatcagtccctttaacaaggaagaggaatataaattcccaaaaaacataacaatttatgatactaccttaagagatggagaacaaactccaggggtctgtttttcaaaggaagacaaattagagattgctagaaaattagatcaatttagaattcatcagattgaagcgggattccctatcgtttcaagccgtgaagcagatgccgtaaaggcaatagcaaatgaaggcttggatgcacagattatctgtcttgcaagaactaaaagagcagacatcgataaggctcttgactgtgatgttgatggaataatcacattcatgggaacctcagacattcatttagagcacaagatgcatatcaaaagacaggaagccttgaatatttgcatgaaatccattgaatacgctaaggaccatggattgttcgtagcattctcagcagaagatgctacaagaactgacttggacttcttaaagagaacctactccaaagcggaaagctatggggcagacagggttcatattgcagacacagtaggagcaataactcctcaaggaatcactttcctaatcaaagagcttagaaaagtcacaaatgtcgatattgcaatgcattgtcataatgactttggtcttgctgtaataaactcaatttacggacttttagcaggaggttccgctgtttcaacaactgtaaatggaatcggagaaagggcaggaaacgcatcacttgaagagcttgtaatgtctctaaaaatcttatatggaaaggatttaggatttaagaccaaatacattcaagagctttcagagcttgttgcagaaaagacaaagcttggaattccttataataagcctgttgtaggtaaaaacgtattcagacatgaatctggaatccatgtggatgcagtgattgaagagcctcttacatatgagccatatcttccagagcttgtaggacaaaagagacaattagtcttaggaaagcattcaggatgcagagctgttaaggcaaaattagatgaatgcggatttaaggttacaaatgatcagctttgtcagatagttaaaaaagtcaaagaaagcagagaagaaggaaaatacattgatgataatgtatttaaagacattgtaagaagcattgatgctaattatgttgacttatag

SEQ ID NO: 262 - DNA, 546 bp, Methanobrevibacter ruminantium
atgatagaagtagaagttaaagctaagataaataattttgaagatataaaagtcaaattaaacgaaatcaatgcaataaaaacaaaaacagaaaagcagatagacagatatttcaacagccctgtaaatgactttgcaaagactgatgaggccttaaggataagagaaaccaaaacagaaaaatcccataacttgtttataacctataaaggccctaagatagacagcaaaagcaagactcgagaagaagttgaaatgaaaatcgaagacagcgacaaatgtgcaaaaatctttgagaatctaggatttatcgaagttagaacagtcaaaaagaacagagagtattttaagcttgagaattttgagataagcttagatgatgtagagggccttgatccatatatggaaatagagattgcattggaggacggttccgattataatgaagctcaagataaaatatttgacctatttgagcaattgggaattactgatggcttcgagcgaacttcctatttggaattgctagaagagcaggacaaataa

SEQ ID NO: 263 - DNA, 546 bp, Methanobrevibacter ruminantium
ttgaccgatgttgatataaaaatagaaaacattgtggcttctgctagcattggtaaagacattgttcttactgaagttgcaaaagcattagaaggcgtcgatttcaatagagaacagtttccaggtctagtttttaaacttcaagaccctaagactgctgctttaatttttagttccggcaaacttgtttgtactggcgctaaatctatcgatgattcaaagttagctattaagaaaactgtcgaccttatgagaactattgataccgagattcctcatgagtttgatattaaaattcaaaatattgttgcttctgcaaatttacaatccacattaaatttagaagcagttgctttggaattggaaaacaccgagtacgaacctgaacaattcccaggtttagtgtaccgtttatctgatcctaaagtagttttattattattcggttccggtaaagttgtttgtaccggcgctaaaaccaaacaagacgctaggttaggtgttgaaaacgctaaagctagacttagcgaattggacttaatataa

SEQ ID NO: 264 - DNA, 2064 bp, Methanobrevibacter ruminantium
ttgattaaacttgtagtatttgacttagataatgttattattgatggtgagggcatagatgagattggaaaattggtaaatattgaagatcaaattgcaaaaatcaccgagcaggcaatgcaaggtgaaatcgacttcgaaacatccattaaaaaaagagtaggacttcttaagggagcttctactgatgatattaaaacattagctaatgaaatgcctctaatggaaggtgctgaagaaaccgtttcctctttaaaggaaaatggttttgatgtagctattataagtggcagttttgatattattgccgatattattaaggaaaaactcaatgtggataatgtattcacaaattcacttgttgaagaagacgggatcttgacaggtgaagttactggaccattggtatctggttcaaaagtagatgttttatctaaattcattgaagacaagggctattctttagaggaatgtgttgctgtcggagatggagctaatgacatttctatgattgaatctgctggatacggcattgcattcaatgcaaagcctgccttaaaggaaaatgcagacatcattgtagaaacccgtaatcttactgacgtccgtgacgtcattattaacttaaattctgaaaacactgaagaaggtgctgacgtggataaagaagttgaaattgaaactgaagtagttgaatctactgatgtagttgtcgaaaatcaagaagaacaagttgcagatgcaactgaagaagtagttgaagtagaagaagcagaagaagctgttgaagaagcagttgaaactgaagaagaagcagttgaagaagaaactgtagaagctgaagaggaagctgttgaagaagaagcagaagaagctgttgaagctgaggaagaagctgaagaaatcgaagaagctgctgaagaggaagcagaagaagctaccgaagaagaagctattgaagaggccgaagaggaagctgatgaagaagtagttgaagaggctgaagaagaagtagctgaagaagaagcagaagagattgaagaagctgttgaagaagaggctgaagaagaagtagctgaagaagctgcagatgaagaagtagttgaagaagctgctgaagaagaagcagaagaagctaccgaagaggaagctgctgaagaagaagctaaagaagaaaagcctaaaaagtctaaaaagtctaaaaacactcttcctgaacctgatttcgaattagctgatactatcgaaggagtcagagctcaaaaagatgaaagagaagcaaaaattgctcaagttgctgacgaaagagaagcattcaatagagaagctaaagagcaacgtaaaatacgtgatgaattaaacactgaattaaaattaaacttagcaaaagctattgaattcagagatcaacgtaatgaaatcaacagagaagttgaagaaaacaaaagagctcgtaacaaagtaaatgaagagattaaaaatctcgaatggtcttctggtaaaaaagatagaatcagaattgaaaacgaaatcaagaagattgataaaatcattgaaaccagagttttagacattaaaaaggaaaatcagcttgtaaaaactgctaacgatttaagaaaacaacttgcagaaattacagaagacaacaaagtaaaagaagaagctgaaaagcttaaaaagcaatctgaagaataccacgctaaagttgtcgaactttccgaacaagctcaagaagctcacgaacaaatgctttcttactttaggaaaactgatgaaatcagaactgctgcagatgaagcacacaagttattcatccaagctaggaaaaacgcttctgctaaacatgaagaatttaaagtcattttaagtgaaattcatgttattaataaaagattaggaagcaacagagctagaagaagaaaatctgagaaaactagcaatgctcctggtaaaagaaatcgtgaagagaaagagaaagctgaagctatctttgataagtttaaaaacggtaaaaaattatcaactgaagagcttttactcttgcaaaaatatgatattaattaa

SEQ ID NO: 265 - DNA, 246 bp, Methanobrevibacter ruminantium
atggatgatattatggatttggaaaataaaaaagatgataaaaatcaaaataaagaagaaataattgaatctagtgaaaaagaagttaaaatggaaatatgttatacctgcggtaaggagtttgatatgaattctgacgaaggcgctcattaccattatggtgaatatccaatgtgcggctattgcactaacttctttggattctataaggaagatatgatgggtggcaaggcaaaaaaggaataa

SEQ ID NO: 266 - DNA, 2226 bp, Methanobrevibacter ruminantium
atgcatgaagtgattatttcagaaaaaccaaagtctgctgagaagatagcaaaggcactttctccaaatgcccaaaagaagaaatataatagaaagatcaactattgggaatttgaagaaaacggcaaaaagaccactgtcctatctgcagtgggacatttgtactcattgacttctgctagttccagagacagattaggttttgatttgacttgggttccagcttatgaggtggaaaagcaaaaatatacaagggattacatcaatgcaattaaaaaactctcaaaaggtgcagataagtttgttcatgcttgcgattacgatgttgaaggaaccttaatcggatacaatgcattgaaatatgcatgtggaaacaatgccgaagcaaaggcatcccgtatgaaattttcaacattgactaagaaggatatcgtagaggcatacaatacaatgagggacattgacattcgtcaagtggatcatggtattgcaaggcatatgcttgactattattatggtatgaatatctcttcagccttgatgaaggctgtaagggcctctagctcaagatttattagcttatccgccggacgtgtacagactccaaccctttctattttagttgatagggaaaaggagattcaatcctttgttccggaaccttattggatgatcaaggctaaatctgactatgatatcatagcagaccatgtcgaaggaaagatatttgatgaagagcgagctaaaaagatttatgctgactgtcaaggtgctgatgctgatgtgacaagtgttaaggttacagaatccattagaaaacctcctattccattcaatttaggaggacttcagtctgaagcacatactgtctttggattctctcctaaaaggactcaagttgcagctcaaaacctttatgttggaggatatacatcctatcctcgtacatcatctcaaaagctgcctgaatccttggatttcaaaaacatttttgcagggcttgctaaagaccctgaattcaagaagcatatctttgacttacctgctaagcttaagcctaatgaaggtaaaaagactgatgcagcgcaccctgctatacaccctacaggagtattgccttccaatctatctgcagatgaggctaagatttacagcttgattgtttataggttcatcagcgtattttccgaaaactccaagcttgaaaccatgaaggtcaacttaaaggttgcagatgagaagttcaccttttccagaaaaagagtctcttatgaaggttggctaaagcattatccgtttaaaaagcaggaaaatgatgcattccctcctataaataagggagatcaactaaaaatccataagattttagttgaagagaaggaaaccaaacctcctgccagatataatgaggcttcacttatcaaggaactggaaaagagggaattgggaactaaggccacccgtgcagacattgttgccaagctttatgatagaaaatacattgaaggcaagaagattgaggtcaagcctttaggaatcaatatcatagacaccttaaacgagtattgtaaggacctgacaagcgaggagctaacccgtgagtttgaaagggaacttgaaggaatcgatactgataagtatacaaaggagcagattcttgaaaacggtgaaaaggaagtcaagaccattttagctgaaatcaaccaaaacaagaagcaaatcggtgaaaagctttatggagcatatcaggaaaccaatgtggttggagagtgcagctgcggaggaaaactgataaaaagatattctccaagaacaaagaacacctttgtaggatgctccaatttcccaaaatgtaaggttacctattccctgccaaagggagcgaatatgctaaagaagacatgccctacctgcggtttgcctatgatttccattaaaaaggcaagcggaaagggaagagatcatgtctgccttgattcaaattgtggaaaggatgtaagcagacgccaagctcctgaagttgttggaaaatgtccggaatgtggcaaggaccttttaaaacgttctggcagatatggagaatttgtaggatgctctggattcccaaggtgccgcttcacttgttctgttgatgagttgaacaatcttggcaaagataaaaataaggaagatgtaaaagagaataagggtgtttctaagaagatagtaaggtctgaggctaaataa

SEQ ID NO: 267 - DNA, 1095 bp, Methanobrevibacter ruminantium
atgactatagaagaaaaaattaaagctattgaagaggaaattcaaaagacaccttataacaaagctacttctcatcacataggaaaattaaaggctaagatttctaaacttaaggaagagcaaatcaaaagaagtagcggtggaactaaaggtgaaggtttccacattaaaaaaagcggagatgctactgctgttttagtaggtttcccatctgtaggtaaatctacattgcttaatgaaatcacaaatgctgaaagtaaggttggagcttatcaattcactacattagaaatcattccaggggtcatggaatataataatgctcagattcaaatatttgacattccaggaatcattacaggtgctgcaggtggtaaaggtagaggaaaagagatcttatctgtagcaagaactgctgacttgattattgtggtcttggatgttctcaaccctcaacacattaatgttatcttaaaggagcttagaaatgtaggtgtaaggccaaatgagaccaagccagatgttagaatcaaaaagacacgtaaaggtggagtcaatgtttcatcaaccgttcctttaacctatttggatgaaaagaccattaggtcaatcatcaatgaatatggaatacacaatgcagatgtcctatttagggatgatgtcacaatcgatcagttcattgatgtgattgaggccaataagtcctatgttccaatgatggttctcttaaataaggtggatttggtagatgaacattatctaaatgaaatcaagaaggaacttcctccattcattccgatctctgcagataaacagttaaatattgaagcacttaaagaagagatatttaataatttaaaccttatcagggtttatctaaagccacaaggaagaaaagcggatatggaagatccattggttgttaaaaaaggttctaccgtaattgatgtctgtggaaaacttcacagagagtttgttaaaaacttcagacatgcaaagatttggggaacttcagtaaaattcccaggtcaaaaggtaggtccagaccatgtcgtagaggatgaagacattctaaggattattttaaagaaataa

SEQ ID NO: 268 - DNA, 603 bp, Methanobrevibacter ruminantium
atgtctatttcagataaaatcgaagaaaataaagtaatattcatatcaggaactccatgtactggtaaaactacaattgcaactaaactaaatgatttcttaaccaacaatggattcaattcttattttataaaaataaatgattttgccattgaaaatgatttggttttaggcaaggacccagacaaattgtatacagttatagacattggcagacttgatgaagtcttaaataaggagattaataattttcttgatgaaaactcttcagatgattctaaaatagttgttgttgaaggacatctgtcccatttgtgcaatggtgcagataagatgataattcttcgattaaatccagaaaaactcctcaaaagacttgaagagcgaaagtatagtgaaaacaaaattcatgaaaatcttgaagcagaggctttggctgtctgttctgcagaagcttatgacttatatgatgataaggccagtgaaatagacactacaaataaatctgttgatgagactcttgagcttgttcttaaaatcattactggtgaactagaatctcctgtaggctctgttgattttatggattggtttttattataa

SEQ ID NO: 269 - DNA, 372 bp, Methanobrevibacter ruminantium
ttggctagaggaaaaagaccaaaatggatgattgatatagctcaagaacgtatggatattctttttaatcgtgcagaaaaagaatataagaagaatccggagagatcccatcgttacatagagctagctcgaaacatttccaagaaatacaatacaaaaattccccagccatggaaccgaagatattgtaagaaatgctacaagttcttggttcccggtcacaactgcgctgtccggctaattaataatgaaattaatatatattgtggcgagtgtggccatgttatgaaaattccttacatcagggaaaaaaagttaaaaaggagagctaaaattgactcttacactttcaaaaaaagagattatgaatga

SEQ ID NO: 270 - DNA, 216 bp, Methanobrevibacter ruminantium
atgacaatcaatattggaaaagctggtgttaacgataatgttattgaagagattaaacgtcagttaaaatccaatcctattattaaattacgatttgctaaaaatgtagcaagaaataaagatgatttaattaacagcattgttgaaggcactaaatcccaactcattgatgttagagggaatgttgctgttatttataagaaacaatctcattaa

SEQ ID NO: 271 - DNA, 441 bp, Methanobrevibacter ruminantium
gtgacaactgtatttgatgttcctgcagagttattgattaatactgttgcagatgaatttaaagataataatgataaaatcgttgcccctgaatggacaaaacttgttaaaactggtgttcacaaagaaagaaaaccagaaaacatcgactggtggtatgtaagatgcgcttctattttaagaagagtctatattgacggaccagttggagtaagaagtttaagaaccttctatggcggtaaaaaagatagaggcgtaaaccctgaaaaattcagaaaaggtagtggatctattgttagagtagctctacaccaattagaagatgcaggatacgtagaaaaagtcgatgctggaagaattattactccgcaaggtagatctttcttagataatacttctgctgaattaattaaagacattccagaactttcaaaatattaa

SEQ ID NO: 272 - DNA, 372 bp, Methanobrevibacter ruminantium
atgagtgaacttgatgaattacgtaaaaaacgtatggctgaactgcaaagacaggccgctatgaatgctgatccgcagatggctcaacagcaaatggctcaacagcagatggctcagcaacaattagctcaacagcaagaaatggaagctcagttgaaacaagctatgagacagatcttaactccagaagctcgtggaagattggataacttaagattgaccaagcctgagttagtacaaaacattgagattcaattgcttcaatcagctcaagcaggttctcttagaggcaaagtaactgatgaacaacttaaagttttgcttaaaaatctcatgggtcaaaaaagggaaattcatattacaagaagataa

SEQ ID NO: 273 - DNA, 582 bp, Methanobrevibacter ruminantium
atgaaagcttgtgttctttatagcggtggcaaagacagttcattgatgggatacatcctcaatcaattaggctttgacgttgaactggtcactgcaaattttggtgtttacgattcatacattccagcttcaaagtctgcagagtccattggattgaagcatagggttttaaacctggacatttccatcttggaaaaggctgtagacatgattttagaagacggatttcctaatgagggaatcaagtatcttcatgaggctgttgttgaggaagtggcaaatcattatgatttggttgctgacggtacaagaagggatgacaagacccctaaactcaatagaaatcaaataaggagcttggaagacagaaaagatgtccaatacatgaatttggatagttttggctataagaccatcaaatatcttgtaggaaatctttttgaattgaagcatgaaaagagcaataaggatacaagttcagactatgaggttgaaattcgattgctgattgaccaaaaaggtggaaattcatctgaaatattcccagaacattatcagactaatgtggtcggattaaaataa

SEQ ID NO: 274 - DNA, 156 bp, Methanobrevibacter ruminantium
atgagtagaaacaaaccattagctaagaaattaagaatggctaaagctaataaacaaaacagaagaatcccaatttgggcttatggtaagactcaacgtaaattaagatacagacctaagcctagacattggagaagaaatgatcttaaagtatag

SEQ ID NO: 275 - DNA, 261 bp, Methanobrevibacter ruminantium
atggcagaagaattagaaagaacttatgttattccacttagaaaagttaaaaatgtcaaaagaactataagagctcctagagctattagagaagttcaaaactttttaatgaaacatatgaaagctgaagaagtaaaaattgacgcttctataaatgaatttatttgggaaagaggaattcaaaaaatcccttccaaagtaaaggtaattgcagtaaaagatgaagaaggtattgtcagagcaactttagcagaaaactaa

SEQ ID NO: 276 - DNA, 678 bp, Methanobrevibacter ruminantium
atgctgaaaagaattaatttaaccggaaaccctaatttaggtgtttacatatctgttaatgatgaaatagctattgttccttttaatgttcctgttgaaatggaatctgttattaaagagaccttagaagtcgacatcattaagacttccattgcaggctctaacctaaacggtgttttagcaacaggaaattctaatggatttttagtttctccctttacatatgacagagaaattgaactattggaatctgcaggcataaatgttgcaaagcttccaggcaaatacactgccattggaaacataattgctgtaaatgattatggtgcccttgcaggtcctaatattggggaagaaacaatcaaggttattgaagatactttaaaggttccagtaaagatttatccatttgcagacactaagattgtaggttctgcaagcatagttaccaataaaggagctttattgcatagggatacaatctctgaagagattgatttcattgaagacttctttaaggttgaagcaaacattggaactgtatgcaaaggaatgcctcttgtaggtgcttgtggtatagccaattcccaaggtgtaatggttggggaaagtactacaggtcctgagatggctagaattgaagaatctttaggctttttagactttggtaatttctaa

SEQ ID NO: 277 - DNA, 225 bp, Methanobrevibacter ruminantium
atgataactaaaaattatagagttaaaggtagcttcgtaatgggtagtgaaacacaagttttcactaaagagttaagagctattaaagaagaagacatttatgaaaagctttattctatcttcggaagtaaacatagaataaaaagaaatcaaatcaaaattgattcaattgaagaaatcagcgatgacgaagtggaagatcctatcgtacaagcgattctttaa

SEQ ID NO: 278 - DNA, 438 bp, Methanobrevibacter ruminantium
atggaagaccagcaaaaattacaacaaattttaagtcaacttgaagtttacaagcaacaatctgagttatataagactcaaatcgatgctgttcaagcttcacttgctgaaattaaaatcttagaatctacattagatgacattagtggtaaagacaccatagaaactttagttcctcttggtgctggctccttcattaatgcagagattaaaaatgaagataaagttattatgagcctcggttcaggtgttgctgtttccaagacttttgcagaagctaaggaaaccactgctgcacagaaaaaagagcttgaagagactttagataagttatttgcagatcttcaacaaataactgacattgtagctcagctatctccgcaagctgaacagttgatggctaaagctcaagcgcaaatgggacagcctctttattag

SEQ ID NO: 279 - DNA, 1731 bp, Methanobrevibacter ruminantium
ttggcagggataaacttgtttagttcattaaagaaaaaatttgctgatgcaagtagcaaattaagaaataaggtagaagaagaagctaaagatgaagataacattgaattaatcgaagagtctaaagatgaatttgatgacatcgacgaagatctcatcgaatatattgatgaagaagatgaagatgacgattgggacttcgatgatattgataaagaagataaatctaaggaagagcctaaagaggaatctaaagaggaatctaaagaggaatctaaagaggaatctgtagaagaaacagttgatgaggctatagaagaagtcgaagatgtttctgcagatgaagattctgatgaagaagtaaaagattctgatgaagaaaaaaaggattctgaagaaaaggattcaaaagataaaaaagaaaaatccggtttcttctcattcttaaaacgtggtaagaaagaagataaaaaagaggatgaagaagaaattgaagattctaaagaagaggaagttccagaagaagaagtcaaagaagcatcagatgaggaagttccagaagaagaaacatcagaagaggagtctgaagaggaagttccagaggaagagatagaagaatctgaagctgaaccagttgaagaaactgttgaagaggaagcagaagaatctgaagctgaaccagttgaagaagctgttgaagaggaagcagaagaaactgaagaagcaaaagaagaaacttccgaagaggatgaagaagaaaagcctaaaaagaaacgttccctatttagacgtggtaaaaaagacaaagagaaggattcagaagaggaattcgatgcagaagaggctaaaggcaaaggtggattcctatcattcatccgtgaaaagactatctctgaagatgatgttgaagacattctattcgaacttgaattgggcctattggaatcagacgttgcaatggacgtatccagtgtcgttgtagattcagtcaaaaacgaccttgtcggtcaaaaaattaaaagaagcagtgacatagaggaatatacctatgaagcccttaaaaaggcagtttacaacattataaacattgaaggaaagtccatgaccgagcttcttgaagagaaggtcgctcaaggagagcctcttgtcgtcatgcttgtcggtattaatggtacaggaaaaacaactacaataggcaaattagctaacttttacattaaaaaaggttacactccagttattgcagcatcagacacattcagagcaggggctattgagcaggttgcctatcatgcagataagttgggtgtcaaattaatcaagcatgagaaaggttcagacccagcagctgtcgctttcgatgcagttcagcatgcaaaggccaaaggcaaagagcttgtattgattgacactgccggaagaatgcaaacaaataccaatcttatggatgaaatgaagaagattagaagggtctccaagccggaccttgttgtatttgtaggagatgctttaaccggaaatgacgcaaccgaacaggcaagaaaattcaatgaagccattgacatcgatggagtaatccttaccaaggcagatgcggactctaaaggaggagcagcactgtcagttggttatatcattcaaaagccaattctcttcttgggaatgggtcaatcctatgatgatattaaggaatatgatcctgattggatgctagagcaaatattctcttaa

SEQ ID NO: 280 - DNA, 2649 bp, Methanobrevibacter ruminantium
atggatgatgaaactaataacaatcaatggaacagttcaacaagcttcatacttgtcatggtaggatccatcatagcattggcagggatttggagattttcctatcttatttatgaaaacggagggggcagcttcctaatcccatacatattagccatcgttatcatggtcatcccccttcttgtccttgagtttggagtgggattcaaatacaaggcaagcctgccaaggatattttacaatatcaagtctgaatttgaaatagtggcatggtttatccttttcctaatattcatagtcctaatctgctatacttgcataatgtcctgggaccttatctacatagtcctaagtttatttaaaggatggggcaataatcctagtgttttctttacaaccaccctacttcatagcacctctaatccatatggcttaacttaccttgtagttcctattggaatcggcctcatattaatctgggccttgatatatttcatatctcgaagggaaataaataggggaatatcattagtgacaaaattttccctggcattgacatttgttctcgtcatcatcctttcagtctttgcccttcaattgccaggatccagaactggccttatggccttgttcaatccaaattgggaatatctcttggactataacatttggctcactgcattcggacagcttatattttcctatggccttgcatatggaatcgcaagcacatattcctcctatcttccagaggacagcaagcttatagacagcgcatgggttattgttctaatcagcctaatattcgaaattctgatgtctgttctcatatttgcattgcttggacatatggcattgggaaagaacatgcctattacaagccttgtaagcgacagcttctcattgatatttgtggttttccctaatgtattcaatgtgatgggctcatgggcaacaataataggtccattgttctttatggttatatttatagggggattaggtgcattatttgctcttatagagcctttggcaaatgcaatatgcgaaaagttcatttggactaaggatagggcaataaagacattggtcttggcaggactctttgcatctttcatatttgcaacaggaatgggagagtatttccttaggatagttgacggcttcataacccaatttgcaataattctagttgttttggtagagatattagtattcggatggctttttgaccttgatgatataagaaatgttttaaacaataattctagaataaagctcggaaaatattgggtctatctaatcaagtttgcaattccgattcttcttattgtaatctggatattgggagtttataatttgattataactggagacaggcaaagccttcttgttcagtccattttagcttcaatcattgttattgtgcctctagctctaactgtagctccatttaatggagaatattctcttggctcaattacaggaggatataattactttagggacagtggggatgatgaagaggccaaatcaaattcaaagccagacttaaagtccagattcacatcaagattcacatctaaggataatgatgttgataatggcactgaaggctatgaagagaagacctatgttgaaaagacaatagatgactatgagggctatgatggtgtagtggcaatcacagatgatgaagaggaaaattccagccttaaatccagattcagttgggacaagtttaaaaagtctaaaaatggtaagaatgttttaaataatgttgatttgtctgcgaaagagtttgatcctccaagcgatgatgattatgatgattatgaaacttataatagtttagatgatggttatagccaaggctctgatgattttgataatagtatggatgattataggtctaaatctaagtccaaatctaaatccaaatctaaatccaaatctaaatccaaatctaaatcagaatctaagtcattatttgaaaagattaatttatttaataaagaccaaggagagaatgattatttggatgataattatggctataattctaatgataattatgaagatgatgattcctcctttgaagatgtcttcgatgattttgattatataactcctataagggaagaagaacctaaatctaaacctaaaacaaagtctaaaccaaaatctaaaacaaattccaaatcaaaatctaaggctaaaggtggaaataaaaaacctaaattcattagtgctgaggatcttgatggaattgaaagtttagatgatttaagtagccagcctaataagaaacctgcttctaaaaagacttctgcttctaaaaagaaatcaagttcaaaatctaaaaaggaatctggctctaaatccaaaaaagcatcagaacctaaagaagaacctaaacctaaagaagaagaaatagaatatgaagagttctcagatgatttctttgatgatggtgtatttggagaggaaggctatgaagctcttctagacgattatgtggaaccgaaaccaaaatccaaaaagaaaaaggcatcttccaaatctgaccaatctacacctagggattctaaaccctattatgattatgaaaagaaaggatcagattctgtttttaatttagatgattaa

SEQ ID NO: 281 - DNA, 732 bp, Methanobrevibacter ruminantium
atgattaaaaatcatctaatactttatttttttatctcttatctttttttagtccatttctttacctatttaactatttctattcctattattttctatcattttcattttttatcattatttgttcatgatttttcaattaatttacatatttatccatattttcaaaatataaaatttataaaagataaaaacatacctataattatcaaaataggtgattatatggataaaaaaatgacagttttattggttgccctattttgccttctctgtgtaggctcatatctaatctttgaacctgccaggcatataagctatcatgaggtcaatctcactgacacctgcgttgcaaaggtcccggtaaccgataaggtatcttcatatacagacaacttaaacattcactactattccgattatgaaaacgatcttaacattacaagtttttatgatgtggctccggaatcttcgtctcaagggcatctgagaatggacaatcttaaaaaggaagttttaggtacggaaaagggaagtgcaggcaatctcacttattataaaaacaataatgccggaacttacacaatgtatgttgaagatagaatgtcacataattatattttgctttccgctaaggacttaacaattttcactaatgtatattctagcttagaggctagaattgtggtaaatgaaactgatattgatagtttggactcaagctatgcttaa

SEQ ID NO: 282 - DNA, 1737 bp, Methanobrevibacter ruminantium
atgaacactgcagagattttagtcaatttgcttgaaagggatggaaatgaatttatctttggccatccaggtgaacagatacttccattttataaggcattgaaggactcttcaatcagccatatcctaacaaggcatgaacaagctgcagcccatgctgcagatgcatatgcgagggtttctggtgaatacggcatttgcatatcaactgcaggtcccggtgccatgaatctggtcatgggagcctccacagcattcaaggattctgttccaatgcttgtgataaccggagacaatgactatgataaaaaggactctgacatttttcagtcatttcctataaactctgtctttgagaatatatcaattaaaagcttccatccttatgatgggaaatccgctgtttacaatatgattgaagcattgattcttcttcataagtttccaaaaggtcctgttcatatcaatctctctagagatgtacttttagaagagattgattttgattctattgatttaagagatattggtctatctaatattccttctttgaatcttaatgattctgatataattgaaaactttgatctttttgatgattctttagataatttatatgacttttcacaaaagttatccgctgatgtagatataactattcaatcagctattaaaaaattaaaggattcgtcaaaaccattagtcatactaggaaatggtatagtttggtcaaaagctacttttaaattaagcgactttttaagtaaaactatgcttccagttgttaccacatatcactcaaagggaatagtcagtgaccatgacagattgaaccttgggatagtaggtcttaggggaaactcattgtcaaattatgcttatgagaattcagattgcattttggttctaggtgccaaactctctgaacgtacaatcggtgcttccgactttgacattgccaaggaaaagatgatacatgttaatattgatgagaattgcttaaagggaaaaattaatatttgcatggatgttaatgagttcttggactgtcttttggatgaattagatcaagataatggaacatttgattatgatgatggatggatagatgagatctactccaattatgaggaattgattgttggtggaattgaagaagtggaagaaaactttaatccattaaggcctccttatgcgattaataggattatagatgcttttaaaggagcatatttcctatcagatgcaggaacccatacgacatggactactttgcttgcaaaaagcgattcattcggcaagcttttgttttcaggtggctttggtcctatgggatatagccttccagggtccattggtgttgcatttgccttaaagaagagaggaattgatgaaagggtgcttgtcatctgtggtgatggagatattcaaatggtaattcaggaattggctacaattagggaatatgatttgaatattgatatttttataatcaataactctcagttaggaataataagacaatgggaagagactgtttatgactttgataagtatcaggttgaccttattaatccagactttgctaaattggctgatgcatatggtgttgattctatgaaggtggaatctaaggaagaccttcaattggctattgagatgtctttggattcaaataaggcatttttagctgatgtatgtgtttgtgaagagaatattcctatgcctaaaaaatag

SEQ ID NO: 283 - DNA, 348 bp, Methanobrevibacter ruminantium
atggatggactagaaataataaatagcttcaataaagaaacaatttacgaatttagcgaagcttttaccatatttgaagatgaaatatatttcatattcaaagtagatatcatttcaatcaatgcaaacccatccaaaactaaagataaaaataaaaataaaaataaagagaacaaagataataaaaaagctcaaagaataatatcccatttagaaatagagccaatagcttatctattaaaaaaagctgaaaatgaagattatcaaatagaagcgattgatgaaaaatacactgaatttattggaaaaaataaagataaactcttaaaagagtttttaaaccaataa

SEQ ID NO: 284 - DNA, 516 bp, Methanobrevibacter ruminantium
atgattgatgaagaaccaattaaaacaactgtagaagaattaagaaagcttattcacattagcaactatattggagacgcaatagaaactgaagacaaattattaatccctgtatccaaagctgcagtaggattcggaataggagagcaaaaggctgataattcacttgccggaaccggtgcaggtgtaagcgttgaacctataaccatggttgtcgtatcaaaaggaaacagtggagttgatgaaataaggacaatcaacctatcaaaaggaaaccaaaccaacaagacattaaacgaaatcggattaatcctaactgatgtcttaaaagagttcctcccatcaaaaggcaatgacgactacatagatgttgatgacgtaagtgaagttgatatccaagacgcagacataaaagaaaaggtcgaagatgctgttgaagaatcagacctaaaagaaaaggttgaagaagaagtagaagaagcagaagaatcattaggcattgaaatagatgactaa

SEQ ID NO: 285 - DNA, 1167 bp, Methanobrevibacter ruminantium
atgaacgaaatattattaatgctcccaggtccaacaactgcagacccaagagtattacaagcaatgagcaaagctgttgtaaaccacagaggagacgaatttggagaaatctatacagaaacaaccaaattaatgtctaaaactttccaaactaaaaatgattcttatatcctaacaggttctggaacttctgcaatggaagcagcagtctcaaaccttgtcaacagaggagataaaatattaaatgtagtaggcggaaaattcggtgaaagatttgcagacatctccaagatgcatggaatcgaatccgtacagttagatgttgaatggggaaccgctgtaactccagaccttgttgaagaagccttagaaaaagacgaagacattaaagcaatcaccatggtacacaatgaaacctcaaccggtgttgccgcacctatcaaagaagtgggagaagtaatgaaaaaccacgatgcattattcattgtagacacagtatcctctttaggaggagactatgtggatgtggacaaataccacattgacgcatgtgtaaccggttctcaaaaatgtctcgccgcacctccaggccttgcagcaatcacattcaatgacgacgcatgggcagcatgtgaaaaggtagaagacaacaattactacttgaacatgcctaaatacagagcaaacggtaataaggaccctgctcaaaccccttatactccatctgtatcattgatctatgcattaaaggctgctcttgaagttctccatgaggaaggtcttgaaaacagaatagaaagacaccacacagcagcagctgcatcaagagatgctgttaaagctttaggtcttgaattattccctgatgaagctgtatcctctgcaactgtaactgcagtaaaaatgccagaaggagcaaatgacgaccaaatcagaggaaccatgctcaacaaatataaagtccaattagcagggggacaagaccaccttaaaggaaacatattcagaattggacatatgggtgtaatcaactatcaagaattagctatcactttcactgcattaggattaaccttaaaaggattaggattagttgaagatgcaggtgccggtgtggctgctcttgcgaaccattacatcaaattcaaacttttagaaaaagtttga

SEQ ID NO: 286 - DNA, 1101 bp, Methanobrevibacter ruminantium
atgagttttagaacaaaaagagtaattatatccaccttattagtaatgatatatgaattctttctgatgaaatatctttttttactctttggaggattggatgacatttatttgcttttactcactattttattcggtatattgaatatggttcccatgttctttgaggaaaagaagtcaaggcctattacaaggcttcttgatacgatatcaggattttggatatggatgtctctcttttacttatttgtcatattgattatctatatcggaggagtctatattgattggccgttttatattatagtcattctagttcttcttgttccattattgacagtctattcctatttccatgcacataagatcattattcatgaaaggacaatccaaatggataatattaatgaggatatcaacattgcccacctttctgacgttcatttcggctcaacaaggcatgataagatcattagggatctttctgataaattgaaggagctttcagattattgtgacttggcaattatcagtggagacattgttgatgggtcctctgctattgaagaggatgattttctacctcttaaggatgtgaatatgcctatagtctttacaccaggcaatcatgactcatatctggatattgaggacgtctttggggcatgcagaaatgcaggcattattgttctagacgatgagggaatggaattcggcaatcttaatatatttggaatgacattcatctttggaatgacccgcaagtttgaagagtttgaagtagtcagcacaggtgtattaggggatttcgttaaggaagataaggtgaatattatcattttccatgttcctaaaaactgggaggacttttctaaattaggatttgacattcaattgtctggccatactcatggaggccagttccatccacttacttggatatgcgatcttatttggtataacagaggtctttttaaagctaatattggtggcaaggacaggtatttgcatgttactactggtgtaggctctatggattatccttttagatggggtactgattcagagatagttgttctaaaattaagaaagaatgattag

SEQ ID NO: 287 - DNA, 1266 bp, Methanobrevibacter ruminantium
atgcttaaaagaacagttaaaaagaatggagatgaattatttcctcttggattgggagctatgcgacttccaactaaaaacaattcaattgataaggatttggctcgtgaatttatcctttatgcaattgacaatggaataaattatatagacactgcatatgcctatcatggtggagaaagcgagtcctttttaggagatatattgtctttaactgattccgatggagtaaaatacagggataaagtcaaattgtccaccaaatcaccttcttggatggtaaggtcaagggaggactttgatgcctttttaaatgaacagttaaggcgacttaaaacagactgcattgattattattatcttcatacaatcgatttaagcatattagagcgtcttaagggattgggagtttatgagtttctagaaaaagcacgttcagagggaaagatcaagaatattggattctcctatcatggcgcacctaatgagttcaatgacttgattgacgactatgattgggacatggttcttgttcaatacaattatctggatgtgaatgcacaggcaggaattcgcggaatcagatatgcatatgagaatgatgtggctgtattcattatggaacctttaaaaggaggaatactcgctggagaattgcctaaggaagttgatgggctgtttaaaggtgtcgattccaataagtcttcagtggattgggctttaagttgggtcttaaaccaaaaggaagtcacttgcgtactctctggaatgggttctatagagcagataaaggaaaatatgaatattgcagagagagttgaagtggattcattgtctgatgatgaattggctgtattggagaaggctcaaggaatcttcaattcaatgatgaaaataaattgcacaggctgcggctattgtcttccttgccctaagggagtaaacattccagattgctttaatatttataatgagaaatatttgtttaataaaaaagcatttggacctattcccggtgctatggtgaattattatatggttgttggtggaataaccaataagcagtcaaatgcaggtctttgcaatcattgcggtaggtgtaaaagattgtgtcctcagtcattagacattccaagccatttagatagtgtaaagtctgaattcgagaagtttggatttaattatcagattaagtttattagaaatattgcaatgccttctataaataagatatctaaggtatttgatgtctttaagcattcttaa

SEQ ID NO: 288 - DNA, 4308 bp, Methanobrevibacter ruminantium
ttgtacatctcagagatagagattaatcaaaacattatcctaaacactgaaggcaataaaatatatctaaacaattcccctaaaagcaatatacacgataactggtttggaaacactctgctgaactatgatgaggtgccatatgaaggctgcacaaattggatattcctaaatggagaaagcaaccaggtctcactggagaatccgatcagctttgaaatcacatttaccctatcctctttcaataagaatacaaagaaaataagcaactatgatgatagaaagcttccattcaatctaacagcacatgcagagcatggaatcttaaatccgaacagtaatcttttaggaaaaacaacaatatatgaaacagaaatcatcaatgttgagagaataatcggaaatattgcaaatatagattcagaatttgaaataatggagtttttagtcactgacggaaccacattctatgacttgaaccaactcatcaacaacaacagcaataatgaaatcaatataagcggaaattacacatatcatgatgatatagactttgaatttaaagagggaatcaatgtcaaccgcagcctaatcattaatggaaacggatttacaataaacggattaaactcctcacgcatcttcaatataaatggagacaatgtcacaataaataatatttcccttataaacggaaatggatatgaggacacctacgacagtgacggaggagccatatactggaaaggagctgacggaaccctgattcaaagcaatttcacaaacaacagcggatataatggaggcgccattctctgggaaggagacaatggaagaataataaacaacacattcaaaaacaacagcgcattcgatggaggaggtgccatcaccataacagtagagagaggaataataataaacaacacattcacaaacaacagcgcatcctacgatggaggcgccatctacctaatagcaagcagtggagagataataaacaacacattcacaaacaacagcggatataaaggaggcggaatgatctgctatgcagataatctaagcatgatcaacaatacaatggaaagcaacattgcatccgacgacaatggaggcgccattctctgggaaggagaaataggaagaataataaacaacacattcaaaaacaactacgcctctgaagaaggaggggctatcagcataagaggagagataggagagataataaacaacacattcacaaacaacaacgcatcctacagaggaggagccatcagcataataataactagtggagagataataaacaacacattcacaaacaacagcggatatagcggaggaggaatactttgctatggaaataatgtaagcataatcaacaatacaatggaaagcaacattgcatcctacgatggaggagcactttacgtcagcatggattatgcaatgataataaacaatacaataaaaaacaacaatgcatccgacaatggaggagcaatctactgggatagatataagggaataataagcctaaacacaatcgccaacaataatgcaaatcatgggggagcaatctactatgagggatattcttcaaatcttaactataacatcatcttaaacaataagaatagtgaaatctatttcgacaatgtcagaactttcaacggaagcaataattggtttggaaacaatgcaagcaattataatttgaatccaaacactagcttcgaatatgacaatagcccaaatgtaacccttagtgattggctatttttaaatggaacagcaaatccaaaaatagtgaatgcctttgaaagctcccaaatcttatttaaattatattcctatgacggaatattgataagtgaatatgacaattccctaataacagacaccaagctaaacttaagtgcagaaaggggaagatttgacaagacaagcgccagtttcaatgagccgataaactatactgcaatagaagggggaagagatacaataagaggagcaatagataagagtggatacagcataaatctaacaaacaggagagtatcctcaaaaattgcaatggatactaaagagataaactatagcagaaatgcatcaatcaagcttaattacaatgactttgcaggaggaaatgtcacaataagactaatgggagaaaataatgaatacctctttgaaaacatgaccctgaacaagacaatattccttggagtcataaatagggacagttacaacgtaagaatagaatattcaggagataggtcattcctagaggagaacataagcgaaagccttatagtgaataaggcaggaacaaaaatagttccaacaaatgacacaatagacctaggcataggagagaactcaaaagtcaactacactttctatgttatagatgatgaaggccaatacataactaacccagaggacattggaaacataagcttcaagtcagatggaagcgcagtcgaagtagattcaaagacaggggaaataaatacaattaaggaaggaactgcaaacatcctaataagattccaaggagatgaaaaccatcttgattccaatgcaagtgtatatgtaatttcaagtaataaaataaggaccaaaataacagcagaaaacctaacaacagattataaaaaggatgactacatcatagcaagattaaccgacctcacaggaaaaccgatagccaatgcaaagctgattgttgaacttaatggcacaaataactatacaactaattcaaagggagagataaaagtcccaacaaaaggattggattcaaatgaatacatagcaaagatcatctatgaaggagatgaaagctacagattttcaaatgcaagtgtaagactaatagtgaataagctaaatacagaaataactgcaaataatatcacaacaatctataatataactaaagaattggtgattagactaaaagacgtcaatggagacccagtaagcggggttgaactaactgttgacctgaacggaatgaataattatacaacagatgataatggacaagcaatagtggaaataaaaggattgattcctaacaattacacagcaaagatcacatttgaaggcaatggaaactataacaaggccagcacagaatcagatatagaaatattaaaaattccaagcattttaaatggaacagacatgacagtaaactataaggaagataaatatttgacagttagcctaaaagacaaagataataagcctatccataatgcaagtatctcagttgaattagagggtattaaaaattacactactaattctgatgggcaaataaaagttccaacaagcagtttacctgcaaaaaaccatacagcaatgattagatttgaaggaaacgaaatttacgaaaaatcaaatgctacagcgaaaataactgtaaataaaatttccggcaaattgactgcaagcaatgtcactgcaagatatggagacaatcagaacctagttattagtttaaaagacagcaagaaaaatccattaagtggttttaaagtgtctgttgacttaaacggcaaaaagaactacactacagattcttcaggacaaatcaaagtttcaactaaagatctagttccagacacttataaggcaatcatagtctttgcgggaaatgagaactatacaggatcaaatgcaagtgcaagtgtgagaataaatagaataaatacaacattcaaatacacaaacatgaatacaattgcttttgattcaaatatagaaggacgtattggagaatatttccgcttccaattgttggatgaagatggaaaaccattatctggcaaacaagtctttattggatttaatggagtcaaatacaatagaacaacaaatgaaacaggagaggcaaggcttcaaatcaacttaaaatatgtcaaccattatacctttgcaatagcattcttaggagatgattattataagggaagctttaatgttgctttaatcaatgtgactgaacagattccagtcttaagcacaagtgctaaaacatataaatcaagtgcaaagaccaagactttgactgctactcttaaatcatctagaggacatgtccttgcaggcaagaagattagttttacacttaatggaaaggtatacactgcaaatacaaacagtaaaggtttagcaagtgtaaaggtctctttaagcaaaaaaggaacttatagttttacagttcagtttggaggagacagtacttataagaaggtaactaaaagttcaaaacttacaataaaataa

SEQ ID NO: 289 - DNA, 4176 bp, Methanobrevibacter ruminantium
atgaaattaaaaagatattcatacataataatgatatttcttgtttgcatgataagcatctctgcaataagtgctgcagatgactcatcaatagctactgacgattcaaacaagataatcaatgataataacaatcaggacattgtattagaagaaaatggaccctcaacaaatatagctttagaagacaagaattataaaattgaaaagccacagcttaaggaaaatagcccaggcaattttaccgatttaaattatctaataaatgaggatgaaaccacccgccataacactacaatcactttagaccgtgactacatcggcggtgagaaaggcataagaatcgatcgtcccctaatcattgacgggcaagggcatacattaaatgcatcccaaaataacagagtcttccatattacttcagaaaatgttacccttaaaaacatcattttcacaggaggtagatcagattatggtggcgcaatttactggcaaggagacaatgggaagataatcaattgtaactttacttacaacacagccactaaatatggcggtgccgttttctggggagatgacgaatttgaaggtacagctgaccaaacaatagctaaagatggaattataataaactctaatttcatctccaataaagcgaatgtaggaaatggagaggcctgggaaaatggcggaggcggagaaggtggtgcagtttactggtatgccaataatggaaccatatgcaactcctatttccataataatcgtgccggtggacaaggaggcgccatcacttggaaaggaaatgatgggatcatatgcaataacaccaacttcactgccaatagtgcaggagattctggcggtgccgttttctggcgtggagataacggaaccataagcaataactgtgagtttaataataatatagcctatggtcgtaccagtgatggcatatccagaggaggaggagctattttttgtcatggcgaaaatggtaagataagcaactgctcttttatggaaaacagtgcaaaacctgaaagtgaaagcggtaaaggaggaggagcaatttatgctgaatataatactttcatcacagattgcatttttataagaaactctgcagattattatggaggtgcaattctcatattcagaacaggtgatgtctatagaaatatctttataaacaacactgccttaaacggcaacactataacattaaaaggaataggccattcaaccataacaaacaacattatcctaaataagacaaatgcaatctactggaatgaatccgactatacaatcgaagctaattggtttggaaacaatgctacacaatattcagaaccttatgaatactcacaaacctggttgtttttaaatgcaacagcaaatccaaaccctgcaccattcaatattccaactgaagtgaaattcaagctatggctctacaataaaaagactaaaaaaataacagaatatgacaattccttactgccaactatccaattaagcttaagccaaacaaagggaagcattaataaggagactgcaggattggatgacccaatcaactatactgcaaatgaggtaggaacaggaagcataactggaaaaatggaatggataacagatagcatcttctttgaaatcgtaaatgaccctaaattagaggtatctgttaatcctagcgaaatcgactacggagacaatattaccctccatctcggatatgaggatgaggctacaggaacagtaaacatcagctttaaaggaagtacacacgaaaaaacaatagaaaacattcctttaaacaagactatcacaattacagagtccattttgccagacgaatataccgttactgtattctattcaggagataatcaattctcaagagcaagtaagaccgcagatgaaaaattgaaaataaatcaaaagaatccgaatatgacagtgacatcctatgagatctatgtaaatgacactaacggagtcatgtttagcataaagctagataaggatgccacaggaaagataattcttacaggagacattggaagggaaatcaatctgactgaaggcagcataaaggatgggaaaagaattattgaaattaaaaacaatggttttgatcttggcaaatacaatgtcacattttcatatcctggagatgagatatattgggaatatgaaacaactgccctctcagagattaaagtcatagaaaccaaaataattccacaaaaggaagaaatagtcttaataattggcgataagtcaaagataaactataccataaatccaagcaatgcagttggagatgtcactttcacaagcaatgacacaaatgtggtcaaagtcaatggaagcggagatattgaggcaatcgataaaggacaggccacaatcacaataaaattctctggaagcaaagactatgccccttcaaatgcaactgtaaacataacaatcggcagggaaatggctaagttaactgccgaaaacattactgtaacatataatgctgaaggataccttaaggttgccttaaaggatagtaaaaacaagtcaataagcggagccatattgattgtagacttaatcaataaaacaaattacactacagactccaacggagagataaaagtcccaacaaagtcattggctgctggaaactatactgcaagcatagaatttgaaggaaatgataagtacttgccagcaaacacaacagcaggagttacaatcgagaaggataatcctagattgacttcaaacaatatcacaaacaaatatcatactgaagattacctgatagtgagcttaaaggacagtgcatcaggacctataagcggtgccgagcttactgtatacctaaatggaagcgaaacttataagacagatggaaacggacaaataaaaatccctactaaagacttgcttccaaacatatatgtggcaaatataagctttgcaggcaatgaaaactacacagaagcaaacgcaagcgcaagcataaacataactaaactagatacaaggctgaatgcaacagacacaatcacaaaatacaatgtaaataaagatatgatagtcaccttaaaggacattgatggaaatgccataagcggtttgaatatacttgtagatctggacggagttaaaaattacacaacagactccaacggagaggtaaaagtgccaacaaagtcattggctgctggaaactatactgcaaacatagcatttgaaggcgacaatatctatattggatcaaatgcaacagcaaaggtcacaatagaaaaagagagcaccgaaataagcgctacaaatgtcagcgcaaaatatggctcaaaccaaagcatgatagtcactctaaaggacagccaaggcaatccaataagcggagctaaagtctctgttgagatagatggcaaaaaggactacactaccgactctaatggacaggtgaatgttccaagcaaaaacatagttccagacacttacaacgcgaccattacttttgctggaaatgagaactacacctcttcaaacacaagcgcaagcgtggtcataaaaagagtcaaaactgcacttaactacacagacatgaatacaactgcatttgattcaaatattgaaggaagagtaggagagtatttcagtttccaattgcttgacgaatatggaaagccattatccggaaaacaggtcttcattggatttaatggagttaaatacaaccgtacaacaaatgaaacaggagaggcaaggcttcagataaacctgaaatatgcaaacaattacacatttgccatagcattccttggagatgaaaactatagcggatcattcaattttgcaattatcagtgtaagcgaacagactccaagcttatccacaagccctaagacatataaggcaagtgcaaagacaaaggcattgactgcaacattgaaatcctataagggaacagcaattccggacaaaaagattacttttactgtcaatggaaaaacatatagtgcaaataccaattcaaagggcatagcaactgtgaatgtaagtctaaacaagaaaggaacttataactttacagtccaatatgcaggagatagtacttataagaagataagtaaaagtgaaaagcttactataaaataa

SEQ ID NO: 290 - DNA, 789 bp, Methanobrevibacter ruminantium
atgaagaatatattaatatccaatgatgatggggttatgggtcctgggatattggctagcaagcaggctcttgaagggcttgccaatgtggttgtcgtagctcctcaggaaaacaacagcgctgtaggccgcaaggtcaatatcatgaagcatatgtatttggaaaactatgaattggctgatggaagcatggcttatggcttgtctggaactcctgcagattctgttaatgtggggattaattatgtgtgtgatgaggttccagatcttgttgtaactggaataaatcctggaataaacatcagcagattgcagataacaacatctggaactgtctgtgcagcgattgaagctgttggtttaggcattccagccattgcatgctcattgtttttggatgacgattgctttaagcaggatgatgagggcaattggtatgtggatacagattacagttttgctcaaaagatccttgcaaaacttgtaaagaaggtattggatgagggcatgccagatggcgttgacttatttaatcttaatattccatctaagccattatcggataagattaagattacaagacttgcagatagcatgctgaagtttaatattcttgaaagggttgatgatgatggcaatgatactgtcatgaatgttccggaactgattgaggattatgaggaaggaaccgatggatattgcttgcttgttgagaggaggccaagtcttactcctttgaatgttcattttggtgctgaaattagtaatttggaagattgggagttttag

SEQ ID NO: 291 - DNA, 735 bp, Methanobrevibacter ruminantium
atggatataaatgaatgggaagaatggtatgaagagattcttaatacctttggatttcgtagggaagatgatgagaagactgcagacctattggatgaaatccttgcagatcatggttttttgaccattgatgagttctatgatgagatcatgcttaagaagggatacactgataagtttattgtctttggagcaggaccttcattgaaggagcatataagattcttgaaggaaaactatgacttaagcaaatacatgcttgtatctgccgatggggctacaacagcccttttggaagaggatgtcgttccagatattgttgcaactgacttagacggcaagatgtctgaccttttgactgcaaattcacttggctcatactttgtgattcatgcccatggaaacaatgaggagcttattgacctatggacaacaagctttaataagatccttggaacaacccagtctgttccagtaggcaatctctataactttggaggattcactgatggagatagggcaatgttctttgttgtagagcttggtgcaaaagagatggttcttgctggaatggactttggaacagttgtaaccaagtattcaaggccaaacattgagggtgagacaggccctgccgatgagataaagactaaaaagcttatttttgctgaaaggttattaaattggattagggaaaatgaggatgtggaagtgattaatttaatcgatagttaa

SEQ ID NO: 292 - DNA, 627 bp, Methanobrevibacter ruminantium
atgaaagaaattgaatttgacttaaagaacaatccgttttataatttcctatcttcaagatatagcatgtctgcacgtttgaatgtggagaagatgtggaattattcaaaggaaaatgatctttccttttttacattatctcttgctgctttaatcaacagcttgaatgaaatccctgaaatgagacgaaggatagtgaatggaaaggtcattgaatatgattatctggatgcagtttgcccgataatggatgaggatagcggaatctataaggagatgagggtaaaggctccccagagatttgatgagatattggattggcatgattatgttcaagagcatgaaaggaagattttaaatggaacagaagacgcttttgaggtgaagactaccgaaagagatgagctgaatattgccaatttctcttgcattccttgggtggattttgattcaatcacaaattgcacagcaagctccaatcagattcagcctttgataacttggggaaaggtcaatgaggattatgaaatgactgtggctataacagttagccatatctttgtaaatgggcgagagttagcttatttttatcaattcgctcaggacaattttaataatcttttttag

SEQ ID NO: 293 - DNA, 1119 bp, Methanobrevibacter ruminantium
atggcaatagaagatattttgatgtttgacgagacaatatttaatgatataaatgcattcaatccagactatatgccacctaactataattttagagacagtcagatggaaggaatggctatggctatacgccctgccataagaggtggacgtccaaccaattcagtaatattaggatcatgcgctacaggtaagacaactgcaattaaaaaggtatttgaattggttgaaaagactacagataaagtggtttgtgtttatatcaattgtcagcttcacactacacgttttggaatcttttctcaaattcataaaaagatatttggacatcagcctccagagactggagttccattctcaagggtatatgaaaaggttatggataaactttcctcagatggaaagtctcttattgttgcctttgatgatgtaaactatctattccagactcctcatgcaaacaaggtattctatgatatccttagggcctatgaggaatatgaaggggtaagaacaggaatctttgcaatcctttcagacttggagtttcgattcgcccttgacaagaatgtaaataccgtattcattcctcaagacattgtatttccgccttataactatagcgagatattcagcattctaaaggatagggctaaggcaggattcttcccaggtgttgtctctgatgaaatcattgaagagatagccaatcagacctatgaagtaggtgacttgagagtgggaattgaccttttaagggttagcggaaacattgccgaatccaatgcaagcagaaccatagaattggagcatgttgaagaggcagttgcaaagcaaggctctgttaatcttatggaaacaatcaattcattgaatgacttagaaaaaaccatgatcaaggtcttaattgatagggatgaggttgttacagcaggagcattgtctaaggaatttaaggagcaggctggagtaagctatgcgacattcaacagaacccttgaaaagttggaattcttaagattggttgatacaaggtatacaggaaaaggagtaagaggcaattccagggagataattttaagattctctccagaggatattaaacgttgcaatctttag

SEQ ID NO: 294 - DNA, 192 bp, Methanobrevibacter ruminantium
atgatggtaagccataataacagaacttgtgatttaagaaaaaaacaaaatttaagagatcctttgactttcaacaaccttagaataaacattaaagattgcatggtaatatttgtagtgtttacagtattgcttttatctattttagctgtaagtgcagctccaagcccagattttatgctctgggtataa

SEQ ID NO: 295 - DNA, 474 bp, Methanobrevibacter ruminantium
atgattttaattcattgtggtgcaattatgagtgaaaataatcaaagggagaaaaaattcgaatattttgaagttactgcagatattggattttatgcttatggtaatactctggaagaggcttacgaaaatgctgctttagctatgtttaatgtggtgactgatatagataaggttaaaactagcgaaacccgtgagtttgaggtcgaatcagaggatttggtttctcttttatatgattatttggatgagttcttattccttcaagatactgaattcttgtttttcagtgagtttaaggttgatatagataaaacagaggatggttataagttaaattgcattgcatctggtgaggaaatcaattgggacgttcatgttccacgctctgaagttaaggccatcacttttcataagatgtgtgtaaaaaaggaagatggtgtttttaagcttagggctattttggatttgtaa

SEQ ID NO: 296 - DNA, 1449 bp, Methanobrevibacter ruminantium
atgtcaattagagaaagtcttgtaaaagttagagaaaatgtttgggaacttccaagtgactataagaaggaaatgagagttcctggaaggatgtatcttgatgatgaagctgtaaagaccattgaagaaggtgctcttgaacaggtttcaaatgtggcctgcatgcctggtattcaaggggcatcaatcgccatgcctgatattcacttcggatacggtttcagcataggaggagtaggtgcattcaattataataacggtgttgtaagtcctggaggagtgggctttgacattaactgtggagtaagaatgcttaggaccaatcttactgaagatgaaatcaagccgcatcttaaggagcttacagaggttctctttaaaaacattccatcaggtgttggaagcaaaggtcagataaggcttaaggacaatgagatcaatgaggttcttgattatggtgcctggtgggcagttgaacgtggattcggctgggaagaagacctaaaattccttgaagagaatgggagaatggaagaggccgaatctgaagtcgtaagcaaaaaggctaaaaaaagaggagttcctcaattaggttcattaggttctggaaaccacttccttgaggttcaaaagattgaggaagtctatgacgataatgttgcaaaggcatttggtctagagcctggaaatgttacaataatgattcacagcggttcaagaggctgcggacaccaaatctgttctgattatttaagaaagatggataaggcttatagaaactataagatcaagcttccagacagacaattggcatgtgctcctattgactctccagaggctacaggataccttaaggctatggctgcaggtgcaaactatgcttgggctaaccgtcagatgatgtcccattgggtaaggcaatcctttgaagaggtatttaagagggatgcagaagatatgggaatgagcacaatctatgatgttgcccataacattgctaaaaaggaagtccataaggttaaaaattcccatatggaagttcttgttcacagaaaaggtgcaacccgtgcattctgtcctggaagacgtgagattcctaaggaatatcgtgatgtaggtcagcctgtccttattcctggaaccatgggaaccgcttcatatatcttgcatggtactgatgttgctatggaagagacctttggatccactgcacatggtgctggaagggtattgtccagaactgctgctaaaaagcaatacactgctaaggatattgaaaaagaattgaatgataagggaattcatgtaaaagctaattcagctcctgtgttagctgaagaggctcctggtgcatataagaatgtggattctgttgttaagacctctcacgatgctggcattgctaagctggttgctaaggttgttccactagcagttacaaaaggatag

SEQ ID NO: 297 - DNA, 774 bp, Methanobrevibacter ruminantium
atgattgcaattattggaggaagcggtgtcgatgagattacagacatggcagaatcaatagagaaaaagatagtagataccgaatatggctctgtacaggtttctctatttgaaattgaaggaaaagaagttgttttccttccaagacattcagaaggacatacctgtcctccacataagattaactttaaggcaaatatcatggccttaaaggagttaggggttagtcagattttagctacaaatgcagtaggttcagttgatttggaaattggcccgggatccatagtaattccagatgacttcttggactttactgtaaatagggataggacattctatgacgatgatgttgttcatattgacatgagcgagccttactgcaataggcttagaaatgcattgctagagaattctgattgtgtaaatggaggtcttgtagatggtggaacccatatttgtacagaaggacctagatttgaaactccatctgaaatcaggatgtttaaaatgattggcggaactgttgtgggaatgactacattacctgaagctgttcttgcaagggaaaaggagatgtgctatgcttccatagccattgtatccaattattgcacttccattgccaagcataaattaggagtggaagagataattgaaataatggctgtaaaaaaggaagaattgattagtcttctgtttaatacaattaagaatctgcctgtagactatgattgtgaatgccatcatgcattaggtgatgcggagttttaa

SEQ ID NO: 298 - DNA, 393 bp, Methanobrevibacter ruminantium
atgaatgaatttggacaattacaattaatctggattagaagacttgcaagagaaactggtagaattactgcattgatagaagctggaaatctttctgtaattgatttggtcagatataaaaagagcatttcatcaatggatggattttgtcgttttgtaattgaatctcaagattgggatgatgttagaagaattcctgaaattgttgaagatgttgaagaaaagttattcttgcacttttatgaaatgatcgacagattcgatggagaaggagctcatttagacttttccaaagaagatgagggtaagatatgcttaaatttcgacgatgcttctttagaggacattgtatttacaatcattgatgacgaagacattgatgtgtttttataa

SEQ ID NO: 299 - DNA, 204 bp, Methanobrevibacter ruminantium
atgagaaataatctaaaaatatatagggcaatagaaaatattactcaaaaggaattagcagatgaattaggcgttagcagacagacaattgtattgattgaaaataataaaaatgatccgtcattggaattagcctttaaaatagcccataaatttgatgtgaaaatcgaagacatatttattaatgattctaataaaaaataa

SEQ ID NO: 300 - DNA, 300 bp, Methanobrevibacter ruminantium
atggaaaatcttttaaatttaaaatatacttgtaaagactgtgattttacttggataacattaaatggagaacatagcatttgtcctaagtgccatagtgaaaatattgatttattaggagaagtaaaggatttggatattgaagcaattcttgctcataataaaatgaggggaggatgttgtggttctgcacgtggaaaaggtcctttgacatgtggaaaaccaatgcctgaccatgcaaatccaaatattcctcatcataaccacaataagaaaacttgttgtggatacaatgaataa

SEQ ID NO: 301 - DNA, 1068 bp, Methanobrevibacter ruminantium
atgaatgtaagtgatttaaaaagagaccattatatgctaaagggtccccttgcaaagcaaggctatgactggtggtggcattccctcactgcatacaataaggaaactggggaaccaagacctttctttatagaatactttgtgtgcaatcctgctcttgctgaggatgagcctaccttaggccaagaccctaaaaacattgaagcagggaaaaagccatcctactgtatgctgaaggtaggagcatggggtaaggagcctaagcagattcataatttctattccatgaaggatttcgaatgtccagatgacaagttggatgttaagattggagagttcagcttaactgaaaaacatatgaccggatactgtaaggttacagaggaggaagcacgtgaccatccggagtacatgtgtgatgcaggagagatgaaatgggacttggacattgacaagcaaatcacttttaatgtgggatatggagctaacactctctttagaaaacttaattcatttgaaatgttttggcatgctgaaggaataaagactcaatacagcggaaccattgagcttgatggggtcgaatatgaggttattccagaaaagtcattcggatatgccgacaagaactggggagcagactttacaagcccttggctatggatctcctcatgcaatctaacaagcctcattactggagagaagcttaacaactctgcctttgaagcaggtggaggaaagcctaaggcatttggtatttcacttcctagaaagcttctgataggattctattatgaaggaaagatgtatgaatataactttgcaagattctggaatatggtaaaggttgatttcggatttaaggaaggtgaagagttgaatgaatggtttatcaatgcaagtaataaggacagcaagatggaaatgaagctttattgcaagcgtgatgagatgttgctctttaattatgaagctccaaccggtaagaagctacacacccgtctttggaatggtggtaacggctttggtgagataaagcttatgaaaaaaggacggcacattgattga

SEQ ID NO: 302 - DNA, 2208 bp, Methanobrevibacter ruminantium
atgactgatgtagaacttaaaatcaaagttgcagaaaccttgtctcaaaatgatgtaggcaaaaacattgctaaattggatatggaatccatgtttaagctcggcttaaaagacggagacattatcgaaatagtcggatctaaaaacactgcagctattgctgtcgcttctcaatctgatatggaaacaatcatcaggattgacggtaccacccgtaagaattccggtgcttcaataggagaggaagttaccatcagaagagcagatgtaaaggaagctaaaaaaatagtcctcgctcctatcgatgcaagaatcaggattggtggtgactttaacagggcattcgcaaatcaagtcatggttcaaggcgacttgataaacactggaatcaagacccctcaaagaagggtttcaggaagcggattctttgatgatatctttgatgaccttatgaatgtgcctggaataggtgcaatgagccagatcaagttggctgttgtaagcacaagccctggaggtgttgtaaaagttggccctaacactaaattggaaataaatgaagagccagttgacatctctaaattggaaggtgtatccaatcttgtagatatcagttacgatgacattggcggtttgaaggaggaagtcaagaaggtaagggaaatgattgagattcctcttaagaaaccggaattatttgaaaaattaggtatctcacctccaaaaggtgtattgatgcatggtcctcctggaaccggtaagaccttgcttgcaaaggctgtagcaaatgaaagtgatgcacacttcattgtaataaacggtcctgaaatcatgagcaaatatgttggaggctctgaagagaaccttagggaattctttgaagaagctgaagagaatgctccatcaattatcttcattgatgaattggatgcaattgctccaaaacgtgaagagaccaatggtgaagtggaaagaagaactgttgcacagcttttaaccttgatggatggtcttaattcaagaggtcaagttgttgtaatcggagcaacaaacagacctgattcacttgacggcgctcttagaagacctggaagatttgaccgtgaaattgaaatcggcgttccagataaggatgagcgtaaggaaatcatggaaatccacacaagaggaatgcctcttgcagaggatgttgacttggaccaaatcgcaaatacaacccatggatttgtaggtgcagatcttgaggcattggctaaggaagctgctatgagggttgtaagaagaatcattccggatttaggttcagacgatgagattccacctgaagtccttgaaaagcttgtggtaaccaaggaagactttaagtctgcccaaagggagattcagccttcagctttaagggaagtccttgtacaagttccaaatgtaacttgggatgatgtaggtggattggatgacgctaaacaggaattgaaggaagctgtcgaatggccattgaaatatcctaacaagttcaaggaatttggagtcagacctcctaaaggaaccttgctctatggtattccaggtactggtaagaccatgcttgcaaaagcagttgcaaatgaaagtgaagctaacttcattgcaatcaagggacctgaactcctctctaaatgggttggagaatctgaaaaaggagtaagggaagtctttagaaaggcaagacagactgctcctactgtaatcttctttgatgagattgattcaattgcaagctcaagaggaggcgaatctggagattctggagtaaccaaacgcgttgtaaatcaattgttaaccgaaatcgacggtcttgaagagctagaggatgttgcaatcattgcagcaaccaacagaccagacattatcgatccaggtctcatgagaccaggaagatttgacagacacattaaggtggacgctcctaatgaggacgctagacttgcaatattcaaggttcacaccaaagacatgcctcttgctaaggatgtaaagcttaagaaattagctaaacgtgctgaaggatatgttggagctgacattgaagcagtttgccgtgaagcagctatgctagctttaagggatgatattgaagcaaaagaagtttcagcaaaattctttgacgaggctatggataaggtgaagccaaaaagcagtaatgaagaagaattgatccaatacttctag

SEQ ID NO: 303 - DNA, 840 bp, Methanobrevibacter ruminantium
atggataggcatgtgattgaagcattaggtagggctagaataacagtggaaaatgggaaggttgttgatgtaggagagcctatgattgaatattgtcctttatttgacaagcataggggaataaaggaacttacaaaagaggaaatagaaaaaaacattcaatttagaatagatgactttggaatgtgtactaaaaatcgtcaattaagacttaaagactttttatcctttggaatatctgaaatattgtctacattgcttgatgagaatcttattgactgtgcagtcatggtttgtgaaggatgtggaactgtccttgtaaccgaaagtgagatggctcagggagttggaggaagagtctctggacttgttgaaacaagtcctatttcccagagctttatttggaagagttttggtcaagatcgtgttgttgacagcgagactgcaagaatagatcaggtggatggccttagattggctattgacaatggatataagaacattgcagtaacaatttgccttgctgaagatggaatcattcttagggaattggaaaaggaatatgaagacattaatgtctatatatttgcagtccattcaacaggccttggaagagaagaagcagaaataatatttgatactgcggatgtggttacaggatgtgcttcaaagcatcttagggatattggaaaggagctaaaggttttctctgtaggaacttcaattccaatttttgctgcaagcgataagggtgaggagtttattaaattaagattggataaaataggtgggccaaaaaagaaaactggtaattccaaacagcctaatcctttagtttag

SEQ ID NO: 304 - DNA, 636 bp, Methanobrevibacter ruminantium
atgtcaaaagatgtggttttaatattatcaggaggtttagactctactacattattatataaattattaaatgaaggaaataatgtcactgcactcagtttcaactatggccaaaaggctgctatagagattgaacgtgcaagtgagatatgtaaaatgaacgatgtaaatcattttgtttttgatataagaaatattgtagacttgcttagcagcagcttaaccgataaggataatgacaatgttcaagagccaaaaagcactgttgttccaagcagaaatacaatcttgcttgagcttgcaactgcatttgcaataagcaacaacttagaggaagtttattatggtgcaatcaaggcagacactggcgactatccagacaccactcctgaattcttaaagcagataaatgaattaaataaggttaataattatgaatacattccagtttgtgctccttttattgatacagataaaaaggatgttgtaaagcttgctttagagttaggagtgcctattgaaaagacttggagttgctatgtaaacaatgacggaactccttgtggggaatgctttagctgcaagtcaagaatagaagctataaaagaagctaaggaagaattaggtattgaataa

SEQ ID NO: 305 - DNA, 360 bp, Methanobrevibacter ruminantium
atgttaacattagtatcagaacacagaatatatggctgtcacaagctaaaggaccaaggaggaaagtgtacacaatggcatggacaccaatatagagttatattaactttacaggctccttataaggatttggattatagaaatatgatcatggacacctatgacattgaagctatctttaatgagttcattggtgtggatcatttgaatttaaatgaattcatggattctgaaaatcctaccatggaagagatgagcaaattcttctatgatggtcttaaggataagattgaatgcttggtaagcgttggagtttatgaaactcctgaaactggagttacctatactcctatggaatag

SEQ ID NO: 306 - DNA, 609 bp, Methanobrevibacter ruminantium
gtgattaaaattaaggtaagtgaaatattcacatcatttcaaggcgaagggccttatatagggactcctgcaactttcttaagattgtatggatgcaatcttaactgcccatggtgtgacactgatatctccacatatgaaattctatcagtggatgaggtctttgagatacttatgactcaaatggagtttaataatataaggatattggttataactggtggagagcctacattgcagatggaagagcttaagcgtttgattaaggaaattccagatgagattaagattcaaatcgaaacaaacggttcaatttttgaatacgttccagaaatcgattatgtgataagtccgaaggaagataaggaaaccgtatttaagaactattataaatatgataatgtgttctttaagtttgttatttgctcacaggaggatattgatgaggtcatttatctaaaggataaatataattatgataaaaccatatggcttcaaggagagtttagcaaggatggtgaaatggcagacttgattagggagaatttccctcatttggagaatgttaagttgtctgttcaaactcataaatatttgaatcaaagatga

SEQ ID NO: 307 - DNA, 423 bp, Methanobrevibacter ruminantium
atgtataaaaagattatattaccaactgatggatctgaatattctaatagagaaattttaagagctactaagttattagctgaagatggagaagtcattattctttctgttgcaacagaattaagaaaaactgctttccaaagaagcaaagatattgatagggctaataaggagtctattcaagaagctaaagaatatgttgcagctatgaaaaaaggatttgatgacagcgtaaatgtcaggactaaagtcgttgtaggatttccagctgaagctattaatcaagttgcagaagaggaaggggctgatttgattattattgcttcttcaggtaaaagagggcttcataggtttgttattggaagcgttgctgaaaaggtacttaaagattctgaaattgatgtgttattagttcatgattaa

SEQ ID NO: 308 - DNA, 450 bp, Methanobrevibacter ruminantium
atgaaaaaagaatcaatattcaatgacgaagtaagcctattcaattccatttatgtaatgcacaaggcatttgaaaagtttttaaaaacccatgtaaatgatttaaatatcaataaggcagaatctaaatttttaggtgaaatctattataatgaagggataagccaaagggaaattgctcgaaacttatttgtttcagaagcaaatattgcaaagacatacaagatattagaaaaaaaaggatttatctataagaaagttgatgaaaagaacaatacccgtcgtcagttatacttaactgaaaaaggcaaagaatcctttgaagaaatcattaagctttatgaagagtatcatcatttcattttaagtgattacacagaagaggaaatcagaaagcatgaagaaatgatgaaaggaattgcagacaaatccttaaaattcttaaaataa

SEQ ID NO: 309 - DNA, 1275 bp, Methanobrevibacter ruminantium
atgactcaaatgactgaagctaagaaaggcaatgtaacccctgagatgcaagctgttgctgaatttgaaagagtagatgttggaaagattctaaacggacttgcaagtggtagaatagtaattccaaagaatattaatagagatacaaaggcttgcggtattggtcagggcttaacaaccaaaatcaatgcaaatataggatcttcaagcaaaatcgaagacattgatttggagattaaaaaagcaaaattggcagttgattttggtgcagatgcaatcatggacctaagcacaggacctaaattattagagttcagggaaaggataatggactcagtggatgtggccattggaactgtccctatctatgaagcaggggtagttacattaaataagggcaatgaaataatagatatggatgaggatgacatattcaattccataatccatcaggcaaaggatggggttgacttcatgacccttcactgtggaatcaatcaggatttggtctataaacttcaagaggctaaaagaatgatgggtattgtaagcagaggaggaactttcctcgcttcttggatattgcataatgaaaaggaaaacccattatattcaaattatgattatttgcttgagattgcattggaatatgatataactctctcattaggtgacggacttcgtccgggatgccagtctgatgcaacagacacttcccagattcaggagcttgtaaccttgggaacccttgtaaagagagcacaggaagcgggagttcagacaatggttgaagggccaggacatgttccccttaatcagataagggcaaatatggagattcaaaagacattgtgtcatggcgctccattctatgtattagggcctattgtaactgatttggctccaggctatgatcatatcacttcagctattggaggagcaattgcagcatcaagcggagctgacttcctatgttatgtgactccagcagagcatctctcacttccatcccttgaagacgttaaggaaggagtcattgcaagcaagattgctgcccaagctgcagatgttgctttaggattggacactgcatgggagaaggaagtggaaatggcacaggctcgtaaaaactttgattgggaaaagcagtttgatttagcttttgatagtgtaaagccacgtcattataggaataagtgtgaattggatgatgatgagatgtgtgctatgtgcggagagtattgtgcggtaaagatagctaaaggtgacttttag

SEQ ID NO: 310 - DNA, 1653 bp, Methanobrevibacter ruminantium
atgaaatacgaagaacttgttaatgtttatgaggcattaggtgcaactacaaaaagattagagaaaacagagatattggcagattttcttaaaacagtggaactagaagatttacagaagattactttaatggctttaggtcgtgtttttcctccttggagtgaagaggaacagggaattggcgataagcttgttatgaaagctgtaggagatgctgtaggagtctctgtagcagtagttgaagatgcaatcagagatgaaggagacattggagcagctgcagagaagctttacggcaaaaagactcaaatgactttcttctcacagcccttgacagttaactttgtctataatcagctgagaaaattggccaaaataactggaaacaggtccacagccaaaaagatctcaaacattttggaattattgtcatctgcatctgcacttgaagctaaatacatttgccgaaccatattggaagaacttagaatcggtgtaggtgaaggaatcattcgtgatgcaatttcacaagcctttggtgttgataaggcacttgctgagagggcacatatgcttacaaatgatttaggccttgttgcaaaggttgcaaaggaagaaggtgaagatggccttaaaaaactttcattaattccaggaaggcctgtcaagccaatgcttgcccaattgtctgagggaattgaaataagcataaatgaaatgggttgtgcactttgtgagacaaaatacgatggaattcgtatgcaggttcataagaaggatgatgagattacaatattcactcgcagactggagaatgtgactatggcccttccagaggcagttgacctaatcagggaagctttcccagatgaggacttcattgcagaaggtgaaatcatagcaatccgtgatggaaagccgactacattccagaacatccttcagagagtcagaagaaaacataatattgaagaagctatggaaaaggttcctattaagatttatctatatgatttgctctactttaaggagccaaccattgatgagccgataatcaagcgtcgtgaaatattggaaagtgtagtggattgctcaaatcctaatttggccctcagttcccttgtcaaggtaggtccagataatattgatgatgcagtggatttattcaataagtcaattgaagggggacatgaaggaatcatgattaaagactgcgatgagccttatattccaggaattagaggcaaaaaaatgctaaagcttaaggcagagcctgaaacattggatgcagttgtaatcggtggagttaaaggaataggcaaaaggggagactttataggctcttatgtgattgcccttcgagatgagaatgaccagttgcagcctattgctcatgtaggaaccggtctttcagatgatgacttggcaaatctcactgaaaagatggaagctcttaagataactgaaaagggaactagaataactgttcatcctaagatagtctttgagatagcttatagtgagattgtaaagagtccagagtatagtgcaggttattcattgcgtttccctgtagttaaaaggataagggatgataaaggcgttgatgacattgatacaattgaaagattagagtctatgtttaagggatag

SEQ ID NO: 311 - DNA, 213 bp, Methanobrevibacter ruminantium
atgtatgaaaaggataaattagtattgcctaatatcattaaagaagaatttgattgcatagaattaaatgaagacaccatatttgattgggctattgaagatgacaaaatcattcttaaacctagaaatatagttacaactgacgatattataggtattatagatgatgatggtggagaatgggatattgataatgaaatttattccttatga

SEQ ID NO: 312 - DNA, 234 bp, Methanobrevibacter ruminantium
atggggtttttagctagttctaagatttatggggattatcaaatagatattcccaaggaagttatagaagaattcaatgtggaaagagattctattatggaatggattattaatgaagatggaagaatttccattaatttcagaaagaaatattctataaaagatttggtaggtgcttttcatctggatgatgaagtcagttctgttgatttaaaaagaagtttgtatgagtag

SEQ ID NO: 313 - DNA, 1365 bp, Methanobrevibacter ruminantium
atggtagaaaaacgattatttggtacatttggtgtaagaagaaactgcgaaatgatggtgttgactcctgaatttgcatccagacttgccgcaagttatggatctattgtgcaagggaccgtagccattggaggagatacaaggacaagcactccaatgcttaaacatgcaatcactgcaggtttgctctcttcaggctgtgatgttgtggatttaggaatcctcccaactcctgctattcaatatgcagttagaaattattatgatgggggaattattgtaacagcttcacacaatcctccaaaatacaatggtcttaagtttgtagatgaatttggtataggaactccagatgatatggaaattgaggttgaaaagctatactttgatgaggagcctattcgcgcttcttgggataagattggtgaagtctttacaaacgaatcaatcattaaggaatatattgcagagactttaaagagagttgatgtggaagcaatcagggcaagaaagcttaaggttgttgtagactgcggttcaggtgcaggatcatacaccgccccatacattcttaaggaattaggatgcgaggtaaccacattgaactgtcaggctgacggatttttcccaggaagggacccagagccaatagagccaaatcttcaggacttgattgcaacagtaaagaaccttggagcagacattggacttgcccatgacggtgatgcagacagaaccatttgcattgatgagaaaggaaacttcatattaggagataagacctttgcccttgttgaaaagcatatgcttaaggaaaacggtggaggaattgttgtaaccactgtagctacctctcaagccatttatgatattgcagaagagtttggcggtgaagttattgcaactgctgttggagatttgcttgttgcaagaaagcttaaggatacagatggactctttggaggagaagaaaacggtggactaattttcccagactttatctatggaagagatgctgccatgactgtggcaaagatacttgaaattcttgttaaggaagataagccattatctgaacttgtagcagagcttccagtctattatcaggaaaagttaaagattgaatgtccagatgatcaaaagcaagatgtcatggctaatattgcaaatgagattaaggacacaactgactttgagcttgatacaactgacggagttaagattctaaaagaggatggctgggtaattattaggccatctggtaccgaaccgatattcagatgctttgctgaatctgattccatggataaggctcaagagatggctaactggggaatcagtttagtggagaagtataagaattag

SEQ ID NO: 314 - DNA, 804 bp, Methanobrevibacter ruminantium
atgatttccgatagacaaaaaacattgctcattcttattctagtgcttgttttagcttttgcaataatatttctaggatattccatctccttaggaaacaatcaaacagcaggtgttaagctaaatgattccaataagatttatattaatcaatcttatccggcagagcctattccagatgctaaaattgatacaagcggtgtaaattcagttttattaggtcaaaatgaattaggtagcgtagagcttctcggcccatttggaaactccgattcagagattaagatagcctattcaataggtatgcatccttgggaaagcaaggttcataaggctttgtttgataccgtccttgctaaaaacagctctttaaaatattgctattatatttataagataaatgtgacaaattataatactgatgatgagggcagaatggatgggcagcttcttgctcaggagtttgtggcacctcatataattaatggagattatgacttgtttttagacattcacagcaataagggaactgttggaggaacttatgagcaaactaactttgcttttgcagttggtcaagatgaaaagtccgaggcctttgtaaagaaaatattagataagatgccagagcttgtttattatttcccagctgatcagtcaagccctccttatataaccttacctgtagagcaagcaggaactcctacagttaattatgaaacattctcatatgaggacattaatacaacctatgatttgattgataaattggttgatgtggttgataatttggagtttaaatga

SEQ ID NO: 315 - DNA, 714 bp, Methanobrevibacter ruminantium
ttgtgtgatttgatattgaatttaattattaaaatagatgatattatgattattaaaaattattctaatgaacctactgatgaagcaaaggtagattcaagtttatatgatgctcaattaattggagaaaacgatttaggaactgtacaccttcatggcccatttggaaatgaggaatcagacattaagatagcttatctaatcggcatgcatcctttggagagcaaggcacatagggctttatttgatacagttcttgataaggatggggatttgaattattcatattatatctataacataaatgttataggagaacttgatgaggcaactgaaggtcgtatggatggccagcttcttgctcaggagtttgtagcccatcatataattgataggggatacgatttctttttagacattcatagcaatagggggtctaggagtcctggaacttatgaaataagcaattttctatttgctccaggctttgatgaagaatctagtaaatatatgaatgtattgctttctaagatagatgaattggtttattatgctcctgaatatagaacaagtcctgaatttattacagttcctgttcaaaagagtggaattcctacactagtttatgagacctattcctatgagccaattgagctcacttatgaattgagtgaaaaattagtggatgctgttgacagtttggactttgattga

SEQ ID NO: 316 - DNA, 1137 bp, Methanobrevibacter ruminantium
atgcctataatgtcctttggaagtcagaacatcaatatcataacaaataaaaaagcaatgaccataaggaaattatggaaaacccctttaaagaaaggtgataggcttcattgttactggaatcttgcttctaaggaaaagaaaaaaatctttgaagctgaagtcacagaagtggaaaccattaccttcaaggaactaaaggataacgatgaattggcaagagaggaaggatacgaagattccaaggaaatggttaaggaatttaaaaaaatgtatcccgacagaatcgcagacgacgacctattccaaataatctattttgaaaagcttgacataaacaaatggaaaggtgaaaagatagatcaaaaggaaatgatcacccaaagggcagatatcctttttgatactggaaaatacgacaagtctgtactatgctataatgctgccttaaagatagaccctaatgatgtttaccttttaaacaagaaaggagacaatttaggaaggctagacagatttgaagagtctattgaatgttatgacaaggcccttgaaatagaaggagacaatgaatatatctggaacaataaggcaatagccatgcttaactctggaaatatagaggaagctttagttgcaagcgatggagcattaaatgcaaacccagacaatccagttgtcctatactggagaggattcatccttgaaatcctatcagaattcgataaggctttagaggtttatgataagctaatcacaattgatgacactaaccctgaagtatggaacgcaagaggaaatgtcttaacagacatggaccgactggaagaggcattgcaatcatatgacaaggcattggaattatgcttagaagattctgaaatagacgcatctgcacaaaacagaaaaggaaacgcacttttagaccttggaagatttgaagaggcaatccaatgctatgacagagcaatcgaacttgaaccactaaacacatcattcctattaaacaagggagttgtattgatggagattgataagtttgatgaggcagaaatcctttttactaaagttcttgcattagacccttccaatgatgatgcaagggttttaaaattggaatgtcttgaaaatatgtaa

SEQ ID NO: 317 - DNA, 723 bp, Methanobrevibacter ruminantium
atggaatatggtgctacaattacttcttcaatcgaatatcctaaaaaaatgtcatttgttatctttttagcaaagtgtcctttaagctgtccttactgcagcaatagcgaactgctctatggaggagaggaaataagcttagaagagattattgaaaagatagatgattccgctttcctatcagatgcagttgttgtctccggaggagagccattggtacagcttgaagatacaattgaaatattaaaatacacaagaaaaataggactcaacaccaaattagacacaagcggagtctatccaaacagattaagaaaagtattggatttaggattggtcgattaccttgcaatggatgtgaaggcaccatttaacaaatataaagaagtcatccattcagacattggagataaggtaaaggaatcattggatattgcaaatgaatatgatgatgttttccttgaatgcagaacaacctattgtccagcattacttgaagaagaagacctatttaagatagttgatgaagtggaatgtgacttatacacaatccagcaattcagaaacagatgcacattggatgaaagtctagacggtgcagaagagccaaacccacataatatgagagaaatagctcaaaaaataaaagaattgcaccctaatcaggatataaacattaaaactgctgaatttggccaacagaaaatcgaattagaaaattaa

SEQ ID NO: 318 - DNA, 1125 bp, Methanobrevibacter ruminantium
atgaaagcccgtaaagcagtagaagaaatagatccatatgttccaggccgttcaaaagaagagatagcacaggaattcggagttaaaaaggaagatataatcaagctaggatccaatgaaaatccatggggaccatccccaaaagcattggaagcaatcaaggaagaactgaataacatcaacagataccctgaatctgacgttgagctattgaaaaaggaatttgcaagatactctaatgtaaagcctgaaaacattattatcggaggagacggagcagacgaaatccttgacacccttgcaaagacattcatagaaaaaggagacgaattcatagtgccactgccttcttatatgtattatgaatttctattcaagccttacggagctatccctaactatgcaaaatggaatcttgaaactaacacattagatttagactctgtgcttgatgcaatcaatgaaaaaacaaagatgcttttcctatgcagtccaaacaatccaactggcgcattgattacacaggatgaattcagaccaatcctagagaaaacaaacaagtccagaggaggagtctgtgatgcaatagtagtaatcgatgaggcatatgttgaatatgcagagggaaccaatgtaaatctccttgaggagtatgacaatatattcatcataagaacaatgtctaaagtcatgggacttgctggaatgagaataggctatggaatatcaagccctgaaatcattgaatacatgcacaggataaagcctgtattctcacttacaaagctttcatatgtagctgcattagctacaatcagagacacagaatacatagaagaatcaatcaaaaagggaattgaaagcagagaatacctatacaatgaaataaacaagatgaagtctgtaaaagtcttcaaatcctactcaaactttatgctaatcgatatccacaatacaggatacacagcagcagaacttacaagagaatttatgaaaagaggaatgattgtaagagactgcacttcctttaagggaatcgatgaatactactttagaattagcatctgtaccctagaggaagataaaaagttcatagaagccatgaaagatatcttgaatgaataa

SEQ ID NO: 319 - DNA, 477 bp, Methanobrevibacter ruminantium
atgaaactcaaagaacccgtaaaaatattccctggtgcacaagtaatcggcgatgttgaaatagatgaaaactgttccatttggcatggagcaatcataagaggagatgtcggaccaataagaattggaaaaaactctaatgtccaagacaactgtgtccttcatacttcagcaaatctaacccttaagataggagataacgttactgtaggacatggagctgttgttcatggctgtgaaattggcgacaatgttcttataggaatgaatgcaactattttaaatggtgccaagataggcaaaaactctattgtaggtgctggagcagtagtaagcgaaaataaggagtttccagaaaatagccttattctaggagttcctggaaaactcattaaggaaaccactcaagagcaaagagacaatatcgcttggaatgctaagcactatgtagaacttgctaatgaatatgatgaataa

SEQ ID NO: 320 - DNA, 1320 bp, Methanobrevibacter ruminantium
gtgaaagcattaatactaagcgccggggaaggtactcgtatgagaccattaacacttacaaaacctaaaacaatgctccctgtcgctggaaaacctatcatacaatataacatagaagcattacgtgaatgtggcgtaaaagacattcttcttatagttggctataaggaagaaatggtaaaaaattactttgatgacggaagcaaattcggcgttaacataagctatgcaacccaaaccaaattagaaggaactgcaaatgcaattagctacggaaaagacttcatagaagatagcctaatcacacttaacggagacatcatcctcgatgaggagatactcagggaaatcatagaggactacgaagagtctggcgcagatacattaatggtattaaccgaagtggaagatccaagcgcattcggtgttgttgaattggatggagaaaaaatcacaaacattgtggaaaagcctaaaaaggaagaggctccaagcaatctagtcaacacaggaatatatatctttaacaaagacatcttcgacaagatagacaaaactaaagtctccccaaggggagaatatgaaatcacagactccctatccctacagattgaagatggcaaatttgtaaaaggccataagaccgaaaaggaatggatggatattggaaagccatgggagcttattgaaataaacgaatccctcctcaacaatatcaaaggagaaatcaaaggaaccgtagaggaaggagccaccttacatggagaggtattccttgatgagggaagccttatccgttctggagtttacattaaaggtcctgtatacataggaaaggactgtgacataggccctaactcatatatccgtggaaactcatacttcggcgacgatgtccatattggaaacgctgtggaaatcaaaaactcaattattatggaaaacaccaatgtaagccacctaagctacgttggagactctatcctaggctcaaactgtaatattgcagctggaaccaacattgcaaacttgcgttttgacaataagaccgtaaaattcaatataaaaaataaaaaagtagacacaggcagacgtaagctaggagcaattgttggggatggagttaaaactggaatcaattcaagcctttcccctggagtaaccataggtacaagagctacaataggttctggcgtcttattatatgacgatcttccatcagacatgagagttctccttaagcaggagcatataattcaaaacaagaaagaaaatggacaaatccgcttagaagaagttgaagaggatatgaataaatag

SEQ ID NO: 321 - DNA, 162 bp, Methanobrevibacter ruminantium
atggtaaaatatgtatgtatgcattgtgaatatacttgggactctgaaactggtgatgaaacttacaaagtaccagcaggacctatcgaagacttcccagatgactgggtatgccctcaatgtgctgcaggtattgaaggaattattaccgaagaagactag

SEQ ID NO: 322 - DNA, 1347 bp, Methanobrevibacter ruminantium
atggcaaataaaaaattattcggaacttctggaatcagaggaaagataggttcagaagtcacctctgaattggcacttaaaataggaaaatcattagccaaatacttaaataacactggaaaggtagttatcggctatgacacccgtactacaaacagaatgcttgaacaggcaatcactgcaggactcatcgagcatggagtcgatgtaatcaagatagctatggttccaacacctcttgtaggatatgcaaccattaagctaggtgcagatgctggaataatgcttacagcctcccacaacccttcagagtataatggaatcaagctctggaatgcaaacggaatggcttatacaccagaacaggaagaaaagatagaagaaatctactacaacgaagacttcggaaaggttgaatgggacaaaataggaataataagccataatgatgagattaaaaagcaatatatagatgatcttttagacattgtagacatcaagccaggtcttaaagtggtcatcgactgtgcatgcggagcaggatctgaactttccccagtattgtttagaaaagcaggatgtgaagtaatcaccttaaactcacaggttgacggattcttccctggaagaaacccagagccaaatatagcaaacctttcaagccttatgaaagcggttgtagcaaccgaatcagaccttggaattgctcacgacggtgatgcagacagaatgattaccgtcgatgagaacggtaaggtttcagactttgacaagcttcttgctcttgtatccaagaaattcggaggaacagtggtaacaactgtagatgcaggattatgcatggatgaggctatggaagaagtaggaggaaaggtcctcagaacaaaggtaggagacgtaaacgtagctgaagtgatgatagaagaaaatgcaagcttcggcggagagccttcaggaacttggcttcaccaagacttttgcatgtgtccagacggaatcctatcagggcttagaatggcagaaatcgtttcaaaggaaggaaagctatcagagcttctagcacaattcactgactatcctcatatgagggaaaaggtcatatgttcaaaagagcaaaagatagccgtgatggaaaacatggaagagctccttaaaaacgcctttgatgacattaaggaaatcaatacaatcgacggcataagattaagctttgaagacggcagttgggtattggtaaggccatcaggtactgaagactatgtcagagtaactttagaagccaaaacccaagaaaaagcagaattcattagagacacttgtgtcaaaatcattaaagagaatatttag

SEQ ID NO: 323 - DNA, 1239 bp, Methanobrevibacter ruminantium
atgaaaggaatgatattggttatggacggattgggtggccgtcccttaaaggaacttaacaatcaaactacactccaagctgcaaagactccaaatatggataaaatggctgaaagaggaataacaggaataatggactcaatagctcctggaatcataccaggcagtgacacagcacacttatccctattaggatatgacccttacgaagtatacactggaagaggcccatttgaagcctctggagtcggagtggatgtaatacctggagacattgcattcagatgtaatttctcaacttcagatgaggatggaataatcacagacagacgtgcaggcagaatcagagaaggcacaaaggacattgtagacgtcctaaacacaatggtcattgaaggctacgaagacattgaaatcatattcaaggaatccactgggcatagggcagttctagtccttagaggagaaggattatctggtgaggtaagcgatgcagaccctaaagtggaaggaaacaaaccaaaagaagtaaaaggccttgacggaagcccagaagcagataaaactgcagacatccttaacaaattagtggtcaaatcctatgaaatggttaaagatcatccagtaaaccttaaaagaattgaagaaggacttccaccagcaaatatcataattcctcgtggtgcaggagaagtgcctgaagtggagccaatcaacgagaaatatgaagtcaattctgcatgcattgcagaaacagggcttatcatgggaatcggacgctttgctggaatggacatcattgaaatggaagatgttaccggcggagtggacaccaacctttacaatatcagagatacaatcgtagatcaggtaaacaactcagaacatgacttcttccttgtaaacattgacggagcagacgaagcaggtcacgatggaaatgcaaaagacaagcttgaattcattgaaaaggtggatgagattgtaatgagcgaacttttaaagctagaggacatttatattttcctaactgcagatcattccacaccgatttcagttaaaaaccactcaggagacccagttcctataataatcaacggccctgaagtgagagtagacgatgtaaaggaatacaatgaatatgcagtggctaaaggaggaatgtgcagaatccgaggagcagatgtaatgaacattcttactgacctaatgggctatgcacataagtttggagcctaa

SEQ ID NO: 324 - DNA, 579 bp, Methanobrevibacter ruminantium
atggcaaagaaacaaagacgtagagtacgtgacacttggaaagaaaaatcttggtacaccatcaaaactcctatagcattcggagaaaaggaaatcggtaccacccctgcaagagacccagaacttgtatacggaagaactgtagaagtaaccatgagagaattaaccggagacttctccaaacaatacatcaaattacaatttgaagttgacaacgttgcaggagacattgcaagcaccaaatttaccggacacaagaccactaccgattatgtaagaagcatgatcagaagaggaaccagtagaatcgacgctccggttattgtaaccacccaagatgaacgtaaattaaaactccatgtattagctgtaaccaccagaagagctaaatcttcccaacaaaaatacatgagagaaaccattaccgaattagttagcaatgttgctagcgaaaaaacctttgatgaacttgtagaaatctctgtaaacggtagattagcttctgaagtttaccacaaagctaaaaaaatctatcctttaaagagagtagaaatcatcaaaagcaaagtattagattaa

SEQ ID NO: 325 - DNA, 804 bp, Methanobrevibacter ruminantium
atgtgtgagatatttggattctcatcctctagggaagaggaattaaatgattatttaaagacatttttcagtcattgtgaagagcaccctcacggttggggattggctattttagattcagataaatatcaaataagaaaagaaccggtaaaggcccgaagtagtgtaatgttaggaaatattttattaaatccaatagtctgtaaaaatatgcttgcacatataagattggctacgataggcaatttggatttctataactgccatccttttgtaaagaaagacaattcagataggagatggactcttattcataatggaactatctttgactgccaggatctttgtagatacagtacagaagaggaaggggagacagattccgaaaggatattgctttatattgtagatacaatcaataattatgaatctgtaaagggagagcctttaagcttaaaggaacgttttgatatagtttccagcttgattaaaggaatgtcctgcaccaataagttaaatcttatggtttcagatggtgagcagatctatgttcacactaatctaaaggattcccttcattatctaaagaaggaccattccattttcgtttcaacacagccattggatgatgatgactggaaggaggttccattaaataagacattttcaatcattaacggtgacgtattgtttgaaagcgattcacattcaaatgaatatttcgaaacagaggaacagcttagattcattgaaaagttcttagagtcattaaagacagattcagatgaggagtacgcttggtaa

SEQ ID NO: 326 - DNA, 726 bp, Methanobrevibacter ruminantium
atgtgtaaagatggtattagcgatgaggcattaagagaaaaattgtatcaagcatttttagagcctaccaaaaaggataaaaaggaatacataggcattgaaatagagatgccaataatcaatcttaacaaggaagcggtagactttaaagttgttcataaggtcactagggatttcagtgaggaatttgataactttgaacttgaaggaatagattatgatggaaacatctatgcattgagagataaggctagtgatgatataatttgctatggctgctcctataacaatatagaatttgcaatgggaaaggaagagaatcttttttctgtaaatgagcgtttccttaaatattattcatattttaaagataagtttgaagagcatggacatacattgactggaatgggaatcaatccatatagaaagtacaataatgaggttccgattccaaatgaaaggtatcttatgctttttcatcatctaaagtcttcctctgactatgtaggaatggagtttcaccaatatcctgcttatggcatgttttcaagcgcatctcaggtgcaattggatgttccttatgatgaattggtggacaatattaatgtcttttcaaaattagagccgattaaagcactgcttttttcaaattccgttttttggaagagaatgaagactatctttgctttagagatatcttatgggaattcagtacccatggcgtaa

SEQ ID NO: 327 - DNA, 654 bp, Methanobrevibacter ruminantium
atgtataatcaggaatttgaggacattgatgagctgctttcctatttggagtccttaaatatctattgtgttatgagagatgggttatatattaattttccttcaatggggcttaaggaattcttcagcaaggacaagataacaggagaatactattgtaagggagaatataagaaaagggaatttgaaccctctttggatgatattcaatatttaagagcttttaagtttatcaatctcacctttaggggaacaattgaatataggagcgtttgtactcagccaattaaggattccatgtctgttgcagcattccatgtaggtttaaagcataaaaccgatgaattgaatgaattattcttaaaatcaggcatttataagaatgactgcgatgcaaatgagcttagaaaactattgattagaagggaaattccagatttcgttgatatggaaaagatttatggattggctttgaaggttcttgacttggcaaaagaaggattgcttgaaagagatttgggagaagaagttttcttagactctttgtatgataatttgaataataggaccaatcctggaaaaagacttttagattcattagatggtggaaaaagcttggaagagattattaaagagtatggtgaagttgaatag

SEQ ID NO: 328 - DNA, 1425 bp, Methanobrevibacter ruminantium
atggataaaatatttaatctgtcgcagattaaaaataatttgagctcagagcagctaaaagaaggatcatttgggattgaatgggaatgcttaagggtcaaggaaaatggagagctctcattaagtccgcatcctgagatttttggagataagttgacaaatccatatataacaactgatttttcagagagtcaaatagagataatcactccagcctttgatacaatagatgaggctttttcattcttttcattcatgtctgatctggtaaacagttccctatcagatgatgagtatctttggtttcagtcattgccttgcatacttccagagtctgataaaatccctatagccaaatataaaggcagaggattaggggaagaatctatggagtatagaaagggtttggctaaaaagtatggccttaaaaaacagctcatttcagggattcactttaatttttcatttaaggaagagctaatagaaagcttctatgatggtgtcattggagataaggagaagatttcatataaggaatttaaggatagtctttatttaaagatttcacgtaattatattcgttatgtatggcttattatttatcttactggctgttctgttgctgttcataatagctttactttagattgtcagaaattgatgaatcataaggacaatcagggaagcgtctatagtgatagggggccttcatttagaaattcctcctgcggatataagaatttagagcatttgtatccaagttatgcctctgttgaagagtttacaagagatattcaatcatttattgataatggacatttatctgaggcaaaggaattatacactcaaatcagattgaagccaagaaacccttcagaccttttgggttccttgaataataacggcatacagtatttggagataaggacattggacattaatccattctataaatgtggccttattaagaatgatatgaatttccttcatatgtttatgatctatcttctaattaaggaagagtctgattatgaaagctggcaggaagatgctctttataatgaggaaaagactgctgaatgtggatatgaagatggagttaagcttattaaggatggcaaagaggtagttttaaaggattgggccttatctatcttggatgaaatggagatgatggttgaatcattgaatcttgaaaataagtctgttatagagttgatgaagttaaagataatcaattcagacttgacatatggtaggcgtcttgctcggttggtggaaaaggatggatatattgaaagccaattgaagctctctagaaataataagttaagaagtaagtatctggttgaagagaccaatttgctaaatgatgaaaggtttaaagaatatgtgcctattgctcttcaaggattgagcaaatag

SEQ ID NO: 329 - DNA, 339 bp, Methanobrevibacter ruminantium
atgagaatagcagttgccacatcaaacggagaggatgtaaatttacactttggaaaagccagttcattatatatctacgaatacgatgaagagaatgatgaaacaagctttatagaacatagaactgtagaaatagaaaaggacagcaaacaccaaaacccaaagatcattaaggcactagcggactgtgaagtagcaatctgtgaagaattcggatttaaggcatctatctttgcagaggatgctggattaaaacttgtaaaggatgaaggaaccgtagaagaagttttaaagaaatacacagatcatgtgaagttcctaaagaatgttaaaatataa

SEQ ID NO: 330 - DNA, 1572 bp, Methanobrevibacter ruminantium
atgaaaatgataaagcaaacattaggcttaaatgtagaagataaaaaatactacctgaagctaattatagaggctgtattaatcggtttattctcaggattcattgtatccctgtatcgacttggattagaccactcagaaagcatattatcctacatcctaaagtatatccaaggagacttgaccctaatagttctatggtttgtcatacttgcaatcatgggacttatcaccgcccttctgatgaagtgggacccagacagcctaggaagcggaattcctcaggtcatgggagaggtgaaaggatactttgatgtgacatggtggaaaactctaatagcaaagttcattggaggaacccttacagcccttggaggactttcccttggaagggaagggccatctgtccaattaggagccatggctgcaaaaggagtatcaaaatacctcccaaacagcaagactgatgaaaagcgtcttttagtatgcggaagcggagcagggcttgctgcaacattcagcgcacctcttgcaggattcatattcacattagaggaaatcaacaagggatttgacagatcaatcgtccttgtaggtcttgtttcagcagttgtagcggttttagtatccaatgtattcttcgggcaaagcccaatctttccatttacatccttaaatcttccattggaatatttctggctattaatcgtcctaggaatagcaattggaatattaggatacatctacaatgtaggaatgatcaaggcagctgaaatgtgggataaattaagtttcctccctcttgagataaaattcatcatagttttccttgtaactggaattgtaggactcttcttgcctgaagtgcttggaggaggatactctatgatgcaccttatagagctaagcttgcctccattatctgtcctaattgtccttttgattggaaaataccttcttttaatattctgtttcggctcaagcgcccctggaggaatattctaccctgttcttgtaatcggagcatatatcggagcaatattcagtgccatcgtaattccaatatttggactgaacccattaatcgcatataagttcattatgatttcaatggctgcaatgtttgcaagctcagttaggactccaataactgcagttgtccttattgccgaaatgactggagttacaaattccattgttgcaatgatagttgtagtaatccttgcatatatcattccaaccattctagacaatgatccgatttatgagaccttgcttatgagactcctaaaaaagaataagggaatcgactttgataagacaaaaagcgtattggaagagtatgtggttccaatggactgtgcattgataggaactaaaatctgggagcttcctattccaaagtcagcaatggtggtttcagttgtaagaagcggaaacactctcatcccagatgagaatctagagttaaagtatgcagatgagttatttatcattatgaatcaaaacacttacccagaagacaataataagatagaatcattgatttacaacaattggaaagaagaatag

SEQ ID NO: 331 - DNA, 1308 bp, Methanobrevibacter ruminantium
atgaaaataggcattataggaggaactagaggtttaggaagaaccttagcctggtatttaaaggattttgactttgatgttacagttacaggaagagattccatagttggagctcaagtaagcgaagagattggagtgaaatactcaaacaacaacaagaagatagttcaagacagcgatatagtaatcatatccgtccctatctccagcaccgaatcagtgatagaggaactggcaccattcatgaaagacgggtcagtgatgcttgatgtcacctccgtcaaggaagggccaagcaaaaagatgaaagaatgcttgagcgaaggagtggaattcatcccaacccaccctgtcttcggtccgagaacaaccgacctgaagggacagatcattgtcctcaccccaattaaaaagggaaaatggtatcctagaatctataagttcctagaggataagggaatgagaataatagaaaccactgcagagcatcacgatgacatgatgggaatcgttcaggtcttaactcacttctcctacatctcaacagcttcagcaatcgaaaggctgcaggtagacctcaaggacacccaaaactatgaaagtccgatctataatctcatgatcgatacaattgcaaggatcgtatcccaaaacccatatcttacctattccatacagcatgaaaacaaaaagggagagaaaataagacaagccctatttgattcaatgagtgaattaaaggatgccttaagcaaagaggacgaagaggaatttgttgaaattgcacttaaggcaaccaaacatatgggagacattcaaggagctttaggtaggagtgacaaggcgataaatgccctcacccaagaatataacatattgctccaatccattggagaggaagtggggcttaagcatatctattccgatacaatccatgtaggaaaaatcaaaaaaatcgatttggatttcctatatcttgaagatgaaaacgggaaagtcaaaaagcttaagatgtctaatgtagcgattttaagtgaaaaggaactctttgaatggaaaataaacaatcaaaagacctattcaagagacataagcgctatgtttacaaaaaattcaaatccccatatcattaaagacaccttaaagctgatggaagacataattgacgtggaaataattgatatttatgatggagagcctgtaaaggaagaccaaatcagctatacctttaagatagaagctctcagtatggaagcaattaaaaactgcagagacatcttaataggatttggcggaatcagcagataa

SEQ ID NO: 332 - DNA, 1062 bp, Methanobrevibacter ruminantium
atgaaagtgacttctgaagatgagagcaaaggaactgttgagctttttcctgaaactttagatgacttatggcatttgtcccatattgtagctgaaggggacatagtctactctaagactacccgtaggattcaagatacaagcggagatttaattaggggagaccgaggggttaaaaagacattcaccttaggaatttctgttaagaatgtcagttttcatcttttcacaggcaaattaagaataatcggatcaattgtaagcggtcctgaagagtttgttcctttaggatctcaccacaccatcgaagccaagcttcacactcccatcacaatcaaaaaggaaagatggtccagctatgccttaaaacgtattgaacgagctattgaagcatctaaaaaattatctgcaatcattgtggttattgaggatgatgttgccgattttggccttatgagacagtttggaatcgaatattatggtcctatcatgggaaatgtctctggaaagaggataattgataagaataggaagaaaaacatcgaaaagttctatgaaaagattgtagactacattaataagtttgataatattcaaaccattgtccttgcaggtcctggattctttaagaatgacttctttaagtatttggagttaaagcataaggatttggctaaaaacacaatcatagaatctacaggttcaggtggccgtgtaggaatcaatgaggtattaaagaagggcaccgttgaaaagcttgctaccgaaaatagggtcgcttatgaaatatctgctgtagatgctattttaaaggagatagctatgaattctccattggttgtttatggaaagaagcaagtccatgaagccatcaatatgggagcaattgagaagctacttgttttggataatttggttagaagtgaaaacatggaagattctatggatatggttgaaaacatgtctggtgaggttttggtaatcagcagtcagcatgaggggggtaaacagcttgaagcccttggtggaatggcagctaacttgagatatgccatttcttaa

SEQ ID NO: 333 - DNA, 957 bp, Methanobrevibacter ruminantium
atgtttttcgaattattaattgtattcttattatgtttttttggaaccgggatcgtaagtatagtgttccgtttcttgggaaaacgaggatatatgggtaatctatatgaaacagtccgaggagggactcctagagctgttgggatagttccttttattcttatcagtctctttatgccaagcggatttaataatcttgttttggtgatgggtctatgtgccttaatagatgatataatcggcagaaaaacaattgctaatttgccgattgagattggtcagcttgcaagaggaataggcatgctttgtgtaataggattaggatatcctattatgggagtctcatctattttggttgtccttttaatccagccaatgaatattgcagatatgcaaccgggaactgctgcagctacaaccattataatgagtttcttcactcttttagctgttgtgattatgcaagtaggtcctgtcttagagatacatccatattactatccattgcttgttttagttacatgtctagcttattgtcctttggatttcgctggaaagatcatgatgggtgaggtaggtaaccatacctttgcaatatctttaggaatctgtttttatgctctaggcggatttataggaactttaatattattcattgtaaccactggattgattgcatatttaagaagatataatctctctagattccttataaataaattgcatattccaaatcctacttttggagatttatttatggatgtcttaactggaggaggtttaggtgacttatttagaaagattctcttgaaatcaaaccagtatgatgttgataatgagatattgattgcccttggatttagacggttattgtataatccttattctcctaaccttgaaaaagtggttcaaaaagatagtagaacaaaacgtgcagatttaagaaggttttattag

SEQ ID NO: 334 - DNA, 546 bp, Methanobrevibacter ruminantium
atggctgatgtttttgatgtaattaagaatagaagaggcgtaagagcttataaagatgagcaaattgatgatgaggatattgagaagatattgcaggcagctatcatggctcctactgcaaggggagaggctccatggcattttactgtagttcaaaataaggagcttcttgatgagatcaatgattctgtacacagcatattaactaattctggtgatgagcttcttgaagcaatcgctgcatctggcagaaatgtaatgcacaatgctccaactgttgtttttgtttctgctaaatcagatgctactaatatgcaagcagactgttctgcagctattgaaaatatgcttcttgcagctgaaggattagacattgggtcctgctggttaggtcttgtcgctttattcttcagcgttgaggaaaacttgaaaaagcttcacattcctgaaggttatactccattatacggtgtttccttaggatataaggttgaagaaaacgaaccaaacccacgcagtgatgttttggttaattggttaaaataa

SEQ ID NO: 335 - DNA, 1374 bp, Methanobrevibacter ruminantium
atgaaagaaactaaaaaaataaaaaacattgtcattggagcaggccctgcaggaagacttgcttcatttgaacttggaaaattaggtgaggaaaccttactaattgaaaagaaatacattgcagggacttgccttaatgaaggatgcatggttgtctgtgcattgactgacatcagccgcttttggaagaattgccaaagattttccgaaatgggattggtcaatggacttttagagttgaactacaattccatatgtgaaaacattaaaaagacccaaaaattccttcgtaaacttaaccaagaagaaaatgaaagcgtgagcaataaagttctctatggagaagctagtgtagaagtggatgaagatgagaaaatcatcgttaccgtcaaattggacaatgacaacgagcttcaaaaagaggagtacaagggaaaagaaactttgagctttgaagcagaaaatttactcatagccactggagcaaggccattcattccaaatatccctggagcagaatatgccctaacaagcagtgatgtaattaatctagatgaagttcctcctaaattaaacatagttggaggaggaataattgcaactgagctttctaacatcttttcaagctttggaagcgaggtaaaaatcattgcaagaagcgaaattctaaaagacctagagcctgaaatcaaaagttatgtagtcaaaaagattatcaatgatgttgaaatccacgaaaacaccaatgtcctaaagattaacgaagactcaatcgaaacagataatggagaatttgaaggcaaaacattaatagccaccggaagagtccctaattctgaaatactaaaaggacttgtggatttgaatgaagacggttcaatcaaggtcaacgaattcttccaaacatcaaaaccccatatctatgcagcaggagatgtcaccggaggaataaccttaaccccatatgctagaaaagagggaatttcagcagcaagaaatatggctggatacttgaataaatttgaagagatgattgttccccaatctttaactctagatttggatgtgagcttcactcaaaagacagataaagaagcagacccagataagattgaagatgtaatcatcccaggccttggaggacctcatgcattttggagaattctaagaggagaaacaggccttacaaagatttcattaaataccgaaaccgatgaaattgtaagagcaagccagatatccccatcttcaattgatgatacagcttatcttgcattcctaatgaatttgggaattaaaaaagaagcatttgatgactttttagaagttcatccatctactgatgcttattataaaattttaaagattatgtaa

SEQ ID NO: 336 - DNA, 267 bp, Methanobrevibacter ruminantium
atgtgtattgctgcaccagctaaaattgtagaaatcgatacagaatctaacatttgtgctgctgattttggaggagtcagacaaaatgcaaaattggatcttcttccagatgctgaaattggcgattatgttttaattcatgcaggatatgctatagaaaaactatccgaagaagccgctaaggaatctttagagtcttggaatgaattaatggaaatgttagatgaagaagacagagaacgtgaattacaaatgaatggcttataa

SEQ ID NO: 337 - DNA, 495 bp, Methanobrevibacter ruminantium
atgtgtgaggaaattaagttattgaaggatttgggatgtccagaatgggttatagaacattctaaaggtgtttcaagaaaagcagttcaaatagcgagcaattttgatgatgttgatattgagcttgtaagagttggaggtcttttgcatgatatcggaagatctaaaaccaattcaattgagcatgcagtcattggagcaaaaatagtttctgatttgggctattctcaagagatagtcaatattgttgaaaggcatattggaactgggctaactgaagaggatgctaaggaattgggacttcctataaaggattacactcctcagactcttgaagagaagatagtttctcatgcagataatctttttaatggtgcagatgaggttgatgttgattttaccatcaataaatggaaaagaaagttaggtgaaaatcatccatcaattgagaaaataaaagagattcatgaagagttggttggtcgttttgagtaa

SEQ ID NO: 338 - DNA, 909 bp, Methanobrevibacter ruminantium
atgaaagttatttgtacagttgacgagtccttatacaggccagaagtagttcgttggagagaaagaatggctatgatggagccattaggtgaagtggttgtagcgcttccttgcagtatgaaaaagccatattccaattcacagtctcatcagaaatttaaaagagctaccaaaggctatcaggaagttatagttacctctccatttggtatttgtcctcgtgaaatggaaaacactttcccaattcagtcttatgatgtgacagtctctggagattggagctttgatgaggtgagaatctctggtgagttgttacgtgattatgtaggagataagcctgtcattgccaatgttcatggaggctatgaagaggtttgccgtgaataccttgacaattgtgtttatgtctgtcaggatggacgtcctacctctcctgattcaatctatcatttaagggaagagcttaaaaagtattctaaggtcaaacatagggataaggttttaaatgaacttagatccattgcaaaatatcagtttggtcctgaagcatataagataattagcgatgatgttgttgctaagggaaggtatcataggactatctatagcgagggaaagcaattggctcttttaaatagggatattggattgtatactctcaatttggaaggtggaagaagacttgcagagcttgacattcatgttgttgagattgattttgacttaaagactaattctgtatttgcgccaggaatttccaatgctgatttgagcatcgttccaaaggacgaggttgttgttgtaagggacggtgaagtggtaggtgttggaaaggctgtcttaactggaaaagagatgattgagtctactagtggaatcggtgtaaagataaggcataggaaaaaataa

SEQ ID NO: 339 - DNA, 288 bp, Methanobrevibacter ruminantium
atgtctgaagaattagcacttgctgttaaagatgcagtttctgtagtaaacgaccctcacatgggtgtaagtattgtagatatgggtattgtacaatctattgcaattgaaggttcaactgctgaattggtaatcaaacctaccaatcctggttgtatgagtgttactcgtattgcagctcaagctaaagctgaagctttaaaagttgaaggtatcgataaggtaaaaattattattgaaggtcatgtaatggctgattctcttaatgagatgctcaatagagattaa

SEQ ID NO: 340 - DNA, 504 bp, Methanobrevibacter ruminantium
atgtgggaaagtttaaattcaaaatttagcaaatatcctgcaagaatgactgtggctcaaaagatgtttgagctaggtttaagaatcggtgaagacaataagatttattgcggaaatcttaagatcagtgattctgctttagctgcagctgcaaatgtggatcgtagagttattaaatctacagttaatgtaattgttcaagatgaagatttatttgaggtcttttcaaacattgtccctgcaggaacattgcttaaaaacattgcaaaaaatttaggattaggtgtagttgaaatagaagctggagaagaaagcgaaggtattttggctgctgtagctacaacaatgagcgaacatgatatagacattcgtcaagcttatgctggagacactaaatttgaaggaaatcctgttttgactattattactgaaaatccaattccaggtgaacttttaaatgaatttattaagataaatggagttttaaaggtttcagttttataa

SEQ ID NO: 341 - DNA, 1074 bp, Methanobrevibacter ruminantium
atgctaagcgatcctattattcaaaagaattttccgggaacatttgaattcgaagaggccatggttattattgattgtctaaaggaatggcctaaaagcagattatgtgatgataaagctattgcaaggaaagccgctaagacaattgacatagacattaagacagttagggatgttcttgctttacttgaagtaaataactgtgcttataatataaagattaatgagctatgcattaaattaattaagcattatcgttctggaaaacttactcataagaagattgctaaaaaacttaagatagatgataatattgttgatcagttcattgaagaaaatgaatctcttttagaagaaactaaaaagacttattctcaagaaactttaatggctttaaatgatagtttcaatgactttattaaaggaaggaaacctcttaaaataaataaggatgaagaggaagataatccagatgaagattctaaagatgaaaaggctacagatgaagagttcaaatctggagaagtagaaattaaagaggaagttgaagaaaccaaagaagaagaggaagtagaggaagaaaaacctgctaaaaagagaactgttaatcaaaagttctggtatcttacctttgatgaagtaatcgattgccttaagaacggatatgctacagatgaagaaatatctgaaaaaatcggttgcaagttaaatatcgtaagaaaaatcctttacagcttatatgacatgcatttagcaagctataagagggataaggataaggaaacccaatggtatacttacgattggaaattcaatgaaagcgaatataaaaaattagaattgaatattgcaagtgccgaacttaagaagctaaatgaagatttagaatatgaagcgaacaatatgttcttcatttgtcctgtgggacactaccgtcttgactttgaggacgcttccactgtcgaatttatttgtcctgaatgtggggcagaattagaatttgatgacaattctgaagttgttgaagctttgaaggaccagattgcatatattgaagaaatgatttctgaatag

SEQ ID NO: 342 - DNA, 903 bp, Methanobrevibacter ruminantium
atgacagacaatccaaactataaagaagcagaaactgagcaaggacaagtttacaaatatgttgagattagaggatatcaagttatccctattgaaacacattatataaagcctaatgaaagcatagactttatgattgatgacatctcaaaattatgcaagtccggcgactatttagtaatagccgaaactccaatatcagtctctcaaggaagattggttgatgaagcagactatactccatcccttaaggcaaaattcctagccacatattggagcaaatacttttggggatatgtccttggacctattctaggaataaaggagagaacaattaaaaaccttagaaaacttccagaagagtctaaaagacataaggaagttgttctccaattatatggttggaaacatgcattaaagccagcttcagaagcgggaattgacttaagcaatgctccgggaacttgcgtatcccttcttcccgaaaatccagaaaaggttgcaaaggaaatcagcgaaagccttatggaaaaaacaaatcaagatgtcaccacattaattattgacacagatgcaacctatagaagaaagaacaaatactttacaggacttcctattgcaatagatggaattgaagcagataagggagtttttggatacgcgttaggacaattgtctgaaaatatgggatccaccccacttggatgctcaagggaaatctctgttgaagagggaataaaaatagccaatattgctgaagactatcagaaatcattatctacagcaatggagacaatctatagcgcaaaggacgttttaaattcagacactcctgaagttactgtagaatccttggattcaattattcatacacctgctgttttagttagaaaaatagaataa

SEQ ID NO: 343 - DNA, 570 bp, Methanobrevibacter ruminantium
atggaaaaatcaataacttattttgaaaatcccggtgctgagaatactgatgcagttatcgaacttgttcgtgaaagattagaaggttctaacatcaaatatgttgctgttgcatcttctacaggtgcaagtgccttaaagttaaatgaagctttaaaggatcttgatgtgacaatagtaaattgctcccatcatgttggattcagggaacctaataaggcacaaataagtgctgaaactaagactgaacttgaagagaagggaatagtcacattcattggttcacatgccttaagcggtgttggcaaaagcatttccaagaagtttggtggagtcactccagttgagatcattgctgcagtctatagaactttctctcaaggaataaaggtatgtgctgaaatttctatcatgcttgcagatgccggattggttcctgtaggtgaagagataatcgctattggtggaacaggctctggtttggacactgctgctgtattgactcctgcaaacatgacaaatgtctttgatatgaagtttcatgagattatagcaatgccaagaccttaa

SEQ ID NO: 344 - DNA, 1170 bp, Methanobrevibacter ruminantium
gtgaaatttatagatgatgcaatcaaagaatctgaggaaagtattgaaaaaactgcttctcctaaaaaatcagatgatgaattagataaagaattactcgacattatcagtcgcagtcgagctaaaattattgtagtcggtgctggtggagccggaaataacactatttcaagattgactgaaataggtattgaaggcgctgaaacaattactgtaaacaccgatgcacaagacttgttctacagtcaagctgataaaaaattacttttaggaagacaaacctgtggcggtctcggtgctggtggagaacctgccatcggtgaggaatctgctgaagaaagtgaagaagacattagagcagaattggaaggggctgacatggtatttgttacctgcggtctcggtggaggaaccggtactggatctgctcctgtaattgctaaagtggctaagaaagctggagctttaactgtagctgttgctaccatgccattctctgctgaaggtgtaaaaagaagagaaaatgcagaaatcggtttagaaaaactccaagaaaatgcagatactgtaattgtcattcctaatgataaattattagaagttgctccaaaccttcctttaaacaaagcatttatggcttccgatgaaatcttaggaagagctgttaaaggaattaccgaactcattaccaaaccaggactcatcagtctggactttgctgatatcagttccatcatgaaaggctctggtatggctatgataggtatgggagaatctgaatccggtgacagagcaatcgaatctgtacatgaagctttaagcagtcctttattagacattgacatttccaatgctaaaggagctcttattaacatttcaggaagctctgacttgaccttgcaagaagctgaaaaaatcgttcagattgttgctgacagattagatcctgaagctaatattatttggggagctcaaatcgatgaagaattgcagaacatgatacgcacaaccattgttgtatctggagtaaaatcacaatataattcctcttcaagcggaagtgatgatggagaatttactgatattgatgattttactgatgctgacattcttggtgaagacacagctccaaatgatccattagatgaattcctagacggaatcttctag

SEQ ID NO: 345 - DNA, 492 bp, Methanobrevibacter ruminantium
atggaagatgataaaaattccatatttgctcttaaaacatcagcaggtcaagaaagaactgtagctagattgttaggtatgaaagcggataagcctggtgtagatattaaggcaatagttgtgcctgaatctttaaaaggttatatcattgtagaatctgctacaaaccttgatatgaagaaccctgatatgaaagttcgtcatttaagaggtattgtaggggcaaaaagagatggaaccattgatccatccagtcagataaccttggaagaagtcaaaaaattcttaaagccacaacctattatctcatctatacaaaaaggaagtattgtggaacttgtttccggtcctttcaaaggagaaaaatcaaaagttgtccgtttagatgaatctcgtgaagaagttgttctcgagttaattgaagcggcggttccgattcctgttactgttaaagctgatcaaattagaattattaaaaaggaggctgactaa

SEQ ID NO: 346 - DNA, 483 bp, Methanobrevibacter ruminantium
atggctaaagatacagttgaagttcttctcgaaggtggaacagccactcctggaccaccattaggacctgcaattggacctttcggggtaaatatgatgcaggtagtagaagaaattaatgaaaaaagtgctgatttcgcaggtatgaaagtacctgtcataattactatcgacagtaatacaaaagaatttgaaatcgagattggtactcctccaacaactgcccttattatggatgaacttggcattgaaaagggcgctcatgaacctggtgctgaagttgcagcagatttatctgtagaacaagctttaaaaatcgcaagaatgaaattcgattccttactttcaaacgattacaaaagcgcaaccaaagagatcatgggtacctgtgttagtatgggaattaccgtagacggtaaagatcctagagatgctcaaaaagcagttgacgctggagaatacgacgatatcttagtagaatag

SEQ ID NO: 347 - DNA, 639 bp, Methanobrevibacter ruminantium
atgacacaagagattattgatgcggtgaaggaggcaaaagaacaagctaagccgagaaacttcactcaatccattgatgttatcattaacattaaggatttagatgtcagaaaaccagaaaacagatttagcgaagaagtagctcttcctcacggacgtggaaaaccggtcaagatcggtgttatcgctgacggggaattagctcttggagctaaaaatgctggtgtcgatgttgtgatttccaaagaagatttacaagaatttggtaaagacattaaggcagctaaaaaagtagtaaactctgttgattcatttatagctcaagctgacatgatgccacttgtaggtagattcttaggtcgtatcttaggacctcgtaacaaaatgcctaagccagtgccagctagcgctaaaatcgagccattactcgaaagacaacaagctactattaaagttggcgtaaaacaacaaccatctattcaaatcttagttggaactcaagacatggatgacgagaagttggctgaaaatattgaagctgttcttgcagttttagaccgcaatttagaaaaaggaagaaaccaaataaaatccatgtatattaaagcgactatgggttcagtagtgagggtgatttaa

SEQ ID NO: 348 - DNA, 1008 bp, Methanobrevibacter ruminantium
atggctcacgttgctgaatggaaaaaagaagaagttaatgaacttaagggcattattgattctgctgaagtagtaggtattgttaacttattaaacattcctgctagacaattacaggaaatgagaaaaaccctttccggtaaggctaccatcagattatcaaaaattaaccttatgaaattagctttagaagattgtgtaaatgagaaagctaacattactgagctttcagattatatggaaggtcaacctgcacttgtatgtaccgacatgaatcctttcagattgtacaaaatattagaagacagtaaaacatctgctcctgcaaaagcaggcgctattgctcctgaagatattgttgtacctgctggagatactggtttcccaccaggtccgttcctcggtgacttacaacaaataggtgtacctgcaaaaatcgacaaaggaaaaattgtagttcaaaaagacactacagttgtagaagctggagaacctgtccctaaagctgtcgctgctgctttaactaggatggatatcaaacctatggaagtaggtatggatcttaaggctgtatacgaagatggttccatctttaaggcagacgtattggctatcgacgaggaagaaacctttgcagatattcaaaatgcatttactagagcattcaacttatctgtattcagtgctttcccaaccagtgaaacaatatccacaatcattagtactgcacataccaaagcttacaatgttgctattgaagcagctattcctactggtaagacttctgatatgttaattgcacttgcaaacgctaagatgttagcattagctggtgaattagcttccgatgcaatcgacgatgaaatcgctaataagttagcaaacgttgcagttgctgcagcacctgtcgttgaagaagcagaagaagaagttgaggaagaagaagaggaagaagaagacaaaagcgaagaaactgcagcacttggtttaggtgctttgttcggttag

SEQ ID NO: 349 - DNA, 312 bp, Methanobrevibacter ruminantium
atggaatatatatatgcggcaatgattttgcacaccacagaacaagatattaatgaagaaaatgtaactaaaatcttagaagcagctggcgctaacgtagatgattctagagtaaaagctttaatcgcagcattagaagatgttgatattgaagaagctatggaaactactgctatggcagcagctcctgcagcagcagctcctgtagctgaagcagcagtagaagaagaggaagaagaagaggaagaagaagaagacgaagaacaagcagctgcagcagcaaccgctggtttaggtgctttattcggatag

SEQ ID NO: 350 - DNA, 606 bp, Methanobrevibacter ruminantium
atggaaactaaaaatcttataatcatttgtgcaactgtaatattggctgttgtaatagttttatctgcttttatttatgtcaacatgggcaatgaaactcatataagttctaatattgcagatactttacaaaatggcgatgaaatcgttgtcaagcttgtggataaggataataagcctttggtaaataagaccattagcttaaactttaaagatgaaaatggcaagggcaatgccgttagctatgatcttcttactaatgacaaaggtgaagtatattataatgtcaatttgactgaaggaaaatatgtattttccgcagattatgctggagaaacatttattggctcatcaagtttaaataagtctgttgaagttaaaaaagatgttaaaactgcaaatctcagttctacagatacgactaaaaccgctaaaaccaagacctatacagattggcaggaagactatgagactggacgttatgacgaagacggaaatcctatctataggtctataatgtctacctccggaggccaatatgagcctggaatctatgaatgctattggtctgcaaatggtccaatcagtgaaagaagaattggttaa

SEQ ID NO: 351 - DNA, 2733 bp, Methanobrevibacter ruminantium
atgcttaaaatatttgaagatttaggatataagaaacaaatatgtaagacttgtggtcaagagttctattcacaagtggacagagacacatgcggagacgctccatgtgacgaatatggatttatcggaaatccagctactgacaagccttatgatttatacggaatccaagagacttttagaactttcctagaaaaagagggccatgaacctattagtcgttatccaattcttgcaaaaagatggagagatgacgtattcttagttggagcttcaatattttgcttccaaccttgggtaacctccggtttggtggaacctccagctaatcctcttgaagttgaacagccatccatacgcttgaacgatgtggataatgtaggccgtaccggaaggcacatgacctgctttacaatgggttcacatactgtaatcaataagcctgataactttatctattgggaagatgagacaatacgcctttgccatgagttcttcaagtcaatcggaatcaatacagaagagcttacctttatcaagtcatggtggaaaggtggaggaaacgaaggcccatgttatgaggtatgctgccgtggggtagagcttgcaacccttgtattcatgcaatataagacccttgaaaacggagataaggaagagattccaatcaaggttgtggataccggatacggacttgagaggattgcatggatttcccaaggaactccaactgcatatgatgcctgttttgctccggttgttgataagctgaaggaaatcactaatgtatccgttaacgaagagattttagctagaaatgctgagattgcaggaatgatggatattgaggatattggtgatattcgtgatcttcgccaacaggtagctgacagcttaaacatcagtcttgaagagtacttggaaaatgcagagcctatggaagctatctatatcattgcagatcatacaagatgcttggcatttatgctggctgatggaatcattccatccaacgttaaggaaggataccttgcaaggcttgtattaagaagaactatcagattcatgaaggaattagagatggaagagtctctatctgacattatggccattcagcttgacttcttaagggaattctatcctgaaatcgccgagtcccaagagcatatcatgaacatcatcaaccttgaagaggaaagatatgcaaaaaccattgaaaagggtaaaaagactgttaagagaacaatcaaacgtcttaaaaaagaaggaaaaacttccatgcctcttgaaacattgattgatttatacgacgctcaaggaatgcctccagaaactgtagaagagcttgcaagtggagataaggactttgaggtctttgtgccagataatttctttacaatcgtagcggatatgcacgaagaggataaggtagctaaaaaagagacctttgagcttgatgttccagagactgagcttgacttctataaggacatctatcaaaaggaatctgatggaacaatcattgaagtcgttgaaaaagatggcaatttaaacattattcttgataggacaatattctaccctgaagggggaggtcagccttcagacattggtataatttctatagaaggcacaatctatgaggttgtctatgctgaaaagttagatggtgttgtattgcataggatagccacaaaagaggatgaggatgtggcttcccttgtagaggacttaaggaaatatattggaactgaagtccatatggcaatcaattggaataggagaataacccttgcaaggcatcacacaggtactcaccttgtaattgcagctgctagaaagattttaggccagcacatctggcaggcaggtgcacagaagggtcttgcacgttcccgtatcgatttggctcattataaacgtatcaccataggggaattggatgagattgagaaattggctaatgagtatgtgatgatgaacattgacttggatatcaattggctaagccgtgatgatgcagagaagaaatatggtttgatattataccaaggtggtgtagtgccaggctctcaaatcagggtagttaagattccaggcatagacgttcaggcatgtgcaggtactcacctttccagaaccggtgaggtaggtccaattaaaatcaataagactgaaagggttcaggatggtgttgaaaggattgatttctcagcaggtcttgcagctattgattccattcaaaatgataaggcaatcataaaggaaagtagtgatgtatttagtgtaaccaatgatcaattgcctaaaacctgtgaaaggttcttcaatgaatggaaagctcaaaagaatgagattgcaaggcttcaaaaggaaattgctaatttaaaggtcagcacacttgcagaaaatgcatttgaagttaatggattgaaagtgcttaaggaaatccttgatgcaaacattaaagagcttcaaaagatagccactgactttacagacaatgacaaggttgatttggtcttcattggtaataatgagggtaagattgtaggttcagcaagtaagaatgctattgatagtggagttcaagttaataatattattaaggaagctgcttccctacttggtggtggcggcggaggccgtccaactttagctcaaggtgcaggtcctaatgcagataagatggctgatgctttagatttggctgttgagttattgaataaataa

SEQ ID NO: 352 - DNA, 2448 bp, Methanobrevibacter ruminantium
atgattaaaaagataacgattttgtcagttattctgattctgtttttagcagtttcaacggtagctgcaattgatgtggatacgaatgataatttggatgatggtagttcttctaattcagatttaattagttcttcttcattggattcttctagttctgatgatgtttcttctggttctagtgaggtttctagttctgatgaatcacttgatggaaataatttgtctgatggtaatgtttcttcttctgatgagtctgttggtgctgataatttgtctgatggtaatgtttcttcttctgatgagtctgttggtgctgataatttgtctgatgatgagtcatcttctgatgctctatctgaagaattgcctaaaactgaaacagtcattaaagcagacccaataaattataattatgcttcagttaaaggattaaccattaatctaacagattctgcgggacttgctttatccaataagactttgactgtcaaggtcagtgctttaaataagacttctaatctgactaccaattctaaaggacaggctatctttaagctaagcgcttctgttggatcatatgatgtttttatttcttttactggggatgaaagctatgctccatccaatgcaagttctaaaataactatcaaaaagtcctcaacaaagattaaattgagcaatattcacggatatttgactatttcaaattatgtaagtgtcacattactggattctgctggaaagcctataaaaagcaaatcagtaacaattcaagttaataaggcaaaatataatgtcaaaacagacagcaaaggcattgctaaagtcaaggttgcaaataagattggaacttactctgtgaatgctaaattcagtggagataagaattattacgcctcttcaaatagctccaaattgacaataactaaaatgaaggtttatattaaggctccatctgtaaagtattatatgacaaacagctctgctccttatttgacaattaacctgactaacgttaaaggcagtccacttgcaaaaaagaaagtctctgttaagataggcaaaaagacttatacattaaagaccaattcacagggaatcgctaaattcaagttcactaagaaagtgtcaagctataattgtaagattaattttaaggccacttccaatttctatggtgcatctgtaaattcaaagatgactattcaaaagatgccaacctcccttaaggcacctagcgttagcattaattcaactaactatggaaaagttctaataagcttaaaggatggaaagggaaaagccttgaaaaatactacagtcactgtaaatgtcactgaacttaagaaggttttcaccctaaagacaaatgccagcggagttgccacatttagctttaatggtgaaaagacattcaatcttaaaataaagtatgcaggaaataagaattatgcagcaagctctgtaagttctaaaataaacgttaaacagattaaggtaaagctcagcgatgtcattggtgcatcaagggtattgattgactatgtaaacagaacaaaggacttgccttcaaatgtccaatataataattataatttcactgtcactcagcttacatatttggcttctaaggcagttaaaaatataaacaataagaattatggagatattgttcttatttctgttccaaaaagctataagtcctctggagagatttatgatacagtttataagaaggactttgttaagatagcaaatagcgttgtcggatcttcttacaattataagaataaggagtatgtaagctattccatttataaggttccatttaaggtatattccattagctttgctaaggttctaaacttctatggaaataataagaaattgcctaattattcactctttacccttgcagactttgctaaggttaaagataatggaggatataatttctatctgacaactgataatattgcaggtaagaaatctgatttgaatatgcttaagagcttagctaagaccttaaaatccatgggatataatgcagtcattgtaggtatcggtccggatatacataatgtggcttataggtatggatgtactggaaacaattctgttttgcttgcttgcttcggcggagttgatgtaggatgcatagaagaatgggctggcgatttaggtgacttgaatggtcattcatttgtcaatagctatcaaggagctcatgttttaggattatggtttactaagccatatggtgcatctgtaagcttgaataagaaggtaggcattgcatgggatgcagattatggtttcccattaaacactccggctaaatatatgaaaagtcataatattagctatattgagactggaactgttgcaaatgcatgtaaattgttaagcgagggtaaaatgggtggtcctcaattgattagctaa

SEQ ID NO: 353 - DNA, 1161 bp, Methanobrevibacter ruminantium
atgaggtattttatgaattatgatttaatcattgctcgatatggtgaagtagcattaaaaagtaatcgagtaaggcgcagatttgaaagtcgtttagtaaataatataaaagcgtcaatagatgcggaagtgaaggttaaccaagcaagaatttacatctttccaaaagagtttgatgatgcaatagagaaactggagaggatatttggaattgtatcatattctcctgcaatatccaccaaatccacttttgaggatattgaaaaaactgttggggaatatgcagagcatctttatgaagaaggtcttttggatgagaacactaaatttgcaataagctgcagaagggtaggtcaacatgaattctcttcacaggaaatggctgcttttgcaggggctgttgtagttcgcaaatactcttgtcctgttgacttgtcaaatccagaacttactatctatcttgaagtaagagacggcgatgcttatgtttatcacgaaaagattgaaggtccgggaggccttcctcttggaactcaaggaaaggtcgtttcacttgtatcaagtggaatagactctcctgtagctacatatcttatgatgaaaagaggctgtcaggttattgctttatattgtgataatgagccttatacttctcctgaggcactgcagaactttaatgacttgatagatcaattgaatctatatgcaagcggagctccaatcaaaagaagggttgtaaaatatggagaatacctttccacctgtaaggcggaggctccagataagatgacttgtgttctctgcaagtctggaatgtataagttagctggcaaattggctaaaaagcttaatgcagaggctgttattgatggaagcagcttaggtcaggtagcttcccagacacttccaaacatacttgcaacccgtgaggatcttgatgttccggttttaagtccccttataggtcttgataaattggagataactagaattgcagagaaaattggcacattcgagatttccaaaagggatgatgggggctgcaaggcagttccaaggtatcctgaaacaaatgcagatttggaatttgtaaaacaggtaaaagaagagatgaatcaggatgaagagcttgaaaaggcttttaagaccattgtttattag

SEQ ID NO: 354 - DNA, 1101 bp, Methanobrevibacter ruminantium
atgaaaactactgtaagtgtaatcaaagcggatattggaagtgtttccggacactgtgtatctcatcctgcattaatggaaaaatgtgatgaggttttagctaatgctttagaaactggaattcttgaagattactatataacccgttgtggtgacgacattgatttaatcatgacccacagaaacggtgaattgaacgaagaagttcacaaaactgcatatgatgctttcattcaagcaactgaaattgcaagagacttaaaattatacggtgcaggtcaagacttattatctgacactttctctggaaacgttaaaggtatgggtccaggctgtgcagaaatggaatttaaagaaagaagaagtgaccctgtaattgtatactgtatggataagactgaacctggtgcattcaacttgcctatattcaagatctttgcagacccattcaacactgcaggacttgtaattgacccaagtttacatgacggattcagttttgaagtctttgatgtaatggaacacaaaaaagtagtattagactgtcctgaagaaatgtacgacttacttgcattaatcggttccactggaagatacgtaattaaaagagtatttaagaaaaacggtgaaatcgcagcagcagtaagtactgacaaattaaacatgttagctggtgaatacgttggtaaagacgaccctgtagctattgtaagagctcaatctggtttccctgctaatggtgaatgtgtagaaccatttgcattccctcacatggtaagtggatggatgagaggttcccacaacggtcctatgatgccaaccagccaagaagaagctaacccaatcagatttgacggacctcctagggttgtaggtttaggtttccaagtaactgatgctaaattagtcggtcctgtagacttatttgacgaccctgcatttgatgaaaccagaagacaatctgcaaacattgcaacctacatcagaagacacggtccattcgaaccacacagattaccatctgaagagatggaatacacttcattacctggcgtaatggaaaaattagaacctaggttcgaagatatggatgatgactaa

SEQ ID NO: 355 - DNA, 513 bp, Methanobrevibacter ruminantium
atgattttaaaaacagcacgacttattttaagaccttggaaagaggaagatgcagaatgcttatatcattttgctaaaaatccaaagattggacctattgcaggatggccaccacataaaagcgttgaagagagcttagagattataaaaactatttttgcaaaaaaagaaacttatgcaattacaataaatgataaggcaataggatgtgtagggcttttattctatccagatactaatcacaagtgggaaaatgaaggtgtagaattaggctattggattggagaggaatattggggccaaggattagtagtagaagcatgcaatgaactcatcagacatgcctttgaagacattgatataaataaaatttatgctagttttaaatatgaaaatcatcaatctaaaagagttttagaaaaattaggatttaaatattattgtgatttaaaaaataaggattataccggagaagaattctatgaaatagctatgtttttagagaaaaagtaa

SEQ ID NO: 356 - DNA, 192 bp, Methanobrevibacter ruminantium
atggcagatgtggatgttactgaaattagaattattttagaagacctttctaaagatcaattaactgaaattttagaaaaaaacggctataccagcaaaggtagcgaaaaattcctgattaaagaaatcatgactaaaatttcccacgacattattattgatgaattagaccagcttggcgttttagactaa

SEQ ID NO: 357 - DNA, 243 bp, Methanobrevibacter ruminantium
atgaaagatttggaaagtgaagaaaagatagcaattgatattgccaaacttgaaagaaatcttaatcaagttgaagacatcaagtttgaaggaaaagaaaaggaagtttatgatagggcaatagattactggaatgattcaaaatattacctagagaaaaaagacacaagaactgcttttggttgcattgaatatagccacggcttgttagatgcgctaagaatgattcatggattaatttaa

SEQ ID NO: 358 - DNA, 666 bp, Methanobrevibacter ruminantium
atgaaaatatttaaaatgaatcctgaaaatccagatatggatcttatagatgaggctattgacattatggctcaaggaggagttatattatatcctacagacactgtctatggcttgggagcaaatattttcaataatcaggctgttcaacgaatttataaaattaagcatagggaaagatcaaagccattatctgttttggtttcggatattgaaagcttggagcttatcgctcatttagatgatcattcacgtgaagtggttaataaatggcttccaggaccttttacttttattttaaacaagcaaaagactgtttctccctatgtaagttcaagcactaaagtaggtgttaggattccagataataagattgcaagagaattggcttccatttttccaataacaactacaagtgcaaatattgcaaatgaagagactttatctaatccacatgacatattaaaacaaattggtgattgcattgatttggctattgatgttggagacttgactgggggaaagccatcaactgtgattgatttgacttctgctaaaccttctttagttaggaaaggactaatttcaaatgatttggaatctattaaagaagatattggtgatatggactctaataaaaatgatattgatgatatgaacttataa

SEQ ID NO: 359 - DNA, 696 bp, Methanobrevibacter ruminantium
atgaaaattttatctactatgcaagattatgaaaaaatatccactaattctcctttagatgaattgttagatgggggaattgataaaagaactatcactcagatttacggacctccaggtgttggaaaaaccaatgtttccttaaatattgcagttaatgttgcaagaagtggaaaaaaggtaatctatattgataccgaagggggaatctctgttgagaggattaagcaaatatctggtgaagattttgataatgttgctaaaaatatagttgtctttgaaccgacttcatttaaggaacaggaagaggatttggaactgattgaagattggctagcttctaataacagtgaagtggaattaatcgttcttgattctgctgttgcattgtttagggttgaagacgataagtcaagatcacatcttttaggtaagcaaatgcagcagcttgctaaatttgcagttgattatgatttggctgttttagtgacaaatcaaatctatgcctcctttgaggaagacagtgatgaaatggctcctgttggtggaacaatcattcaatataggagcaaaatcattattgaattgaaacgtgaagaaggaagcagtgaaagaattgccattttaaaacgccataaaacccgaagggaaggattagctattcatttctcaattacaaataatggaattgaatga

SEQ ID NO: 360 - DNA, 1161 bp, Methanobrevibacter ruminantium
atgatccaaaagaagaaatatgcaaaggcagcaaagattattccagaaggttataaatctgcgaatcaattctttgaatctgtttttcaagataaagaaatgatttggatgggtcaaaacacaaatgaattgcatattggtcacaatgaagaagttcataaggcaatgattgattgcattgaaagtgacgaatactgtaagtacccacctccagaaggatttacagagctccaatctttaattttaaaggatttggatttggaagacttaagcatttatattaatgcaggggcaacagaatctttatacttggctatgaatgccgttttatctgatacagataatgtaataactccagatccaggatatcttatcattgataattttgcaagcagatttgccggtgaagtaagggctgtaaagatttatagtgaagaaaacaattataaattaactccaaagcttgttagagagaatatggatgaaaatactagagtaattcttttaattgatccattaaacccacttggaagctcttacactgaagaggaaattaaggaatttgcagaaattgcaaaagaaaatgatttattcttattacatgacataacttatagagattttgcacaaaaacatactctcgctgcaaaatacgctccagacaatactataacctgttatagtttctctaagatatttggtatggcaggtcttagattaggtgctatcgtatcaactcaggaagttattgatgttgtcaaaagcattatcattaacgacgtaggtacaagcatggttgcacaggctggtgcaattgcagccttaaagactaagcctcaatggattgatagggttaaagacaccacttttgaaaatcagaagatcattaaggaagctgtggatcagtgtgaaggtgttttcttgccagtctatccgtcaagtggaaatatgatgggaattgacttatccggtgcaggaatcgactcagaagacatgtctcaatatctaattgacagaaaagtctttacaaggcaaggatcctatacaagcaatacctttggtcataaatatttaagagtaagttactcaatcgacccagaaaaggttaaagtatttgctcgtgagtttgttttagctgtagaagctttaagaactaaataa

SEQ ID NO: 361 - DNA, 1776 bp, Methanobrevibacter ruminantium
atgagtagaatttctattttagacaaggacaagtgccaaccaaagaaatgtaacacagtatgtatgcactactgtcctggcgtacgtatggatgaagatacaattgtaattgatgaaaagactaaaaaaccacttatttccgaagagctatgttctggatgtggtatctgcaccaacagatgtccatttggtgcaatcagcgttattaacttacctgaagcattagatgaccctatccacagatatggtcaaaacagctttgaactctttggacttccaagccttaaagaaggcacagtgcttggtttgcttggtcaaaacggtatcggtaagtctacaatcatgagaatcctatctggagagctcattccaaaccttggaaactatgaggaggaagccacttgggataaggtaattgaatattataaaggttcatcccttcaaaactactttaaggcgctccaagcaggagaaattaagaccatccacaagccacaaatggtggatcagctctctaaggtagttcaaggaaatgtaaagacccttctttcaaatgtggatgaaagaggcaaattggatgaaataatcgatgaccttgaccttaagaatgtgctagagagagacatgcaaaacctaagtggaggggaacttcaaagagtggcaatagctgctacagttcttcgtgaaggagacttctactacttcgacgaaccaacatcatggttggatgttcgccaaagattaaatgcagttaaagtaattcgttcccttgcagaagcaggcaaatccgtccttgtgattgagcacgacttagctacattagatgcattaagtgacaatgtccacttattatatggtgaacctggaggatacggtgttgtaagtggaaacaaaggtgttagagtaggaatcaatgcatacattaacggattcctccaagaggaaaacgtaagaatccgaaaacaggcaattgaattcagcattcgtccacctacccctgaagatgacggtgaagtcttaagcgaatacagcgatcttaaaaaggaatatgacggatttacacttgaagcggaagctggaaaaatctatcacgatgagattgtaactgcattcggttcaaacggtatcggtaagaccacatttgccaaaatattggcaggagttgaaaagccaagtgaaggaaacattttagaaaaggttgaaattgcatataaaccacaatacattgaatctgactttgatggaactgctcaagacttcctttttgctaacgccccaacatatggatccaatatcttcaacagtgaaatcggaaagccacttgcacttgaaaacctattggacaaaaaggttaagaaactaagtggaggggaacttcaaagacttgccctcgctgtaaccttatcacaggatgcagacacctatcttttcgacgagccaactgctttcttggatgtagagcaaagactgattgcagcaagagtaatcagaaagatagttgaaagcagaaatgcagcttcacttatcatagatcacgatatcgtatttattgattatatttcagacagagctatggtctttagcggagagcctggacttaatggtaaggcatctaaacctgcagaccttagaacaagcatgaatcagttcttaggagatttagatattacatttagaagagataaggaaactaaacgtcctagagtaaataaatatgattcttatcttgatagagagcaaaaagaacaaggagagtattattacttaaaagaataa

SEQ ID NO: 362 - DNA, 339 bp, Methanobrevibacter ruminantium
atgaaacaggtaatggttgtaagaacagatataaagatgggaaaaggtaagatagctgctcagtgttgccatgctgctataggtgcttataagcaagcggataaggaaaaaataagaaagtgggaaaatgaggcctatgcaaaagtggttttaaaagcacctacattacaggatctttataatttaagggaaattgcaagggcaaatggtgtggcctattatttggtgacagatgctggcagaacccaattgccaaaatccactgtgactgttttaggattaggtcctgatgaagatgatgttttagataaaataactggtgatttgaagttattataa

SEQ ID NO: 363 - DNA, 816 bp, Methanobrevibacter ruminantium
atgaataaaataaaaaagcatgaaagtaaatttacaaacaataggctacttaatcccgctgaatatatgccaaaagaggaagttgaaacattaaagcaagtatcctatttaatagtgctatttttactcttcatattcttcatatacagtttttggccaatggcaaatatgaaattcttctcatttttagaaattgtattgatggtatacattgcattaaacatagactatagcaactggaaaaacaaggtactgtttttctttttagtgccttatggatcaatagcatggttcctttttgaagaacttacaaacagcctattcgacatattccatatgataattcttttatactttatgaaagtctattatgagaagtttagggaatatactgaaacaaatggtttaggaataaccatattgctattatttaccataatatttattagttttattttaacaatgattgtagaaggagtctcaccgatcgattcaatagcaatggtctcaaatgcatttacaagtaatggatatgcagttttaggaagttcattcggtggaaaattaaacagcatactattggtttggagcggttatatcctttcaggagtaggtactgctacaatgacagttgctcttctttcaaaacacttcaataaaagaatcaaggaaaatgaaaaaacaaatgaagcacaatatgccgaattaaaagagatgattgaaagaaataatgaggaaattaaagagatccttaaagagaacaatctggaaaaaaagactgaagaagaattagaaaagaaaattatagaaccgtaa

SEQ ID NO: 364 - DNA, 915 bp, Methanobrevibacter ruminantium
atgtcaaataaaaagtcatttcttgcaaaaattgaagagattatcttgatgcaaacaaaacctgattatatggattcctatgaaaaggtaaatgatttaataaaagagagattaaacgctcaagagaagcctcctaaaagcgccttattcaaaagcacatacttaaatggaacacagatattccattatggaaatagccaatcaaaaaatctgattgtttacattcatggaggggcctttataaatgaaataggattccagcatcacttcttctgttcatatatttctaaaaaattagatgcttatgtaatctctccagtttaccctttggctcctaagcattcctgcaatgaaacctttaatcaaataactgatttatataagtctttaattgaagagaataaatctaatggagataataaaaataataactataataacagtaataacaataaatccatttatctgatgggagactctgctgggggtggatttgtcttatcattctgccaatacttaaagacagtcaatcttccacaacctgataagatagtggtttattctccatgggtagatatttcaatggatgattctccttatgataatgaatccgatccgatccttggtgagataggccttagagaaataggaaagtcatgggctggagaattggatacaaaggattacagagtaagcccattgtttggagacaattctggcttggctccaatacttatctttgctggagacaatgagatattctataaggacatattgaagtattatgaaaagttaaaagaagataatgttgatgctcgattggttgtaggaagtggcatgtttcatatttatcctctatttccttccccagaggcaagtgaggcttttaaagagctaaaaaaagagtttgaataa

SEQ ID NO: 365 - DNA, 300 bp, Methanobrevibacter ruminantium
atggaattgataaaaaattataatgaaaaggaattaacaattgaaactggaaacaagatagatacaaccactgcacctgactttgaaaatgaaataatggatgaaatgggcaactttgattcattgactttagatttaaagaatttggaatacatttccagtgcaggcttaagggttttaattcttgttcaaaagaaattaaaagctgacgacattccgtttgttatcataaacactaatgacaacattaaaaacattctaacaatgtctggctttgacaagattttaaatattcaataa

SEQ ID NO: 366 - DNA, 633 bp, Methanobrevibacter ruminantium
atgataaaattagcctattgcaatgtagaagaacttgacttaaaaagagcttacagcttagtctccaagagccgtcaagaaaaaatcgacttttacagattcgataaggataagaagctaagcgctggagcatatcttctattgaaaaggctattgtctgaggtgaatattaaggattttgaaataattattgaaaaatatgagaagccccgtatagtcgaccatgagaacatatatttcaatataagtcattcaagcaaaatggttttatgtgcaatatccgataaggaacttggcgtagatattgaaaatattgatggcgaaattgatttaaatatagctaaaaattttttctataatgatgagtataagtcgattatgaactgcgacaatccaagtgatgaattcttcaaatattgggtcctgaaggaaagctatatgaaatacactggccttggaatgaatttgaaactggatagttttgaaatagttattggagatgagatcaaacttaaagatgacgatagtgatttaaaattcaatctatttgaaatagaagattataaaattggaatagcaagccattacaatgtatatgacttgattgaatatgatcttaaggaactgtattaa

SEQ ID NO: 367 - DNA, 1875 bp, Methanobrevibacter ruminantium
atgaagactaaactaaaacaaatattaatctcatttattgtgacaacaatattttattttgcgctttctcaaacctttataactcaattaggattagggagcccacaaataggattattatacgtttttggcctattatttggcccttttggtgcattaggtgcatcattatcaaacgtagcaatagatgtttatcatggatatacctttgttcaaatactcccttcagccatcatcagctttggagtttctcttttggcatataagctttggtactccggatttaaatcagatgagtatacaaaaccaagattggatacaatttaccacctatgcctatttttagcaagcataatcatatgcggaatgatttattcagtaggccacggaaatctggcatatatcctaatcagcccagatatagaggaatcaataatcattccatccttcttgaactttacaaacgttgcattcattatgggtattgcaggaatttggctttttaaaagaacaaatctcatagagacccctaaaaaatcagagcgtcgattgaacaagaacctataccgtttgatcttttccttattaatggtcatgacaatagtctcattcatattcataattagaaattcagataatctcacaataatcacaggcctaataatagttgtggccctaatgtatgcctatatgacaaagccattcatacatgagatacaagaggtcaacgagaacagcataattgcaaagattgtccgcaatttcattataattaccctaatccttggattctttggagggctcgtttccatagccagctttgactatgttgaaacaagcattacactcaacatctacctccatctgatgccgattcttgtgataagcgacataatcataattctcttcttcattccaggaatcattatccttaaatacattggagataatgtagtcaagccaatcacctcattttccgaaatcgaaggattcatcaaggaagatgaaaagatagaagcggaagggctcattaaggtctattcagaatatgtcaatgaacagaatgaaataggaacccttgcaaggtcatatacagagcttatcaatcataacaacaactatatcgaaaacattcaaaagatcgaaggggaaaaggagcgcacaaatgcagagcttgacattgcaacaaacattcaggcagctgcccttccaactgaagcaattaaaacagatgcattcattgtcaatggatattcaaagcctgcaaaagaggtcggaggagacttctttgactattatgagttggatgatggcaatttagcaattgtaatcggagacgcttcaggaaaaggagttccagcagcactggttgccatgattacacaagtggtaatcaagcagacactgataaacaatcacgacccttcagaagtcctattctcattgaataatcagctatgtgtaaacaatcccgaatcaatgttcattaccctatggctcggaatatataataaaacaaataaaaagctgacattttccaatgccggacataatcctcctttaatcaaggaaaacggcaaattcaaatatttggatatcgaaagcggaattgtccttggaataatggaagacttccaatatgaggatgaggaaataaccatagatggagaattggttacatatactgatggaatcaccgatgcaaacaataatgatggtgaaatgtatggcgaggataggcttttagaattctttaataaatttaaaagcgataaagacccaatattaccattattaaaagacattaatgactttactaaagatacagaacagtttgatgacatgactttattatacttgaaagtgaatgattaa

SEQ ID NO: 368 - DNA, 378 bp, Methanobrevibacter ruminantium
atgaattcaatgaactttaaagtagaaatagatgaattacatagactaaacgagtttattttaaacgaacttcctcatgaagactttatggtaaatctgattgtagaagagatctttgtaaacatagttaactattcccaaacagaatatatcatagttaatttagattacaaagagcctaatttaacaattgagtttgttgacaatggaatagaattcaatcctctttcaaaggaagattatgaagccccagacagtattgaggatgcaaaaataggaggtcttggaattcatctaaccaaggaaatagctgatgaactggattatcactacgaagatggtgaaaatcacttgatgattgttaaaaaagtagaataa

SEQ ID NO: 369 - DNA, 318 bp, Methanobrevibacter ruminantium
atgtcatcaagcaaggaatatttagaatatatactggaacagctctctgaactggatgagataacttaccgtgcaatgatgggagaatacatcatctactaccgaggcaagatcattggaggagtctatgatgaccgctttctagtcaagcctgtaaaatcagcaagggaaatgatgccaaatgcaaatatggaattgccttatgaaggagcaaaggaaatgatccttgtagatgatgtggaagacaaggagtttttaagagaacttgtagaagcgatgtatgaagagctacctgcccctagaaaaagacgtaaatga

SEQ ID NO: 370 - DNA, 471 bp, Methanobrevibacter ruminantium
atggacatcttagctaaattgctgaatgataaattagcatttgcagaaatcagctatacaatagaagaagcaaaaagtatatctgattcaaataagataccaattatgatttgtagcgaaattctaaaggaaaatgagccatttgcacattcctgggatgttacaagcgactcaattgcagcatatattgcaagccttttagatgcaaagcttttaatagcaacagatgtaaatggtatatatactaaagatccatccttaagtggagcagagcttattaaagagattgatgtaaatgaactgctgacttttgaagaatcatcaatcgatttgatgctgcccagtttattgattgagtatggattggattgttatgtcgtaaatggagagtatcctaagagagttttatccataatcaacaatgaggattgctcttttgaatatactttcataagaaatggaaacgactaa

SEQ ID NO: 371 - DNA, 162 bp, Methanobrevibacter ruminantium
atggaaaaagtaaactgtcaatcttgtaaacaagaaataccattaattgaaccttatgttcaattcaactgtccagaatgtggtagacctatcgcaagatgtgaaagctgccgtactttcggtcactcttacaaatgcgaatgtggatttgaaggaccataa

SEQ ID NO: 372 - DNA, 270 bp, Methanobrevibacter ruminantium
atgggagaagttgttaacactttaaaagtaatgccagaaagtccagaagtagatttagaagcattaaaagtagcaattactgatgcaatgcctgaagatgcagaattacacgaaattactgaagaacctattgcatttggtttagtagctttaaatgttgtattcatcgtagaagacggtgaaggtggaactggacctactgaagatgctattaatgctatcgaagatgtagctagtgcagaaattactgattctagaagattaatgtaa

SEQ ID NO: 373 - DNA, 1515 bp, Methanobrevibacter ruminantium
atggctaaaacaattattccaaaatataaggtttcaaagtttgaatttacagaagaagagagaagaactctagaagagttgcgggaaaatctaatcgatctggctatctcagagagaatgtccaacttcaatgaggatctaatactaaacgatatcattcgttttttagacaatcgtctattctcaaatgcagattatgtgagaaatattgattttgagaaactggacagtttcaatccttcaaaatataagcatatcggaaatcctaaaaggtattctcaattctatgcaatattcaaggatgagattgaaaaatacaagaataatttggctcgaaacatgtttcaagagcttattggatatggggaaattggatttttgattgatgacgatgatttggaagagattatggtgattggactcaataagcctgtatttgtatatcatagggaatatggtatgatggaaactgatttaatcttcaaagaggaggaaaagattctaagcataatcgattcaattgcccgtgagacaaaccgcagaatagatcagcaatctccaattttagatacaagacttcctaatggctcccgtgttaatgcaaccattcctccactttcagcagatggcccaaccataaccattcgaaagtttaagaaagacccattgacaattgttgatttgataagatacaacacattaaacactgaaatcgcatcattcctatggctctgtgttgacgggcttggggtaaagcctgcaaatatcatagtctcaggcggaaccagctcaggtaagacaaccctccttaatgccctttcaatatttatcaatccaaaggagcgaatcgtcacaatagaagatactcttgagcttcaaatccctcataagcatatcttaagaatggaagcacgtacagttaatattgaaaatcaaggggaaatcacaatagaggacttggtaaagaactccttaaggcaaaggccagataggataattgtaggtgaagtgaggggaaaggaagctatcactctgtttacagcccttaacacagggcattcaggattcggcacattgcatgcaaacagttcaagggaaaccattacaaggcttaccaatgctccaatgtctgttccaaagataatgataagttctattgatttcatcattatggaaaaaagaatctacaagtcagatggattgtcctataggagaatcactgaaatagcagaggtggttggaatagaggaaggaacaatccagcttagcaaactctttgaatgggatagtaaaaaggatgagttcaagaatctgacaatcttaagcaaaacattggaaaacattgcaagcctaaagggagttcatatttcaattcttaatgaggaatggaaaaacaggaagaaagttttagattatttggtaagaaatgacatttcttctcaagatgatatatctaaagttctcgaggactattatattaatcccgactatgtattaaatatgatttccaattaa

SEQ ID NO: 374 - DNA, 552 bp, Methanobrevibacter ruminantium
gtggtgatttttatttttgataaattttttatccaattaagtgattctatcataaatttcttggtttctatctcaaatctttttctttcattttttgataagaataatgattctaaagagaaatggggaaacgaaactaatcaatttgattcaagcaaatatgaggaattgaattattttaacaattttaaatctgttaatttaaattattcagataattctaattctggagacgatttaaaaaatgagaattattcattcatctctaatttaaacttatctaagatttttaataatgaaaatatctttgaatacttggaaaacaaatatttaaacaagcaagcaatgtttataactccaaatggcactaatgaaaatgaatcaaataaaaatttcctatataatttaaagataaaactagttgttttaatattagacaacaggttttttcaaataagatcttctcaagaccttttaaaactgttattttatgtcctttttaattataataaatcctttttccattcttattgctgtatttgtttcttttga

SEQ ID NO: 375 - DNA, 606 bp, Methanobrevibacter ruminantium
atgttttttatattgtttgctttgtttatcctttatcttcctaaaataagacatgagaatgattattcatcaatctcaaaagaactgccctatgcattgcgccaattgtccactgaattaagggctggaaaaagcttgtttgatgctcttgattctattgttgactctgactatggtgttttatcaagggaattttcaagggttcttgaggagataaaatatggtgaaacaagtgaaaatgcctttttgaatctggagaagagggtaaactccaaggcattatctagagtaatctatgagatacttgcaagcttaaggatagggagcaatctgtcccattcattaaatattattgctgaagatgttaattttgatatgagaatgaagttaaaggaatatagtgaaaaattaaatgctttcattatgatttatacatttttagctattttagcgcctgtgattattttaacaatgcttcttgcagcttctgttgtaattggagatattgttccaagcagtctgctttttattctgtatggattgttctttccaatgataattgtgtttttagcatttgcaattaagaaattagagcctaagctgtga

SEQ ID NO: 376 - DNA, 1509 bp, Methanobrevibacter ruminantium
atgtacgaacttattaaggaatcaattaatagtgatgaaagtgctttggaattagctaaaagcaaaaaagatgtaatctctgttgtagatgcaatatccgatttaagctttgaagacaccatgaaacttggaacaagattcaagaagttcccgatcggctgtgacttaactgaagtggtggttggaacctgtgcatcagatttggaaaagatggatctcttcggcaactgcatgcttgcaaacatgatcggtgctcctatacacatatgcgcatatgcgttctcagacattgcagagaaatatggccaaagaggtgtggaaataatggaagaggtctacaatatcacagatgttccactggaccttgaccactttggaaaatacggtgccatgagattcccaaagcatattgtaggatgcggaggagactgctacaaccaaggaccaagctttaccgaatgccctagaggaagaatccacgaaagattgcttgacaaggaaaaggcagagcttgacgataaggaaacctgggtccaattatcatcttccgttgcaatcaacttaagcagcgagcaatgcaatgacggccatgcggcacctcttgaagaggcccaagacttggcagaccttgcaaagaaatatggaaagggccttgaagcaatcatgtttgtaggagacggatatgatgaacttatcacaggctttacaaaggcaatcgaaatgggtgttgatgtatttgtaattgaagggggaccattcaacagatgcgaaaacaccaacgaaagctttgctaagacaattgcaatgagcagagtcttatgtcctggaaaagttgttgccacaaacggtgcatatgaaagtgaatgcagagcagggcttagatccggactaaatgttataattaccggttttcctaaaaaccatcacggatacatgtgcggtttcgagcctggaactgcaagaagaggcaagttcggcctcccaagagtaatcaagatcatgaatgaggaaataagtgcaggcccaacaagagttcctgtccaaagagaagagctattggcattgacccatgcagtcaagcttgcaggacctgaaaacatctatcctaagacaatcggatcatttgcaattggagacgcccattgggctacaatacaaaactctaaaatgtataaggaaatgtatcttccaaaaaccttagaggaaatagctgatagcgtaaatggcaattcagtttcattgcatggaggaagattcgtttcatggcttgttgcaaaagagctggataagaaaggaatcgatgagataataatcactgacagcaacccatgggtagagaaagtcagcgtagacaatcttcaagaggaattgaatgcaactatcatcagaggccatgcagatgataagggagctggaatgattgctaaggaatctattgtaaccactacaattcctaaaatccataatgcaattaaatccaagattcctcatgcagtaaatatcatctaa

SEQ ID NO: 377 - DNA, 1002 bp, Methanobrevibacter ruminantium
ttgatagaatctatcttggaaaaagctaaaaatagagaaaagttaagcagaaatgaattgatccaattatttgaaatagatgatgaggaaactttaaaggaattatgtaaaatagcttgcgatattcgcaatgaatgttctgatgtaattaaattaacatccactattcatcttacaaataaatgtcaagttcaacctagatgcaaatattgcggatttgctgctaagacttcatccattggatattatgacgctttttataagtctgatgaagagatacgccaagctgcaatgtgtgttgaaagatcaggcattcctagaataagctgttctggaggacatggatataaaggaaagcaagcagtaaatgctgcaaagatagttaagggagaaacctcccttgaaatattggttaatgtcggcgctgatttaactcaagaagcagtagacgaattgaagaaatatgatgctgatactgtttgctgcaatttagagacaaccaatgaagacgtttttaactttgtaaagcctggtgaaaagttatctgaccgcataaacatatgcagaatggtatcagatgcaggtattggattgtcttccggtctgttgattggcattggagaatcctatgaggatagggttgaccatctattattccttggaagctttgagagcttagaggagattcctataatgggatttaatccatatgttgacacccctatggaaaatcaccctccttgctctatcgaagagcagctaaagacaattgcaattacaaggatcatgtatcctcgcattagaataactgttccaacacctacaatcggtcctgagaatgttgagcttcctttgatggctggagcaaacaatttggcaacagtaatccctgaagactatcctttagtcgttaagggagttggaaatccagaatacggcaatttgcatgaggtgatttcagtagttgagaatttgggccttgaggttcagcttcatgcttaa

SEQ ID NO: 378 - DNA, 474 bp, Methanobrevibacter ruminantium
atggcctttgaggaaagtattagaaaagcttctatccaatcttatgaaggaacacgtaagggagacactattgaagagattgaagcaatccagaactatattcgaaatgcaaagattgttgttcctaataagaatggcataaaagtagaggtaataaatgaggttctagctaaattcaatattcctcctgctgaatatctgcaggtaaatactaattatgctgatttcagtagaatgcctgcaattgcaaaggctatgatagctgtagatcagtcagatgcagatttggtcattgcaagaggtcgtttaggaatccctggctctggttcttttttggtttttatggacagcaaatccaggattttaactgcagccacttccccatcccatataattcataatcagccactcgaaaagactgtttataaggagacattagaggcgttaaagaaagtaggctttaaagaagaatga

SEQ ID NO: 379 - DNA, 441 bp, Methanobrevibacter ruminantium
ttgggaggaatagatgaaagccaatcagaatcaatttacacaaaggtctttttaattgaagaccctatagctgaagacaatgatgacttattgaagaataaaaacaatatctattctcgcataagcctggtgaattcatataataagttcattcttaaaacagaaggtttaaacacaaaaacctctggaaccatgactttgacaatagatatcttaaggcaatcaatgaatgagatattgtcaagggaaggagttctttactgttcatctgaaatgaccttctttgaagagattgtttttaaggaaaatgacttggataagttctttgaattaatagggtctcctgtaattaaagtttcaactattgctccatttgactgtgaggaaattattaaatgctttattgacaaaatctattctgaaatcttgattaggtggtaa

SEQ ID NO: 380 - DNA, 729 bp, Methanobrevibacter ruminantium
atgtatgcaaatgatatttttaatattatagatgaattggtgcctcgtaaattggcattgaagaatgataaattcggctattttggaaagactttcgacaatttcgatattaaaaatattaaagtcatattagatttattgccagaagatgacttgaaatttgataagggtgatttggttatttcccatcatcctcctctctttatgccaaagactccaacctatgttgtccattccaattgggatattgttcagggaggggcaaatgacgctttggcttattatttgggtttaaagcctatttctatttttcacaagcagacaggcataggccgaatctgctcttcaacaaagacattggatcagttcttagccttggtttgctataagttcggtcctgaaaatgttcgattggttcatgatggcgactttgataagatgcttaggaaaattgctatagtttccggatttggcttaagcaataaggaatttattaaattggctaaggacaggtccgtagatgcatttttatctggtgacttgaaccattcaaatgcgatttatgcgaaaaagctaggaattactttaatcgatgtttctcatcatattattgagattccggggctatttgccttaaaggaattgctaagacgaaatgaggatattactgttcctgtagaaatgattgacaatggagttccttggaaatatatttctgctgatttttag

SEQ ID NO: 381 - DNA, 645 bp, Methanobrevibacter ruminantium
atgattcaagaaatggaaaatagtttaattccaaaaggaagtattgatttagtgggatttggaagattaggtttaagaacaggaatcaatcttatacaggttcacagaggaggtccagctaagataacagttattgatggacagaagatctctgaatctgatataatatttctattgaaaggagctaaagtcggcacttataaatctgactttttaaaggaaatttccacccattcaaaggattttagagaagttgtttcaatcactgaagacataacagaggataatattgatttaatcactggagatgtggttgtaattgaaatagctggaggaaataccgtacctactgcagcaaagataattaaaaaagctcatgaaaacggctcaaaaacaattggaactgcaggtatattcggaattggggatgaagagattgttgtagcagacatctctgaatttgatgattccaatcccgctattgaagagttaagaaaagaaggaatccttgataaccatttagttataagcactaataggtttattagggatggaattccaataactccttatgtattggatgatattgctaatatcattacaagagaggccttaaaattacttattgaaaagaataatgaatag

SEQ ID NO: 382 - DNA, 609 bp, Methanobrevibacter ruminantium
atgattactatcgcaactgcagaatgttttacacatgggattttagctcgtgaaatacatgctctcgctcaggattatgatgatatttttgcatcttcctattggggtttggttaacaaagtccaaaaggattgcatcaaggatgcaattcttgaagataaatgttccatttttgatttaagggatttgagtgttagctgtggattgttcattcctacattggatgctgtaaaatctgttttaaagatagaaaatccgctagagcctttgacacttattgatggaattaaggtttatgacgatgatggcgatagggaaatggctatattgatggcagaggctgctaaaaaggtatctggttctgatattggaataggcacaactgcagggattggatatggtggcatagctattgtcgatgatgatattgtcattagcacaagttctgatgtttatgctgatttggtaaatgtggattccgatgatctttatatgcgtcaaagaagtggaatagaaaagactttaaaaatattgatttattatttaaacgataatttagacattattaatcaaatgaataatgtgaaaatatataataaatcagaataa

SEQ ID NO: 383 - DNA, 2169 bp, Methanobrevibacter ruminantium
atgatttttacaatagaatatgataaaggaactcgcttaagagtgagatgtggtaaagaagcatttaccaaagaggaatcctatggcttagctgaaaccttaatcgactatgacttcatagatgaagtaaaggtgtctcatagaaacggaagcattcttgtcttatacaatgatcctaaaaaaaggatagaaattcttagaatcatatcaaaaatcagccaagataatttatatgaaacaaaggcaagtgataaggctgctcttgaagagctgaatgacaagtttgcaataaaaattgcaaagcatattctcaaaagatacctctttaagatcatattgccaattcctttaaggaaattaagaatgctttatcatgcgtcatcctatatctggagagggctcgacagcctaacaagtttccgcgctgatgtggcccttcttgatggaacagcaattactgcatcattattgactaaaaactacaagtctgtagggtcaatgatgtttctcctatccatctctgaaatgttagaagactatacaatgcaaaagaccaaaagcacattaaaaagcagtctggccttaaacattgacagcgtatggaaagtggagattgatgatgagggaaatgaaatcgaaagccaattcccattaagcaagcttgaaaaaggagacaagataagaatcagaaccggcgcgatcattccagtcgatggagtcattgcagatggggatgcaatgatcaatgaagcctccatgactggagagtcattagctgttcataaggataatggcaaggctgtccatgcaggaaccgttgttgaagagggctcaatagtcattgaagtccgctccgttaacgatgagacaagattgaataagatcattgacatgattgaggattcagaggagctgaaggctggaattcaaagcaaagcagaaaagctagcagattcaattgtgccatacagcttagctgcaacagcactgacatacctcattacaagaaatgtgacaaaggcattatccgtattgatggtagacttctcctgtgcaatcaagctaacaacccctatttctgtcatctcagcaatgaaagaggcatcagacaataggataatggtaaaaggtggaaagcacctggaagcatatgcaaatgcagacaccattgtctttgataagactggaacattaaccaatgctcatccagtattggaaaaggtcattccttgtggaaaatatgatagagatgaggtcttaagaattgcagcatgcattgaagagcactttgcccatagtgtagccactgccattgtgaagcaagccgaaaaagaaggattgcaccatgaggaagaccatagtgaagtggaatacattgttgcacatggaatctcaactacttatgacggcaagaaagcaatcattggaagcaggcactttttagaagaggacgaaggaatcagatttaccaaaaagcaagaaaaacttattgaagaaaatgcagaagagtattctgtaatctatcttgcaataggtaaaaaacttcaaggaatcctttgcattgcagatcctgtaagagacgaagcccatgaagtaataagtcagcttaaggcattaggcattgaaaatgtagtgatgctaactggagacagcgaaaacgctgcaaaaagaatagccaaggatttaggcattacccggtataaatctcaagtgcttccagaggataaggcaagcattattcaagagattaaagccgaaggccatcaggtcattatggttggagatggaataaacgactctcctgcattatctgctgctgatgtgtcagtagctatgagaaactcatcagacattgcaagagaagttgcagatatttccctactttcagatgacctttatgacttggcaactcttagattgcttgcaacaggcatgcttgataagataaatacaaattacaggcatattgtcatgtttaatggatcactgattggacttggattgcttggagtcattccacctacaacaagctcattgcttcataacttatctacaatgctctttggatatagaagcactaagtctgttttaggtgaaaaagaagaagtcgttattgatacaaacgtaattaataatgatggtgctttgattggccaatcaggcaaataa

SEQ ID NO: 384 - DNA, 234 bp, Methanobrevibacter ruminantium
atgattaaaaaattaagcgaactcaaatctggagaacaaggcaccttatcttcttacggaactggcggagatttggaattgaaaagacatttgctcggtatgggcttcattaaaggagcagatattgaagtagaaaaagtagctcctcttggagatcctatgcaaattaaggtaaaaggatactctgtatgtcttagaaaagaagaagctaggaatatcgatgtagaagtataa

SEQ ID NO: 385 - DNA, 198 bp, Methanobrevibacter ruminantium
atgcaatgtagtatgtgtggttacgagtttgatcctcttgaaggagggccttgtggtgcttgtggacagtgtaaaggctgtaataaggctttttgtccaagatgcggatatgggaattccctttctactgtaaaggaatttgattatatatccaaacttcaagcaaaattaagggcttttaaatcaaaagcaaaatag

SEQ ID NO: 386 - DNA, 627 bp, Methanobrevibacter ruminantium
atgcatatacctgatggttttatacctctttggcaatgtgcgatctactatgtaatcttgattattgcattgtatttcgctggaaaatgggccaaagcaaatctagatgaaaaacgtataccacttcttgcagtattagctgcaggtatttttgcaattatgtctatgaacatgcctattccatttggtaccagtggccacatggtcggtggggcattagttgctattgtatttatggctcctgaagctgctgttcttgtattcactgcagtattgcttatacaagctttattcttcggagacggtggaattaccgctttaggtgcaaatgtatttaacatggctatcgttggaggatgtgtcggtctttacacctacaaaggattaaacggcatcattggaaaatatccttcaatattcttaggcgcatggcttgcaacattagttgcagctgttgtctgtgctcttgagatggctattgcaggaactttcccattgagtgtgggagtcgcttctatggcactttaccatgcattcattggtttaattgaaggagtattaacagttattgttatatttgctcttgaaaaatacagaccagatctattggcatggaatagagaatag

SEQ ID NO: 387 - DNA, 1350 bp, Methanobrevibacter ruminantium
atgagcttaatatattctataactagcacaataactagaaatatagaaaaaatactaagagagtcccttttatttacaatcattttcaatatattggaatttattgaaaatcaatgggtcaacagttattttaagggcttataccctagcgaaagattcctatcaattgtaaataagagtaagatcttaaaggaagagatattttcaccccttattgttttagtcacattcactctttttatacttcttgcaactgatccggtcccaagggatttgcagaccactataatcattgcttttctaagcttttttattggtgcaataatatttccaagatttattttgaataatcaattaaatcaattaaatgatgaaactaataccgacaataaagaatcaaagactgataaaagcaagcaaattcccttatttaattcctacgatgtatattcaataggattctgccttagcttaattggaattgtctttttgtttttaagcattgcctccgttggagggctgccaatactaaagtcctcattaagatattcacttaagccagcatttacaatgcctgtatttttaataattccaggtatcggacttatggcttcacattatctaaaccagtacaagaataatgaaatcagccgcagccaaacaagattcagattcttggttttaactgcaattggaattggaactgtccttacactccaatatagaaccccaatcattgccattttacttatgatgattataataggatattatggtaaaatactatcagtttgggaggtcattttaggtgccctgcttggagtatgtgccatcattggaattggatatttaagatcattgaatgagcttgcaataagctcaaatacaaatatattctccaccttaaactcaagggcaaactttacaatgcatgtattgaacctactgaattatatttcagggaatttcggactaatgcatggaaagatgatagcaagcgccatgcctggaagcgatcttggacctagaatgatggtgggcaaactgatagcttggagaacagaggttactgtaacccctacattgctaggacagatgctagtggatttcggaaaacttggggttgcagtggagatgtgcctgcttggattccttttaggaactggatataaaatagttaaaatcactgaaaactctttttacatagccctttatggcttgattttaacctattccattgtaggtgttgaaactggaatattggacatacagattttagcttacttctttataagtgcttttatctattttgcagttatattaaaagataaaggcataagaatctattaa

SEQ ID NO: 388 - DNA, 162 bp, Methanobrevibacter ruminantium
gtgattgatttagacgaatgcggagtatgtgaaaaatgcatacctgtctgtcctaaggaactaattgaaaaaaaaggatatacaatgattataaaagatggctgcgatgactgtggcatatgcttggatatgtgtcctttaggagccatctatgaggaatag

SEQ ID NO: 389 - DNA, 318 bp, Methanobrevibacter ruminantium
atgagattttgtcctaaatgtggtaaaatgctaatgcctaaaaatgatattcttaaatgtgcttgcggatatgaggaaaagatatctgcagaagtagctgaaagggagtataaattcaaaggcgagagaaaaaaagagaataaggttattgttacagacaataataacattgcattgcctaccacaaagataacctgctataaatgcggaggcactaaaggggtttggtggacagttcagacaagatctgctgatgaagcccccacttattttatcagatgcgtaaaatgcggaaacacttggagaaggtctaactga

SEQ ID NO: 390 - DNA, 894 bp, Methanobrevibacter ruminantium
atgacaacgaatgataaagtatctgattatattagctttcctaagacctttgaaagctataggtggtacaagccgatacttgtttttataataagttttataataactcttatactcggagcactgatagtggcggttttttatctgataatgggtcctgattttataatatccattttcaaagggggagctgaatcattaaacacttcaatgaacatattcttcaccgatctgattattattgcattcattccttcattgtatattgcatcaaagattgttaaggacaggcccttttcctcctattcatcttcacgagggggatggaacttcagactctactttaaggcattggcaattcctgtaatattgtatataatatatttgggggcagaatctctcattttaggatcagaaggcacatctcatttctcaatagcctttcttgctgtgcttttgatttccgtgcctctccaatgtattgcagaggaatatatatttcgtgggattatcatgcaaacattagggtcatggattgggatacctcttatagccatagttattcaagccataatatttactttgggccatggatatgacgccctaggactccttgaaacattggttttaggtattgcctatggattttttgcctggaaaacaaatgggatagagataagttcagcccttcatactgcgaataatttttctcttggcttattcatcatgcttggactggaagcatcaaattcctctttccaattatatgataagataggaggaattgtctatttaataatattatgtataataatgtattatgttggcaagaaaactgattggtttggtgaaatcccagaagactctcaaaatataggattattaaatttttaa

SEQ ID NO: 391 - DNA, 522 bp, Methanobrevibacter ruminantium
atgattgaaattcgctttcacggacgtggaggacaaggtgctgtaactgcagcagaaattttggctaaagcagcatttaaagatggtaaatactctcaagcgttcccattcttcggtgtagaaagaaggggagctcctgttatggcatttaccagaatcgatacagagcctatcaacctaagatatcaggtatacaatcctgaccatgtgatagttcttgacgacggtctcttaaatgttgtggacgtctattccggattaaaagaaaatggtgaagtaattataaacactcatgaaaaagtcgaatctgaaagtcacaaggtatttgatgttgatgctacaggcatcgcattggaaattttaggtgtaaacatcgttaacaccattattttaggatactttgctaaaaagactggtgaagtaagtattaattcacttattgaagtaataaaggaaactttcccaggtccaattggagagaaaaacgcagtggcagctcaaaaggcttatgatatggcttag

SEQ ID NO: 392 - DNA, 243 bp, Methanobrevibacter ruminantium
atggtttctattggatgtgcaatttatgaacctggaagtacacgtaagaacaagacagggagttggagaacttttaagccaatccttgataaagacgcttgtgtagattgcaataactgtctcatgttctgtcctgaaggatgcgtaaacaaggagcatgacattgattacgattattgtaaaggttgcggtatttgtaaagtagaatgcccagttcaagctattaaaatggaaatagaatag

SEQ ID NO: 393 - DNA, 1149 bp, Methanobrevibacter ruminantium
atggcaaaagaaattatgacaacaaatagagcagttgcagaagctgtaaagttagcaaaaccacaagttgttcctgtttaccctattactcctcaaactacaatatccgaataccttgcacagtttgttgcagacggcgatttggatgctgagtatattagagttgaatctgaacacagtgcgattagtgctactttaggagcttccgaagcgggagtaagagtattcaccgctacttcatctcaaggattaatgcttatgcatgagatattgtttgcagctgcaggtatgagagctccaatagtaatggcagatgcaaacagggcaatttctgctccattaaacatttggaacgatcaacaagactccatcgcacaaagggatgcaggatggatacagctttatgtggaaaatgctcaagaggcattcgacactgtgcttcaagcatatagaattgcagagcatgaagaggtcatgcttccagtaatggtatgtttagacggatttattttaacacacactgtcgagccagtagatttattggaacaagctgatgtggatacattcctcgaaccatacgtacctaagtttgcatttttagaccctgaaaaaccaatgtcattaggtaactttgcagaccctgaatattatacagaagcaagacatgacatgcaagtggctatggacaagtccatggatgtaatcaaggaagtaggtgcggaattcggtgaaaaattcggaaggacctacggcttgactgaaccttacctttgtgacgatgcagagatcatattggtctgtatgggttcaatggcaagtacagtaagatatgtggtagataatttaagagaaaaaggcgaaaaagtaggtctcttaaaaataagggcttacagaccattcccattcgaggaaattgacgaaattgtcaaaaatgctgataaattagctgtgcttgacaagaacttctcatttggtattggaggagcgctttttgcagacttgaaagccaaatgccacaaggaaacctatggtttcattttaggattaggtggaagagacgtaattcctgaatacattgaagaagctgtcgaattaactaaaaatccagtaaaagaagttacttggttaggcttaaaggaggatgaataa

SEQ ID NO: 394 - DNA, 867 bp, Methanobrevibacter ruminantium
atggaatttcctgaagaagaattattggcaccaggtcacagaggctgtgctggttgcggagcagctatcgctgtaagacttgctcttaaggcattaggcaagaatactgtggttgcttgtgcaactggttgtttggatgttatgacatccccttatcctgaaacagcatgggaagtcccatggattcatgttgcttttgaaaatgcaggggcagtggcttccggtgtggaaagagcattgaaagctcaaggaaaggaagatgtaaatgttgttgctttcggtggtgacggaggtactgcagatattggtatccaatcattatccggtgcaatggaaagaggtcacgacttaacttatatctgttacgataacgaagcttatatgaatacaggtattcaaagaagcggagctacaccttatggtgcatcaacaaccacttcaccagcaggtaagcaaagcttcggtgaagacaagcctaagaagaacatggctttcattatggcagctcatggaattccatatgtggctactgcatcaatttcctatcctgaagactttatgaaaaaggttaaaaaggcagctgaaaccaaaggtccagcttacattcacttgcaacagccatgtaccactggatggggattcaagcctgagcaaaccattcaattaggcagacttgctgttgaaaccggtgcttggggattatttgaaattgaaaacggtgaattcagagtgacttacaggcctcaagaaagaaaacctgttaaggaatacttatccgctcaaaaaagattcaaacatcttgatgatgaacaaattgcaattatacaagaattcgttgacaaccaatgtgaagaattaggtatctaa

SEQ ID NO: 395 - DNA, 501 bp, Methanobrevibacter ruminantium
ttggagaaattaatagtagataatgaattatgtgatggatgccaggattgtgaaaaagcatgtgcaggagtccatggagttcctagaatcactattcatgaattagacggttcttatttccctattcgttgtcaacaatgtgaggacgctccttgtgaaatcatctgtccaaccggtgcaatgagcaatctgggagtggatgttaccaagtgcatagcctgcggattctgtgcaatggcatgtcctttcggtgcaatcagcattcaatacagcaacgctcataagtgcaatcactgtgcagatagagaggaaggtcctgcatgtgttcgcgcctgttccaaaagggcaattgcagtccatgacattgcaaatgtcatcaaaaggaaacaaagggaacacattgaaaagatgtatggcttagacaagcctgctaaaaagaaaggtcttctcagtgtaattacaactgatacaagggctagaaagccattggatggagaatag

SEQ ID NO: 396 - DNA, 429 bp, Methanobrevibacter ruminantium
atggatgaattaaaagtcaacccagaattatgtgtagattgcggactttgcgaacgtaattgtcctaacaatgcaattcgtgttcatgatggagtccctttattctgtatgcattgcagtcctgaaaaagcaccttgtcttgctgtttgccctaaaggagctatagttgccctaggcggagcaatcacaattaagcaggataaatgtatcggctgtggattatgtcatagcgtatgtcccattggggctgttaccatcaatgagataggtcaagccacaaaatgtgatctttgcgcagactatgacacccaacagtgcgttgaagcctgtccgacccatgctcttacaaatgatacagaaaagataattcatgataaacaggaaaaaatatccgaaggatttaagaaggttcaaactcttttgaaatag

SEQ ID NO: 397 - DNA, 435 bp, Methanobrevibacter ruminantium
atgactttcatgaataatggtgcaaatataaaacagttccaattgctcaaattcataaatgagaattgcaatgatgatcatgtgatatccaaaatttcaattgtgcttcgcagggataagatagaggctccctattatatgaatactaaaattagattatctacatgtatggatggggaagaaaagggagttattcatgcaatggacattttaaaccatagcaggaagcataatctctgtgaatataaatatgatgaaatcaaatcactaatctttgacttattcgatagcgaccataagtccgaccaggtggaattctctcaaaatgacaatcgattgaagatatcttttatgtctaagaatgatgaggagttcaggaatcttttcgaaaattatcatgaactttttgaaaagatagatggtctggttgattag

SEQ ID NO: 398 - DNA, 255 bp, Methanobrevibacter ruminantium
atgtcagatccattgattataaaaaaagaattattatttaatgaatataccgggcatgaagatggaaattgtttagaatgggttgatggtcgactaagcaatagtgatgaccatcatagaattccatgcaatcttgaagatgcttttgaaatagcaaaaaaacaaaaagccgtgcttgtaattcaacctgaatttcaggaacaatgcatatttgcagactttacaggtgaagaaattgatgaaaattgggattga

SEQ ID NO: 399 - DNA, 840 bp, Methanobrevibacter ruminantium
atgataacagaaaaacagattgaagatactatttatcaattatacaaacaggcagctatcgtccttggagatgatgttaaatctgcacttgaagatgcattaaaacgtgaggatagtgagcttggtcagctaaatattaaagctatcttaaagaatattgaacttgctgaagaaaagtcaattccgatgtgtcaggatacagggctacctataatttttgtaaagcttggtaatgttcaagtggaaaacctttatgagggaataagaaaaggtgttgcaagagcaactgaagaggtgcctctcagaccaaatgtggtggatccaatcacaagggttaactctggcaatgtgggagataaagtgcctattgtggatatagagcttatagatgaagactacattgaatttacaatcatgcctaagggatttggctctgaaaacaataatgcccttaagatggcacttccagctgaaggaatagaaggtgttaaggactttgttgtggagaccgctcttaaggctggaggcaagccatgccctcctatagttgtaggtgttggaatcggcggaagctctgatatggctttgaaattaggaaagaaggctcttcttggaaaagttggagagcgtaatggcgacccaacattggcagaggtcgagcttgaatgcttgaatagaataaacaaggatggaaaaggtcctatgggtcttggcggaagaaccactgcattggatgtgaagattctaaagatggacactcatacagcagggcttcctattggcgtagtcattcaatgctgggcagatagacatgctacagctcgtttgagagatgattaa

SEQ ID NO: 400 - DNA, 1590 bp, Methanobrevibacter ruminantium
atgatacttattataaccggacacttggcctatcccttggtaaaggagatggcggataaatcaaaaaaggaaactgtagttcatatagcagagactcaagtggctgcttttttaactcctaatcaaattataaaggaaatccacgagtattttgaagacagattagatgatattgatttgatattggttccaggtttaataagaaaagacacattcctgattgctgaggaatttggaattccttgttataaggcatctacagatgcagcagaccttgctatggtcttggaccttgtggatgagctggaactgtcccagtcaacacctgctgataagcttatcatagaagagaagaagaagcaggccttgaagttcattgaagactttgaaaaagacatggaaaagagggaggaactacttaaaaaagagaacaatattcttgtcaggaaccttcctgttggtgaggatttcccaatgagggtattgtctgagatagcaagtgcccctatattgtcaaaagaggatttgattaaaaaggccgaattctttgtcgcttcaggctctgacatgatagacatcggtatgattgcaggtgaggacaggtctgatgagattcccgatttgattgatacattgaggccaattgtgggagacaggcctttaagtatagatacattgaatcctaaggagattgaagctgctgtaaaccatgggattgacatgatcttgagtttagacaatggtaattaccatgagattttgcctttgctcaaggaaaagaatgttcctgcagttattttgcctacaaacttctctgaaggctatgtgccacacagtcccgcggatagggtggcatctatgcaaaagcttgtggaagcttgtgatggacttgaagttgtctgtgaccttatattggacccagtcaacagtgcaagtcttgtggattcaataatagcattccatgatttccatgaggtggataagaagccgatgttctttggaataggaaatgtgattgagcttatggatacagattctgtaggggccaatgcagttcttgcaggtattgctatggaacttggagcaagcattctattcactccagaggagagcggaaagactcatggaagcgtaagagaattggcaattgcatctaagatgatgtttttagctaaaaacaggcaatccattcctaaggatttgggagttgaccttcttgtattcaaggacaagaagaaaaggtttgacttgaagcaggatgacaacgttcctatagtaaagcaggatcgaccgatcaagtttgtacgggataaggcaggaagctttaagataagggttgaacatggaattagcgtaaaggattcctatattgtggcaactcacttcaagaagacaaagccaaccataagctttgaaggaaaaacagcaagtgaaatctatgaagagatcattgaaaaagggcttgtgaccagattggaccatgcggcatatcttggtaaggaacttgaaaaggcagaaatagctatgcttaccggaaaagagtatgttcaagactttgacttgtttaaggatcctgaagagtttatttaa

SEQ ID NO: 401 - DNA, 873 bp, Methanobrevibacter ruminantium
atgacagatgaagaattaaccattgaagaaatagagaaaaaacttgaaagtactggatatatctcaaataaggagatcagcacttctgtatttttatctttatctttaaataagcctatattgattgaaggacctcctggagttggaaagaccgagcttgcaaaggctttggctcaatctttagaaagagacttcttcaggattcagtgctatgaaggaattacctttgagcagatcgttggagaatggaactatcaaaagcaattgctccatcttgaagcattcaagggaagcaagaaaggggaagattcaatcttcgaagaggatttctttataagaaggccccttctaacctctttcatgaatgagaagccatcacttcttctaattgacgagatcgataaggcagatgaagaggttgagagctttctgcttcaggctttaggtgaaaagcagattactgtaaatgacttaggtacctttgaccttcagaatgacttggttgtgatgctcacttcaaatgcccaaaggaatctccttgaggagactaaggacagatgtcttttcttatatatctcttatccttcagttgaacgtgaaatggctattgtaaaagccagattgccaaatgcagaagatggcttggttaaaaaggttgttaatatggttcatagaatcagaacttttaacctaaataagaaaccctctgtaagagcttcaatcgattgggtaaactctgtaatgcatttggataaggattataagaatgtggatgccgcactggaggacagtgttggggtagccattaagacagagcctgacaaggcaaaggtcgttaaagagatatttagaaatgaatacatgaatgactaa

SEQ ID NO: 402 - DNA, 1161 bp, Methanobrevibacter ruminantium
atgacagaaagaatcgtaagattatcaaatgacttgagaaaaaagggaatgcctgtaagcatcaggtccactcagactgcaatagatgcatatgctcttcttggggaagatgatttgcctactttaaaggatgcattccgctcaatttatgtcaaaagcaaatatgacattcctaaattcaatgagtcatttgacggtttcttcactaaaaagcaggttaaaaacctaaccgatgagcttaataaatccagcaggccaaacagcatgaaaggaaagctttcccagcatgaatggaaaatcaccaaacaaaagggtaaaggaggaaagcagattcagatgggtgctgagcaggctatggaatactttgcaggaagacctgttcttgaagacagggacaaggaccttgcaagggacaatgacattctaaacagtgacctatcaaagctgaacaagtacgatgagcgtgtatttgaattatgtgtagagcttggaagaaagattgcaaacaagcagtcaagaagaaagagactggctcgttccaataagattgatatgagaaggaccatgaggcagaacatgaagtatggaggggtcccgattgaccttgtccatgtcaagaagaagcctcatagaaagcagcatctcttccttaatgatgtaagcggttcctgcgaatggatcagcagctggtttttcatgctgatgtttgcatgccaaaagacatttaaagactcaagaatgtttgaatttgataacaggacaatagaaactactgaatttcttaaagaaaagtatatggttaatgcttttgcagaaatcagattgctacgtatgagaaatatgatggttagaggaacttccaatatgtacactgcattccagtcatttatgaaacaggctgacattagcaataagtcttatattattctcctttcagattgcagagattgggctggccctaaggttgatggggttcctgcaagtgtagagcttgtttcccaaatgtctagcatggctaaaaagcttgttatcctaaaccctgaggacaagaagaagtgggatgttgtagacagctgcgtttctttatacaggggagcaggtgcacaggtttatgaagttagcactttaaatcagttggctgagtttgttgcagatatgtaa

SEQ ID NO: 403 - DNA, 918 bp, Methanobrevibacter ruminantium
atgcaatcttgtactaaatgtggaaatccaaagattattataaaaaaaccggcttctggacaggccttatgtaaggactgtttcatagaaagcattgagaaaaaagttcgccaaaccataaagcgtgaaaactttattgataggggagataaggttttagtagcattatccggaggaaaggatagtgtagtaacccttgatattcttaattcctatcgtgaaaggcatatcatagatttatgtgccgtaaccattgacgaaggaattgcaggataccgtgaagatggagttgaaattgccaaggcacatgcagagagacttggaattccacataaggtagtgtcatttaaggaaagttttggaattgatttggatgaaatcatggccaaagaaaaccacagaggatcatgtacctattgcggtgtattcaggcgatggataatcaatagggctgcaagggactttggagcaactaaaatagcaacaggccataatctggatgatgagactcaagctatcttaatgaattatcttgaggggaatactgaaaaccttgctaagattggtcctaagacagaatctaatgatgaattgtttacagttaagataaagccacttagggaaattccagaaaaggaaataggtctttatgctattgcaaaaggattggatattcaccttgcaggctgtccatatgcagaggagtcattcagaatggaaatttccaatattctaaaagacctaacaaaggatcatcctaccataatgtattcaacccttcggggatttgataagatgagaccagccattaaggaagagtttaaatccaattttgtttacaaaagatgtgaacgttgtggagagccttcttccaatagattatgcagggcctgtaccttcttggaagaattggattaa

SEQ ID NO: 404 - DNA, 201 bp, Methanobrevibacter ruminantium
atgagttttaagttaaaaatcaaggataatgttgaagagagagaaatagatggagagttaacaattaaaaaattattggatgatttggatttatctagtgagactatggtaactaaaaagaatggtgaaatagttattgaagaggaaacaattgaagatggtgatgaaatcgagtttattcaaatcatttacggaggataa

SEQ ID NO: 405 - DNA, 720 bp, Methanobrevibacter ruminantium
ttgtcttcaaatgctacaggaacaaggattcatcagtacatcaaaaaggaaactggctgttatgatccatatttttatcaaaagaaagagggaaatgaaattgcattgtctctaatgccaatggttagggaaatattaaaggaagataatgacttggaaacctatgttaagatagccattgtagggaatattcttgatttcggcacttttgatttggatacagactttgaatcattgatttttgaaggattgaagaaagaattggtcataaataaaatagatgaatttgaagaagccttaaagaaatatgataatgttctttatttggtggataatacaggagaaatagtctttgataagcttcttattgaaaagataaaggaatatgatgtggatattacagtggcagtaaaggaaaggcctatattgaatgatgcctgcatggaagaagcattagaggctggacttgatgagattgccgatttaatcactacaggctctgactctgtaggcgttgtcgaatccatgatatcagatgagtttaaggaaattctattggattctccttttgtaatctcaaaaggaatgggaaattatgagggattgactgaaatggatcttgacggacaggatgtctttgtattgttctgcactaaatgcaatgctatctcaaaagatttaggacttcctgaaggatctcatatcctctctaaattataa

SEQ ID NO: 406 - DNA, 825 bp, Methanobrevibacter ruminantium
atgaaattcggatttattggttttggtgaagtctcatataccttatcaaaattgcttttagcattggattttgagattttaagttctatcgaaggacgttcccaaaaaactatagacttaattaattctttagatttaacccttttagatagttttaaagatgttgcaaaagagtctgatgtattgatttctgcaaacagtccagatattgctttagatattgcaaaaaactatggcaatttaacaaatggatttttccttgatttcaataatatttcaccaaaaactgtttttgaaattgaagatattttatccgatgacaagtttattgattctgcaatcattggcagggtaaattcggatgaattgaacatatatctatctggaagcaaggcacaattccttttagataaaataaaaaaagaaattggttctaaaggtattgatattaataaaatggactttaaaattaatgtaaaacttatcagtgataaaattggtgatgtttctaaattaaagatgcttaggtcttcatatacaaaaggagtgtctgctcttttagtggaaagctttgaattggcagaaaagttagatttggaagaggaattatgggagattctttcactaactgaaaatagagattttgaaagatcttccaagtcaagaatcgatagttcaaaaaaagcttctaaaagaagatatgaagaattagtagaagttttatactttttagataatgtagataatgtagatgagtctaaaatcatggctcgagccacaaaagacaagtttgaatatttgaaaaatagggaaaataaagaataa

SEQ ID NO: 407 - DNA, 1299 bp, Methanobrevibacter ruminantium
atgatagctataagtgcagattttgatccagtccataagggacatgaacaactaataaaaaaaggaaaggaaatagctgaagagaagaattcaaagctagtcatttaccttaataaaggatatagtgcaaatcatgccccattttttactccatttgatgcaagatgcagaatggcaaaggcattaggggcagatgaggtcgtaggggttgaaggactgcaccacagactcattttatcttatagtgtgccgattaggctagctcaaatgcatgaggatggagttaccgattatataactgcagcagacattagcttagaagagattaaaaactatgcagagcgttttatcaatgaaggaagctttcttggaattccacaggactttccaagccgcaatgtaatacgttggtatgcaatcaatgagtttctatcaaagaaattcaacagaaagatagattttcatcttattccagaagtgagctctccaaaaaagatttcaggaagatttatcagaaaagagatactcaataacaatctgaccatttcaaaggaaataagggaattgcttcctaaaacaagtatagaaatactggaagaggagatagaaaagggaaatgttcctggaaaaaggaacatgaaagtgcttaagcataagatgaacacttattcaaggtcaaatctgacaaatattgcatacttgaacggaaaggtaatcaataggatagtggaagggagattctataaggaagatgacgaatccatctgggcaagcttcagaagggcagattacggtccagtcatgacccgtcttgctgcaagctgcatagaggaggaagtcactaaagatgaagtcctaaagctgatgagacattatgaatcaaaaggagtaatccctccggaacaaaatgtggataaaatcattgaaagggcttggtatgttgctttggaagttgataagggagttccagccaaagaagcaaatgagaagtttagaaagaaagaaaacttgaaattgaatcctatgctaagccttgaagcaggattgaatcttacaaaattcgaagcaaaaaagattcatgaaggaattgaagcaaagatctttgtggataaggacaataagatatcctgtgagattaaggataagaagataaaagtaaaaaccgctttaaagttgccatcaatggaagtgacttatcttagatacatattggactcaaggtatattccagtaagcggagagcttattaaaaataagagaaatgattttagagttaaaataactattcatgattattaa

SEQ ID NO: 408 - DNA, 1089 bp, Methanobrevibacter ruminantium
atggaaattagagaattaacaaaggaaatcagagacagatctatagaatatgcaaagccaaaggacttggataacttatctgccagctggtatcaagaggacctattatattcaggaaagggaaagacaatattccttattctacctactcccggatgctcttgggctcttggaccaagcggaggatgcacaatgtgcagctacatctcagactgctatctaaagccaatagaaacttccaaaataatcgagctctttgaaatggaactgggcaaatgggattttgctgaagactataaaaatggagagaagattgcaataaagctatttgcatctggaagctttttaaacccagaagaacttccaaaggaagctagaaattacatccttcaaagattggcagacctggatgaaataagcgagatagtcgtagagtccagacccgaatatgtaaaaaaagagataatcgatgaaatatttgaaataatcggcgacaagctatttgaaataagcataggccttgaaacttcaaatgaagaaaccagattaaacaagattaataaaggatttaacaataaaagctttgaaagggcaattgacaccattaagcagtcaaaagaaagctatgacataaagtcaaaagcatatatctttgttaagcctattctcttatctgaaagtgaagccatcgaagaagcaattgaaactgcaagctactgcgaaagcattggagttgatagggtttcatgctgtcctgcaacaatccatagaggaacacttattgaaagactatggagaagaggctcatacaatcctccttggatctggtcaacagttgaagtgataaatagaatcagagaaaatgtgaatattccggcacttatggacacctctggattcggctcaagaagaggcccatacaattgcaagaagtgcaataaagagctaaaacataagataattgattcaaacttcgaccaaagccaaatagaacatgattgcaattgcaagagtgaatggattgctgaagtcaagttctctaatttaaacaggtcaaaaactcaaaccaaacatttgcctttatattaa

SEQ ID NO: 409 - DNA, 210 bp, Methanobrevibacter ruminantium
atggaaaccaataggctggaagctttttatgatgcgataattgcaattattgtaacagttttggttttggaattgccacagcctgaaaccgctaccattgcaggaattttagctttgaaagtttcatatttcacttatcttgtcagtttccttgtttgccaatctctggcaatatcaccacttgatatatgctcatgtgaaaaaaattga

SEQ ID NO: 410 - DNA, 483 bp, Methanobrevibacter ruminantium
atgtttattgaaaaaagatgcacaggctgtcgtgaaggcagtgcctgttatctgacctgcacaatagcaccatgcagcattgaacatggaaatatagactactgcttcgaatgtgaggaatatccctgtgacaaatatgatggaattgaattatacgattcactaatcacacacaggaatcagaaaaaggatttgcaaaaagcaaaaactataggaatcgaaaactatcacaaagaacagcttgaaaaaaaggaaatcataaaccatattttaaacaggtataatattgccaacagacatatcttcttctgcctggcggtaaatctgcttgaagttgatgacttaaaacagatattaaaagactgcgatgaatcaacaaaagatatggatttaaaggaaagatcagattatataaaacatgaattatatgaattcgccaaaaaaagaaatatcatactcaaattaaatacaggaagatattga

SEQ ID NO: 411 - DNA, 252 bp, Methanobrevibacter ruminantium
atgaattatgtagaagaagcagtacaattatttgaagatggttatatgtgttcacaagctgtcttagaggtattttgtgaagagtttggactttcaagagaacaggcatttaaaatcagcatatcatttggaggcggtatgcgtaaaggagaagtttgtggagcttgcactggtgctataatggcattaggtttgaaatatggtgatttcgaaaggatggcacaaataaggagaaataaaaggtcattatga

SEQ ID NO: 412 - DNA, 456 bp, Methanobrevibacter ruminantium
atggatgatttgcctgaaatgatttcaatctggaatgaaattgtcgaggagggcaatgcgtttccacaagaagaagtactgacattaaagacaggtttggattttttcaacagtcaaagtcatgttggagttgcatttgacggtgaaattctcggactgtatattctccatccaaataatgtgggaagatgcagccatattgccaatgccagctatgtagtatcctcaaaagccagaggaaaatatattggtcaaaaactggttttggattcgattgaaaaagcaaaagaacttgattttctaattcttcagttcaatgctgttgttgaagataatttatctgcaagacaattgtatgaaaagttaggattcaaacagcttggtgtcattccaaaaggattcaggttagataatgatgaattcgctaatatatgtccatattatattgaattataa

SEQ ID NO: 413 - DNA, 660 bp, Methanobrevibacter ruminantium
atgaattatcaagaaatatcaaatatcattaaagaaagcctaaaccttaaaaccagcccagttagcgtgaaattatttgaaaaagaaaaggatgcagaagaaatttttgaaaaaaccaataaaacaatacattgtcaggcaataataacagcaagtaaaggaaaatcattttatggaaccatagatgaaattggatgtccgattggagcgggaattttgggtctaaaggaactacctgaaaaaatacttaacggatcacaattcgataaaatgaatgtaacctcatctcaggaaagcgggaaagcattaattgattcagttgctaaaaacaatagaatagaagccattgcatacatgcctttggaggattcaaaaatagaacctgacgttgttgtggtaattgccaaaccaagacagattttcgatttgataagagccaatacttatcaggaaggaaaaagaatggacaacagtgtgggaggaacacaatcactatgcggagacattgtagtaaattcaattcaaacaaatgaaccccatatctcatttggctgtataggctcacacatggcaacagaactctcagaagaccaagtaataatcggaataccaatatccaaacttgaagaaatagctaattctttaaatataattaactaa

SEQ ID NO: 414 - DNA, 750 bp, Methanobrevibacter ruminantium
atgaaatttaaattcaatacaccattaactgaaggaaagataatcaaaagaaacagccagttcaccttggatgttgaaatcaacgacaacattgaaaaagtgcactgtcccacaaccggacggattggaaatattgatttaaaaaatgttgcaggattactttccaaaagcgacaatcccaaaagaaaaacaaaatataccttagaggcaatatccatcagcaatctcaacagaaaagataaaaaatggataggaataaatcaaatagcttcaaacaaatatattgagctgtttttaaaaaatcatcttctcgacgggatgcttccggaatatagtgagattaaaagggaagttagtcttggaaaatccaaattggactttttagttggaagcacatatcttgaagttaagactccacttcaaacattacaaatagaatacgatacagatattaaaacaaaaaaagtttcatcattctcatcaactgacagattcataaagcatatcaatgaacttgcagacagtcttgaaagtaatgaaaaggcaatacttctaaatacatttcaatatgacaatccaggatatgaaatcttaaatccaagtacaaattatattgaagtcagcgaaaatgtggacagatgcattgaaaaaggattggagatatggcaggtaaatatgaaaatagaccatgaaggtgtggaattactcaaatactggaatacaacatcaaactttaggaagataaaatga

SEQ ID NO: 415 - DNA, 510 bp, Methanobrevibacter ruminantium
atgaaaagcaaggataaaattgttaaaagtctaattgaactaatggaaactcatgaatttgaagaaataactgtaaaagatatatccgaactggctgaagtcaacaggtcaacatattatcgcaattttaaatcaaaagaagacatcataaaatacaagttagaatcgataatggacgaatacctgaaagaatttgaaagtaaaacagataaaacaaaagagacttatatccgaacaattcttgaaacatttctcaaacatgaggaatttttaaaaatcatacataagcaaaatcaaagctacatactgcaaaaagtactcgccaattactttggcgacgtattgaaagacacctctaaaaaggaaagatatcaagtctattaccatatcggaggaatttacaactttacaatatgctggattgaaaatgacatgaaagaccgaccggaatatcttgcaaaaataggtgcggagataacatcaaatattgaaccgtatttgcttaaataa

SEQ ID NO: 416 - DNA, 990 bp, Methanobrevibacter ruminantium
atgggatgcatggggttcggagatccggaaaatggaatgcacacatggacattgcctgaaaaggaatcaatagaaataattacaaatggcctacacaatggaattaacttctttgatactgctatcggttatcagaatggaacttccgagcaatatgtgggaaaagcaatccgggaaaacgcttctcgtgaggaagttgttgttgcaacaaagtttctgcctagatcacaggaagatattggaaataatgtctctggaagacagcatatccacaatatggtcgaaaaaagccttataaatcttggcttggattacattgacctgtatatctatcatatgtgggactacaacactcctttatatgatcttcttgaaggattaaatgaggtcattgaagaaggtaaagttaaatatattggaatatcaaactgttttgcctggcaacttgcaaaggccaatgcacttgcagaaatggagggttttgctaaattcgtatcaattcaaggccattacaatttaattttcagggaagaggaacgtgaaatgattccattatgccacacagacaatattgcattaacaccatacagcgcactggcttcaggaagattgtcaaggctccctggtgaagaatctaaaagattaaatgaagattactatgccaaattgaaatatcaaaattccgaacagcaagatttaaagattatagaaagagtcaatgaacttgctcaaaattatggtgtgtcaatgacagaagtgtctctggcatggctacttacaaaagttacagctcctattgtaggggccactaaaatgcatcatgttgaaggtgcagttagttccgttgatttgacattaacggaggaggatattagttatttggaggaaccctatattgctcatgatttggtaggagtaatggcagacaataaggtttcagccagtgataacgagaaagtctggattaaacacactaaaaacaagatttaa

SEQ ID NO: 417 - DNA, 534 bp, Methanobrevibacter ruminantium
atgaaaattatagttttgaaaggaagtccaaatattaatggttcttctaatcttcttgcagataacttcattaaaggagcagaagaagcgggccatgttgttggagaaattgatgctgctcatgcagacattgcaccatgttctggttgtgttagctgtggctatgaaggtccatgcataattagtgatgatatggatatttttagagaaaaaatccttgaagcggatatgctggtgtttgtaactccattatactattatggaatgtcagcgcagcttaaaattctaattgacagattctgttcagcaaacagttccattcagtcaagtcatttcaaatctgcacttataaccgttgcatataattcatccaattggacatttgatgcactggaagcacattatgatactctagttaaatatcttaatttagatgatcaaggcagaattttaggttatggttgtggcactccctcaatgacaaaatactctgattatcctaaaaaggcttatgaatttggaaaaagtttataa

SEQ ID NO: 418 - DNA, 1401 bp, Methanobrevibacter ruminantium
atgccaaatttcttctcaggaggagatcttatatcaaataataaaccgcaagaaacgtttaggggaaaaactgacagggctattaagaaacgacccccatggaaggaatacaacctgcatatagtttgttttgttctggttgccatttcaatggccattggagttaaagagattagaatcactgataccataagtgttttattattgcctttaatatatgccctaatcatgggtttggctctttttttagcaaaacctataaaatttataggtaaaaagcaatcaaaggtagctgaaggagcaatggttttatttataggagttttaattgctaaattagctatttcgagcggacaatccattgatattatttttaatgtcggcccctccttgattttacaacttttgggggatttgggcactcttatagcattgcccgttgctttgattttaggatttagaagagaagtaatcggtatggcaagttccatttgccgcgaacctaacttgggagtcattatcgacaagtatggtttcaaatcccctgagacaaggggagttttagccatttttgttataggatccattatcggcactccttttatcagcttcctatcaagcatatgcatttcgctcataccttaccatccatatgcctttgcaatggcttcaggcataggaagcgcaagcatgaatgctgcagcattggttccattggtgcatatgtaccctgccatggctacccaattggaggcctttgcaggatgcagtaacattctttcattttgtttaggcatttacatgtgcatattcatttccctgcctcttgcagaaaaattgtataaatggttatctccaatcataggtaaaggtgaggggagaaccattgatgacgaatatgctattgaaggagtaaaagatgataaatatgctacttctgaggatttgagttctggtaagattgaaagatgggtcactttcctcgtacttttctcaatcatcggcacagttggaaatttcataggttatcatacccctttgcttgatgtgttcatcggaatgctaatcatttcaattattacccttatcggaatgtgccttgagaggataattccatgggatatcccatcaatcatttatataagtttacttggtatttttttagccattcctggagttccaacttcagacattataataacttatgtctctcaaattgagttaactacaatctgcactgcatttttagcatatgtcggtattgcaatcggtaacgattgggaggaatttaaaaagattggttggaaaggaatcattatagcaataatcgtaatttccggaacttacctcggttctgcaagtattgcaaatctggtcttatttgtaacaggcatgatttaa

SEQ ID NO: 419 - DNA, 894 bp, Methanobrevibacter ruminantium
atggcgcggagcgataaaactttggaagacattttgaatattattttttatgataaaccgtcaactcaagatgaaattgccgaaaaattaaagattagtcgaagatatgttactcaattgcttaaaccattaattgaagaagacattgtcaaaagggcttatgtcatcgacttgaataaatatgatgaaatttatggctcttcagaccctatcttcaatctcaaacagcattccgcattttttttaattgaaaacatgctaagcagcatgagcgagcatgttaaagaacaggtccaaatgtctttcgatgccattttaactaatgataaggacttggcagaacaagctttaaaactggattttaccacaaataatatgtatgaaaaagttcgcgcatctgttgaaactgtcgttgatgttgatccccattccaaactttccaagattttattgttcagcgaagcggcatacaattatgaacgcattggagattattcaggccatattgccaaatttgtcattaatgagaagactgccgtagacgatgaacttttagatatattaaaaaaaatgcataaatatgcacaaaaatctatttcatatgcaactgatgcttttattaatgggaatattgactcacgtggaaatttgatggatacagaagaaaaaattcatgaaactcaacaaaaagccatgaatctcattgccaaccaaatggttgaaacttcttttgaggatattgaaatgtccaattattatatttacatatcccgtgtagtgaaatcattcgaaagaatgggcgatatctcagtggaaattatggatttggctgctgaattccataaggatattccaaggccaacaactccacgttcatttagagaaaaaatttaa

SEQ ID NO: 420 - DNA, 1935 bp, Methanobrevibacter ruminantium
atggaaggaagcgaattacagaacataaaaggaattggagataagctgtcccaaaagattttgctaaaccttggaggagaagaggaacttaaccgggtcataaatgagcttgatcttgaaagacttatccaaattgaaggaataagccaaagaaaggcgattgaaataatgaaccaattattgggaaatcctgcacagaagtttttaaaaagcgaacgtgcaattcagctatatgaagaaatcattgaaaaaatcctcaaatattcaaatacaaactactctaaaaacagaatcttgcttttagctccaataaaggatgaattcattattgccgaaaggctttcatttgtcatgagcgctaaggaaagagtcagcaaactgcctcttgatgagctgaacaagctgatgagaaatctccatgagccaaagaatgcaaaggcaaactacgatgccagcaaggcaatacttgttgaaagcgctgaggatagcgattatctaatggaccttggactgaacaaatactatacaatcctaactgcctccgattcaccattcttcaaggaggaaatcagcggatatgagcttgtctattacatctactctgaagggatactcgactttggagacatgcctaacctcatcatgataagcaaggaagctgaagactaccagcttgtgcctgagattattttagattacttcaaggaaaacagggaactctttgagaatgtttgtaaaatccgaaagatcctaggtgaaagcactgtcttggaggatgttggtccggtcttagaggaacttgacaattacaagacccaagagattgacttggatggaatcgttcaggaagaaaagacctatattgatgaggaacttaaaactaggatacacaatgttgaccttgaaggagatgaagtccttgacttattaaataatgccttgccccctaagatagagaaaatatttgacgaaatcttgtctaaatcaaaagagaacataaaggcaaaaagtggaattgactttgatccattcatcaaaaaatatcctattgaaattgatgatatggagatggagagaatcaagatggagattctctcaagcagcgagaacaactattttgacatgaaaatcactgctgccgaacatttggctctcattaaggagcaggccgaaagggaggttaaggaaacaattgaatttgactttgaatatgccctaggaagctttgcataccattataagcttaatgctcctgaattttcaaacgaatatgctcttgaaggagcccttcatttggaattatgccttaaggagacagaggaagataatgagaatggagagattcaaaggatagattataaattgaatgagcaggagaatgtggcgcttttaactggagcaaacagtggtggaaagacaacacttcttgagacaatcagccagatagcgattcttgcacagatgggccttccagttccggcaaatatggctaagataaaattattggatgagatttatcacttctctaaaaagagatcattggatgccggagcatttgaatcattccttaatgtgtttatgccaattgtgacaagcgactgtgaaaaattggttcttcttgatgaacttgagggaattacagaattggaagccgctgtaaagatcatttcaagctttattgagatgataaaggacagcaattcctttgcaatcattgtaacccatatggctaatgagcttatgaagtatacagacattagggtggatggtattgaggcaactggattggatgagaattataatctgattgtggataggacccctaagatgaattatttggctaagagtacacctgagctcattataaaaagaatgtatgagaactctagtcctgaactgaaaaaggtctatggtaagatcttggagaaattctga

SEQ ID NO: 421 - DNA, 3054 bp, Methanobrevibacter ruminantium
atgaaattgcctgaattattagcccctgttggaagtgctgaacacttaaagactgccatcttatctggcgcaaactcaatatacctctctggagagaactatggtgctagaaagtatgctgaaaacttctcccttcccgaaataagagaagcgatcaaatatgcccatttgcataatgtcaaggcctatgtaacagtaaacaccctaatcaaggaaggtgaactgaagaaagtaagcgaatatttgctccaattatacaaaatgggagttgatgcagtacttgttcaagacatcggactaataaatataataaacaaacatattccaaaactcaatatacatgcttccacccaaatgaacctccacaatatagagggcatcaaatgggcctacgatcacaatataaaaagaatagtccttccaagggaaattgagatgagagagcttaaggaaatagtggaatatgcccattccttaggaattgaaatagagatatttgcacatggagcgctatgctattcatattcaggccattgcctcctatcctctcttcaaggaggaagaagcggaaaccgcggaagatgcgcacagccctgtagggagcaatatgaactgtccataaacaaaagcaaaagaatcagtccaaagaacgaaggaaactatcttttatccccaagggacctgtcattatatgaaaaccttgatgaaatcgtaaatttaggcattgatagcctaaagatagaagggcgaatgagaagcacagactatgtggcaactgtagttaagaactacagaaaaagacttaacagattaagatacgacaagacctcaaagtcattgaatagaaacataaatgaatcaatcaaaaaaaccaaaaagggaaagaaaggaagaaaatcagacttaaaaaagatagaggataaggaaaagatagaaagccttaagaagattcaaaaggaagaaaacagaaattcagaggaagaattaggactggtcttcaatagggagtttacggcaggtcatcttattccaaaaaacaatcctatgatcatgaacagaaagaaacctggccatcagggattatatattggaaatattcacagatacaatcctcaaacagaagagattcatatcctattaaatgacaatttaattcacattcccgaaaaaggagatggaatattaatagaaagcagaatcaatagagaaaactctgatgaaagaaacaataaatctaataaaaacaataaaaataaacaaaatgaatccaaatcaaataagaaagataaaaataaaaagaaaataaaaaggatggaaaatgatgaaaactatcattcaatcattcagacttatggatttgacatatcctcaaagcctgtcctaaaagattccaaagacaagcattggagaaaaagggaaaaggacaaggacatagaaggcaaactacttgttataaaaagagttagggagaacaaaagaatcccatttcctcttgagaagggctcaaaggtataccttacaaagagaaactccctgataaatgaagtcaagaatctaaaaagcgacaagtccaagcatatgataaagaaatccaatctggaactctactttagaatagacagcgacaattaccctcacctaaaaggaaaccttaaattggacaatggaaaggtaatcacccttaaaataagaggggaaatgccatgggaagaggcaatcaaaaagcctattacaaatgagaccatcaaaaagcaattgatgaagataggagacctcccttattatatcgaaaagattacagtaaacaacaataaaagcctattcacaccaataagcggaataaatgagcttagaagagaattctttgacaagcttgaagaggaagtaattaattcatacattcctactgatgaagatataaaaattgcagaagaaaacattaaggagttgtctaaagaactggatagaaagattgatttaaaggccaaagttaaatcagaacaagaaaacaatgatttaaaatccaatgccaaattggaaaataagaataagaattcaaaaaatctatccatctacataaatagcctagaaagcttaaaggaaataaataaaatcaatgatctttcaaatactctattcaatagaatctatttagaaataccgccaaatagaagactggatgaaattacaaaggatagaatagaaaactacaacccaaatgactcaaaagaacttaacataagctactgtgttaacttcctaaagtctgcaatcaacttggcccaagaccaagactatgaactcatatggaaattgccagacattgcacataagcaatccaaggaatcaatagtaaagatattaggcatactaaataaaatgaatttgcacattaatattatgactagtttaattggattagacgattcattaaaagataagtttaagctagaactttatggaaattatccgttaaatgtatataatgcatatagtgttatggaattaaaaaattataagacattatgcatatcacccgagttatataagaagaatattgaaaaattaatggaagactattatacaaacaaaaacaatgagggattatctgaaatggaaatcttggttcatggaaagattgaagccatgaccacaagaaaggaacttatttccaaaaaacaattgaagctaatcgacaaatataataagaagatgagaagggataaaatggacatctcttcaaatgagttttacctaaaaaacagaaaggatcaatattacccaataagaacaagcataaatgaggataatctgattattctaaactcagaggagttttgcctgattgatgagattgattacttgaagtcaattggaatcaaaaactattccattgactgcagatggaagggcattgattatattagggatattggaatggtttatagggattccctagataatgatgattatgacctaggtgagtttaaagaaattatcaataaacattcagagcaattgactaaagcaaattttgatataggattaaaataa

SEQ ID NO: 422 - DNA, 2586 bp, Methanobrevibacter ruminantium
atgacattacctgaattattagcgcctgcaggagactatgacattttagttactgctgtaaatgcaggagcagatgcagtttatatatctggcgaacgctttggagcaagggcctttgccaaaaacttcacacttgaagaaattgagaaaagtgtagaatatgctcacttaaatggagtaaagatacatgtaacagtaaacaccctcataaacaactttgaggttgttgatgttgtccaatacctcttcaaactctacaagcttggggtagacgcagttattgtacaggatgtgggaattatagagctaatcaaaaccctaatccctggtcttgaagttcacgcatctactcaaatgacccttagcgactatgactgcattctttgggctgttgagaatggaatatcaagaattgtctttccacgtgagataagcgtggataagataagggaaatcagcgaaaagctaaaatcctcaaacttaaatatggaacttgaagtattcggccatggagcactttgctactgcttcagcggaaactgctacatctcatcttataacagcggacgaagtggaaacaggggagcctgcgcacagccttgccgtaagcaatacaagttaaaatacaaaaactacaatgtaggaaacggattccttctttcaacccatgacttggcagtctataaaggtttggataaaatagaagaagccggagtattctccctaaaattagaaggaagaatgaagtctgcagattatgtagggacaatcgttaatgcatacagacatataatcgatggagatgagggggactatgaaaaagaccttcatttagtcttcaatagagaatttacagatggatatatcctaaaccaaagtccaggccaagtcctaggaagggaaagctcaggccacgagggagtctatatcggaaagatcatcgaaaagaaaggagagcagattaagatttccaaagaaaacaaggacttttcaataaaccttgacatcggtgacggaataggattcaaatataaggacaaaatcaagggaatctatattgacaacattaaagaacagactgacgattatataatcctaaataccacaagaaatgtccgtgaaggagataaggtactcttaagctattcaaagtcaacccacgataaattaaagaaattccataatgaaacaataaagcagcacatcccattgtccctagacatatactggaatgaggatttaagcctaaatgtcacaggaagattccagatagaggaaaagggaataaacaacaaaaacataatagagcgctttaactttaactatatttccgaaaccaagtttgaaaaggcattgaatagaccaataagcaaagaggatatagaaaagcaaatgctaaagactggagacagctcattttatataaaggaaatgaacattcatggcatgcctgaaaacactttcatacctattggaaaattaaacaaaatcagaagaaggcttcttgaaaaagccacaaatctactgcttgattattataagccaagcaaaaaagaagtgagggctacaaataaaaaggtaaatcaatttataaaggaatataaaacatatagtgacattgatctaagaaaggaaaaactgaacctatcaatatttgttgacagccttgagcttttggagatgacaaggaaacttcctattcataaatattattttgacccatcattctcattcaacagcccagaagagtattttgaaaagattaaggacctattgaaggaagcttattcaatagttggcaattccaataatccaaataataaatcaaaatcaaatgaagatgaaagattagttctagtcttgtcttcctttatttcagatgaagagatagaaaaactaagcaaaatcattgatgagctaaaagaagaaggaataagcatccctataatgtatgacactcccggaataggaaaaagcttcaatacagacatctatggaaaccacaacctaaacatctggaacagctacaatgtcaaaaacctctctgaatctggatttaaaagccttatcctatcatcagaactctcccataaggaaataaaggaacttgtatcaaaataccaatacattaaaggagacaaagaaaccgacctaaacataattattcaaggaaaccttgaagtcatgagcagcaaagacgacttttccaatttaaatgatggaaaagacttcataataaactctgcagatgactatgcaatccttgaggataagaaaagaaagaaattcaaatataaggttgtatttgactataataagcatagccatttcatcaataaggactgcctatgcctgatagaggaagtggagcttataaaggatacaggagttgattctgtaataatcgatacaagattctcatcagccaaatacagctctacaataatctctttatacctgcaggcattaaaagaggacaatacttatgacttaagcctgctaaaggatcaaattcgaaacataaccctatccagactaaatcaaggaaactttataaatggaaggttacatgaaaaagactgttaa

SEQ ID NO: 423 - DNA, 591 bp, Methanobrevibacter ruminantium
atgtatatcgtattagaaggaatagatggtgctggaaaatcaactcaaataaactatttaaaaggatggctggaagataacggctttaaagttgaaacaattgttgaacctaccgatttggaagttggaaatcttattcgtcaattgttgactaggtctgatgctacaagtgacactatgcaaaagactttaggccttctttttgcagctgacagacttgttcttatggataaaatcgaaaagcttgaaagtgaaaggactgttgtaataagcgataggtctttttattcaagtctggtatatcaaaagccacaggattggattcgtgagataaataagtttgcaaaaatccctgatttggttttgctccttgatttggatgttaaaaagtcagttgaaagatgcgatggaactgatgaattcgaaaatgaggagtttttaactggagttaaagagaattatctggcattatctagagagaatgataattttaaaatcattgatgcgaataatggtccaaataaagttgcatctgatataaaaaaagctgttgctcctttatttgatatctgtgtagattgcattaggtag

SEQ ID NO: 424 - DNA, 207 bp, Methanobrevibacter ruminantium
atggaagaagaaccaatttacgaaatgaaacttacaaacggaattggagaacagatgcttgctcatgtttttgaaaagttcgatgtggaactaaagcaaactgagttcggacctaaactccaaggaactaaagaggaattggaaaaagctcaagaatacattgttgaaatgatgaaaaaaagattagaagaattagataggcaataa

SEQ ID NO: 425 - DNA, 966 bp, Methanobrevibacter ruminantium
atgaacatagaagaaaaaatagaattaatccaagaaggaacacttgaaatcatagaactggaagaattaaagcaaaagcttgaaaaagaaaccccaattgcttatactggatatgaaccttctggaaaaattcatttaggtcatgcagttaccataatgaagcttaagcaattgcaaaagttaggatttaagataaagatccttcttgcagactaccatgctttcttgaatggaaaaggaactgtagaagagattgcagaaactgcagaatacaataaaaggtgttttcaaggtttaggattagctgatgatacagaatacatcttaggttcatctttccaaaccggaagcgaatatactaatgatgtttaccaattagccaccataacaaccttaaaaagagcaaaaagaagtatggatcaagtaagcagacacgatgacaatccaaaagttgcaagcgtagtctatcctctcatgcaaactgctgatatgtctgcattaaatgtagatattgccttaggaggaatggagcaaagaaaaatccaaatgttagcaagggaaaacctgcctagaatcggaaaggaagctcctgtatgtattcacactcctttgattcatggtctcgacggcgatgacaagatgtcctcaagcaaaggaaactatatcgctgtggatgatgacgaaaagacaatcaaggaaaaaataagaaaaagctactgtccgcaaggtgaaatcgaaggaaacccaatgattgaaattgcagacttctttgtattctcccaacaagacacattcgtcatagaaagacctgaaaaattcggaggaaaccttgaattaacaaaagatgaactgcatacaatgtacagcgaaggcaaacttcatccaatggacttaaaaaatggaatcactaaattcctcattgatttcttaaagccagttagagaatttatggaatctggcgaataa

SEQ ID NO: 426 - DNA, 1041 bp, Methanobrevibacter ruminantium
atgttttgtccagaatgtggtgccactgatgttgaaatggtagatggaatctgcaagaattgctatttgaagaaatttcaattgatggaaattccagaaaacattaccgtaaccatctgtaaacactgtaatgctaaattagaggaaggaaaatggaaagacgaatatattccagaggatgagattatatatcgtaccttagaaaacaatattaaacttaatgatttagcagaaaatgaagagattgaactggaaatagaccaaatgcgaggaacaattgcagaatgttacattgaagcagtggcgacagttcttggagaggaaattgtagaaacccatacgccaaatgttaaaatcaaatattccgtttgtccagactgcagcaaaagaaatgcaggatactatgaagcagtaattcaacttcgtgcagacaatagggaacttaaggaagatgaaataatcaaagctgaagaaataatcggcagaacactggacaagcagtttaaaaaagacaaattggcatatattccacaagtggctaagcttaaggaaggaaatgactattatatcggttccttaaagtcagctaaaaaggttgtggaacatcttaaagaggagcttggaggaaaagtcaaggaatctccaaggctaatcagcgaagacaagtctacaggaaaaggattatacagaatctggatatcattaaggcttcctaagtttgaaaaagagaatataatcaagtataatgataaaatctatagggtggaagccattgatggaaatagaattctcctggccaatttggaaaatcaggactccttggcattgaaatggagagagtatgattcaattgaaaagatggaaaacctaaatggaattcaaaaggcaatcataactgcaaaatctccaaagagcattcaaatcctagatccagatgacttcagcccattggaccttgatatgaatgaaaaattagaaggctttaatatcggggatgaaattgatatattaaaaatagagggcagaatatttattatttaa

SEQ ID NO: 427 - DNA, 408 bp, Methanobrevibacter ruminantium
atggacgattatgaaaatttattaaacagagcgattgatcaattacctcctgaagtatttgaaaccaaaaggtttgaaccagttaaagcttactctgttattcaaggtaatagaacattcattcaaaatttcaaagatgttgcagactcattaaatagagaccctcagcatatattaaaatacctgcttagggaattaggtacagcaggaaacctggaaggagtaagagcaatccttcaaggtaagttcaatcactttttaatcaacgaaagaattgacgaatatattgaaaaatacgttatctgtcatgaatgtaacaggccagatactaaaatcataagagaagatagaatatttattttaaaatgtgctgcatgtggtgcaaaagctccgcttaaaccattataa

SEQ ID NO: 428 - DNA, 1998 bp, Methanobrevibacter ruminantium
atgagtcccactaacaaaaccaaagcatcacttgcaagatttgaagaattcttctctacaatttacaaggacgatgtatttgaagttctagaaaaatatcctgatgaaaggtcattgacagtcgattataacgatttagaaatgtttgatccagatttggcggatttattaatcgataagcctgatgaagtcattacaacttcacaaaaggctatcaagaatatcgatccattgatgaaagacgctaatttaaatatcagattcgaaaatcttacaaacaacgttccattaagcgatctcttaagtaaatacattggaaagtttgtttcagcagatggaatcgtaagaaaaaccgatgagattcgcccaagaattgaaaaaggtgttttcgaatgcagaggctgcatgagacaacaagaagttgaacagacatcctcaagccgcataatggaaccttccatgtgtacagaatgtggaggaaggtcattcagactgcttcaagaggaatccaaatacatagacactcaaagcgccagaatgcaagagcctttggaaaacctttcaggaggaacagagcctaagcaaatgcttatggtattggaagatgacttggtggatgaattgagtccaggagacaaggtcaggattacagggactttaaaaacattcagagaagaaaaaagcggaaaattcaaaaattacatttatgtaaatcatattgagcctttagaacaggaatttgaggaattgcaccttagcgaagaggatgaggctaaaatccttgaattatcccaagaccctaacatacatgataaaatcattaactccactgcaccttcaatcagaggatacagagaggtcaaggaagcgattgcattgcagctctttggaggatctgtaaagcaccttgaagacaagacacgtttaaggggagatatccacatcctcattgtcggagaccctggtatcggtaagtcacagatacttaagtacgtatcaaaattggcaccaagaagtgtatatacaagtggtaaaggcacttcaggtgcaggtttgactgcagcggcagtaagagatgagcttggcggctggtctcttgaagcaggtgcattggtgcttggggaccaaggtaacgtatgtgtcgacgaattggacaagatgcgttccgaagaccgttcagcccttcacgaggcattggaacaacagacagtaagtattgcaaaggctggaatcatggctacattgaatacaagatgttcagttcttgcagctgcaaaccctaaattcggtagattcgaccgatataaaaccttagcagaccaaattgacttgccttcaccgattctttctcgtttcgaccttacctttgtaattgaagataagccaaacattgaaaacgatagaaaactggcacaacacattctaaagatacaccagtctgaaagcgtaaactatgagatagagcctgatctccttagaaaatatatcgcatatgcccgtaaaaacataaatccagtcctaaccgacgaggcaaacaaggtattggaagacttttatgtatctgtaagaagtgcaggggtggaggaagacactccagttccaattacagcaagacaacttgaagcaatcatccgtctagctgaagcaagcgcaaagctccaattaaaggacaaggtagaggcagtggatgctcaaagagcaatcacattgcaaaggaaaacattagagcaaattggattagaccctgaaacaggacagttagatatttcaagagtggaaggaggaacaacaacctcagatagggaaagaatgcaaaagatagaagaggaaatcaagcttcttgaacaggaattcgaacgagctcctatagacactcttaaggaaaacatgaaagagaaatatgatatgagtcctgaaaaggttgaaactcttgttaaaaaacttaaaggaaaaggcatcatatttgaaccaagaaatggtttctttaatactgcttaa

SEQ ID NO: 429 - DNA, 642 bp, Methanobrevibacter ruminantium
atgggaagtagatggcaagtggaaaagaagaaagatccctattatagaagagctaaaagtgaagaatatcgttcaagagcatcatataaacttaaacaacttgataaaaagtataaaataatcaaagaaggaaacactgtagtggatttaggtgcagctccaggaggatggtctcaagtggccttggaaaaggttggggaagagggaatcgttgttggagtggatttgaacagaatcaagccattccctgaaaagaacttctatggaattagaggggacttcaccaaagagatagttcaagataagattatggaacttacaaacggcaaagcaaaagtccttatttcagatgcagcaccttcattaactggaattaagacaatagaccatttaaattcagttgatttagtggaaaccgttataaaaatagcagacaatatccttgaaaccgaaggaaatatggtaatcaaagcattccaaggccctgaatacaagcgcttattggatgaaatcaagcaggactttagaaaagtcaaatccacaaagccaccatcatcaagacacagaagcaaagagatgtatattgttggattaggctatagaaaaggtcctggaagtagaaaaagtagaaataaagagtaa

SEQ ID NO: 430 - DNA, 540 bp, Methanobrevibacter ruminantium
atgttaattggattaatatcagacacccatattccagatagaagaatgaaacttccccaaaaagtattggatgcatttgaagatgttgaaatgattcttcatgcaggagacatcaccagccaaagcgttattgatgatttggaggcaattgcaccggtccatgcagttgaaggaaatatggacagggttgtaggggaaatgaatcttcctccatctaaaatagttgaagctgaaggccataaaataggaatagtccatggagaagtctatccaagaggagacacccaacagctctattacactgcattggaattaggtgtagacatccttgtaagcggccattcccatgttgcacagcttgaaaagattaaaaatgtgattctggttaatccgggaagccctacaaatccaagattgtcagacccttcagtggcaattatggaaataaatggaaatgatattaattttgaattcgttaaagtgggaaatcctgtttgttctgctttaaatttctttaaagacaaagcaaataaagaataa

SEQ ID NO: 431 - DNA, 1092 bp, Methanobrevibacter ruminantium
atgggaaaagttagtaaagaaaaaatattggagattttagatggctatgataaggaaaacattaccatagctactctcggtagtcacacttccttgcatattcttaacggtgctaaagaagaaggctttagaactgctattgtatgtgaaaaaggtagggaagtaccttatgaacgttttgaagttgcagatgaattcattatggtcgatgaatttaaagacatagtgaatgaagatgtacagcaaaagctaagagatatgaatgcaatcgttattcctcatggttcctttgttgcatatgcgggtttggacaatgttgaagacaaattcaatgttcctatgtttggaaaccgtgatattttaagatgggaagctgaaagagaccttgaaagaaaactattggtcaatggtaaaattagaatcccaatgaaatatgatgacccttcaaaaatcgaccgtgcagtaatggttaaattccctggggcaagaggtggaagaggatactttgtagcttcatctcctgaagaatttgatgctaaaatcgatgcaatgaaagaacgtggatggattgaagatgaagatgtggcacaagctcacattgaagagtatgtttcaggctgtaactactgtattcactacttctactctgctttgaatgacgaagtggaattgatgggtatggacagcagatatgaatccagcattgacggatttgtaagaatgcctgctaagggtcaattaagcattgatatcagcccttcatatgttgtaaccggtaaccaccctgttgtaatgagggaatccttgcttccacaagcatttgaaatcggtgacaaattggtcaaaagtgcagcagagcttgtaaaaccaggtttgaacggtccattctgtatacaaactcttgtaaacgataaccttgaagttgttgtatttgaaacaagtgcaagaactgacggtggtactaatacctttatggaaggttcttcctacagttaccttaagtatggtgaaggtatgagtatgggaagaagagttgcacgtgagattaaaaacgctttagaaaacggtggttttgagaaaattattacataa

SEQ ID NO: 432 - DNA, 375 bp, Methanobrevibacter ruminantium
atggcaaaaatgaatgctgtgatattaggatttatattgacacttgttgtttacctattctttggacgctatgaattctggggtcttttaattgtaggattcattgtaggatatatagctcacgaaggaatattaggcggaatgtggaatgcagcccttgcaggagcattcggaacaatcatatcagcaatcctattcataatacttgtcacaattggaggaactgcaatgatgggattcctcggaggacttgctggatttacagtttcaggaattacaagcttgattgatattgtatttacaataatcaaatatatgattgttatgggaataactggtgctgtaggtggagccttaagcggagaaaaagaataa

SEQ ID NO: 433 - DNA, 2598 bp, Methanobrevibacter ruminantium
atgattaaaaaacaaactaaaacatattcaaagaagcagatttacaagaatcttcatccgtttgtacgagaatggtttgaaaatagcttcgaagactttacaccagcacaaaaacaatcaattccagaaatacaaaagggaaaaaacatacttgtctcatcaccaacaggttccggtaagacactaaccgcctttctatcagtaattaacgagcttacaacccttgcagacaaaggagagcttgaagataaggtatactgcatttacatatctccccttaaggcattggacaatgacattgagcgcaatctagacactccgcttaaagagatagaaaaaatagctggaaagccattaaacataagaaaatctgtaagaacaggagacaccacacaatatcaaagaaacaagatgttaaaataccctccgcatatccttatcacaacccctgaaacattatccatccttcttgtggcccctaagtttagggaaaagctttcccatgtgaaatatgtgataatcgatgagatccactcacttgctgaaaacaaaaggggagttcaccttagcctatcccttgaaaggctacaggccttaatcggagggtttgtaagaatagggctctctgcaacggtatctccattggaggaagtggcaagatttcttgttggatacgaatatggaacagaaagggactgtttgctagtggacatcaattatctaaaggaactggacatagaggtcatatcccctgtggatgacattgtaatagctgatagcgaagacactcgccttgctacctatgccctattggatgatttgattatggagcataagactagcctgatttttacaaatacccgtagcgccaccgaaaggtatgtatataatcttaaaaagctctatggagagcacttcaacagcaataacattatggctcaccattcttccttatcaaaggaactgagactggaaactgaagaaaagctaaagaaaggagagcttaaggcagttgtatcctcaacatcccttgagcttggaatagatatcggatacattgaccttgtaatcctgataaactctccaaaatcagtttcaagggcacttcagaggattggaagaagcggacacaggctgcatgagaaatcaaagggaaggataatcgttacagacagagatgagcttgtcgaatgcagtgtgcttttaaagaatgcaaaggaaggaaagatagataatataaagattcctaaaaactgtttagatgtcctatcacagcatatctatggaatgggaatagaaaacccatgggacattgactatgcctttgatatcatccgaaaaagctactgctataaagatctctcaagagacgactatgaagacgtattaagctatcttgccggagaatatgtagagcttgaagagagatatgtctatgccaaaatctggataaactatgaggagaacacctttggaaaaaggggaaagcttgcaagaatgctctattcaacaaacattggaacaatccctgatcattcggcagttattgtaaaatgcgacggagaggtcataggaaaggttgaagaggactttatggaaaagcttaagaaaggagacagctttgtattgggaggtcgaacatataagttcaaatatggaaagggaatgacaataaatgtatcccctgcatctggacctccatcaattccatcttggtattcagagcaattgccacttgcatttgaccttgcagtggacattcaaagattcagatatatccttgacagcaagttccagtatggcagaagcaaggaagagataatggagtttctccacgactatctctatgtggatgattttgcagcaaattccatctatgaatacttcaatgagcagtatctctatgcgcagataccacataagcaaaagctccttgtagagtactacacaggatttggagggcgcaaattcgtcatattccatagcctattcggacgaaagacaaatgatgcaatagctagggcagttgcatttctagcctcagacttcaataagcgaaacataacaatatccattacagacaatggattttatttaagttcagatggaaagatgggggccttagaggcattgaacagattaaatcctcaaaactttgaaaacattctaatcaaatcacttgacaagactgaaaccctagcaagcaggttcaggcattgcgcaggacgctccctcatgaccctaaggagatataaaggccatgagaagtctgtagggcgccagcaagtcagaggaaaaatactgctaaagcacattcaagagatggacaataacttcccaattcttaaggagtcccgaagggaagctacagaggactatatggacatcaagaatgcaaagagagtcatctcatggattgacagcggagagatggaaataaaaacaataaatacaatcatccccaccccatttgcattcaatctggtttcccaaggatatttggaagttctccaccaggacgataaggcagagtttacaaaaaggatgcatagggcagttctagataagatcaaggaagagatggacaatcagttttaa

SEQ ID NO: 434 - DNA, 852 bp, Methanobrevibacter ruminantium
atggttgaaaaattatcaattgatgaagctattgaagcattgaaagatgaagatgtggctaataggaaattagccatcaaaagcttagagcataagagcgacgataagattatcgaacctttgattgaagccactaaggatgaaaatgctcaagttagatttggagctgctgaaatattaggggatattggagattcagcagttgataaattattggatgaatttaataaggaatccggttcaaataaacgttttttagctgttgcacttcaaaaaactggcagcgaaaaggcagttgatgcatttgctgatgcattgaatgatgaagactttggagttcgaaaagtagctgtaagggcgcttggagaacttagggctgaagataagattgatgccattgccgaatgcataaatgatgaggatggtggagtaaggactgctgctatctttgctttaggagatattggaactgataagtccattcaaatcattaaggatgcaagacgtaaggaaaaggacaaggactttaagaagtattgcaataaagcaataaagcaagctgaaaaagttcaaaagtctggaggcaaagtcaagtcttccaaaggtcagccaatgagcacaattaaggaaatggaaaagcaagatccagaagctgccattaaggcttatgaagttcatgtaaaaagcggcagcactaaggacactccttataagcgtctcgctatattgtataggaagataaatgattatgataatgagactagggttttaaaattagctattgaagttttatctaaagaaaatcctagcaaggttggatggtttgagaaaagattggaaaaaatgacctaa

SEQ ID NO: 435 - DNA, 807 bp, Methanobrevibacter ruminantium
atggatattttcaattatatatttcaaattatcgtttcggttttgatttttgcagcaatctttgctgttggaatattgctaagggataaaatagtccataagctaaatttctttgtaaatcctcagaattatttgcctgaagaggaaatacaaacattgaagcaggtttattatttgattttaattctaattttagttgtgtgtattctaaacttcttctttgacaataatatcatattgccaaacagtccggaattctatgtattcaattcctttttagatattatagtttcagtatatatagcaataatcatttatgacggctctaaaaaaagcaaaatattattgatattcctaattcctattccatcaattgcattcctattatttggcgaatctttaattgaatattgggattttgtacgtattcctgcattattatatattatgaagatattttatgataagttccatatttatactgataagtataatttggaaaaatcaatacttcttctcttttcaatagtgttcattagttttattataacattggttgctgaaaacgaagatccattaaacgcattggttatggtctccaatgcatttacaagcaagggatatacaattttaggtgaaagcactataggaaaaatagatagcatatttctagtttggggaggttatattatatctggagctgctacagctactttgactgctgcaattttaattaaacactttaatgctaaaatagagaaatttgatgaaaaatttgaagaattagaaaagttaatttccgaataa

SEQ ID NO: 436 - DNA, 846 bp, Methanobrevibacter ruminantium
atgaataaaatcaaaatagctctttgtcagatgaatgtagtagacaataaggacgagaatatcaaaaaggcaattgaaatgataaaagagtctaaaaaacaaggagcagaccttgcaatattgcctgaaatgtttaactgcccatatgaaaacgaaaagttcattaaatatggagagaccctagaagatagcagaacattgaaatcaatatctgaaactgcaaatgaagaaaatatctatgttctagcaggatctgtacctgaacttgtcttaaatgattcttctaatgaaaataacttatacaacacatcagttttctttgacaatgaaggaaagatattgggaaaacatagaaaggtccacctatttgacatagatataaaggataaaatctattttaaggaatcagacactttaagtgcaggagatgactttacaatcattaaaacaccttttgcaagaatcggaattggaatatgctatgacataagatttgtagagctttcaagaattttagctttaaacggagcagagatattaattttcccaggggcattcaatctgacaaccggccctgcacattgggaacttctatttaggtcaagggcattggacaatcaggtttatgcaataggagtggcccccgctttggataaggaggcaagctataattcctatgggcattcaattattgtaagtccttggggagaagtaattgaagaattagactatgatgaagagttaaaaatagttgaattggatcttgatttgattaagcaagttcgagaagagatacctgtactaaaaaatagaagaaccgacttgtatgacatcaatgaaaaataa

SEQ ID NO: 437 - DNA, 1179 bp, Methanobrevibacter ruminantium
gtgaaatattgtcaagagtgtggaaatgcaagctatgatagtgcaccagtatgtggaaactgtggtgctaagctaggtccaaagtcagaggcaaattctacacccccaagtcgtgataaaaaagctaaatcaacatcaacttctagtgaaagttccatattttcaagcaaatccgacggatttagttccaaaataggcaaaaaaattggcagtttccaagtgagcagcactaacactgctgttgaaaataaacaggaaagagaagaagctttcttaaaacaaacttcaaaaccaagtttctctaaaactgcaacagaaggatttaagcaaaaggataaaggaataaaaaatcctgctacaaaatataatatgcctaaaaaagaagaaactgttgatgctaaagctaaggaagctcctaaaagggaagctcctaaaaaagaaattaaaagggaatcccctaagaaagaagttaaaaaagaagctcctaaaaaagaaattaaaccaaatattgttaaaaaatcagatgaaggttcatctggcggaataaaccttaaaaagattggaattatagcaataatcatactaatcattcttttaatcgcaggaatcggacttaatcaaatgcaaaaccagacaactgatgaggtgatgaactatacagacggcatcatcaatttcacctactctggtaactggtctgtatacaacaataccaatgcagattccaacatgaccgatcttgcattcaaaactaaagataaaactttaattggatttacaacaattcaaagcgatgaaatcacttatgaaaaaatcctatcagatgtaaatgacactgcccattccttaaatggagaaatccttgaatatcaagaggttaatgtgggaggcgtcccagctcaagagataatcataagcactcaagatcaaggctattccagatacctatgcatcttgcatgacggagtctactattgcttcgttgcaaacaatgcaaaatctgacaatcagaacttgacatctttgaatacaactgaaattcaaaatatgattaatagtattagttttaaggatgttgtagctggagacactgcaaaccttgatacaagctatcaggaaagcagttaccaagaggaaagctacgacaactataactatgaagacacaagcaattactaa

SEQ ID NO: 438 - DNA, 501 bp, Methanobrevibacter ruminantium
atggtaaagaaagaaaagattaaatgtgataatattaattatgcagtttataggattgatgattgggaaaacgattatgaaataaacattattggaactgcaagagagattccagtaacacagcctacccttgagcatatgctaaagcagatggatcatattcgccaatcagtatttgaaataggtggaaaaaaggttaatggaatgattggattgtctatgcagtttaatccaagctttgcttcaagagacattgatgagcttatcgaacaggagcaaaaggagtttgattcaatcatggctgaattgaatgcccttgaattgaaggacgctaaggatgtaatattcttggacacagatgagtatgtcatatataaattagagtatgatgggcatagcttaagcccaaagccttataatgactacgctaaacagcatcatttggatgaaattaaacgtttgaaggaattaagtggagaaaggtttgttttagagctttag

SEQ ID NO: 439 - DNA, 726 bp, Methanobrevibacter ruminantium
atgtctaaaattcaacaattgcaggaaataataaattcatcagacaatattgttttctttggaggggctggtgtttcaacagaaagcggaattccagactttcgctctgaaagcggaatctttaaaagcctggaaaaatatggggatgttccggagaatctggtgtctcatacttactactcagaccacacagaggagttctttgagtattataaggacactcttgtatttgatggtgctaagccaaatccagctcatttgaagttggcagagcttgaagaaaaaggcaagttaagggcagttattacacagaatattgatggccttcatcaaaaggccggaagcaagaatgtcctggagcttcatggaagcattcatagaaattattgtcagatttgcaataaggagtattctcttgattttattttaaaaagcgaaggcattccaaggtgtgattgtggtggtgttgtaaagccagatgttgtcctttatgaagagcctttagacaataggattctagcttatgcaatcgattacattcaaaatgcagatacattgattattgggggaacttccttggttgtttatcctgcagcaggtcttataaattatttccatggtggcaatctggttttaattaataagagtgagactggctttgattatatggctaatttggttattaatgagccaattggagagacattgtctcaaatcagagtttaa

SEQ ID NO: 440 - DNA, 783 bp, Methanobrevibacter ruminantium
atgaaatataaaatcttagaaaatcccaattataaagaggcatatgagctaatcgaagaaggattagtgaaaaaagcaaccatgctcctatttgcatgctgtaaggtaagctatgaaggccgtgcattaagtgaacttgactatggagaaagaataatcatgattaagccagacggctgctttttgatacaccaagacaataaggtggatccggtcaattggcaacctccaaaatcaaaaacaaaagctttgataaaagatgaaaccctttacttagaaagccacaggcgaaagccacctgaactattggaagttgaagttaaaaagattcattatgcaagatataacctgattgaagattatgaagagcttgaaagggcaggctatgaaaaggatatgggagatatgatttgggacaatccacatatcatagaggaaggattccgcccgactgtaagggaatatgctacagagcatggtttcattgacattttaggaaaggatgccgacggaaaccttatggttttagagcttaaggcaagaaaggcagggatcactgcagtaaaacagataaggcgttatctcactgactttgaaaatagggaaaacaaggaaataagacatgaagaggaaaagcaaaaggtaagaggcttgcttgttgctccttcaataggtgatgatgcccttgagcttttagaggaagaaggtattgaatttgtctcagtagaaccacctcgtgagcttaaaaaagataaaaaagtaactttagatgcatttaaatag

SEQ ID NO: 441 - DNA, 768 bp, Methanobrevibacter ruminantium
atgcaaaaagtaattaattctcattgtcacatttatccagataagattgcagcaaaggctgttaaaggaatacgtgatttttatgaccttcatatgtctttaaatgggactgtagatgatttgattgaagacggtaaaaaagtaggggttgttcattatctcatccactcagttgcaacaactccaaagcaggtcgagtcaatcaatgaattcatttcatttgaagtaaacactcatcctggcttgtttacaggcttcggcacccctcatccagatagcgaagacattgaaagggacctagaccacataattgaacttggccttaagggcgtaaaggttcatccagacttccagcagtttgccttaaacgaggagcgtgcttttaggatgggtgaggcaatcaatgaaaggggattgcctattatgattcactgtggcgatttcaggtataattattctaatcccgaacagttaaggcctttccttgaagagtttccagaccttacagtgattggagctcattttgcaggatggagcatgtgggagaaggctacagaggaattggctggaactcctaatctgattgttgactgcagttcaagcttatattcattgactccagagactgcaaaggacttgattcatgcatatggtgcagataaggttctatgggctactgactttccgatgtgggagtctgtaagcgagatggaaatgtttaataagattgatcttagcgaggaagagagaaatacttattctttatga

SEQ ID NO: 442 - DNA, 999 bp, Methanobrevibacter ruminantium
atgtttgatgtggaaagtattgaagtggagtattttactctcaaggaatttaaatttaaaaacggagaagtcctgaaggatgcaaaagtcgaatatatcacctttggaactcccaaatatgatgataatggaattataaataatgcagtaatctatttccatggaacaagtggcaattgtcattctgcaaagcgtttatgcgaatctatgggtagcggagatatattggacacagataagttcttctttatttcattaagcactttaggcagtccaaattcagcaagcccatcttcaactggccttatgaacaagtttccagaatatgacatagaagatatggtcaatttccaaaagcagtttgttgaggaaagattcggaatcacccatattaaggggcttattggaaactctatgggtggatttgaagtcctgacatggggatgtgtctatccagattctgttgactttataatttctcttgtaagcagctttaaggtagggggccacaattatatattaagcaaggtgattgacaatatattcacttcagatccggattataatgatggcgcatatgatttgcctatttccgattctttaaagagaagcttaaagctctcatcagatgcaatgtattcatttggattgtcacgggaggaatatcgaaataaccttacaaatgaggaattaaccgaattcatggcagaatttgcagaggaaagccttgaagaggatcctaatgatgtggtctatatgaataaggcttccattgattttgatataagtgaagatttaaagaatataaaggccaaggttttaattatagcaatcaatcaagatcagtatttccctcctaatttggatgcaattccaatgagcaagatgattgaaaacaataaattggtcatatttgattcctgtatgggtcatgttggctctggtgaattgtttaagatagaagatgacttaagggagtttttaactgaattctactag

SEQ ID NO: 443 - DNA, 405 bp, Methanobrevibacter ruminantium
atggaaataacttataaggatactcatgactttaaggaagaggacctaaaagacttgttcttatcagtggaatggtcttcaggccattttccagacaagcttgtcatagccatgaaaaactttgagacagtttattctgcatgggatggcgataagttggtaggtcttgtttcagctatggatgatggaataatgactgcatatgttcattatgttctcataagacctgaatatcagggaaagggaattggaaaagagctattgaaaagaacaacagatcattataaggattatttgagaatagttgtggtttcatataatgaagagattgaattctatgaagcctgcggctttgaaaaggcagatgatgcaagccctatgtttataacagaattatggacttag

SEQ ID NO: 444 - DNA, 285 bp, Methanobrevibacter ruminantium
atgtttagcgttaaagttgatgattatggtgaaactgaagatgatatgcattttgtaacttatatgatttcaggattaagtgaagctgaattggattatcttattgctaatcttgaaggagagcttgcccttgaggatggcaatctgtttttaaatatattctattcaaagcagttcttcccatttggttcagatgatgctcatttcaaattggacgactttattaaaagggaagaaatagaaatgacttatttcattgcaagctttttagaggatatgaaataa

SEQ ID NO: 445 - DNA, 918 bp, Methanobrevibacter ruminantium
atgacaacagaattacagaacgaaattattcaattgaaagaagagaagaatgcaatcattcttgctcacaattatcagcctaaagagattcaggaaatagctgattttctaggagattctcttgaattatgcatgaaagcaaaagagattgatgacaaggacatcatagtcttctgtggcgtagactttatggcagaaactgcatatatgttaaatccagacaagaaggttttaataccagatattgaagcggaatgtcctatggcacatatgcttacaggagaacaagtaatagaagctaagaaaaaatatcctgacgctgcagtatgcctgtatgtaaacagtctcggagaggcaaaggcagaatccgatattctctgtacctctggaaatgttaaaaaggttgtagaaagcatagaagaggataccattctctttggaccagatacaaaccttggagagtttgtacaaccattcactgacaaaaagatcattccgattccaggtgacggtcactgctatgttcacaagctattccataaggaggatatagatgatgcaaggaaaaaatatcctaatgctgagataatcattcacccagaatccaataaggaagttcaggatatggcagattacgtcttaagcactggaggaatgctttcacacatcagagatagcgaaaagcaagaatttgtcattggaactgaagtggatctcattacaagacttgaagcagaattcccagataaaacatactatcctttgcttgaaggagctatctgcaagacaatgaagcttcacacacttgaaaagcttaaagactgtcttgttaatgaggagcctttaatcaccgttccagaagacattgcagaaaggtctatttctgcagttgaaagaatgcttgacgcttctaaataa

SEQ ID NO: 446 - DNA, 912 bp, Methanobrevibacter ruminantium
atggaaatcatatttttaggaacatcctctgcagtgccttcaagggagagaaaccatgctgcaattgtcataagagaatttggagaagtatttctctttgattgtggagaaggaacccaaagacagttcattgaagcaaatgtaagtccaatgaaagtggataaaatattcatcacccatttccacggagaccacatacttggattaggaggactaattcaatcaatgggacttaggcaaagggaagaggatctagatatctatgggccaagaggacttaaaaaagtgatgaatgcaatcacccataccggatacttcaagattgacttcaatcttaacattcatgaaatcgacgaaggaattgttgtagaaacagaaaagtacagaatagaaaccacaaaaacaaaacatagcgtcccaaataatgcttattcaattattgaaaagaaaaaacctcgtttcataagggaaaaggccattgagcttggtgttccagtaggacctgcctttggaaagcttcacagaggagaagaagttgaaatagacggcaaaataatcaagccagaacaagtccttggtcctcctagaaaaggccttaaggtaacttattcaggagacacaagaccttcctttaagcttatcgaacttgcaagagacagcgacattttaatccacgaagcgacctttgaagaagaagaccggcttcatgcatacgaacatgatcattccacagcaagggacgctgcagacatagctagagaggcaaatgtagggaaattgattctaacacacataagcccaaggtatcaggaattcagcgtcttggaaagagaagccaaggaagcattcgataatgttgaagtggctgaagactttaaggtttttaatataaacagcaaagacaaggaataa

SEQ ID NO: 447 - DNA, 831 bp, Methanobrevibacter ruminantium
atggatgatataattaaatttatgcttgaagaggatgaaggctttggcgatatcacttcaaatgcattgattcctcaagataaggttttttatgctaagctaatctcaaaggatgaaggaatccttgctgggattgagataattaaggaaatctttttggaatatggaatagatattctgtcctctaaaaatgatggggatgaaatcaaaaaaggagatattcttcttgaaattgaaggaaacgcaagaaaaattcttcttttagagagaactgcacttaaccttcttatgaggatgtctggcgtagccaccaaaacccatagggttgtaagcagtgtaaaagaagtcaatgataaggttagagttgcaggaactcgtaagactgctccagcacttcaaaagtatgataagatagctatttcaattgggggaggagaccctcacaggtacggtttggatgatatggttttaattaaggacaatcatattgcagtggtcggatctgttaaggatgctcttagattggctaaagagaatgtcagcttttctaaaaagattgaaatagaggttgaatctgccgatgatgcggtgattgcagcagagaatggtgcagacattatcatgtttgataatatgagtcccaaagaagctcaagatagtttagatgctcttattgataatgatttaaggaatggtgtccttattgaaatctcagggggaattactgaggataatatacttgattatgctcctttagatgttgatatcatatctttaggctctcttacccatcaagcaagcagcttgaactttagcttggatatggattga

SEQ ID NO: 448 - DNA, 258 bp, Methanobrevibacter ruminantium
atggctgaacttgataacaacataaaggaaaaacttacagaagtgtttaaagaagaattaggcaaagacgattttgaattgaattatctgattacagacaacgaaatcacatttttctttggcatctctgaaggaaaggaactttctctcgatggaattgaaaagatttctagcataatcgatggaggttatgagggaaattccattgttaatcaggaatacaggtacaaattcaatttagacccttgttctgattag

SEQ ID NO: 449 - DNA, 2097 bp, Methanobrevibacter ruminantium
atggaaaatcgctatcaagaacatcaatcagatttcaaatatctcctaatcatcaatgatgatttggaatgtgaaataaaaataagaagagaaggcaatgccagtgaaaagaacctaaaagataatattttcacaattaaagaagcaagtgataaggaattagaagatatcggcaggatatatgacttattcgaccaatttgcaatagaaaatacaagatatgaaaaaatccaaatggacaaaaaggcattcataaaattcgccctaaacattaaacctatcctaagggacaataatgcagagcttatctcatcaaaagagattatagaaagcgatttgaaacttatcatggatactgatttaaaggaaaatgaattctctttaaaaaaactaaacagaatcaaatggatagtgagattaaacaaaggaagaattgccttaagagactttgacaagcaaacagaaaacaataaggaaatcctaataaccagaaattacttcttcatacttaataggaatgagttccttgatataaaattctacgcatcctcacttttaaaaaccactgaaaatagcgaaatactaaaattggcattatccgaagagatagatggctttaaatttgaagtgggggaaaacttaaagagacttataaatccttcaagggtttatgaggttccaaggacattaaagggtgaattgaggacctatcaaaagattggctattcatggcttgtgcaaaacataagatctggctttggatccatattggcagatgatatgggtttaggtaaaaccctccaagtcttaactgcaatcctatattttaaggaaaaaggattgcttgaagaaagaccaagcctgattgtcgttcccccaaccctgatttcaaattgggaacatgagattaggaaattcaccccagaactatcatattacatctatcacggcacaaacagaagatttccattggaagactatgacattgtactaagctcatatggagttattcggaatgatttagaccttttcttagataaggaatggtttttatacataattgatgaggcccaaaacattaagagcccacatacacagcagacaaaagcgattaaggaggttaatgcatacaataagatagcattgactggaactccaatcgaaaacagactcacagactattggtcaatatttgactttacaaataagggatacctctcaagcctcagtgactttaaggatagctatgtctttagaattgaaaggctggaagatgaaagatcccttgagaactttcttgcaataacaaaaccatttgtaatgagaagacttaagaccgatgagcaaatcaagggagaactgcctgataggattgtaaacgatatctatgcaagccttagcaaaaaacagataaagctatacaatgctgtcttagatggaatatttgaagagatagatgaactcaaaggaattgaaagaaggggaaccatcctaaagacaataacttccctaaagcaaacttgcaaccaccctgcacagtttttaggctcaggcaaaccaaaaatcaaagaatcaggtaagatggaactcttaatcacaattctggaaaatataatggatatggatgagaaggtcttgattttcacccagtacgttaagatgggagagataattcaagatcttgtttcaaaaaaacttaaaagagaggttcttttcctccacggctcacaaagcagaaacgaaaaggcagagataatagacagattccaggaagatgacaactataagatattgattgcaacccttaagacaggaggagtgggtttgaatctcactgcagcttcaaatgtgattcactatgacctatggtggaatcctgcagtggaaaaccaggccacagacagggtacataggataggacaggaaaaggatgttatggtttatagatttataacaaaaggaactcttgaggaagaaattgattcaatcattaagaccaaattggatttagctgaaaaggcaataagcgttgatgaaacattcattactgaaatgactactgaagagctgaaaagagcattatccttaagattataa

SEQ ID NO: 450 - DNA, 435 bp, Methanobrevibacter ruminantium
atggctgaagatgaaaaaatcgaagaaatcgaagaaatcgaagacaaagaggaagaaaacttaccttttgctaaagcagaagtagttcgtttaatgaaagaaaacctcgatgatgacaagatgattagggaaagagttaaagttgaaatgaacaagttcttaggagacattcttaaacaagtatgtgaacaacttaacgattatccttacactaccattgagtatgaaatgcttaaggagtcaatctatccatacactaacattaaaaggattaaccaagaaaaagaaagaattttattacacttaaatgctattaaagcagactgtgatgcattagctatggatgttgaaaagactctcaaattaaaagatgttgcagatgaagatgcattcactcctttatctgaagcacaagatgaagaaatggatgaataa

SEQ ID NO: 451 - DNA, 666 bp, Methanobrevibacter ruminantium
atgaagcatagattaaatttagataataaagacccaaattatattttgttgaaagaaatatttaaaattatggattctagaaaatccaaaagtatattagcatcctatggatttaaaaacttaaatagaacaatatttacttttaaaattatatttataagtatgttctttggaattgacattccattcattttaaacgagcttaaatccaaaaaagaacttcgcaaatactttaatatttctgaagttttgactgcagatcaagtttataaaattttttcagaaataaactctgaaaaacttataaaatgtttaaacagaatcttaaactcaaggaatatggttaaaagaagaggaaaaaaaacttttattgttgatgcgaccccagtggacgtagatattaatttccacagaaataaaaagactaaagaacatctggaaaaaattaatctcaaatggagttattcatcctctaaaggttattatattggatttaaagcaactgttgtattagattatgattctatgaatcctgtttgtattttagtccactctggagctccaaacgatgcaaaacttttcgaagaaattttagaaaaccttcaaaaaagacgaataatcagaaaaggagacacattaatctttgataaaggatattacagctaa

SEQ ID NO: 452 - DNA, 111 bp, Methanobrevibacter ruminantium
ttggatgacattttaacttatccactagccgtatttaacaaaacaaagagaataatgaaagaaaaaagattatacaacagtttaaaaatggaattaatgaaaaaaaaatag

SEQ ID NO: 453 - DNA, 348 bp, Methanobrevibacter ruminantium
atgatagaattaaataagaaatatgtttttcatgttccactttataaatacaaagatgaagaattaatccctattgatatggatgacattcttgatgaattaatagacgaattctatcaaaacggatatgacagtctatatatgacaaatatagaaacatattataaatatagattcttaacagagattttaataagcatctttgtatcaactgaacgcttagcaaaagaaaatcaggagtttccagacagaatatttaaaaaatggtttaaaaagaacaataaaatattggaacaggaagcttttgcttatgagtataataataaaatgtttattgaaaagctttaa

SEQ ID NO: 454 - DNA, 600 bp, Methanobrevibacter ruminantium
atgactaaggatgatattataactggaaaacaagcaataatcaaaatggactgtccagtatgcggaggcaataaaacagctaattacatcactcaaactcacgagcttgcctattttggagagatagtggaatccacaatccaatgtgaaaaatgcggatttcgccatagcgacattataacaaccgaacagaaggatcctgcaaagcatagcctgataattacaaagaaatcattgaattcaagggtggtcagatcccaatctgccacagtttcactgccagaaatcggaataaaggtagaacctggcccaaaatccgaaggatacatctcaaatgtggaaggagttcttataagattcaagcaagccacagaaagtgcattaagaatgtttgatgatgaggagtcccaaaagaatgcaaatgcagttctagataagataaatcaagtccttgctggagaattggaaaccctcctacttattgaagatccctttggacagagcaaaatcatggacgttcgtgcaaagagcgagcctttaagcgatgaagagttaaagaacttgaaaacaggctttactgttattgatgatgaacaataa

SEQ ID NO: 455 - DNA, 1053 bp, Methanobrevibacter ruminantium
ttgtattctataacttcagttgaggatcttcaagaactcaatccatatgtgattatcggatgtggcggaggcggagagaaattctccaatcttgaaggtattgaaacagttggttttctagacgataatcctgaaaagcaaggaaaactattctgtggtttagaagtagcatcaaatttatctgatttatttgaatcaactgatgcaaatacagttgctgtcatgttgcctattggcgctgaaggcgcagcattgaaatatgcagttgaagcattggcaaatggcaagaatgcagttgtttcatttagatcattatctttatgtgaaaatgagtctttattaaaattagcaagtcaaaatgatgtagttattaaggaaattagtccaagattggatgtagttcgtgaaatctgtggtacagcacctgaaaaatgctgtgaagtgcttcctaagatttcttatgaaccaaaagctaaagttgtctttgttggtggaacttcccaagagtgtggaaagaggacaactaccaagtctcttggtattgaagccgaaaagagaggcatgaaggctgctgtcatttccactgatgagatgggattggaaaagcctactgtatttaactttagggcaggaagcttgtcagctatggatattccttctgcaattctctcatccatgaaatatgtggaagaaagggacagtccggacatcatattcattgaaggtcaatccagcttgactgaagatggaaaccctcatccaagaggattgtctgcttgcatattgattggagcaaatcctgatgcagtcattgtcggacacaggccaaaccacccatatcgtgagccaagaggaatcgattatgaggttaaggctattgaagctgttgttcctacaacaaaagtcgttggattatctataaaccttagaaataaggatgaaggcatgactgtggaagactttgaaaaagagtatggattgcctgcagcagatatgtatgatggcggagcatctaagttattagatgctattttagattatttagatgaataa

SEQ ID NO: 456 - DNA, 285 bp, Methanobrevibacter ruminantium
atgactaaaatggaaattgaattaaatgatgaacaacttgaaaaagtaaaaatactagaatcacatgacataagtgtcggtgatgctatagacatgctttttgaagccagagatagggttatatccatcatagatgatatagatgaaaaagatctagaagacgatactccaaatacagaagaagccaaagcagagcaaactcaattaactgtaaaaacatatgatatagcaattgaagattataaatcccacataagctgggctaatgacttctttaaactctaa

SEQ ID NO: 457 - DNA, 969 bp, Methanobrevibacter ruminantium
atgaaaatcgccccaatgaataaagataaaggaggtgaaaaaattttagactacagtatattaaaccataaaggattcaactcttttgaagagaaaatcaagaggataaaagtccataagccctatgataagatccttaaaacctcatttaagaaaaatcccaatgggtttttggagatattggaaaagggagcaatatttgaagagtttgtggatagtgaaattataaatgctttttttagggaattgcattctgatattattataagagtttataagaagagaatctatattattgaatttcaaagcagcagattaaagctagaggatattttaaggtttgggctttatagggccagcatagctcatcaagaaaaaaaggacatacatctttatgttgtttcaaaagagccgataaagagggataaaattgaaaataagtatggagactactggtttactatacatgtcaaatcgttaaccgatatggattataataaagctttaaataggacaaataataaaatagagaatgaagaggaagagtttacagaggaggattttgtttatcttgaaattagtcctttaatgactcgaaaaaagaaaaagcagagacagttattaaaaagagtagctgagatgacaaataagttggatgggagaataagcagggaaaagttgattgaaatcaaatccatacaattcgtacttgcaacagaactcctaaacgacaacgaaaaagccaaaatagccaaggtgataagcatgcaatcagaaggaaaagaagaagtcttccaaggatacctaacaaaagaagaacgaaaacaaacctatgaagaaggaagagaagaagaaagagaagaaatcgtaaaaagcctagccgaactagatgtatcaccagacatcatagcaaaagcaacaaaaatgagcaaagcagaaatagcaacactcacaacaacaataatctaa

SEQ ID NO: 458 - DNA, 510 bp, Methanobrevibacter ruminantium
atggagtatagattgccaaggatggaagatgaggatgacataagggacttcataagggagtgctgttatgttgaggaatgctatgtcatgctcaagcaggagctccttctttcagattacagcaaatgggtttctctaatacacagatatgcatctttaggcaatggaaaatggggaagatccttgcttcttcttgcttatgatggttctcgattagtcggaatactgcctatcagatatgaaatatccgaggactatgcttttctatatggcaatattggctatcatgtaagaccttccttaaggaatatgggctatgctaccaagatgcttaagcatggattggaaatctgcaaggaaaaaggaatggctcgggtaatcgttgggtgtgatagggataatctggcatcttctgctgtgataaagaaatgtggcggtgttcgtcttaggacattcaatgactcctatggcgttaacgattattatggaatttatctctcaagcgaataa

SEQ ID NO: 459 - DNA, 654 bp, Methanobrevibacter ruminantium
atgaaaaccacctcagtgatagtccttttagttattttaggctatggattaaaggttactcaagacgtaatcaatggaggcaccagtctgcctaagataagccttaaggaattgctcaatttcggagtgaaaggaaccatcgtatatacattctatctgaccatacaagcttcccttttaggtttgatttccctagcaatgaatttccctgaatttgaattggaagagatgattctaaatcttcacgagaccatagaattgttttttgagcatgatcctatcagcttcatactatttatcatattaggacttctcattgtctatggaacaatattctttatggaaatcgctcttgcaatactagcagatggggaaacactaaaagcagcatttgactttaaaagaatcaaaagaacagttgaaacaatcggttggaaggaatatgctgaagactatacaaagattgtagcggctgttgttattttagtatttatcaatggatatttccactcttatggttggataagcattataataggagtattgactgatattttggcatttacagtggaatatcgtggaattggaaatatttatagaggatataaacagaagataaatcaagagacagccctcgaggatacaagcaattaa

SEQ ID NO: 460 - DNA, 1407 bp, Methanobrevibacter ruminantium
atgaagaagacaaaaattatagctagtgtaggtcctgcatctgattcagttgaagttatgagtgatatggttgagatggggatggattgtgccaggatcaatctctctcatgctaatcaagaggatattttaaagataatagatgtggttaatgaggtgcgtaagatatgcaatgtgcctttggcaattatgtatgacacaaaagggcctgagtttaggacttctgaatttaagcatggaggtgtgctgcttaatgaaggggacaccattaagatgagcaagacttgcatacaaggtaataaagaggaatttggagtcaatcataaagaagcaatcgactttataaacgtgggcgacaaggttctaatcgacaatgctctcttggaatttgaagtcattgacaagaaagaggattatgtgctattgaaggctttaggagatggaaagattctaaatcataagaccatcaatgtccctggtgttgacttgaagcttgattttataagtgatgtggataaggaggacatatcctttgcagcagggcattcctgtgattatttggccctttcttttgtaaattcaggggaagatgtaattgcagctcgtaaaattgtggaggacgccggaggagatgcccttatcatttcaaagattgaaagtcgcatgggccttatgaatcttgatgagataattgatgaatctgacggaatcatggtggctcgaggggacttgggggttgaggtaccaatggaacatttgcctataattcaaaaggacatcatcagaaaatgtcgtgaaaagggcaagtttgccattgttgcaacagagatgcttgcttcaatgtatgaaagccctagacctacccgtgctgaggtttcagatgttgcaaatgccgttttggatggaaccgattgtgtaatgctctctggagagacaactatcggtaagcatccggtccatgcagttgaaatgatggatcgtatatgcaattatgtggaatcgaccattgactatagtaagcataccttttacaagggaaaggtggctatcagcgatacaatcgccaagcttgtcataggagctagcgaatattcagacattaagctaatagtcacacctactttgactggatttacagcccgcaaaatcagcaatttgagatcaagctctgcaattttagcttgctgtccatctaatgacattgcaaggaagcttgttttaaattttggagtaaaggctgtaataactgacatttatgagaatactgatgaaatgattgataatgtggtggatattgctaaaatggaatttgatttaaacaaaggcgatcttatagtggtcacaggaggattcccattaggtaagactagaaatactaattccttaaggatattggaaatcgattga

SEQ ID NO: 461 - DNA, 1491 bp, Methanobrevibacter ruminantium
atggctaatgaaaatgaatggggcagcaatcttgcatttgtacttgcaatgattggttctgcagttggattgggaaatatctggagatatccatatgtgctttattcaaatggaggcggagccttttacattccttatctaattgcaattttagttttagccattcctctcatcattctagaatatggggtcgtctataactataagtcctcatttacaaaggctatcgtaaaaataaagcctaaattggaattttatggttggattcttcctgttgtcacttttattatgacaatttactattcaaccatattgggctgggatggaatctatttcatcctaagcttctttaagggctggggatcagatccaaatacatttttaacagtttccctattgcagtctgcagattcaataagtggcattttaaacttcattccagtcattgccatttcaatgattttcatatggctcataatatggttcatttcccataggaacttggatgaaggcttaggccgtgttgcccgatactttgttccaatgctttttgttataatgatagtgattgttgctttttcattgaccctgcctggagcatccattggtcttgctgagttgtttgatcctgattggtcccttttatacaattatagcatatggatggctgcattcggtcagatattcttctcattgagcttgggaatgggggctggatttacatttgcaagctataccaaaagggacatagacttgatttcaagtggattatgtgttgttttggctaatagtctttttgaaaactttgcagcattaggggttttctcaattctaggatatatgtcccttgagtctggagttgctgtttcaaagcttgtatcacaaggcacaacactgatttttgttgcatatcctaaagtgtttaatattttaggaggtgtcgctttgattttagggccactattcttttttacagtttatgttgcaggagtcacaagcatattgtcctcctttgaagtgctttcaatttccattcaggacaagttcgctttttcaaggaaaaaggctacaaccgctttatgcattgttggagggctggcttcaatggtctttgccacttcagctggaggttatttgcttagcattgcagacatatttgtaaataatattatggttttgttttcagtgattgttcaaaccatcctttttgcatgggtattcaaggctgaaaggctggtggactttttcaatgctaaaagccgatttttaaaacttggaagatggtggttaatccttgttaaatatatttgcccaatccttttaactgtaatctggattggagaattatataatcttataaaaatgggttcaactgaatttgtagtgattttaggagtattgcttgcaatattattgatatttgcatttatatttacaatcaggccagcaaaaactgatgaatggtttaaaaccgaagagaggattaagtaa

SEQ ID NO: 462 - DNA, 618 bp, Methanobrevibacter ruminantium
atgggtgaagaagaattaatagaccaatatatgaaacctcatggcgaggaaggaattaagataattgaaagcatgaacgaagagcatcaaaatatctctgaatttgcatttgaatgtgtcaatctcggtgcatatgatgatataattgatattggctgcgggggcggcgtaaacatagaaaaattcctaaatgtgactaacggacatgtggatggccttgattactctgatgtgtctgttagcgaatcaatcaaaagaaatcagacttcagtagatggtggaagatgcaatgtaatcctaggggatgttactgacatgccaattggggatgagtcctacgatttggctacagcattttctacaatctttttctggcctaatcttgttgaaacatttaaggaagttaaaagaatcataaagccaaatggacaatttatgatagcccaaggaaccgatggaacaaatcccgaagatcaggaatggattgataccattgctggaataaatgtctatactgctaatgagcttgaagaatatttgcttgatgcgggatttaaaagagttgatgtatttaccaaggaaaatacttatcttttagttgttattgggaaaaaatag

SEQ ID NO: 463 - DNA, 498 bp, Methanobrevibacter ruminantium
atggatttcaataaggaaaaattcaagatggtcttgcagtacatcatttacaaatgcggaattaaaaatactgttggaaggacagttcttcataaattgctatatttttcagactttaattattttgagctttataataagtctttaaccaatgaatgctatagaaaattagctagaggtcctgtgccagttcattttgaatctgttgttgaggaattgattgatgaaaagaagatctctttaaagaacaggagattgccttgcggcaagcttatgaacaggtatttctcattggaaaagcctgagatagacttaaaagaagatgaattagctgtcattgatgaagtcattaaggatttaagccatatgaatggaaagatgattggagaatactctcttaaggatatgcctgtaaagcaggctcatgataatgggagtattgactataatcttgtttttagccgcagtttacaatattcaaagagaactgacgattag

SEQ ID NO: 464 - DNA, 123 bp, Methanobrevibacter ruminantium
atggctaaaattaattattcttatagtaaaaagtattgcataattgttttcattatgatgttttttatgaaaagaaattattccaaaaagaattataaaataggaaaaacagatattttataa

SEQ ID NO: 465 - DNA, 339 bp, Methanobrevibacter ruminantium
atgaaagaccttattggattttgtggtttggattgtgagctatgtcaagcttatattgcaacaattaatgatgatgatgaactccgtgaggaagttgctaagcactggagtgagctcaataatgttgaaatcagtcctgaaatgattaattgtatgggatgtagagttgaaggggtaaagactccattttgtgattttatgtgtcctatacgccaatgtgctttggagaataattatgatacctgtgcagactgtgataaaatggagggctgtgaaaaactagtgatgatctttgaaaacaatgataatgcttataaaaatttaaaacatcattattag

SEQ ID NO: 466 - DNA, 549 bp, Methanobrevibacter ruminantium
atgtctaggagatttgcagttatcgacactgaaacaaattggaatgatgaagtaatgtctatcggtgttttaatcgccagatgcaagaattttaaaagaacagactctcgccattacatattgcctaaggcagaggcagtagggggcatgtattcaaaatcaatgagagttacaagtcatgagattctgacaaagcataggaatgatgccattgacgatttaaggtatttgcttgattccaatggtgttgatgatttgtttgcatataatgcttcttttgataatcgtcatttgcctgagctttctgacttttgttggcgtgatataatgaaggttgcagcttataaacagcataatccatccattccaaatcatatgccctgcttcaagactggaagattgagaagaggttatggagttgagccaatgcttcagattttgggaattgaggactactgtgaaagccataatgcgattattgatgctagagacgagctgaagatcatggagcttttaggatatgatatagatttctatcctgaaatctga

SEQ ID NO: 467 - DNA, 609 bp, Methanobrevibacter ruminantium
atgactgtgatcatgagcactaacaccatgggctatgcagatttggatttaagacctgctgaaatgcaaagaagcacaatgtacatttccataaacgaatgccctaattgcggatatgctgaatttgacttctcaagagaacctaaaatcaaaagagaatatcttgagtcagaagagtatcaaagctgtgagggaatcgaatttaaatcagaacgttcaaagccattctacaaagcttatctgattaatagaaaagaagaaaacacccaaaatgaacttaattttttaatgcattccatttggtcttgtgatgattccgaagattgtgaaaacgctagaaaacttagaagaattgcatgccaattgcttgaaaccattcttagcaatattgaaaaacataaagaatgggcagataaggacactttaatgctcatgaaatctgatttgatgagacgtggggagatgtttgatgaattgattgaagaatacgagactgtttcttttgaagatactcttttgaataatataaatcaattccaaatcaaaaaatctaaagaaaaggacagtgccagatacaccattggaactgtgataagcctttatggatag

SEQ ID NO: 468 - DNA, 627 bp, Methanobrevibacter ruminantium
atgaacactaaggaaaagatatttgatgtgtctttagatctgttttcaaaaagaggatacgactctgtctcacttagagaaattgcagaagaggtgggaattaaaaaaagctcaatatatagtcattattcctctaaagaagcaatattaatggatatatttgaatattttacagatcttttcgaatatgatgatttaatcaacagtaaagagcttgtcttaagcgaagataatgatgtattgattgaaaaccctgaattgttttatcatatgggctctgaagccataagggggatgtttaaagaggaaagaaaccttaagatttggaagctgatttttatacaaatgcattataatgaaaagataaggaatttcttccaaaaggaaatgcttcttaagccattgatattttgggagaacttttttgctattctaaaagaaaaagggataattcgtgcagattccaatccgcagttacttgctaaggagtattatagctttccaatctttttgcttttagaaatctgtgcaaagtatgatgacattccagagagctgtttggatgacttctttaagcaagctgaagagcatgcaaggtttcttttggattgtgtgaaggtgaaataa

SEQ ID NO: 469 - DNA, 1092 bp, Methanobrevibacter ruminantium
atggattctaagtttaacattcaagaatatttggctaatggggttgaagtcatcttaaaggatgcctttaaagccacattaaagaatccaaaggaaggcttatatttggccaagtttgcaaagcacgctagaaaggccagtgaaatcagaagggaatatagcaaaaagggccagaatattccagttttccttatagcaagcataacaagttcctgcaatctccattgtgtaggatgttattctagagcaaataattcctgtagtgatgaggctcccttaaatcagctttcagctgatgattgggaagatatatttaaacaggcaagagatattggaataagtttcatagttcttgcaggtggagagccaatgattagggaggatgttataaaaaaagcaagtaaatttcctgaaattttatttccaatatttacaaacggaaccatgttaaatgaggattatttgaaattattggataaaaacagaaaccttgttcctatattgtctattgagggggatgagaagcttactgattcaagaaggggctctggagtctataaacagttgatggattctatggagacaatgaagaaaaagaatattgtatttggagcgtcccttacctttacaaaaggaaatatctcttccctactttcaagggactatattgaaaagctgcatgatttgggatgcaaggtggtctttttcattgaatatgttccagttaatgaggaaacagttgatttggctccaagcgacagtgaaagggaattattgctaagtgagcttgatgaattgcgcagtgattattcagatatgctatttttatcattccctggagatgaaaaggaatctggaggttgccttgcagctggaagaggatttttccatattaattcccatggaggggctgaaccttgtcccgcttcaccttattcagatataaatgtgtgtgagacttctcttttggaagctttggaatcaaacttgtttagatcccttagggatggtggtcttttgctggatgatcatgaagggggatgcgttctatttgaacataaagaagaagtagaaagtttatttgataattga

SEQ ID NO: 470 - DNA, 414 bp, Methanobrevibacter ruminantium
atgagttttacagacaatttaaagaaaagtttaggctttgaagaaggagaatatggtagtggatatacttttgatgaaggttataatggtgaaccggacccattttttgaaggaattttgattccctataaatttccagaaacaaaggcttttatggaaatcatcttaattaaacctaaatctgttgatgatatggattatatttttgatcaagttgtagaagagaacaatcctgtgattatggatttaagtttcatggaaaagaaaggtgcagctgaatttaaacaagcaggagaaaaattaaaagttttaagacaacaatataatgctgaagctatcttgctttctaaatctgatgataaaaatttaattattgtgactcctgcaagagttaaattgattagaaaagagtaa

SEQ ID NO: 471 - DNA, 756 bp, Methanobrevibacter ruminantium
atgatagatacacatatgcatgcagacgcaagaagcagtgaagactttgaaaaaatgtttattggcggaattgatacagcaataagctgctcatactacccatacaaagtaaataatgccgaaatactcttaaaccatttaaatagaatattgaactttgaacctaaaagagccatggaatatggccttgaattaaagattgccttaggaattcatccggcaaactcaattaaagacaatgaaataatattcgactcattaaaagaatggatagacaacaaagacataatagcaattggagaaattggtcttgatgaaaacacagagcttgaaaaggaagtctttaaaaaacaattagaacttgctgaagagacaaaatcaaaggtaattgtccacacaccaagaaaaaacaaattagaagttttaaaagacattaaagagattgcacttgaaaatatcaatcctaagcttgttgtaattgaccacataaaccttaacaccattgaagagataattgatgatgatttcaccataggattaaccgtccaaccgcaaaagatggaagttgaagaggccattgagattttggacaaatatgactttgataagtttttattaaatagtgatataagcaataaaccatcagatcctttatctgttccaaagacagtaagaacattgaaaagacttggatataaacaagataaaattgataaagtggcttttaaaaatgcagaaagcttttttaacttgtaa

SEQ ID NO: 472 - DNA, 813 bp, Methanobrevibacter ruminantium
atgtattatcacgattatgtaaaagagcaattgcgatttttgaataattcagagattcgattgagaatattggcttatttgtctaaaaagccattcagtttagcagactttaaaaatagttcctttgtaagctatagctctatttcctctaatgtttataagcttacggatgaaggatttgtagagaagattgataaaaataacttcagattgacaaatattggtaaaatttacctgatttccttaatggagtttcatgatacaataaatacggtaaataatttctcagacttctggttggatcatgatgttcgggcattatccagcaaatatttaaagaggatttcacagctggaaggttctaagcttattcaaagcagacctacagatatctataagactcatgaggagtttagaaatctatttaaggattcagatattctaaaggtcattttcccttatttgcatcctgaatatcctagattgattagaacattgctttccaatggttcaaaaatagagatattggttccaagagtaatctgtcgacgatttatcaagagtgtgggagaatccttggttagaagctcgattaagcagaatgctctttcgataaagttcattgacgatgaggttaagcttgctttggctatttctaataaatgggtttctattggtctctttaaacgagatggaagctatgaccaaagcagattattggtttcagataaaaaggatgccattaaatgggcatataatattttcaaatcatatgataaaaaagcagaacttgtggaccttagaagtttataa

SEQ ID NO: 473 - DNA, 819 bp, Methanobrevibacter ruminantium
atgattggtgatattaattttgaattggatagtgaaaattttagaatcatgcgtttcttattaagctcttttatgagaacagatcttttgttgactttagtgaattcttcttctcgcttgtgttccttgagatcgaatttaggaaagagttctgctacaatcttgcatggagttagtgagttggaagcctttaatttaatttcaaaggattccaaatattattgtctctcttcgaaaggttttatttatggcttggcattggataagctgtgtaagaatctatatatttttcagtcaaatccagaattctggcagaatcattttatagacggtcttccaagcgaatttgtagaaaatgcatatctcattaaggattccgtttatatatgcagtgataagcttgatatggaaaagccgattagggattattttaagaatataaagaattccaaaagcattaagattattttgcctatattttctgaattatatttggagatgattttaaaaactgttggaagcgatcatgacttggaattgatagtggatgaggaagttttcacttcaattaagaaatccagatattataggaggattatacgtctatccaaaggtggaaaaattattttgagaaaatatattggggatttaaatttatttttaacatttagcgatgaattcatgtctttgaatctatttgataaggatggattctttgatgattctgaaactattttcaataatactccagatggtgttaaatgggcagaaataatgtttgattactttttggacaattctaatgtggttgttttgtaa

SEQ ID NO: 474 - DNA, 1713 bp, Methanobrevibacter ruminantium
atgaatcatgaaaaaatgtcaaacatagcaagaaaaagaggatttttatggccgtcctttgaaatctattccggagtgtctggatttaccgattacggacctctcggagcaagcctaaaaaacaacatcatgcaaaaatggagaaagcaatacattgcaggagaaggcttccacgaaatagaaggacctaccgtaatgcctaaagaggtattaaaagcctctggacacgttgataactttacagatccaatgacaaaatgtaaagactgtggagaagtctttagagcagaccacattattgaagaagccattggagaagacgtagaaagccttgaaaatgaagagatggatgaaatcgttagaaaaaatgatatcaaatgtccaagctgtggcggagagcttgcaaatatttggaattataacttaatgtttaaaaccgaaatcggagcaaaaggagacaaagtaggatatatgagacctgaaaccgctcaaggaatattcattctattcaaacgattgtccagattctttaaaaataagcttccattcggtgctgtccaacttggtaaagcatatagaaatgaaatctcaccaagacaaggagtcatccgccttagagaatttacacaagctgaagcggaaatcttcctagaccctagagacaagacacatcctaaattcagccagattgctgatgaaatcttatatctatcatctcaagatgttcaaataaacaataaggaaaccttggaaatcaccgctcaagaagctcttgatcaaggagtggtatcctctgaaacattaatctaccaattataccttgcaagaaaattccttaaggaattaggcattccagatgaagtattaagattcagacaacacctacctggagagatggcacactatgcacttgattgttgggatgtagaatgcctaactgaccaatatggttgggttgaaatcataggtattgcagataggggagattatgacttaaaagcacatacagagttcagtaatgaagagttaagcatttacattgaatatgatgaaccaaaattagtcaaaaagaccattgtaaaacctaatttaaaattattcggacctgcatttaagggagactctcctaaaataaagacatatattgaaaatctcagcgatgaagaggtcatagaacttaaggaaaaaattgaaagcaaaggaaaattcacccttgagctagaccaaagctttgaaatcctcaaagagcatctattgtttgaggacattgaagaggaagtcaaaggagaaagaatcatccctcacgttattgaaccttcatttggtattgaccgtatcctttattgcacactattacattcattcaagacagaagaagatggtttcgataaggaatactttaaatttgctaatgagattgctccaatacaagtcagcgtattcccattgatgaatagagatggccttggagaaatagcaacagaaattacacataacttacgtgaagctggatttacagtagataatgacacttcaggaaccattggaaaaagatacgctcgtgcagatgaagtaggtgttcctatagccataactgttgactacgatacaaaagaagacgatacagttaccgtgagaaatagggacactgaagaacaagaaagagtaaaaattgaagacttaaaagaagtcattgaaaccaaatacctttaa

SEQ ID NO: 475 - DNA, 588 bp, Methanobrevibacter ruminantium
atggctattttaagtgacagagatattaaaaaatacttaaatgaaggcaaaataacaattgaccctttagaagatgaaaagcaaatacagccgtcatctgttgacatgagactaggggatgaattcaaagtctttaaagttattagaaaacctttcattgaccctaaagacccagaagaccttgcatcctatatggaatccacaatagttccagaaggagatgcattcatcatccatccaaacgaatttgcccttgcaaccacatatgaatatgtaaaaatcccagatgaccttgtagcaagagttgaagggcgttcatcaatgggaagactgggagttaccatgcatgtgactgcaggctttattgacccaggatttgaagggagaatcacccttgaaatctctaatattggggcaatgccagtggcattatatccgggtcaaagagtatgtcagcttgtatttgagacaatgacttctccatctgaattgccttacggccatccagaaagaaacagtaagtatatgcgtcaaagaagaccagaaagcagtagaattaaatttgattatgaattaaatgaaaaataa

SEQ ID NO: 476 - DNA, 876 bp, Methanobrevibacter ruminantium
atgaggaaaggattttacgaagatatcagtacatttttagtgaaacatacatttcacactcgttttttcctttcaagattaactaaaaaatctaaaattgctaaaaaaatcatagatagacttcttttccaaggtgacgaagtttatgttcttccaaacaaaaatacagtacaaaaaacaaaatctgccacaatctctgcaaacattgaagtcaaccaaagcttccagaaagacgattccgaattcgttccaagcgaaatattaaaaattgcaattagagaagcttcagacattgtcataatgaacaaatgcctttgcagaagctctaatgattgtcaagactatcctcaagacttgggatgcatatttttaggccctgcaagcagaaagatagcctcaaaatatggaagaagagctactgtagaagaggcattggcacatgttgataaagcagatgcagaaggattgagccacgttattggaagaaataagattgataccatatggatgcatgtaagccctaaagaagagttactgaccatctgccattgctgtccatgctgctgtctatggaaagtacttccagacttggacaatgatattagcgataagatcatgagacttgaagacgttgaagttcatccaataagcgacaactgtaaaatgtgcaaaaaatgtttaggggatgacatttgctttggcggtgcaatcagcttggaaaacgacaagataactatagatcaaaacaaatgtgtaggatgcggacactgtgttcaaacctgcaaattcaatgctattgagttaaattatactcaaaaatcagttgattctgttttaaatagaattggagaattagttgattataagaaacattaa

SEQ ID NO: 477 - DNA, 792 bp, Methanobrevibacter ruminantium
atgaaatacaaagataaaaaatcagagagaggaaaagtaaaggaaatagttgaagatgaagaaactataagacttaaagaaaacatctatgttgtctttgtagaatgtgaatctcctggaaatgttggatttttagcaagaaccatgggaaactttggattgaataaattagtcctaatcaatccctgcacacttaaggaagaagcttattatcaagccacccatgcaagggacactgtagagaatgcaatgatttatgacactgtaggggaatttgtcaaagacaaaaagattgacttcataataggatctaccggagctcccggaggaagctataatatttcaagaattccattgaagcctgaagagctagcaaaatcaatgaattacaatgataagatagcgattctatttggaagggaaggaaatggactgaccaatgcagaagtggacatgtgcgatttgattgtaagcattccaaccgatccaagctatccgattatgaacatttcccatgcagctgcaataatcctttatgaaatctttaaaaacaggaatgagtttccagtgcaaggcctggaagaaagcacagcaatcgagaaggaatatcttatcaaggatatggaagaactcatcgataacttaaacattccagaacataagaagaaaaatggattgaaagtattcaagaacattgtaaatagggctttcattacaggaagagaagcccatacattaataggtattttaagacgtttaaatttaaaaataaagcatggagacgaatattaa

SEQ ID NO: 478 - DNA, 1527 bp, Methanobrevibacter ruminantium
atgataacagtttatgtaaagagattcgatagcgagaaggatgaggagcctcatatcgaagcttacgaaattgaagaaagcccaggaatgaaagtgctagatgcattagaagaaatcaacagaaaatataatgcagacattagctttagaagctcatgcaaagcaggacaatgcggatcatgtggagtaaagattaacggaaatggcgcacttgcttgcaaggcccaaataaaggacaatagattaattgaaccattggatttcccagtgattaaagacctagttgtagatagaagctctgcagatgaaaaggtaaagcaattgcaattaagcctaaattgcgatgatgagactgcacatgagaaattaaatcctaaagatattaaggacactaaaaaggtcagaagttgcattgaatgctatacctgtctttcaacctgtcctgttgtaaagcactttaaggaagacttcctcggaccatattacttaagatacctctctaaatttgattttgacccaagggacgaatcagacagacttattgaagcattagacagcggaatgtacaactgtacaagctgcggcaaatgcggttcaatctgtcctaaaagcattaacagctttggagatgcaatagaaaagcttagagcaatggcttatgctagggatttaggacctcttgatgcccataaaatgtttagggaaaatgttgtagcaagcggaaggtctgtaagcaaacctgaagagccattcattgaaacaatccataagaaatgggatgaagaaggcaaatattatactgatgacgaaagcaatgatgaaaacaaaaataaagaaaaagtggccttattcactggctgtatggtagactacagagcacaggaagttggatatgccttaatagatgtcctaaaggcaaacaatattgaaatagacattccagaaggccaagtatgctgcggctcacctcttcttagaacaggacaagtagatgctgtccaagagcttgtagataagaataaggaagtctttaaggattatgataaagtaattacaatctgtgcaggctgcggagccacacttaaaaacgaccatccgaaatacggctcaaatctcaatgtagaggacataagcgaattccttgtagataagctcgatacaagcaagatgaagccattgaacactaaagtaacttggcatgacccttgccacttatccagaggccagaacattaaagatcaacctagagacataatcgaaatgattccaggagtcgagtttgaagagcttgaacttccttgccaatgctgcggtgcaggaggaggaatcaagtccggaagaccagacattgcattggaacttgctaaagacaaggcagagatggttagagttaccggtgcagattatgttactacaatctgtccgttctgtcaaataaacttacaggatggtttaaatgcaattggtcttgataatgttaagacattgaatcttattcaattgcttaaaatggcttatgatgaataa

SEQ ID NO: 479 - DNA, 1992 bp, Methanobrevibacter ruminantium
atggcttatgatcaattagtgactagtgaaaaaggagataaactttttctgcttggtaatgaagctgctgtaagaggagctatagaagctggcgtatcagttgcagcaacatatccaggaactccttcttctgaaattggaaacatattgtcagtagttgctaaaagcgcagacatgtattttgaattctctgcaaacgaaaaggtggctatggaggttgctgcaacagctgcagcaagtggtcttagatcatttacctttatgaagcatgtaggtttgaatgtggctgccgattcattcatgactactgcatattctggagttaagggaggaatgattattcttgtagcagatgacccttccttgttttcatctcaaaatgaacaggatacaagaaactactcccgtttatcttcaattccaatacttgaaccttcaaaccctcaagagataaaggacatgatggtttatggctttgacttatccgaacagtttggaattccagttattctcaggacaagcactcgtgtgtcccatatgagaggaatagttgaaatgggtgagataaacagtcctaaatcaactacaaaggaagtcaagtcagataagcattggcttaaaggatactttgttaaaaatccaagggaatttgtccctgttccagcaaatgcacttgcaatgcatgagagattggttgaaaagataggaaaaattgaagatgaggccaatgaaagccctgtaaatgaggttgtttcatttgaatctggtgtgcttcaaggcaaatatggagtaatttcctctggaggggcattcaattatgcatatgacattgtagctggagaaaatcttggaatggacattttaaagattgcattatcctatccaactccaaaggacttgatttatgacttctgcaaaaaccttgaaggtgttttcatcgtagaggaagttgatcctatccttgaaaaggatgtccttgcagttcttggtgaaaagaatcttgattgtccagtttatggaaagatcgatggaactttcccaatggttcatgaatttaatccagatatcgttaaggaatctttcaataaggtaatctctgatttggccgatgatgaggaattaaaggcagaatataaggatgaattcggcaaagatttaactggcgatttgattgagacagtcgaaaaaatggaatttagccaaagtttgaatgatttggtggacaatattccaacaagggctcctacattatgtgcaggatgttcccatagatctgcttacttcgcttcagtaaaggcttatgaagaattaggatacgataaggaagatatgatctttgcatctgatataggttgctatacattgggaatcagccctccttatgagactgctgactatcttcttgccatgggctcatcagttggagacggttgcggattttcaattgcaacaaatcagcatgtcatgagctttattggagattctacattcttccatagcggattatctcctcttgtaaatgctgttcacaataagaacaagtttgttttaactattttggataataggatcacagcaatgactggaggtcagccaaacccaggaattcctattgacggaatgggagatgaggctcctgcaatttccattgaggatatagttgaggcaattggagttaaattcctcaagattgtaaatcctcacaatattaaaaagactgtagatatctataaggaagctcttgaatacgatggagtggctgttgtcattgcaaggtatccatgtaccctaatcaagggtcaaaagagaaagccagtgatggaaatcaaggacagttgtgtaaaatgcttgcattgtgttgaaaagcttgcatgtcctgcaatatcctatcttgatgataaggtgactgttgacgaggccctttgtaaaggatgtactgtatgtattcagatttgtccaaacaaggcaattggagtaaaaaaaggtgattag

SEQ ID NO: 480 - DNA, 639 bp, Methanobrevibacter ruminantium
atggataatattaatagttcaagttcaaattcagataattctgatgtaaattatagcatttatatctctggtgtaggaggtcaaggaattattaagacatctgtaatcattggagaagctgcaatgcttgaaggatatgatgtggtaatgagtgaaattcatggaatgagtcaaagaggaggctctgtgtcaactgaacttaagataggcaatttcaagtcttcaattgttgaggaaaataaggcagatttgattcttgcatttgaacctattgaagtcttaaggggcttggataaggcaaataaggataccgctcttatatttaacactttcccgattgttccttcaactctcacacagactggagagacatatccagatattggtgatataattaaaaatctcaaggataattttgattccgtttatccagtggaaggaaacggccttgcaaaggatgcaggaagcattttatctttgaacatggtcttattaggtgcatgtgtggcaaatgacagtttcccactttcaaaagaaactgttgaaactgctatgaaacataatttagctcctaagttccatgagatgaatttaaaagctattgaaaatggttataatgcgattaaagactctttgtag

SEQ ID NO: 481 - DNA, 591 bp, Methanobrevibacter ruminantium
ttgaatggaggtgttaagatagaatctactgatataagatatttttatagaaatatagtcaagtctggtaaaaaatatcgtataaaacataacaataaggattatggagaattcagcaaattatctgacgcactctatgaaagggactgcttattttattgcaagttcgactatgacctacttgtagaatgtgaccttccaaacaagtatgagaatatggaacttcctccttttccagaacatcgtccaagaggacagattaaaggattgaaattcaataaaaaggaaagagaaggagaaatagtctttgaccataaggagagaaagttctgtgtaataaggggagaggaacattttggaaagtataatacaatggttgaagcctattatgtgaagaaaatccttatggaaaacgattgggacaaagcttgcctcattcaaaacaagagaatcagagaagacatatttcttaatcagaaaattaaagcaagcactcctaaattaaataaatactgtccaaattgtggtaacaaagtaaaagaagaagatatcatttgtaaaatttgtggtatacggctagttaaggattaa

SEQ ID NO: 482 - DNA, 276 bp, Methanobrevibacter ruminantium
atgtatgaagataaattgtatgacaaagcagaaagaagagtagatgaaaaaattaagttttaccgtcatttgtacagctatattgctgttaatgtgatccttgcagttattaaccttattttctttaaaggtgactggtggttcttatgggtaagcctattctggggaatcggtttagtctcccattttattaagacatttgtaatctttaattattttgatgaccatcacagagattcaatgattgaaaatgaaatggcaaaaatgagaaaatag

SEQ ID NO: 483 - DNA, 462 bp, Methanobrevibacter ruminantium
atgaaagtacagttattcgtttcgaaagatcttgaagagccctatgctgagatttatactgataacttaacagataatattcaaaaggctatggttcttttggaaaatgatgaatcagatgatgatgtggatgagggcaattcaatccttgcagttaagaaggggtccgacattgtccttttagactttgaagacattttcatgataaaggttgaagacaagcagactaaggtcttctctcaaaatgcagaatactcaatcaagaagcccctttatcagattgaagaaagccttgattctgattttgttcgcatttcaaaatccacaattgtcaatttaagaaagataaagagagtggctccttcattaagaggaatgatgtttatagaattgaagaatggcttgaaggacaatatttccagaaaatatttaacagatttcaaaaaggctttagacctatga

SEQ ID NO: 484 - DNA, 432 bp, Methanobrevibacter ruminantium
atggagattattaaaaggattgggattggagcatttgtaggatgttttgtagtgatgcttgtcatggtgcttggaacatatagccttggtccgcagaacgtcagcttttccggaactgaaatcattaatgcattcttcggatcaatagttgtaggatgggcatttgccttcagcggactcatttatgaaaaagaggacattccattacctattcaagtcattttccaaatggtaatcggattgggaaccctatttgctgtagcagtctatttaggctggatgcctattagcttaggcatagggcctataattacttggatagttattgcaattgcctttgctgcagtcttctggctaggattttacttatattacacattcctagcaagggacattaataaaaagatagaattatctaatgattttgattaa

SEQ ID NO: 485 - DNA, 1140 bp, Methanobrevibacter ruminantium
atgaagactatagtaaatggtttaattctaaaaggattagaattagaagcaaaaaaggaaaacatcctcattgatgacgatggaactatcttagaaatatctaaagaggttaaagaaggagaaattatcgatgcagataataagatagtctgtcctaggttcttaaatgcccatactcatattggagatagtataatcaaggatgaaggggaaggattatcccttgatgaagtggtaaagccacctcatggaatcaagcatgtcgcccttgaatcagctgatgacgatgttttgattgaagccatgagagagtccatgtgggatatgtacaatatgggagtaagccattttatcgactaccgtgaaggtggattggatggagtaaagcttctaaaggaagctgctaaggacattccaatcactccaataatacttgcccgagacagctccttctatggggaggatgcaaattatcatatggttaagatggcccttaagaaattgctaaaggaatccgacggcataggattaagcggctttggtgaaatcagcacaactgttgctgagattatctgtgaaaggtgtgaaagggaggataagatatcttctatccatgtagctgaaaatgagctcaatcagattgcctctcttgaaaagactggaaagagcgagcctcaaagggcatttgaagctggattcaatcagatagtacatatgaccaatcctaaaaatgatgatgtcgaattgctagcaaggtctgattcatcacttactgtatgtcctcgctcaaatggagcattggctgttggggttgttcctctttatgaaatcttaaataaaggagttcgtcccctcattggaacagacaatataatgataaattcaccaaatatgtttagggagttggaatttacattaaagataatgaaaggagtttctagaaatcacatagatgctagagaaatattaaaaatggctaccactaatgcagattcaagcatttctaatctgcctattgataagtcatatattggagaaggccaaaaggccgaactcatgattgtaaataagaagtcaaataacccttatttgagtttgatcaatcgaacagaagctaatgacattgttaaaataatctaa

SEQ ID NO: 486 - DNA, 876 bp, Methanobrevibacter ruminantium
atgattgtaaaagatgttgcatctacagatgttattcatgttacagttcctggaagccgtgatgaagcattacgtatcatgaaaaaagaagatgtgtctgtagtgcctgttattaagaaagagactggaaaattagtcggtatattaactcgttctgatatgattaccaatccagatgaagagcaaatcgctatgttgatgactagaaatttgattactgcaaaaatggatgacgaattgtccactgttgctgaaaagatggtaacaaacgatatcagaagagtccctgtaattaatgatgatgatgaattggttggaattgtaaccagctttgatatagtttcccttgctattgcagatatgggaatcaaggaccctgttgaaaattatatgatcaagaccattccttcaacatgggatgagactcctttgaatgtcgcttttgaagtcatgaagttctttggattaaaatccgtcataggattaaactccaacaacaagatgaccggtatcctaactgaaacagatttcattgcagaaagcgaaatcatatctgaaagaactgagcacagctcttctgtaggtaccgaaggggacaaatggtcctgggacagtaccagcgttttatacattgagaaaaaccatcttaagtttactgacaaggtatttaaggacgttgcatccggtgatgttgtaactgcaaataccaagacaaaagtttcagtatgcactgaaaagatgaaatctcttgatgtggaacaattgcctgttcttggaatagaaggagaacttgtcggtttagtaagggcaagtgatttaattaaaagctttattataggctttaatttttctttttcttttatttttactttttag

SEQ ID NO: 487 - DNA, 1080 bp, Methanobrevibacter ruminantium
atgaaagccaatccaaaaatagaaaaagtaaaacagatcctaaaagattacaaaaagatagccttagcattctcagcaggtgcagacagcaccctccttgcataccttgcaaaagagtcagactgtgatgtgcttgcaatcacatatgacaaccagatctttccagagggatttttggaatttgctaaaagacgtgcagatgaacttggaataaaacacgaaattatagaaaatagtttcttaatgatatatgatgtggcacataatactccacaaagatgtctaacatgcagaagattgatgtatggttcaattaaacaagtggctaatgaaagaggatacgatattatcatagatggaaataatataacagaccttatccacgacagaccaggcatcctaatgaaatatgcaaatgggattgaaagtcccctcatagatgccaatcttgaaagctatgaaattcatgatttccttgaagagaatgatattgaatattcaaagtcaacaacctgtcttgcaactagggtgaaggcaaatgaaacagttacagaggacaaggtaaacaggattgactactgtgaagggtttattaaaagtactataggtgctgatgtagtaaagcttagggaagaaaagaacatagccaccattgaattaggaaataatgattcaaagaagatattggataaagaaaaactagagatcatattcaatgagctaaaagaagcacagtatgataagatattattaaacattgatttcactgaagatgaggaagagcttattttagattcagagcttcaaaagggaaaggaaaatctaattcttagaaagaaactgccatttgacattgaaatttccaaaacaggaaaagtaatcaatgaagcagataatgaatttatatcagatattcaaacaattgaagagataggatacataaaattaaaaatagataaaaaagagtctaaaatatttagagatggtaagattagcattgagaataataaaaacaaggaagatgctaaagagtctttagttaagatcttgcctttaataaggagagcaaaaccattttaa

SEQ ID NO: 488 - DNA, 642 bp, Methanobrevibacter ruminantium
atgacaaagatcatagtttatttaggattatccattcaagaggaagaagctaaaaccatcttagatgcggattatagaactccagttaaaaggggagacatattaaaggcaatcagcgaaaagccagacataataggaattatagatggagtcttccaccacacccctgcagttgcccataaggagatcatgaaagccttgaaaatgggaatcactgtagttggagcaagcagtatgggtgcccttagagcttccgaactggatgaccttggaatgattggaataggatatgtctataaagcatacagaagcggaaaaatcacatcagatgatgatgtggccctcagctttgaccccgagagaaatgtgccaatctccgaagcccttgtaaacattgactacaagcttgatttggctgtgaaagaggaaataataagcgaagaggataaagaatacatccataatattgctaaggacatctattatccaaaaaggtcataccaatacatattctctaaagtggaaatggaagatgaaaagaaaaccaagcttattgattttatcctaaaggaaaaggacatcaaatatctggatgcaatagaagctctagagtacattaaatccatttctgaagaagaatag

SEQ ID NO: 489 - DNA, 1260 bp, Methanobrevibacter ruminantium
atgtttgaagatgttgaaatacaattctttaaaggaactcacagagtaagagatccaaaggaaacaatcgaaataaatgaaaataagctaagaactgcaggaatcacccgtctaactgaaataacagacttagacagaataaaaatcccagtgttctctgcaattcgtccaactgcacaggaaggcggagtcagcgtatatgctggaaagggagcaacaaaggaacaagcaaaggcatcagcgatgatggaaggctttgaaagatattctgcagagcgccaggatatagacaacgaaagaacctttgttgacacctacaacaatataaaatcaagccaagaactaaaggccctcgaccctagagaccttctattgccaaagaatttcaccacacagaatgtggaaaactcaaggctcgaatggattgaatcaaaggacataattagcgaagaaacaatctatgttccctcaaatgcagtgtttcacccatatattcctaccagagaagtaattcctagtccactagctatttttaaaggaaacactaatggtttggcatctggaaacataatagaggaatctgttctccatggaatctttgaagtggttgaaagggatgcatggagcctttttgaacttacaaaaagaaacaagaaggaaataaatcaggatacaatagaaaacgacatcataaatgagcttttagccaagttcaacaatgaaggaataaatataaagcttatggacataacagcagaccttaagataacaactgtagctgcaagcgctgatgatacagtactgaaggacccggcactcctcacattaggtgtaggcacccatcttgaccctaatatagcagtgataagagccttaacagaggtggctcaaagcagagcaacccaaatccacggaacccgtgaagacacaataagagcagatttcatgagaaagtcaagctatgaaggcatgaaaaggatgaacaaacactatttccaaaaggaagaagatacaattgacctttcagacattgaagacaagagctcacactcaatcaaaaaggacattgaaacaagcattgaagaggttcagaaggtcggattcgataaggtcctatacacagaccttacaagagaggagattggaataaatgtggctagagtaatcattccaaaggcagaactctactcattggacgaggaaagattaggaactagagccttggaatatgatagaaaagcacgtagaggactggtctaa

SEQ ID NO: 490 - DNA, 1044 bp, Methanobrevibacter ruminantium
atggtttcaagtgaaaataaagttcatgattttcatataaagaatattttaaagagattggaagaaaaagacttggatgcaatgatggtggctaatttcaacaatatctattatctttctggctacttatctacaagctttgcatttatgatagtcaaggaaaatcctatcatatttgtatctgggatggatttggaaaatgcaaacaacaattcttctattgatataatcaaatatgagtctgcagatcagatggttgaatatttgaatgaagaggagattaaggaccttgccatcgagtctgatttgactgcaaatgcctaccaaaagtttaaggactttaatctaactatttctccagctatttccatagaaaggatgataaagaccgatgatgaaatcgataaaatattcaaggctggcgaaattgcacataagtcattgttggagcttgatgtaaggtcaaagcaggaaaagggtgctgaagaatgggaatgtgcatatgagttaggctatctcatgaggaagaatggagcaagcacagaatcattcgatacaattttcgcttcaggtcctgtttcttcacttccccattccacaccaaggcatcacaagttggatactccggtattggttgattatggttgtaagtttgaaggatattgctcagacaccaccagaacatttgtctataatgaaaagcaggaagagatttccaagattgtgcttgaggctcatgacaaggcaataaaagcagttaaggaaggagtaaaatcctgtgaagtggataaggtggcaagggatataattacagaatatggctatggggataagttcattcatagcacagggcatagctttggattggatattcatgaaagcccgtcactgtccttaaaggatgagaccattcttgagaagaatatgtttgttacaattgagcctggaatctatcttgaaggggaatttggtgtcaggatagaagatatggtcttagttgataagaaggctaaaatagttggcaatctgcctcctatcctataa

SEQ ID NO: 491 - DNA, 225 bp, Methanobrevibacter ruminantium
atgtttagcatttatttaaaaaatgattttaatagattattcaaggaagataaagcacaggggtctgtagaattaattttacttatcggaggcataattgtaattgttttggtttgcatgtttgtttataagtcctatatggggggattaggtgatgaattggaatctaatgaattagaatcattaaataactcttttgaagaattatcctctaaatttgagtga

SEQ ID NO: 492 - DNA, 1416 bp, Methanobrevibacter ruminantium
atgaaagtattgattgatggagaggattttgacagcggcgaccattatgaagtaaaaaacccatatgatggtgagcttgtagatactgttccaatttgttttaggcaagatgtagatagggccatagatgcagcaaatagggctaaaaaggaattgcaggatatgtctgcaaaggaagtgtccaataatctttattctgcttatgaagagctcgaatcaagaagcgaagaattggcaaagcttatagtcttggaggctggaaagccaattaagcaggctattggagagcttaacaggtcttgtgagacattgaagtttgcagcagaggaagccaaaagaatctatggagaatctgtccctatagatgctacaggttctgtagatgagcgttttttggcatttacaaagaaagtacctttaggtgtcgttggagcaataactccattcaattatccggttaatcttgcattgcataagatagctccagccattgcagcaaagaatgctgttgtggtaaagccttccactgaagctccattagctgcacttaaattggttgaaattattgataatcatttcccaaatggggtgataaactctgtaactggctatggaagtgaagttggagatgcattggttgtttcagagggcattgataagatatcatttactggaagcattgccactggattgtttatctcttctcgagcaggaatgaagaaattgactttggagcttggtggaaacgatccattggtcgttcttgaagatgcagatattgaaaaggcagttagtgctgcggtgtccggcgcatttctattctccggacaggtttgcataggtgttaaaagaataatattggataataagattgcagatgagttcattgacttatttgttaaagaggcaagtaaattgaagatgggcaatcctatggatgagtctacagatatcggtccgcttataaatgaaaatgcttcaatcaatgttgaaactgcagtaaacaatgctataaaagatggggcagaacttattttgggtggaaaccgtaaggactgcttctatgagccaacaatattggatggtgtcaatatgtctatggaccttgttgcaaatgaaacattcggaccagttgcacctatcataagggtagatagaatagatgaggcaataaaagtggcaaatgacaccagatacggtcttcaagcaggtgttttcactgaaaatgttcatagtgcattaagatgtgcaaatgagatagatgcaggttcagtcttaatcaataaggaatccactttcagaacagatgccatgccatttgggggattcaaatcaagtggaatgggtaaggaaggaattaaatatgcagttgaggatatgtgcaagtttaaattgattgcttttaattgtaggtga

SEQ ID NO: 493 - DNA, 726 bp, Methanobrevibacter ruminantium
ttgtgggatacagctaaagattatagaattttagtagctatgcatgctcgtgagttatttttaagaactgttcaaactggaagttttagaggtaactggaataagaaggctacaatagaagaaaccaaaaagatggaagctgacttaaaatcattgctttactgttatcttgaaggggatgctcttgctaattgtgaagatgttcaaaagcttgaagataaggctggaagaattatagagttccttggcggtgaagattggaaccataaattcatgcaaggggctcctaaagacgaaagggaaaagacagaagagaacattgcaaaagtaagatttttcctagacactatcttaggccttagaaacaggtttaagttcggccctattgatgatcctatcatgggaatcgatgtaaaggttggagagataatgagtgtcagcaagcatcctaaagccgattccttaatgatatgtaatgtaaatattggcaaaagggccttaaaggtcgttaccaatgatttaactgttaaggaaggcaatagggtaggggtttccctgcttcctccggcaacattcatggatgttgtgtctgaaggaatgtttttaggaatgaatggtagcatattaaaagaagttcaaggtgatttgggtaatatgcctaatggaatacctatggaatctttaaatgagactaaaaatatgataactgcctttttagacagttaa

SEQ ID NO: 494 - DNA, 417 bp, Methanobrevibacter ruminantium
atggtggaagttacccaattatatgatttagatatatatactttagctggacaatacgtaggtcaagttcatgatgtagttctcaatatcagatacggaaccatctctagacttcaagtaaaagctttagaacctgaaaaaaagagtgcaggttttagagacatcttcagaggcggattccaatttgtacctgaagaagaagtaggaagaacttatcaagaaggtttgcttaacattgaatttgacagagtaactgctatcggggacattatgttaattgatcctcaagatttaaaaagaccaaaacctcctgtagcaggagaagaaatgtcaattcgcccaagacctgaagctccaaaacaagttcctcaagaagttcctcaagaagtcgctccaaaaccaaaagaagtaatttaa

SEQ ID NO: 495 - DNA, 762 bp, Methanobrevibacter ruminantium
atgattgttggaatattaggttgtggcgcaatagccaatacaatagttaacgagtttctatctgatgatggaatagatattaaatatttctatgatacagacattgaaagggctgagaatcttgcccagatttctaatggtatagctgttttagagatggatgagatgttggacaatgtggatttggttttagagtctgcatcccctattgctttaaaggttcatgccttaaacatcattgaaaacggaaaggacctaatggttatgagtgttggagcattgatggataaggaatttagacaaaagattcataaggctgctcaagcaaacaatgcaaaggtctatgccccatctggagccattgtcggtttggatggaattaaggcggcatccattggaaagattaaaaaggcttcccttactactagaaaatcacctaagtctctaggtcgtgaagttgaagaggaagaaatattatttgaaggaaaggcctctgaagctgtagagaggtttccggtaaacattaatgtggctgcttccttaagcattgcctgcaatatggatattgacgttaagataattgtagatcctaaggtagataggaatgttcacgaggttcttgttcaaggggactttggtgaatttagatcaagttctgagaatgttccatttgctgcaaacccaaagaccagtatgctagcagcattttcagcaattaaattattaaaaagctttagtgagtgtttctctgttggtacatag

SEQ ID NO: 496 - DNA, 759 bp, Methanobrevibacter ruminantium
atgaaagattatgaaatttattcaaatttaaaggttccaaagaattctaatattattttacgtttggatggccgtaaatttcatagcctagctaaatatttggctttaaaaaagccatatgacaataattttgctaaattgatgtctgaggtgtccttagacatttttaatcagttttcacctaaattcatttatacattttcagatgaaatcagcatattattggatgaaattcctttccttggccgtgtagaaaagttaaattcagtattctcatcaatagcctcaagttcattcacctatcacttattaaatgattttaaagatgatttcaatatggataaattggatgaagatgataggaatgtcatttttccagtttcattcgattccagagtaattccaattgtaaatgaagacatttatgattatttcaaatggaggcaggatgaggcatggagaaactgcgttaatgcctatgggatttgggccttaaagaaggaattctcacctcaaatcgcaaatgaaaagattaaaggtttaaaatcaagcgaaatccatgaattattatttaaaaaaggaatcaatcttaatgacgttgacacttggaaaaagagaggaattggtatttataaaatagaaaatcaaatagaaggatttaatccggttaaagaagaaaaaacagtttcttatcgcagtgaagtttttgttgattatgaattggaattgtttaataaggaatatttttataggttttaa

SEQ ID NO: 497 - DNA, 921 bp, Methanobrevibacter ruminantium
atgggatttaaagatttaatctcaaaattgaatgaaaaaaatcattttgaaaaggtttgcatagatcaaactgtaattgattcaatcatttattattcaaagaaatcatatcctgatgagtttttagccatgtttgacggttttgttaagaacgaagttctttatatcagtggcttaatctttttaggaggtgaacgttctcatacaagcgctagctttaatgattggctgcttccacctgatcaaaagaaatggggaactgtacattcacaccctggtttaaatgcaaggccttctggcgctgatttgacaacattctcaaaatatggttcttttcatattattctttgtgagccttattctcttgaaactatgatggcttatgattcttatgggaatatgagaggctttgaagttggcaattttgttgatggtaaggatgatgaaatctataaagaccttgaggaattaagaaaagaaatagaagaagaggacggagagctcactccatctatatttgacctagatcaagacttgtccttttttgatagcgaagaggtaaaaaccaataagtattctcatgaattagaggatgaatttgggaatttagccttagataatgatggctctaatgatttcgattcaaataatttttctgaggatatcaattcaaataatccaaattcaaatgacttcacttcaaaccgcttttatccatcaagaaatgtctcagatgaagatttaggttctattgacttaaatccgcaggttattagaataggtggagaaaaagtaaatggtcaaagccctaaattaggcattatcattgaatttagggacgggaaacctattttaaaaagttatactgtggattctcaagaaaatgaagattctcaagaaaaagaggattctgataaataa

SEQ ID NO: 498 - DNA, 1575 bp, Methanobrevibacter ruminantium
atgaaagcattagtcgcagatgcaattaacgaaaaaggaatagaaaatttaaaagaagtatgtgatgttgttgtagatactagcatcactcctgaagaattactagaaaccattggagaatatgacgctatcctcattagaagcagaacaaaattgcctgctgaagtaatagaaaaggcagacaatcttaaaatcattgcaagagcaggagtaggtgtagacaatgtagatgtaaatgcagctaccaaaaaaggtatcatggttgtaaatgcacctgaatccacttcaatcactgtagctgaacacacaatgggattgatcttaagcaccatccgtaagatagcaatcgctgataaatccactaaagctggaaaatgggagaaaaaagcatttatgggtatggaacttagaaacaagactcttggtgtaatcggtatgggaagaatcggttctcaagtggttaacagatgcaaggcatttgaaatggatgcaattgcatacgacccttatttacctcctgaagttgctaaaaacatgggagtggaattatacgaagacattgaagacgtattaaccagagcagacataattaccatccacgttccactcactccagaaaccgaacactcaatctccacagaacagttcaagatgatgaaagacaccgcactcatattcaactgtgcacgtggcggagtcattgatgaagatgcattatacgaagctttagttaacggagaaatccttggagcaggtttagacgtatatgaaaaggaacctgcaaccaacaataaattattcgaattggacaatatcgtctgtacccctcacattgcagcatcaaccaaagaagctcaaagggatgcagcaatcattgtagcaaatgaagtaatcaccttatttaaaggaggcatgcctaaaaacatcataaatatgcctcgcatgaacaacagcgaatttgaagaaaccaatgattacttagaactctgtgaaaaattaggaagctttatcacccaagctacaagcagcccaatcaacaaattggaaatcacctacaaaggtgaaatcaacaagctccctagcaaagacctattcactagaaccatcttgcaaggaattttaaaccctgtcactgaaactgcagtgaatgcagtaaacgctaccaccgttgctaaagcaagaggaatcagcattacagaagcagtaagtgatgacagcgaaggatatgacaccttaattaaagttgcagcaaaaaccaaggaaggacaaatgtctgctgaaggtacctacctccacgaagctaaaatcataaaggtaaatggatactgggtagatgtaaaacctgaaggaaacatgttcattgccaaatacaaagacattcctggaagcattggtgcaataggaactaaattcggtgaagaaaacattaacattggtatcatgcaagtaggaagagattcaactggtggagaagccatcatgattcttacattagatgaaagaccttctaaagaagctgttaagaaaatcaaagacttagacaatgttagtgatgcaacctgtcttaaattatag

SEQ ID NO: 499 - DNA, 339 bp, Methanobrevibacter ruminantium
atggtaaaatttgaagaattccctatttccagtgcaaattatattccaggttataaggtagttgaagaaaaaggatttgtatacggtttaaccgtacgtgcccgtggccttggtggagacattggtgcaggactaaaaggtatattaggtggagaaattaagcaatatgttaaaatgatggaagagtccagagaagaatccattggccgttgcattgaacatgctaaggaattaggtgcaaatgcaatcatttcagttagattggattcagacagcatctcccaaaacatgcaagaagttttagcatatggaactgctgttgttattgaaaaggaataa

SEQ ID NO: 500 - DNA, 774 bp, Methanobrevibacter ruminantium
gtggttttaggaaatgctccttttcttgcagatgcatattttggtcataggactcgtttatataatttagatcttttaagaaatccaaataatgtaagcaaaatcatagaaaagtcctatgattgtggagtgagatccattaatcttgcaaataaggaaaacctacttaaggcatttgggatggcttgtgacaatggagtcgagatgcaggcagtttccaccattggaaagacagagatggattatgtaatccctgattatgatgaggcaaggcgagaggccacctggaaggaggacattgaaaacttggctcagttcgacaattccataatgcttgtagatgagtttcttatcgactcctatgattgggattttatcactgatatattggatgcaatcaacgatacaggtattccatctggaataatcacttcttttccttttaaaacttctctagagcttattgattcaccattacttgaggataaaaacttatttgacttttatatgattccggtaaacaagttaggttatatgatggatgttcctcattttaagtctgacaagcaggaagagttgaagttgatgcttgataagatagacaaaaagataataatcaataagatattggctgttggcattcaaaggcctgaggaagctttcaatttccttaataccttggattttgcagatatggtttcagttggcattgcatcagagagggaagctgaagagacctttggtatttttaagcaaaatttagattttttttaa

SEQ ID NO: 501 - DNA, 810 bp, Methanobrevibacter ruminantium
atggactatttaaagaagattcccgctattcgttggaaagatggaaaatacgaagaagtggaagagaaaacagttagcgatgagaatatctatttttatattgatttattgcctcctcgtaagttttccacatatcctgcagatttggaggactttggtgtagggtattgcttaggtgatggtctggtaaactcatacgatgatattctaagcattgatattgacggcaagcatataacaatcaaaaccaagttcaatcatggcgcagatgaggataataaggaagcagatgaagaaaagccagatgtggatgctgatgttttaggctatcaaagcgtaatgtctgacagtgcaggaggatggagaagcgagcttaaaaagattgagccaatcgaatccgatctagttgtaaatgcaagtgaaataatagagaatatgaaaaggcttacagctaaagcagagatttggcaagccactggaagtgttcatgttgcccaattggtttatggtgacaaattcattactcgtgaggatgtaagcagacacgttgctgttgataaggtaattggtgcagcagctaaggcaggatttgacctatcaaagtgttatgtgacttatagtggcagaatgcctgcagatatggttataaagatggttagagtaggtgttcctattttggtttccaatgctgctcctgcaggttccggctatgaggttgcagtgaaaggaaacattactttagttggctttgtgcgcagcaataggtttaatgtttatgcttctactagtaggatagatttggataaataa

SEQ ID NO: 502 - DNA, 432 bp, Methanobrevibacter ruminantium
atgtcagatgagaataaagataatagagtttataatcttctaataactaaaggaacagacccagaaggccaatatgaattttataaggagagaattgatagtcaaaaggattttttatatgctgaatataacactcaagataacgagctaaatgatgatttgtttgaagaagtagatgttatagtattgctttatggtctttatcatgataatacggagatttgcgatgagttaataaaaaaatcaaaagaattgagcattccttttcttttggttcgctcttttggtgttgaatggatattgcaggatttggaaagtaaggctgatgcagtggttggatggaatgggcattgcattgttgatgcaattaaaacccttgttgatggtggtggcgagtggatcaaaccatgtgatattgaagaggaatattaa

SEQ ID NO: 503 - DNA, 168 bp, Methanobrevibacter ruminantium
atggaacttaattcaaaacattacacaattattttaatcatagcaataataattgcagttattatgacctatatgactggaataaaaaacccaatcattattggactttgcatacttgccataattgtaattctagctaatttataccttactaagcttaaaaaatag

SEQ ID NO: 504 - DNA, 981 bp, Methanobrevibacter ruminantium
atggctgtaactaataggaatcaattaataagagaagtttatcaattgctaaacaaggagggctttgaaacatccaatatatatgatcaaagctgctttgatatagttgctcgaaagaaactgctcattctacttttaaaaatcctcgtaaatattgatagcattaacgaatctcacgttgaagaaataaggcagatttccaatgttttcctagcaagcccaatcatagtagggctaaaatccaaaaatcacatccttgaagaggatgttgtctatgaaaggcatggtcttccagccattgggcttcagactcttaaaaatatgattatctatgacgaatatccggaaattctagcagaccgtggaggatattatgttcaaatcaatggaaatgtcctaaaggaatacagagaggaatataacctatcattaaaggatttggctgaccttgctcacgtttcaagggctaccatgtacaaatacgaaaatggcatggtgagggcaaatacagaaactgcaatgcttcttgaagagattctaaacacaaagatcactcttgacattgacctttttgagccttatcaagaagacattaagctaaaggcagatacaagcaatctaaatcagacacaaggaacaaacgctcaaaatcttgctaaattaggatttggtgtggtttccacaaacaagagcccatttgatgcacttgcaaaagctgaaatagctaccaaaaagaaagacaaccctttgattgcaaatttaaatgttcaagatgagcagaatacaaagacattgaagaaaatggcaataagcttaaaggatctttcccttgtaacctcttcagatccgttctttgtccttgcagacgataagattaaggattccattgatggaattccagtaataaagtcttgggagatgaaagaatttgaaaattccaaggagtttttaaagttgattaaggaaagaagaaataattga

SEQ ID NO: 505 - DNA, 1293 bp, Methanobrevibacter ruminantium
atggaaattttatatttttattcaagttcagtgattattatggattatttttacataggaatagatgatacagactctccagatggaatgtgcactacatttttagcatcctccattttaaatgagtttgagaggagcaatattaaaattattgattatcctaggcttattcgattaaatccttttgcaaggtttaagactcgtggaaacggcggggtctcattcaagctagacattgatgaggatactgatttggcaaaggagattgtgctaggttatgtaagggagctttccatgtttgactgtgacaacacaaaccctggagttgtcttctatgagggtgaaatcactgaagagatggttgattatgcatttaaggcaatttattccattatcactatagaggaagccgaagaatttgcaaaccatattggggctgaaatttataagttcaaaaagggaaggggaataattggctcaattgcagctatttcctgccctttagaggattacacctatgagcttttggcgtatagggaaccttcaagatatgggactcttagaaacattgattatgattctgttgttagaatggataaggaaacttaccctgaaacctttgaaaatatcgatggcaagtatttggccatagagcctaagactccatgtcctgttttatatggaattagatcaaacagtcctgaggtattggaaaaggcaagggaaatggtcattccaaatgaaaccattgcagacagttgcatatttaagacaaatcagcatactgacatgcatattcaaaatgcagataggataagtgacatgaagcaatattcctgctataggataaggggaaccgtcaaggaaaggccacatataatcgaaggaggccatatgtttttcactttatatgatgattccggcgagatagagtgtggagcatacgaaccaaccaaggactttagaaagatcgttgccaaattaagagaaggggacgttattgaactctatgggggaataggcgagcaaaatacatttaatatagaaaaattccaagtcattaagctaaatgaatttgtatatagaaaccctgtttgcggatgtggcaaaagaatgagctctgctggaagaggaaagggattcaagtgcaaaagctgtggaaaacgtatagaatcagatgaaaaggtgcctgaaaagattgatagaactttaattaatggcaaattctatgaaactccagtctcagcaaggagacacttgtctaaaccgttgattcgtatggatttggattag

SEQ ID NO: 506 - DNA, 1434 bp, Methanobrevibacter ruminantium
atgattattcatgaattgtctagatttctaatagatttaaaatatgatgatattccaaaggaatctattgaaaaggccaaactctgctttttagattatctttcagtttattttaggggattggaaagtgaaaactctaaaatagccattaagaccatatataaactatttggagataattttaattccttgaataaggcattcatcaatggaatagcatcccatagcctagatttggatgatggccatagattggctcaattgcatccgggttctattgtcttttcaagccttttggcactcataagcgataagtctttagatttagacatttcaacagagaaattcattgaatctattgtggcaggttatgaagtagctatcgctcttggaatccttgttaatccaaaccatagaaatcagggatttcatagcacaggaacaataggaaccattgctgcaggtgcagttgcttcaaaaatccttaatttaaatctagaacagacagagcattgcttaggattgtgcacaacccaatctgcaggtcttcttgaggcagatcatgctgggactatgggtaaatctttccatgttggaaatgcttgttatggcggaatcatctctgcattccttgctaaaaatggttttactggaggagaatccataatcgatggtaaagaaggatttttaaaggccatgtccttaaaaacttatgaggattatttggatgcagataataatgatttagactatttaagaatttctaagtttttagaggataatttaggcaagttccatataaatgaggtttatttgaagaaattcccattttgcagacatattcactcttcaattgattcaactctctatttaaaggaatctattgttaattcggatgattttgattctttagattctattggtttggattcaattgattccattgaagtaaaaacctacaagatagcaagtgaacatgataatttcaatccaaagaatccacaggatttaaagcagtcattgccttatgcagtggccatttctctggttttaaatgatttaagtttagattcaattgatgaattaaaagatgatggtctttttgatgaaaagtccaataaggaatatgttttaaaaattaaagaaattatatcaaagataaatattatctatgacaaggatttggatgatttggctcctcaaatgcgtccttctcaagtgacaattaaattcaaggacaattcaagggatagcattaaacatactgtctattatcctttgggtgaagtggaaaatccattaagcgaagaggatattttagaaaagttcaagcttttaaatcctaagtttaatattgataaattacaaataattaaacatatggaagaatattcaattgatgagctttttagggagctagatttgattgattag

SEQ ID NO: 507 - DNA, 876 bp, Methanobrevibacter ruminantium
atggatgaaactaaaaattcattaaaagaattaggcattaatgaattgcatgatgattatgtgtcccaaaagcgatttgaagatggagggcaatataggtttgaagttccaggaattcaaggtccttctgcactcgagtctcttttaaatgcttgtgatgattttgatttaaccattcacagagccactcaaaccaaaggaataatgttcttattggatgaagagatagaagacatggttgatttggctgatgatgcaaatattcagttattcttggctgttggcccaagggctccttatgatacaagtgctaccgttcaaacagaagagggaaaaagaataggctatcgtcttagaggatataaaaaccttgtctatgcaatagaggatgttaaaagggctgttggccttggagttagaggcatcctattgtatgatgaaggcttgctctttgccctttctaaaatgagggagaatggagagcttccatctgaccttaagtttaagctttctgcacatgctggatgttccaatccagcttcagctaagttatttgaatcaatcggattgaattcattaaatccagttcgtgaccttcaaatccctatgttagcatccctgcgtgatgcaatagacattcctattgatgttcatactgaaaatccaaagtctacaggaggtttcatccgccattatgaggttccagaaatgattaaggtggcaagccctatctatctgaagactggaggatctgttgcaaagcatcatagctgggatacaacagaccaggaggctcgccaaagagctaaacaggttgctttaattagggacttgattgaaaggttctatcctgaggctcaaatgtctaaattatga

SEQ ID NO: 508 - DNA, 885 bp, Methanobrevibacter ruminantium
atggatttaattaaaaaagttgaagatgcagttgttaaggcaggaagcggatatagtgaagatagattaactgcatatgaaaacgcattaagactggaagaagaaaagggaaatgaaaatgcagtttgggctttagaacaaatgattgaaaactttaaagtagcaaaagaaaataagcttcccctatgtgatgacacaggaatccctcatataataattgagataggttataatagggagattcctaaaaacttttttaatgatattaatgcaggcatagcaaatggtttggataaacttcctggaaggcctatggcagttaagggcaatgatattgaaagaatcgagcaatcaaagggtttatatgccgagtccaatatgatgaaacctgcctcttttcttattgaagagaaggatgattccacttatggaagaaaaataggcatcgatgatgataagataagaataaatgtccttctagaaggtggaggtcctgaaatcagagctaaaacatatagggtttttcataagagagattcaaatatcgtatttaatgaagcactcagctggctaaaggagtctttgtctatgttgggttgcactccttcaattccagccattggcataggaagaagccacttcgaggcaaattcattgatgttaagggctatggttcatggcaatcttaatgatcaatcagatattgaaaaatacattgcagatgagttgaataagacaaatatcggtcctttaggccttggcggtgtgacaactgttcttggatcttttgtaaatattggatatcagcgagctagcggcgttaggatagttgcagttaggcctgcctgttttgttgaacctagagtttctagctttgaattttaa

SEQ ID NO: 509 - DNA, 849 bp, Methanobrevibacter ruminantium
atgagtgatgatcaaaagccttacaaaaatggtttcaagtttccagagcaaagcattagaacaaaaattaccgaagtaagtcctaaccgattatccactcgaggtttcaatcaggaggaccttattgagaatctttcctactctgagaatgtttttttaatattgagaggaagattgcctgatgagaaggaagctaaaatattcaatcacattcttgtttccttttgcgaccatggtgtcactcctccaagcacacagtctgcaaggcttatcgcctcatctggagcaagcataaacaatgcagttgctggaggattgctgtcctttggcaaaaatcatgcaggggcaattgaaaaagccatggctttgtttcaggaatcaatcagtggcttaaatttggaagagacagaccctgacgatgaaaacaagagaattgccctcttggccatagaaatcgtaaaccgctacgaaggcgaatcaaaaagagttcccggttttggccataggtatcatgataaggaccctagggcagctaaactgattgatttggccattcaagaatcagccattggtcctcatacaaaactagcccttgcaattgaaagcatcttaaatgaaaagaaaggaatttgcttgaatgttgacggtgcaaatgcaggtcttttatctgatttgggctttgatagtgacttaggattgggaatttttatgattgggcgtttgccaggtctcattgctcatgcatttgaagagatgcaggaggaagagaaattcagacgattctgcgatttggaaaacatagtctatgaaggttttaaaaataaaaggattgatgatggcgaagaatga

SEQ ID NO: 510 - DNA, 510 bp, Methanobrevibacter ruminantium
atggaattttttgatgttattgaaaaaagatacagtatgagaggttttgaagacaaagaggtagagcaagagaaattagataagatcttaaaggctgctcaaatcgctccaactggagttaacttccaaccttttaaggtaatcgtaattgacactaaaaagtataaggaagaattaaatgcaatctatcctccagaatggtttacacaagcgccaattgctctttgtgtagttgcttccaaggaaagggcttggacaaggaaattcgatggcaagaatattgcagacatcgatgcaacaattgtcatgacccatatgattcttgcagctgaagacttaggcctaaacacttgtttcattgctgcattcaagcctgatgaagcaaagaaatttttggcacttgatgatgaatgggaacctgtattgttcactcctttaggatatggaaatgcagagcctagagacactcctagaaaagcaatagaagaattggtaatctataaagattaa

SEQ ID NO: 511 - DNA, 315 bp, Methanobrevibacter ruminantium
atggcagggatatcagaagctattacccaaataaaaaaggctgaaagtgatgctgattccttagtagaacaatcaacagtcgatgcgaaagcaatgattgatgaggctcatgttaaagctaatgaaatggttgaagctgctaagaatgaagctaacgaagaagctcaatctactgtttttgatgcagaagaaaatgcaaagaaagaagctacttctatatcttctcaagctgatagcgatgttgaagctatcaagaataaggctagaaataatatagatgaagctgcttcaattattgttaaaaatattttatag

SEQ ID NO: 512 - DNA, 2007 bp, Methanobrevibacter ruminantium
atgtttagaactgcgagaatgcgtaagcttaatgttataactttggacaaatacgctggtcctacggtcagtgcacttcacgacgagggtattgtccaaataaatgatatttctgaacgtattcagcaagatcctaagctagcagaacttttgaaaccttcaaaagttacaccttatactggtaagctgtcctcacttcttatgaagacaagcgcactttccgatcttctcggagatgccctttcagaaggtcagtcccttaaggacacccttatgtctttcataagccccgatcttccagttcctaaagaagtcgaggatgttgatacagaaagctttatagcttatgctgaatcaacattaagccaggttgaggctgaaacaaaaggtattgaagataagttagccgcactagacagtgaagaaagtaagcttgaatcaaataaaagtttagcttctaagcttaaaaatctggatatggatttagctcttttaagcgattcaaagtatacttctaccattgttggtaggatcactgctgagtcagctcagaaattcaaaagtgaatacagtaagattacagaggatctcttttacgaattggttccagatgatgagaaggagtacaatattcttgttgttgtcgtagccaacgagtttaaggatgacatctataccttacttaggaaaaatgaattcgagaagtttgaaactgaggatttacaaggaagacctgacagtcttatttcctcttgcgaatccaggcttcaggctatcgaaagtgaaagatcccaagctaaagctgatttgaaagttgtagcagaaaaatgggatgatgaagttcttgctttaaaagaacaattggaaaacgaaaaagagaaaaatgaggttttcgcaacatttgctgaaaccgacaagactgttgtccttgaagcatgggtgccagagaaaaacctggagcaagctcaaagcataattgagactgctacagatggccacgtgatcatggaaacagaagaggttccagacaatgctgaagacgtacctgtactgcaggaaaactgcacatatgcaaaaccttacgaactattggttgaaatgtactctccattgaagtacaatgaaatcgaccctaccttattcgtagctattacatatccattcttcttcggtttctgtttaaccgatgcaggatacggtattttagttgcacttataggattcatcctctatagaggaatgggtaaagtcaacagaaccatgcacgatggtggtctaatcatcattgcaagtggtatatggtccattattttaggtctgtttaccaacggtttcttaggggacatgtggactaggattttaggtttaggacctgctcttcctacagttatcgattcaatcaatgcatttaagttcccagcaacaatcttggttattgctatcgtaatcggtatcatctataccaatatcggtttcatcttaggtgcaatcgacaacttaagatacggagagaagaaagaagcaatcggttctcaaatcgtatggtttgtatttgagcttggtattatccttctcatattaggattccttttcccaacattcggaatgattggaatggctcttggtgcagtattaatcattgcagctcttggaatgctcatatgggctaacggcgcatatggtcttatggatgtctttggatttatgggagatgtattgtcatacgctcgtctattggctctctgtttagctacaggtggtattgctatgaccgtaaacatcttgaccaatatggtaaatgacatgattccatttgttggtatcgttttagctattatcatctttattggtggacatattgcaaacttccttttccaagtattaggtgcaggagtaaacgctttgcgtcttaactatgtagagttcttctctcaattctatatgggtggaaaaaactcttaccaagcttttaaagcgaaaagacaatttactaaagttaaaaaataa

SEQ ID NO: 513 - DNA, 681 bp, Methanobrevibacter ruminantium
atgagctctggggcagataaaattgtctctaacataatgtctgaagctcaaggcaaggctgatgcaaacattggcgaagctcaagctcaagtcgatgcaatattggcagatggcgaaaaaagggctgaagccactaagcttaaaatctctgaagacgctgcaaagcaagcggaaatgagatatcagcaaatcatctctgaagctaagatgaatgctcgtagggcagaattaggggcaaaagaagaagtaatcgaagaagctttcaataaagctactgaagatttgacaaatatggcaaataccaacgatactgaatatgtggacgctttaattgaaatgattaaggaagcagctgtagaaatcggcggcggagacttaatcgttttattgaaaaaggaggacattcctaaaattgaaggtaaattagaacatatcgtaggtttaataaaatctttaatcaaacgtgaaaaaccttccgatttaaatgtgattgctaaagaagtttctcgtgaaactgatgttgaaactactttagaaattggagaacctatcgataccattggtggagctatattaagaacaagaaatggtgaaattcaagttaataacactattgaatccagaatgttaagatttaaaaaatcattacgttcagaagttgcaaaaacattatttgattag

SEQ ID NO: 514 - DNA, 318 bp, Methanobrevibacter ruminantium
atgagtgatgtcgctataattggggatatcgatactgttactggttttaaacttggtggagttaaaagaggtattattgtaaataatgatgaagaagctaaagatgctcttgatgagttattgaacgatgaaatttcaattattataattacacaaaagatagctgataacataagagaacatattaatagacgtcttggttctgatgtcttaccgatggttattgagataccagacaaatctggttcatctgaaggcggtgccgatcaaatggcagctcttattaagagagttatcggggtagagatggttaaatga

SEQ ID NO: 515 - DNA, 1755 bp, Methanobrevibacter ruminantium
atgattaatgaaggaaatattattaaaattgcaggtcctgttatcgtcgcagatgggatgagaggaactcaaatgtatgaagtggtaagagtaggtgaagccaagcttatcggagagatcattgagcttgaaggcgacaccgctaccattcaagtttatgaagaaaccgctggggtaaagcctggcgagaaagtggaaagtactggaggtccattgtctgtagagcttggacctggtgtaatgggttccatttttgatggaattcaaagacctttggaagtaattaaaggaatctccggagactacatcgcaagaggtattgatgtagactctattgacaaagagaaaaaatggactttcgaacctattgctaaagtaggagacaaagttgtaggcggagacattttaggacaagtacaagaaacatctgctgttgtccaaaagatcatggtccctccaatgattgaaggtaccataaaatccatagcttcacaggctgaatacacagtacttgaaactattgcagaaatagaaactgaagatggaattgaagaaattcaaatgttacagaaatggcctgtacgtaaaggtcgtccatacaaggaaaaattagacccggacattccacttattaccggtcaaagagcacaagacactttcttctgtttagctaaaggtggtgcagcagctattcctggtcctttcggttcaggtaagactgttacccaacagcaattagctaaatgggcagacgcagacattgtggtatatatcggatgtggagaacgtggtaacgaaatgactgaggtacttaccgagttcccattccttactgacccaaaaaccggaaatcctattatggacagaactgttcttattgcaaacacttccaatatgccggtagcagctcgtgaagcatgtgtatacaccggtattacaattgctgaatacttccgtgaccaaggttacgacgtagcgctcatggcagactcaacttccagatgggcagaagctatgagggagatttcaggaaggctcgaagagatgcctggggaagaaggttaccctgcatatctcgcatccagacttgcacagttctatgaaagggctggaagggtcatcacattaggtcaagaccctaaggaatcttccgttactgtagtaggagcggtatcacctcctggtggggacttatccgaaccggttactcaaaacaccctacgtatctgtaaggtattttgggcattggatgcatctcttgcagataagcgtcacttcccttccatcaactggttgcaaagctactcattatatgtagagagcattaccaactggtggcaagaaaacgcttcagaagaatggagagcaaacagggaccaagctatggtattattacaaaaagaatccgagcttgaagagatcgtacaattggtcggtcctgatgcattgccagattctgaacaagtggtattggaaactacccgtatgttaagagaagacttcttgcaacaaaacgcatacgacgatgtagacacttactgttctccaattaaacaagcaggcatgttagaaaccattcttaagttccacgaagcagcaagtgcagctgtaactcgtggcgcagatgtaaaggaaattgcagctttaactgttaaagaggacattgctagaatgaaatacatccctgaagatgaatttgaagcaagagtaaaagaaattcaagaaaaagttgtaacacaatgtgctgaggtataa

SEQ ID NO: 516 - DNA, 1386 bp, Methanobrevibacter ruminantium
atgaacgcagatattaaaacaagagaatatacaacagtttctgaagtttctggtcctttgatggtagtagaaggtgttgaaggtgtagcttataacgaaatcgtagaaattgaagctcctaccggagaacacagaagaggacaagtattggaagttaaagatgatgtagctgttgttcaggtattcgaaggtaccactgacttaaacaccttaaacactaaagtaagattcacaggcgaaaccgctaaaatcggtgtttcaaaagacatgatgggacgtatcttcgacggtactggtaagcctattgacggcggtcctgaaattatcccagaacaagaattggatattaacggtaacccaatgaaccctgcatcaagagaattccctgcagagtttatccaaactggtatcagtaccattgacggaatgaacacccttgtaaggggacaaaaattacctatcttttcaggatcaggtttgccacacaacgacttagctgctcaaattgcaaggcaagctaaagtagtaggttccgacgacgatttcgcagtaattttcgctgctatgggtattactcacgaagaagctaacttctttatgagagatttcgaaagaactggagcacttgaaaaggtaaccgttttcatgaacttggcagacgaccctgctattgaaaggattcttactcctaagatggcacttacaactgctgaatacatggcattcgaacttggtatgcacgtattggttatccttactgacttatccaactactgtgaagcattaagggaaatttccgcagctagggacgaagtgcctggtcgtagaggttaccctggatacatgtacactgacttagctggtatctacgaacgtgcaggacgtattgcaggtaaggaaggttccattactcagatgcctattttggtcatgcctcaagacgatattactcacccaattcctgacttaaccggttatattaccgaaggacaaatcgtattaagtagggatattcacaggaaaggtatctatccacctgtagacgtacttccatccctatctcgtttgatgagtggtggtatcggcggagacaagactcgtgatgaccacagtggtgtatctgaccagctttattccgcttacgcagaaggacgtaacttaagagaccttgtagcagtagtaggggaagacgctcttactgaaagggaccaatctttcttagcatttgctcaagctttcgaagatgagtttatcactcaagctaaagatgaagacagaagcattgttgaaactttagatcttggttggaaattattaactatattacctaaaacagaactcaaaagagttaaagatgaatttattgaaaaatactacccagaataa

SEQ ID NO: 517 - DNA, 693 bp, Methanobrevibacter ruminantium
atggcagaagaaatactagaaggtattaacccaacccgtatggagctacttgctcttaaagatagagaaaaacttgctgtaaagggtcacagtttgctcaagcaaaagagggacgctttgattaaggagtttttcgatatcttagacagagttaaaggtgctagggaaaacgctgaaactaaccttagtgaagcttacgaagcacttactgaagctcaaatcattatgggtgacttagctgttcaaaaggcagctttatctgttaaggaatctgttaaagtagatatttcttcaagaagtattatgggtgtttccgtacctattgcagatatggaaatggaatcaagaactttagttgaaagaggctacggcttttcagacacttcaattcaattagacgaagccgctaaaaaattcgaaacagcgcttaagtacatcattgaattaggtgaaatcgaaaagacaatctatcttttagctgatgagattgaatctaccaagcgtagagtaaactcacttgaacatattatgatccctagattccaagcaaccatcaagtcaatcaatatgaaacttgaagagatggaaagggaaaacttcgttagaatgaagatgattagatctactattgagaaaaacgaagcagaagctttagctaaagctcaattaaaagcagcaaaagcagaagaataa

SEQ ID NO: 518 - DNA, 2859 bp, Methanobrevibacter ruminantium
atgattagtctgtcttttgtttcggcttcatatgctctagactctaatcatttgggagaaaatgatagatcttgtcttaattcttgttcttctttaaaatattctttaggtgataataaaaataatgacttagataatagtgctgatttgaatagtttaaatcccaatagcaataattgcttaaattccaataaaaataattgtaattgctattgcaagaatcaaacagatcttaatgatgatttaaacgattcagataactgtcctgacagttttgctaaaaagacaaatattaatcatgataagcagttgaatgatggtgagatagatttctccgagcgcaataatcaaatcttcctgataagtcctgaaaacttcagtgttttctttgatgaaaataaccgcttaaaggaagattatgggggatgcacccttgtatttgaaggggatttcgctgagcttggcataatcgacatatcatatccttacactcgaatcactgcaaaggaaaactcattcaagaatactgcattcaagctttctgcatctgatatcgaactttccaatctaaacataagtttggataaggaatttaaagataacgaatatgcagggattttggttctatctgattacattagcatctacaatattaccctaaactatacggttccagccaatacaaacggattttgcatctacagcaaaggtgaaggctttagaagaatcactgatttgtccttaatcaacaacacaatcacctttacaggcaataatctaaatgaggcttgggattatggcattttccttgataagacagataatgccttggtttatggcaattcacttggttcatatttgccattatgtgaagacaattggtataataatgaatatggtgctgtcagcaagatgtccagcgctggctttgtagctcaaagctgtaatgatctaaagctgtccagtaatgaaatcaatacctatgttacagattccacccaaagctcatttgctatggattcatgcatattatatgattgcagtgaccttactgtcgaaagaaacactctttatctggaggacattgacagtcaggacggcaagaacaataccttgcatggatttgacttgtatctatgtgacgatgcgataattgccttcaacaatatcgatcttttcacaatgggaggcaatgacgggagaaaaatcacatctccattgcaagtgaacggaccatcagacaatatcagaattgcatataacaatattacaagttctaatttcggttctaactgtggaatatattcccataacttctatggggacacacaccttgaaattataagcaatttcattgatgttgcaggctttgcaaactctggagaatggtcacttctatctggaattgaagtccaggattcagatgacgtaatctggaataatacaattatcgtaacaaatctaggtgatttcaaatataataacaaggtctatggaataagctattcacaaaataggaacaactataactctacattcaatgtccaatacaataacattacaacaaatggatattatgctgtatatttaggtaaggatgattatcctgttgtaaattcaaccgttaagaacaatgtattgaacacttatataaccggaggaaatccggcagtgtcaattgcaaatgataataaaaacaatcctatcgtaaacaatacagacaatgagtttaaaaacatctttaaaaatagcagttttcctaaatggcttaaaaacttcttgagacaggacactaaagtggacaaggacttttcatggattacagatgctataaatcctcaatcaaacggcactggattttctaatgacactggaaatggcacagggataatagataatgatggtagcgacactgtaggaaacaattctgaaggcagcgattctatcgttaatggaagcacttccgctaatggaacaggcaatggaacttctggaaatgccacagaaccacaaaatccgattgatgacaatcaaggagataattctggaggctcaagttccagcgacaattccacaggaagccaaacagataacgaggattccaatcagaacaataccgaccctactgactcaaaaccgacaaataatacagatgtcccagtgaatcctacaaacactagcgataagccagttaacagtacagaaccggtccccgctaatgatacagagccagttccagcaaatgatacagagccagttccagcaaatgatacagggccagttccagataacaagactgataatccagttaacaatacagaaccggttcaagaggatgctaataaaaccgattcagataatactgaaccaatcaacactacaaaagacaatagcactgaaattatcaataagacagaatcagatgatgatactaaccagactgtgttaaaagacgatgatttggatcctaaagaatcacacgaaaattctcaagatgacaataagaatccaagtgatgatgaagagaaatcaacacctggagattctggaaatgagttaacagatcctgaaagcaattcagaaagccctcaaaatcaagaggaaaactcagagaattcgaatgatgattctagtgagccttctagttctacagtcggcgattcacattcagattctgcttccagtccaggtcttagtgatgcttccagcagcaagaatgcatatgaattggataagcctgtagaggatttagttacaaaatctgttgattatatctcacttgcgggaatctgcattgttactttgttattaattttattcggttataaacgtcaaaaggatattgaaggagaagactag

SEQ ID NO: 519 - DNA, 639 bp, Methanobrevibacter ruminantium
atggttgacgtgggtggaggaattctaacttatatcttagacactcttagtcaaagtttacagattccagtaatcatattcttacttatattcgctgttggagcaatcatccttttaggaggcctaatcagagaatatagtcatagaaagaccatctcagatgctgaaatgagaaatattattgatgcaatcaacaaggctaatgacaaatctgagattttatccattgtagactcttcagatattccaaactctcaaaagactgttttaagagagattacagattctgactgggacaatgaatcaagagtgggccttgctaaaaagcttataagttcaagagaaaagagactcgaaaagcgcttgtcatacactgacataatcactcgtatcggtcctacattagggcttatgggaacactcattccaatgggtccaggacttgctgcacttggtacaggagacgttgtaactttgtcaaatgcaattattgtagcatttgatacaactgtggtaggtatcggttcaggtgctcttgcatatgtcataagcaagataaggcgaagatggtatagcgaatacattaacaatattgatgttttaactgatgtggtattgaataagcttaataaattataa

SEQ ID NO: 520 - DNA, 1323 bp, Methanobrevibacter ruminantium
atgggaaaattatcattttcagtagctcaaaggttcggcaaaaagggcacagcccttccaggtaaggttgcattgaaattcaatcctaatctgcttgaagaactatccaaaaaatgtgataagatagtctttatcacaggaaccaatggaaagacaacatcaaacaacctttcaacacacgttctaaaaggagggttcaatgatgtcctctcaaatctgaatggttcaaatatgattcaaggagttttaacccctttcattacagattataaggattcctatgacgtaggtatttttgaagttgatgaaggctctgttccggtagttagccaattcatgaagcctgattatttcataataaccaatttcttcagagatcagctagaccgatacggtgaagttgaaaccacaataaagatggttcatgattcaatcactcctgaaactgttctaataattaactcagatgagccatccttgcttagattcgatgaccttccaaataagaaggtatactatggaataaacaagacaaagtttgcacaagatgatattgatgttgcagagtccattttctgccctaaatgcggaaacaggctaagttatgagtatatctattatggaaatgttggaaaataccactgtgacaagtgcggcatagaaaaccatcctgcagactatttcattgaatctgcagacctaatcaatggctcctataattttacagtattaaacgacaacaaaagagaggaatacactctcaatctgatgggcctctataatctatacaattccttgggagtgataagccttgctaaggagataggccttgactacaatctaattaaggaaagaataaacaatttcgaatacagattgggaagaatggaaactttccactttaaaaataaggaccttgttttggtcctctctaaaaaccctgtaggcctttctgaagtattcaatacaataacctatgatgaaagccaaaaatcagttatgtttatcttaaacgactatgctccagacggaaaggacgtatcatggatttgggatgcaaatttcgatccagttaatcacatccctaatatggatgcattctattgtgtcggaacaagagcagaagaccttgcattgagattaaagtatgcaggagtggatgaaagccttttaaagatatatccggcaaaagaccagtttgacataaacgaggcagtcgatacaatatcaaaggaaagcacaaaggcttatgtgataggaacattcacagcaatgcctgaagctcgtaaaatcctagtaaaaaaagaacaagaaggtttttaa

SEQ ID NO: 521 - DNA, 777 bp, Methanobrevibacter ruminantium
atggataacttagaattaacagtaatgaatatgtactccgatattttaaatacatacggagacataggaaactttagatgcatcaatcaaagaatcagatggagagacatctctttaaacattcaggaatgtacaatcgacaaggatgatgactttgaatgggaagacatcgacataatcctaataggtggaggctcagataataaccaatccattgtatctaaccaccttctagagcaaagaaaagatcttgtcgagtttattgaaaatggaggagtccttctggccatttgcggaagctatcaaatgttcggaaacaaatacctagatgtagacggcaaggacataccttgccttgaagtctttgacatagaaaccacaagccgtcctgatagactaataggggatattgtaatatccaatgccatcccagattcaaataatgtattaaacaaggattttgatttcaaattgaaggatatggttggatttgaaaaccatggaggcagaacctatcacaaccacgaccctttaggccatgtaaaggtcggattcggcaataatggtgaagacaaaggggaaggaatggtatataaaaacttcctagcaagctatttgcatggtcctttcttgccaaagaacccacacattgcagattatatgatattcaatgctttaaatagaaagtactcaattacagagataaaagacctaaatgacactattgaaattagggcacatgaaagaatgttaaaacgtttattgaacgataaatag

SEQ ID NO: 522 - DNA, 1287 bp, Methanobrevibacter ruminantium
atggaaaatttacttattatgggaattaatacaagaccaatggttaattctgcattgaaattggattatagaacatattcagtaagttattttaagacttatgatttcgttagcccatataatgaaaggcatgttttagaccaggaatctgtagactcctgcggattctttgaaaggaactactctcctcaaaagctattggatttatccagggaatatctattcgacttatctaaagaacacaattcaaaaaagcaagataatgaaaataatgaagatatcgatgaaatcgataaaatcgtacttataactggaatacatgctgatgactttaaaggggaattttccagattcaagaccaagattagaggaaacataaatacaaaggatcttgatgataaatttagattctatcaaaaaacaaagaacaaatttgatgttcctctaacttttaaactaagtgatgtagatgaactaagagatattcttaaacaatacaataacaatcaatttattttaaaaccccttaaaggaaatggtggtttaggaattttccttatagattatgatagcttaaatgaattaaataatagcaataatcctttggaaaatatttcatttgatgactacatattgcaggagtatattgagggcacaagcatatcatcttcagttcttggaactaatgatgattgcgttaatctctttaattcaagactagttacagaaaatgatttaggaaatgataattttgcatatagtggaaacattgtgccattggatgtgaatagctttaactgttttaatgaatcttttaaaggattggggattgattcaaagcaattaaacaaagagatgaaagagatttccgaagacctgattaggcaattccgattgattggatctaatggagttgactttattttagatagggaaaacaatctaaaggtcattgaaatcaatccaagacttcagggaacttatgaattatgtgaagagataatggacttgaatcttcttgatgcacacataaaggcatgcgaaggagaattggtggaagttcctaaacttaatggcagatatgggattaaaaagattatttattcatccaaacaggttaaaattggtaatttgagtttatcaaatgtctatgatgtcccttatgaaggagttaagatagaggcaaatcagcctattgttactttgattgattcaaataaggatttgaaaactgcaattgggaatataaatactgcagaagagttggtttataaaaatatctattag

SEQ ID NO: 523 - DNA, 981 bp, Methanobrevibacter ruminantium
atgaacatattttcaactgaagaaacatattatggcactagaaaagactctccagtactgctgccttcatacaacgaatatggagacaagctccatatcaaggacgtattcgattttgaagagatgctggaaaactacatcatcgaaatggaaattagaaactattccgaaaacactgtaaagacatacagctccatcataagaagcatgatagattatatgagctcagaggaaggagtctacgatggaagaaaattcctagcatgctttaaaaagtatataagagacctaaagaaagaccaagacgtttcacaaaactacatatacctaaacacagtggtctgcaagaagttccttgaattcaatgacatctattttttagaggatgttcaaaaccctaaaagaacaaagtcactccctaaatccctgactgaaaaggaagtgaaatcacttatcgatgcagttcaaatcaccgatgaggacagcgaacttaagaaaaaagccaaaatgagagacaaggtcattcttgaattcctatactctacaggacttcgtatttcagagcttgtcaagctgcaaaaaaaagatattgactttgatgagaggacaataagggtaagaggtaagggagaaaaggatagaatagttctttttgacgaaaatacgagagatttgatagataattatatagaaacacaaaaccagaagtcagaatatctattcatcaacaagaacggcagaaagctaactccaagatatgtccagatgatgataaaggagtatgcagaaaaagcgggaatcaaaaagaaagtaaccccccatgtcttaaggcattcatttgcaacacatcttctaaagaatggagttgatataagggtcattcagcaactattgggacactccagcctttccaccactcagatttatacaaacgtagatatggatacaataaaatccgtatatgatcatgcaagagagtag

SEQ ID NO: 524 - DNA, 1338 bp, Methanobrevibacter ruminantium
atgggaaaaggagtagaattaactacaactaaatatcttattcacgctcaaattaatgccaacggaatcgtagaaaagcctgatgttgtaggtgctgttttcggacagaccgaagggcttttaagtaacgatttagaccttagggaacttcaaagaaccggaaggataggaagaatccaagttatcattcattctaacggcggacgtgcaaaaggtgaaattgtaattccatccagcttagatagaatcgaaaccgctatccttgcagcatctcttgagaccattaaccgtgtaggtccttgtgaagcttccatagaagttcttagggtagaagacgtaagagctgtgaaaagacaacaagttatcaatcgtgcaaaagaaatttatatgggcatgatggaaactgtctctcctgaaagcatgaaaatgattgaagaaatcagagaatcaatgagagttcatgagatctctgaatttggagaggaaagacttccagcaggtccaaatgtacatacttccgatgcaatcattgtcgttgaaggaagaaatgacgttttaaacttattaaaatatggaatcaaaaacactgtagcagttgaaggagtaaacattccaacaagcgttgcagagcttactaaaaaaagaactgttacagcatttgttgatggagaccgtggcggagagttaatcttaaaagaactcttgcaagtgggagaagtagattacattaccagagctccaagaggcaaagaagttgaagacttggaaaaagaagaagtcttagtggctttaagagacaaagctccaaccgaacaggtaatcaataatcttgacttcaatctagacactcaagcaaaaactccaaaaaacaaagtaaacagaacagacagaagagcaaaaaacttcaataaatctgacaagttccatggaaataaaagaaacgatcgtaaagacaaattcaatgacagaaaagacaaaaacggaaaaaacgatcgcagaggaaaagacagaaattctagaggtcgcagagacagaggcgacagaattcctgaaagcagaatgaagttattaaagaacatgttaagagacttagaaggaactggaaacagtgaaatcttagatgattctttaaacctcttaaaagaaactaaagtcgaaaccctttatgaagacttaaaagaagacatcccagatgctgatacaattatcttcgatggagtaatcagccaaagattagtggatattgctcattcaaaaggagttaaaacattagttgcttttaaatccagcagagtaattaaaagacctgacaagctcaaattaattactttaaactaa

SEQ ID NO: 525 - DNA, 756 bp, Methanobrevibacter ruminantium
ttggaaggtgttattttggcaaagattaaacctaatgatttattgaaaaaaccatcaaagatagaaaaaatggaactggatcagattgacataagcaaataccaattttcaatagatgatttggagggtaaggacagttccaattacattttactcaagaagattcttgattcaagctcttcatgtcaagtttccgatgcatatgcctctgtatccggacgcagcggagtacttgatggattaaagccaatgaatagaaacaaggtctatggtagggtttttacagctaagaccaatacaaacgattggggaacttccttgatggctatggacaatgcgagccaaggagaggttctattcatctacagctatggagataaggcctctgtttggggagagcttgcttccacatgtgcaggtgagaaaggaattgctggaacaattctttatggttatgcaagggatatggatgctctaatcgacttggattatccagtatacgctcttgactattgtcctaatgcaggtaaggctttagggcttggaaaggttgatatagtgcttgaaattggtgaagacataataaagccaggtgattttgtatttgcagatgagaatggtgttgtattgattcctcaagagctctttggagagactatggtggcaacattcaatgtaaaggtcaaagagagctttattattaaggagcttaaaaaaggcagattattgtctgaaattattggattggaaagatag

SEQ ID NO: 526 - DNA, 363 bp, Methanobrevibacter ruminantium
atgaaatttttaggaaatatatcacaccttgcaaattctggaaagcttatcgccaagtcaagccagactccacctgctggagcttttgtttttactaatgataaacagaaaataggtaaggtatataatatctttggcccagtgaagaatccatatatctctattaatctttacaggtcagtaaataaaagagatcttgaaagtagacaaggtgaaaagctttttgtttctacaaaaagagagatggaaaaagataagaaaaagaaaagaagcaataaatctaaaaaaggcaaatattctaaaggcaaaaacaagtctaaaccatctaagaaaaagagatccaataaaaaatctcgcagataa

SEQ ID NO: 527 - DNA, 795 bp, Methanobrevibacter ruminantium
atgggtcctgaatggagagcatttgaccatgaacaaagagacaaacgtacaagggtaggcgctccaattacttacacaattcacgataaaggattaagtaccatgatcgattggaggaataaggacatctatggtagagatattcctgcaagaaacagagctcaatggtatcgtttaagaaaatggcaaaggaaaatcagaatttccggtgctaccgaacgtaacttggcttttgctttaagtgagttagacagagactcttccagattaggtcttccaagaagcgtaagggaagctgcatctgttatttacagaagtgcagttgaaaacaagctcattcgtggtagaagtattgaaggtgttgtagcagcttctttatatgctgcatgcagacaatgtaaagtccctcgtactttagatgagattgcagaggtttcaagggtaagcaagaaggaagttggaagaacttacagattcttgacaagagaattacacattaaattgcctccaacatctccagtggactatgttcctagatttgctagtgaattaggcttatccggggaagttcaatcccgttccattgaaatcattgaaaaggcaatggaaaaaggtcttacttcaggaagaggccctaccggtgtagcagcagctgcattatacattgcatctgtgctccttggagaaagaaagactcaaagggacgttgctgatgttgcaggagtaactgaagtaactataagaaacaggtataaagagctaactgaacagcttgagacgggagttactttatag

SEQ ID NO: 528 - DNA, 327 bp, Methanobrevibacter ruminantium
atgttattatcttctacaagtactttagaaagcaaaaccatactaaaataccatggattggttagcggcgaatcattaatcggtgccaacatctataaggatctcttctctggagtcagagatgttgtggaaggaaggacttcaacttatgctgaagaacttgacaatgcaagaaatgaagcaattgcaaccatggaagaaaaggctaaggaatatggtgcaaatggaatcataggattgaaaatatcctataacaaccttggcggaaccatgggaaacaccattttagtaaccgtttatggaactgccgtaacttatgaagactaa

SEQ ID NO: 529 - DNA, 189 bp, Methanobrevibacter ruminantium
atggtagaaccacacaaacattgtccagtatgcggtagtccaataccaatgaaagaaagagtatgctctccagactgtgagaaagtattagaaatgaatcagaaaaacattagaaaaagcagaatcatgttatttgctgtgattgttgtctttattctcgtatgggcatatttcatgttctttaaataa

SEQ ID NO: 530 - DNA, 795 bp, Methanobrevibacter ruminantium
atgaccggattaattgacataggccttaatttgatgcacagatcatttgataaaaacagggaagagattatcaataatgcaatatccaatggagtgagccagtttgtaataactggaacaagcgttaaatcaagcaagattgccttaaactatgcaaaggatgagaaatggaatggaatactcttttcaactgcaggggtacaccctcatgatgcaaagacctgcaatgagaaaacccttgatgcattgaaggaatttgctaaaaacgattgcgttgtagccattggagaatgtggacttgactataacagaaactactctccacaggatgttcaaagggaatggtttgaaaatcaggtgaaattagcccaagagcttgacatgccattgtttctccatgaaagggaagcccatgaggatatggttaagattttatcaaaatatcctgagatgtgcgagaaggcttgcgttcactgctttaccggaacaaaggaagaggcagaaaagtaccttgaattgggatgttatattggagttaccggctggatctgcgatgagagaagaggacagtcacttcaggaagctgttacagtcattccacctgaaaagatgatgattgagactgatgctccgtttcttattccaaggaactttccaaaaaagcctaaatcaaataagaacaagccggaatatttgcctcatatcctaaatacaattgcagagtataaggaatgtgatagcgcagagctaggtgaggctgtaagcaagacaacaagagagtttttcaagatatga

SEQ ID NO: 531 - DNA, 678 bp, Methanobrevibacter ruminantium
atgagaattgtagtggctattggcggatccatactattaaagacttatgatgcacaaagatttcaagagtattcagacattctaaaggacttaagcaatgaacatgagatattcattgtagtagggggaggaaaacctgcaagggagtatattggagttgcacgtgatcttggagccggagaggcaaaatgcgatgaccttggaatagaagtcacaagagtcaatgctaagcttctattgcttgctcttggagactatgcttatcaaaaggttcctcataactttaatgaagctcaggaatactctgcaagcggaaagatagttgttatgggaggaaccgaacctgcacacagtacagatgcagtatctgcaatattagccgaattcgttcaagccgacatgcttatcaacctaacttcagttgacggaatgtataccaaggaccctaataaattcgatgatgcagagctcatttcagagattacagctacagacatgatggatttcattagaaaccaggatgtaaaggccggaacatatgaattctttgactttactgcaattcaaatgataaagcgttccaatctagagactgtaatagccaatggattcgaacctcaaaacctaatcaaagcgattaatggtgaaaagataggaacaagagtcatatctgattag

SEQ ID NO: 532 - DNA, 7728 bp, Methanobrevibacter ruminantium
gtgagtttaaataaacttaagattggtagagtttttatttgtctttttattttagtttttatttcttgttcaattaattgtgtttttgcagttgatgatttagctttcaatgatacatattattctgatttagattctgttaatggggattattcaggttttcttagtgaaggagactttaatggaggctcttctgtggttgttgatggtgaaattgactcctctccaattgccaataataaaaagaattcttcatttgcccttactagcaaaaaggattcatcttcaccttctatttccacatcatcaaaaaacaataaaaacaataaaaacacttcttctttaaaggaaaacaagaccgccgccccatcttcacaacgtgtattttatgaccgcgacatagtgtctgatgaagatgtaatcggacctggtcatgaaaacttggactggattaacctaacacatgtcgacgacagcctattttcagataattcaaaggaagatggagcaaaaggcagcaagattgccaccaccattgtcgcaagcaacctagttaaatattatctcaatgccagccaactaaatgtcggcttgaaagactccaacggcaattacctctccggaaaaacaatcaatttcacagtaggcagcgcttcatacatacgcaccaccaactcatcaggcagatgctccctaacaatcaacctaatgcctggcgtctatactttcacaatcagattcctaggagactcctcatattccccaagcagcaaaaatgtcaacgtcacagtcctaaagatgcccacaagcatcacagcaagcaacctggtgaaatactatcacaattcaagcagcctaatcgccacattaaaggacacacatggcaaccccctatccaacatgacagtaacattcaaaatgggatcaaacaactataaccgcaccaccaacacaaacggaaaagccacactagcactaaatatgatcccaggaaacttctccgtaaaaataagcttcacccacccaagatacataacatccagcaaaaacgtaaccgtcacagtcttaagcatgcctaccagcataagcgcaagcaacctaaacatgacctatggagacggcagctacctaaacgccacattaaaggacgcccataacaacccattatcaaacaaaacaatccattacaaactaaacaacaccatatataaccgaactaccaataataacggtcaaacatccctaataatcaacataaaccctggaacttaccaattcaatatctatttcaacgaaaactattaccaaaactccaataaaacagccacagtaacagtcaacggcatacccaacagcataatcgccagcaacctagtggcatatgtcaacgaatcaccaactatagtcgcaaccttaaaggacgcaaacaacaaccctttatcaaataagaatctgacatttaacagaacaggcacactaacaaacatcttaaccaatgccaacggccaagccacatacaacctaaacggctgcacaggcaatttcaacataaaaatcacattcaatacaaccggctacgcattcagcagtaaaacagtaaatgtaaacataaaattctggccatccacaatcactgccaatggtgccacaacatactttacagacacagtacagctctcagcttgcctaaaaggagaaaacaacacccctctagcaaacaagaatgtcaaaatcacatatgccaataagaacataactcgaaccacaaacagcgcaggaaatgtctattatgactttaacgaaaatgtaggcacttacaatgtaaactttagctttaaagagaactattaccaaaatgcttcaaaaacagtcacagtcacagtcaataagatgccaaccagcatcactgcaagcaatctaaacattacatatcaagacggcagcagcctaatcgcaacactaaaggacagccacggcaacccaatagccaacaagacagtcaatttcaaaatggaaacaaacaactataacagaactacagatgccaacggaagggcaactctagcattgaatatgattccagccacatttaatgtaaatatcacattctcccacccatcatatcaaacatcaagcaaatcagtaacagtaacagtaaaccctatctccaacagcataatcgccagcaacctagtggcatatgtcaacgaatcaccaactatagtcgcaaccttaaaggatgcaaacaacaatcccttatcaaataagaatctgacatttaacagaacaggcacgctaacaaacatcttaaccaatgctaatggccaagccacatacaacctgaatggctgcacaggcaatttcaatgtaaaaatcacattcaatacaaccggttatgccataacgtcaaagacagtaagcgtaaacataaaattctggccatccacaatcactgccaatggtgccacaacatactttacagacacagtacagctctcagcttgcctaaaaggagaaaacaacacccctctagcaaacaagaatattaaaattacatacggcaataagaacataacccgaaccacaaacagcgcaggaaatgtctattatgactttaacgaaaacgtaggcacttacaatgtcaatttcagttttaaccaaaactattatcaaaatgcctcaaaaacagtcacagtcacagtcaataagatgccaaccagcatcaccgcaagcaatctaaacatgacatatcaagacggcagcagcctaatcgcaacactaaaggacgcccacggcaacccaatagccaacaagacagtcaatttcaaaatggaaacaaacagctataacagaactacagatgccaacggaagggcaactctaacattgaatatgattccagccacatttaacgtaaatatcacattctcccacccatcatatcaaacatcaagcaaatcagttacagtcactgttaatgagatagcaaccaatcttgcagtaagcaatctaaatatgatctatatggacggcagtcatctagccgccactctaaccgatggcaataacaatcctttagccaataagacaatcatttataccttaggcaatgtaaattataattacaccactaataatagcggtcaaaccagcttaatgattcatttaaatcccggcacttatcagtttacagtccagttcagcgaaagtcattaccaatcagctataaaaacagtgacagtaactgtaaaccctatttccaatagcatcattgccaacaatctgcttgcttatgtcaacgagtccccacatattcttgcaagcctaaaagacagcaacaataatcctataatcaataagactttagtatttaacagatcaggcaacataactaacatcataaccaatgccaacggccaagcaagctacaatcttaacggatgcactggcaatttcaatgtgacaatcacatttaatgccacaggctatgcattcagctcaaaaacggtaaatgttaacataaagttctatccatcaatcatatcagctaatggtgcaacagactattatggcaataccattcatctgtctgcatctcttaaaggagaaaataacactcctcttgcaaatagaactgttcatatttcttatgccaataagaacattacccgcacaacagacagtgcaggcaacatctattatgattttagagagattccaggaatctataatgtctgttttaattttaatcagaattattatcagaacgcttcaaaaacagttagcgtagttgtccttaatccgccatctcctaatgttaatgtaagcagcggtttttataatgtctcttatttgctaattaatgtgtcctctaatatttctggaggaattttatattctagtttggataatggaaccacttggtatactggagaagacaatatctgtttcaatttaacagaaggcaattggtctgtctgttcttactattctttaaatggtttcaatagttctattgtttataataattttattattgatggtagtgctcctttagtttgggcaagcaatggatctgggttttataaacgttctttagatgttaatttaacaagtttggatattgtagataagaatcctgtcatatattacactttggacggtagcttgcctaataatctaagtgctatttatactggcccaatacatattaccagtaattatggcctaacaaaattacagttctatggtgttgatagatttggacataatagttctattgtttgtgtgaattatttccatggaaattatgtggctaatttgaatagtggaaaatattttgatagtgtacaagatgctattgatgatatggacactataaatggtgatgttattgaagttaataaggatttatctggagcttgtgatttgaataaaagtgtctatttgcgctcttcatgtctaaataattttacttggagtcagccgaatatagttattcatagcaataattctgttattgagggttttgattttgatggaagttctatgcattctgttattttagcaggtgtttctaattgtgttataatgaacaatagattttccgttgttgaatatggtatttggtcttccttaagtggttataataatgttattatgaacaataatttttcttcttatggtttgtcaatttcattcatttatttgtctcctatatatggtggagagaatacttatctaattaaagataatatttttaatcattcacgatgtggaatatgcttagaatcttctttgaattctattattagtggcaatgttttcataggttctaattatggtttaaaaattaacggaaacaataattccgtagtttataataatttaagttttaattcttatgcggtttgttgttttggagacgataatacattaatgtataataatattgttaataatgtttatggaatttatggagattattcaaacttgactgtaaattttaatcgtttttataataatagtgctttcggcctttatgcatctggaggtccaattaatgcttgtaataattggtggggtcataataatctttctgtaagcgaggattatggatttgatatttgtcttcaaacagacaatattgactatagtagttacataattttaaaaaattacaaatcctattttgaattaagaaataattttatagataatgtttcttgtgttgttgatttaaattggaataatttaaaggagtatgtgggagagtttattgatggggtaaatgttaagtttgttgatatgaaaacggggccttatcctcattggattgctattgaatctggtcaagcattatataaaacttcatgtgtaaatcaggttaataatgttattattagtttggatgatgagattcaaactttaaattattccagtttttcctcttcggtaaggttttatataaacactacaggtttcataagcaataatagcggaaatttggataattttgttgcgaacgaaaatggatcttattttacttttgatgttattttagatcatgatgtcgattgggtcagttatgtttggagaaatattggtgattttaaatctgaattggacttgattgttgatggggatattgtttccacatcagttgtggagagttcattttataggaataatttaaataatatctcaagcaatgtttttgatgcaatattgttatataatgattggtattatagtcgtttaaattgggctaaggcagttgtgtatgtttatctttctttggagtataatactactgatcttaatgatgttcaatacatttatagtaatgttaattggggatgtttaagtcctgaaaggaagaatcaactgttaaacgatcataatattacttttaatgatgcattatggaatttaatacagaactcctataacttgtcagatgaggatgtgatttttattaaaaatcatcataaatctttcaatgattctgtttgcgtttctgctcattattatggaaatgataatgagataataaatttaaataatataaataataatacattagcttattccggaggtatggtaattggctcgtggaaggcacctattatgtatgttgatggttcttatcaacattttataggtaataactcggacaatagtacggatatttttacttattatcataattatgggaatggcagtattgattgggcttattcaactaattatggtaatttaactaatggcacttatgatggcttgatgacttttacttttgcaaatgataaagttaatggcagtgttttaaatcattatttaagtgagaaaaatcgtactgatgttaatggcagtctggtttattccaatggttttatgaaagcggcatatggcagctttcttgaaggtttgttggttatctatatggatgatttggtggcagatcttgtttcttcaagatataatgcctcttgggaaagggtcagtcctatggttatgagtgttagagatgaccatggcaggctagtcatgagcggagagtctgatttttattttggccgtaagcttttatgtgatgatgagaatataatcaagagcttttatttcgcttgttcaagtgttttctcttccattgaacattatgttcaccaaactttattcccagaccgtatagggtatggtgttacagttgatttgggccgtcttttagctgatggtgaatgtctttctattgttgatgaaggtcgtttcatttatatctgtcctaatgaatctgatgagatttattatttgtgctttgataaattgactggaatcttgatggatgcctccatacttggcaatgatgcttattgctacagtaatcaacagacagaatgggcttttacattaggggaggagctgatagataattgtgatttgatttgggattatttaaatggattggatgtggatatttgtgctttgaatgtttccacacaagacatgttaaaggtttgttatggattcaatattctatctgatttgtttacctgtgctttattgtccgaagtaaatattctaatagaatctattggtttggaggaatcttttaatgccattgttcctttagttggagtattagtttcttctttggagaatattggatcttatgttttagatgaatacctgtctaatcctaagtttttaagcggtgttgtagggggcttattatttgaggctggaatgatagctacatgtacaggtgtaggggcccctgtaggcttggctttaatgggtgctggaacaatatgcacagcatatagctcaggattaatagattataatgacaatgatgggatttacttcaacaccactcttgaaaatcaggccaatttcggattttcaatgtcctgtaatcttattagtggaggtattgggggtttagcatcttcttctgcttttaaagctacagggtctgaagttatacaaattgcaagtaaaaatgctgtaatagactcaaaaggattttatacaacaactatttctactaaatatgttgcatatgaaggttcaagtaatactgtaagtagatatgtgattaatcgaatggtaaattctcaaaatccttctaaaaaaatctttattttaaaaggatgtaggaatattttagattctttaatgcaagattgtatatgggaagaaagaaataatcttttaataaagtaa

SEQ ID NO: 533 - DNA, 567 bp, Methanobrevibacter ruminantium
atgggagtattagctagtgttgctggaggcatattttttgaagcaggcatgattgctacttgtacaggtgttggtttgcctgtaggtttggctttaatgggtgtaggtacaatttgcactgcttatggctctggtttatttggcatgacagacacgggcaatttctattctaatctaactgatgaaaatttagccgattttggcttttcaatgagtttaaatctcattgggggagggtatagtgcagctgctgcgaaatctacattaaggactgtaggaggtaaatcggttcagatttccatatctaaagcggcatttgcaagtgaccaaagaggtgcatacaccacttttcatacaattagttctaaaacatatattcaaaaagttgaaaatggtgcattcagtaactgtggagaatacttaatagaacaagaatttggaacaacagtaattgaaaatataagaaaatcattaagagttttatcaattgattatgctttaaatttttgttatgattttcttaaagaaaattatataaagagcttagatggaggtttatatgtataa

SEQ ID NO: 534 - DNA, 168 bp, Methanobrevibacter ruminantium
atgaatgctgcttatggtagttttcttgagggtttgttggttatctatatggatgatcttgttgctgatgctgcaggggagcgttataatgtcaattggacacgtgtcagccctatggtcatgagcgttcatgataatataaaaggacatatcttacccgggaagtga

SEQ ID NO: 535 - DNA, 1245 bp, Methanobrevibacter ruminantium
atgagtgaggtatcctcaaaggaattatatgagtttaagaagacattaaaagaactcgcagaaaagaaaggaaaaggaacagaacttgtttcaatgtatgttcctccagaaaagcaattaagtgatatcattaagcagatgagagacgaattaggacaaagcgctaacatcaaaagcaaatccacacgtaaaaacgttcaatcagctattgaagtaatcatgcaaagaatccgtatgattacaaatgaaaacaaggatctccctaacggttttgtgctctttgtgggaatgattcctaaaggcggtcccggcactgaaaagatggaaactgtagtaatcgaaccgccggagcctgttcaaacctattggtacatctgtgacagcacattcttcctagagcctttggaagacatgattgcttcaaaggaagtctatggtattgcagttatcgacagaaacgaagcaaccatagcaactttaaaaggtaaaagaattaagattaccgctcacttaaccagtggtgttccaggtaagcataaggcagggggacaatcacaaagaaggttcgacagggtcatcgaacaattggctcatgagttcttaaagagaatcggccagcatatggatgacgacttccttccaatcaaggatgaattgaagggaatcgttcttggaggtcctggatacactaaagaggatttctacaatggagactatatgcattatgagcttaaggacaaagtcatcacaactgtagacacttcctacactggagaatttggtattagggaaaccattgataaggcttcaggtgcattggaagagttaggtgttataaaagagaaaaaacttgtccaaagattctttaaggaacttagagatgacaacggcctttattcctatggtgaaaaggaagttagaacaaacctccaaataggtgctgtagatattcttcttctctctgaagaccttaaatcaaaaagattaaccttagattgtcaggcttgtggattccatgctgaagtaacccaaaaggaaggtcaaaaagtagaggatctaacctgtcctcagtgtaatgataagatgaaaatcacaaaagaagaggatcttattgaagacctttcaaatattgctgaagacttaggcactgaagtggaaatcatttcaactgaaaccgatgaaggtatgcagttatatagagcatttggtggtatagcggcgattactaggtataaggtaaactaa

SEQ ID NO: 536 - DNA, 654 bp, Methanobrevibacter ruminantium
atgagtgataaagaggtttatggcatagtattgtctcaaaagttaacaaaggacaatgtaaatatgggagttgtcatggggaccgagaaatttacattgaaaaggatagagcttaatgaagatgtgagattaaagccccaagataagattctgattacaaaagacagcgaagaacttaaaaagaccgatcaaaaattaagctatgatgacttaagcaatgaagaacagatcgaagctgaaaaagcaattcatagcattgtgattgccaatgaaaacaagtatgtaggatttttcaataagcaaagcaaggacggaactcagcttcacttattggaaggcatcagccgaaagaactcaatgaaaatcattgaagaaaaggaattgaatggcgactttgaaagctttgaggacattgacaatagaatcagcttcattgacgacagcgaagacctaattgcaaaaagagtattatatgaattaagcgaacttaataaggtaaaaaaaggaagacctacttatttatttgcaagtgttaaaaggtcatctaaaaaggaagttcttgaattggatgaatttgaggatgatgacagtttctttattgaaaagttaaaaagagagggcttagttgaacaagagggaaaaagaattagataa

SEQ ID NO: 537 - DNA, 426 bp, Methanobrevibacter ruminantium
atgactgatttaaacacttgctctaatgaaaagttatcctttaaatataatgacaaatgggaattggaagcaattccattggaaaacaatcctgactgcattgctacattaagctatgaggacggcagcctattgaatgtaattgcattcccatcagagctagagtcattagacatctttaaggaagttgttgaagcaagcttaagggatgatggggcagagatagtatcctctgagatagcaaatgtaaacaaaaggccttcaattcagattcattccaaggtaacaacccctgaaatcagctttcaaatgttttcagtcatcttcctggaggaaggattcttatacatatttgaactaagggcggtaagcgaaatagtccacgaattcatggaaattgtaaaaagctttgaaatcctagaataa

SEQ ID NO: 538 - DNA, 804 bp, Methanobrevibacter ruminantium
atgattatcaaggctgggaaaatcaataaagctagaggcaatatagttctcacaattggtaaggaagatgtcaacaagcacaatcttgaagatggagacttcattatccttacaagtgatgaatatgaggacctaaaggcttcctctgaaattgaagtctctacaatggaagtaattcccgatgatgaggcagtcatcaaattggaatatgacctaaaggaagcaaagtcaaaggaaaagatccttttctccaaggttgaagagcttgaaaagctcaatttagaattgactacagaattatccaagattgaaaaggagaattatataaataaaacagtattgacagattcagaatccggttctcttcttgaagaaatcaaaaatgtcaacgataaaaacgaagagctgaattctgaaataaagaaattaaacaaggacctaaaggaatccgatgaggaaagaatcgaacttctacaggacatgaacgtattaaagacaaagatgagctttgatgcaggagagatttcaagacttagggaaagggaatccaaatacagagaagtattggagattatcctaaagtcaaataagaacatccttgatgaagcggtcaataagacagttacagcaaccatccatgagataaacaaggagctgtcacagacaggattaatcagaagaatcagaggacttacaattgtaagagagcctgaaataagcaaggagtccatttccagcaatgcatataaacagctggaaggagtcattccagatgaatatttcctggattctccagatgaataa

SEQ ID NO: 539 - DNA, 504 bp, Methanobrevibacter ruminantium
atgggttattttagaggtgaaataatggaagaaatcacatttaatgaagaaggaatcaaatttaagtatttaagcaattggagagaacaggcaaaagagtcagttggcccaaattgcataaaggcattggttaaggttgtagagggcaagccttccacaatcacagtttataaaaacgatgcaggagatgctaaggctgttgcccaattggaagagcctttcaatgaatcattcaaaagtcaaggttggaacattgtaaaatcagctattttaaatctcaacggcaatcctgtctttaatattgtatccgacgctcaagaaggagatacaattttagaaaacaatacttctgccataataaacaatggaaagatgtatgtatttgaattgatgcattttaaagacttcccatatgcatataatgattatttgtcaatcatggactctcttgaatttgtaaacgaagaggaaatcgaagagactgaagaagaatcagaagaataa

SEQ ID NO: 540 - DNA, 423 bp, Methanobrevibacter ruminantium
atgtctaatctattccaaaatgaccaattaagtttcaaatatccaaagaattggaaactagtttcagatgatgaaatcgaaggctgtttagctatcttagattccgatagcaaacacagcagagtgatgatattcaaatacccagaggaaggactgtcattggaatatcttaaaaacgcaattgaagacattccaagagaagagagcctaaaagtaatatcatccaaccttacaatattggcaaacaaggaaacccacgagcttatagcagaagatacaagccatgagcctcctttaagaacccattcccttacaaccatccacaatagggacgcttatggattcaatttcatgggattcggattggacaatccagacgaagagggattccttttcatgtataggactcttaagtttgaataa

SEQ ID NO: 541 - DNA, 612 bp, Methanobrevibacter ruminantium
atgactttaaaagaagaaaaagacaaggtccgaaagtcaatctatgacaatctattcaataatggattttccaatcgaccaaatggtgactatggcaaaatcccagactttaagggctcagatattgcagctgaacttttatctaaaacagaagaatggaaatcctcaattacaatattctctagtcccgacgctgcacaaactccagttagatatttagccttaaaggacaataagaaccttattatggcaagccctaatctcacacacggctatctcttcctggaaggacaaaatataaaggaaatcgaagaagcttcaactaaggaaggggcatttaagcactgcagtaaaaaggacatatcaaacataaatgtcgaccttgttgtagaaggctctgttggagtggacagaatgggacatagaataggaaagggaaaaggatttgcagatatggaaatagaagatttaaagaaaagaaacatcattaataataccacaccaattgcaacaaccattcatccattgcaattagtgaatcacattccaactgaaagccatgatcaaagaataaacatgattgtcacaacaagagagattataagggtctaa

SEQ ID NO: 542 - DNA, 546 bp, Methanobrevibacter ruminantium
atggcagatttaaaaggtactaaaaccgaagcaaacttagcagcagcatttgctggtgagtcccaagctcatactaaatatcaatatttcgcaagcaaagctaaaaaagaaggatacgtacaaatccacgacatctttatggaaacttccaaaaacgaaaaagaacacgctaaaatctggttcaaacttttacacgacggagaagttccagacactatagctaaccttaacgcagcagctgatggtgaaaacgaagaatggactgcaatgtacaaagaattcgctgaaaccgctaccgaagaaggtttccctgaaatcgcaggcttattcaccatggtaggaaatattgaaaaagaacacgaagaaagatacagagctttactcgctaatgttgaaggcgaagctgtattcaaaaaagaagcagaaatcgaatggaaatgtatcaactgtggtcacatcgtaaaagctcctgaagctcctttcatttgcccagtttgtaaacatccacaagcttacttcgaagaaagagctaccaacttcaaataa

SEQ ID NO: 543 - DNA, 429 bp, Methanobrevibacter ruminantium
atgagtgacatgtggggtctaacagtcagaggaatatgcgaatataatgataagatcttgcttcttaaattaagatcaatctcagctcacgacccatgcaaatgggaaattcctggaggcaaggttaaaaagtgcgaatactttgattctgcattaaaaagagaatataaggaagaaacaggaatggacataagcattgactcattataccatgtcattcaaaagaattatactgcctgcaagactggagaaaaaatcaaatccatacagcttatcatgaaagtttcaacaaattcagatgaagttctcattagtgatgaacatgatatgtatggttggtttacaaaggaagaaattaatgatatgattaaaaataatgaattaactcctccggcaaaagcagctttttgtaaaacactattggtttaa

SEQ ID NO: 544 - DNA, 507 bp, Methanobrevibacter ruminantium
atgagcatgctttccaattatagactaaaagaattgctgaaaaaagagagcgaaatgactgatgaagagtatgagctctttctaaatgaatttagaaagtctgaacttttcataccaatccaagtggacctagattcccttgacttaaaggacgttcaattaaatgaaatcaatcatataaatcaggagataaacttcagactgaaatcatacgagagcaaggacaaaaaaagaaccatccctctttttaccgatgagcatgagattgaaagacttaagatgaatacaactgtaggatctttgttcatgagggacctgtgtgaatcaattatgcctataagagacagctttgaccagataatcattaatcctaaaagcgaaaagtcctttaagatctctgtagatgagttcttggatttattcgatgaggatagggaatttgaagacctgatgaaagaaatagaaaatgatgaagagtttattgagatgatgaaaaaggaactctga

SEQ ID NO: 545 - DNA, 405 bp, Methanobrevibacter ruminantium
atgaccctatctgacaataagaagctaaagaaattattaaagtccaaatctagagttaaaattgaaaataatccaaatctcttttataaggagtttctaaaatcaactctctttgttccggtgattgcaataaacgaagatgagaacctaaacgatggagacacactagacctgcagattggattctttgatgaggaaaatggagatagaaacatctatatctttaccgattcaaatgagatggaaagggctgattataagataacatcaatagctgtaaatatgaaagagctatctgttattctatcccagtttgatatggactttgattatattgtaattaatccatatggtccagacagctataagatagattatgatgagtttaaaagcagaactgaataa

SEQ ID NO: 546 - DNA, 480 bp, Methanobrevibacter ruminantium
atggattttaaaagagaaaaatacatcgaagttttaatatacatcattgcaaagactgccaataagaagaatgttggaaagacagtcctagcaaatatgctttatttcattgactttgactattatgaattatatggtgagtcattgactggagagacttattttaagacaataaacggcctaaagcctaagcatttcgatgacactttaattgatcttattcaaagggacataatctatttgaaaagggaagctgattatgacaataagctgaagaaatattatattgcaaggattccagacaataagctttcaaaaaaggaatattttgttataaccgatgcattagatagattcagtaatctaagcgcaagcaagttcaattatattctatcaaaggacattccttttaagagtgcaaaaatggatgggcaaatcaattatgagtgcgtattccatagattggaaaaaactaattaa

SEQ ID NO: 547 - DNA, 849 bp, Methanobrevibacter ruminantium
atgaacgaaatcattgataattataatgtgaatgaaaagatagaaatagacaactttgaactggaagacataattagcttaggagtaaacaatctgaccattgcagatgaagaagagttcttcaaattacttaaagaagcccaacttttcattttagttcaattgaacaaggaagaagtctttgatgtagacaatcaaaaggttgtagaggtcattaagcctatacctccacttggattcaacttcatgacactaactgtcaatgaaaatgaaagatcaattgttgcattcacacgaaaggagataataaaggaaatagggcttaaggcagaccatattgtaatgaacatgagagaccttgcaaagattctcatgggccttggagataccttctcatcaataataatcaatccccagaccgaacattcaataatgataagcataaacacattcttaagcctctttatggaaaaacctaaaaatccatttataggatcccttgaacagactctagacaaattgaaaaacgattatgtggaacttgacaatcattatatgtttttcatccgctcagactatgaatttatggaaaacgaatcaaaagatggagtctttgtagcaaagatgcctctaagggcaagcaccgatccaaacttccaggcaaaccttccaatattgcataagctgatgatgatggaaggtcagaaagtgttatatacaggtaatccaaacgaggaacaaaccgatttcgatgttttgatagctccaggaactgagtttgaaaagtattatgatgaggatggtgacacttccgtttggagatgtgtaaaacagccattctatgaatag

SEQ ID NO: 548 - DNA, 429 bp, Methanobrevibacter ruminantium
atgcaagatgaaccaaataaaaaaataaatagagctaaagatgatgagaacttactttttgcaaggggagaagtcattcgattgatgaaagatcaccttgacaaggacaagatgattaccgaaagggtcaaggttgaaatgaacagattcctaagtaatgtgctcgtagctgtttgtgaggaacttaacaaatacccatacaccaccattgattatgaaatgctaaaggaatcaacctatccgtataccagaattaagcagattaatcaggaaagggaaagaatcctggtgcacttgaatgcaatcaaggcagattgtgatgcattgggtatggatattgaaaagactttaaagctcaatgagtccgatggggaggatagtgactttgttcctcataccagcagagtaaaagaggatgatggagagtag

SEQ ID NO: 549 - DNA, 1446 bp, Methanobrevibacter ruminantium
atggataatgaattcaaaataaactatctgcttaatatattaaaaacaactccaaaagtagtttcagacaggataataaaagatcagacaagattgaattttagaaaggattattatgaccttaaggaaagcattgataattttcttgaacacgacactgatgatagattctacatattgcctggccttaggggagtgggaaagactacaatagtctttcagctttatgactacctgaccaatgaaaggaacattaactcaaatcatatattataccttgatctagaccgattgaaggaccaaggaccattcaatctcttagaatatcttgatattttcataaaggacatcaatgaggaagcctatctcaataactggccattatttattttcatagatgaatcacaatattcctcaaactgggatcatgtaggaaagataatctttgatgactataagaacgtatttataatattcaccggttctgacgcattgaatcttcaaagctctatggactctgcccgaaggtctcttaaaaaggaaatctatcccctaaattttgcggaatacttatatttaaaatatggctgtgaaattccaagaggcataagtgattccatattcaatgcaatcctcttcaatgattttgagaatcttataaaagacgaacgctacattcaattaaatgtttataataaattcaaaagagatattaacaagatttgggacgaatatatacaatatggaggatttccattatcatttgctcgaaaaaaccatgcttcaataatccaactaggtcttgatatgaaaaataggatagttgaaaaggacctcgacatagtgctttcagtaaactcacagacacggctaaacacctattctctaataaatatcttagcattgcagaagcctggaaccttgtcatataacaaattggcaaagaacttggaaatctctaaaaaaaccgttggcaatttattgaatgcattggaatgcacacagatgatattccatatagagcctcatggagcaattacaaaaagaaacagaaggccttggaaatattatttcctttcaagccagatgaaagcggcaatctatcaaaattccggccaagcaactaaaacaaaaggagaatatatgggaatactaactgagaatctggttggatcattattatttatgatgaaaaacaaaagaaaacaggattttggaattttctatgaagaggaaaaggagagggctgattttctaatcaataccattgatggtaggataatacctattgaagcgggctatggcaagaagggcaaaaggcaggttataaattcaatggaggaccatggaagcgaatatgggattgtggtttcaaacaagactcaaagcattaaaatagaagagaatgtcatattcttacctcttaagacattctctatgctttaa

SEQ ID NO: 550 - DNA, 795 bp, Methanobrevibacter ruminantium
atgggacttgcaaaagaggctagggatttagaaagagaaaacaaatatgatgatgcttttgaacttgcagaagaagctaggaaattagaaaaaaatggcaaatatgatgaggcaattgaactgatcttgaactatctggaccaaaatcctcaatataagacgattgactactaccatttcgcaaatcccatagaggaaatcctatttaatgtttatattgaagatatcgattcagtcaagacactgaatctggaagagtgtcttgagctgatttattttacccttgcaagagcatatggcaaaaagggagataaggaaaaagaagagaaatatttaaagattgcaaataagatcaatccggtctctgcaataatactgcttagattatgcaaatactgccaatccatcaatgagaatgaaaaaataaaggaattggctccagacatcatgaaatactcttataacagcaaaatattgatagagtcatacctcacacttgccttttcctatttagatgataagcaagagaaagaattatataatcatttgatgcaattttatcttactgttgaaacaggaacagacttttgggattcaataaaggaagatataaaatacttagaggagcatgagattcaagtgggctttaatccagaaatgtttagcatattaaaatatttgattgcccttcacacaaaacaaggccgggaagatactgcaaagtattttaaagacatattgtatttaatggaggaatttacaaagtctttaaatgaattaagatacgatagttag

SEQ ID NO: 551 - DNA, 1014 bp, Methanobrevibacter ruminantium
atggattgcattaaaaacggaataatgggacagattgtaggagatgcgcttggattacctgtgcaattccagcctcgtgaagaacgtgacatagaccccgtgactgatatgataggggatggcgcttttgagcttccagctggaagctggtcagatgatagcagccttatccttgcaacaatggatggcttgattaagagtctgaatggagataatgtagattctacaagcttaaatgatataatcgattgggaaattattatgagaaacttttccgattggcttaatttgggagaatacacaccatatggattttcctttgatatagggggagccacaagggatggaatctacaactatgatgacggatgggagccattggaatgtggaggcatcggcgagagagacaatggaaacggctccttaatgaggatcttacctattgcattctttatttattatttatccaaaaaatattcatttatcgaagaagacaagatgactgctgttcataatttgtcttcactcacccacagacacaagagaagccagatgtgctgtggaatctatgtgaacattgctcttgaattcatagataattttgaaaatgggaaatgtttagacttagaggaacttatatcctctggaataaacaaatccaaggaatattattttaatgatgactcatttgaggaagaattgcatcattttgatagagtcttttcattgaatattcaaaatcttccgcgtgatgaaataaaaagcggaggatattgtatttcttcccttgaagcaagcatttggtgtcttttgaataatgagaattataaggataccctcctgactgcagttaatcttggatatgacacagatacaactgcctgtgtagttggaggccttgcagggattttctatggctatgaagatattcctgctgattggattactcaattggccaaattagattatattgaaaatatgattggaaagttttctcaatctttaattgattag

SEQ ID NO: 552 - DNA, 408 bp, Methanobrevibacter ruminantium
atgtatgatttgacaaagatccaaaaaactttcaatgagagggtatttagcagattagacgatgagattcttgaaagaaatggaattgataaagatgaggaactgataagagaagagttatttaggcaaagggaaataattacagtgccttttggacatattgaatattttttagccattgaagatgaaaaagtcctattatatgtcgagaaggcttcaagaatgggttcccataacatctgcatcattgatgatgattcatatgaatgcattgacgtttatgatgggtatcctccagaattgaaggaaagataccttgaccatttgaaaaggattaagaaaaccagaaatagatttgaggaaaatttaaaaaaattatcagaagaaaaaagtataaaggagaaataa

SEQ ID NO: 553 - DNA, 966 bp, Methanobrevibacter ruminantium
atgcaatttggaaattatgcagtggaaataagctctgaaaatgagaatcatttaatcaattatcttaaatttaataatttcaaatatgaaaaagatcttgaaaactgtagcgaaaaagaggaatatgtgattgtaatcaatatcatagagagaatttactataagataaagaattatttggcaggaccaatactctctgaaaaggactttttagataagatcaattataataaatacagcattcataaaaaggcatattctaatgatggcaatttaatctatgaaggttataccatctatgaacaaggctatggggaaatagcctatggtcttggaacatcctactttccaaatggaaataaatgtcatgaaggagtatttgaacgtaaaggattgcttgaaggaaaggaattttattcaaacggccaattaaaatttgaagggacttatggaagatgcagaggttatggaccacactatcctagttttggaaactattactcaaaggatgggcaactgctcttttcagggaaattcaaggtcacttttggaggggtcggctatcccatgataaaagaacctaaatataagctacttgaaaaaggcaggccaagatacatattaaaaaaagatgaagatataactaagctaatagagaaaaacaccaatattgaaaataaaaagtatcctatgacttttgaggaatttgaagagaaggtattggaattgttctttgaatatcatagcgatgaatttatagaaatattaaagaaaagattggaggactataaaaagatagagcctaattttatgaaagccctgtataaacatagctgttgggtatatgacagcccacatatctatggagacacttgcaaattacaatttgaaaaagaacgtttaaggcattatccagtatatcgccttagagtgattgttgggcttgaagatggattcaggggatga

SEQ ID NO: 554 - DNA, 567 bp, Methanobrevibacter ruminantium
atgatatctattaatataaaagaaatgagaaaggaaaaaatctatgaaggcagagtaaagatgggacacggaggaagaggaacaatccgtctgcataattccaatataggagaccaattatacgtaatatttccatcctacggcaagaaggaagacaaggatgggaacttggaaatagatgagatacttaggaagaccgttgaacttggcaaggacggcaaaaataacatagattttaacagggaatacagaggccgcaaatgcatcatcattaaaagggaaagtctaataaaactcgaatttgcaaaatggaaaataatctatgatggaatagtcaaaaaatcattcaatggacaaggacttataagagtaaaggacatgttcctaggagaaagagcatttgtagtctttggggaaagcctcaatgactcaaatgagaacataatggtctcagttaatgagatacgtaataagggaattcatccagacaatgaccatacaagccgagtcttgctttctaaagattacgtaaactgcaaatgccttgtagtcctccaggaagcttga

SEQ ID NO: 555 - DNA, 1491 bp, Methanobrevibacter ruminantium
atgagcaaaatacatttatcaaaatccaaatactgcaaatgcgtccaatgtgaaaagatcctttggctcggcagatacaagccggaggtggcagcagttgaggataaggaaactatttttgaaaatggcagaaaggtaggtgagcttgcaaaaggcctctttggagaatatgaagacatagaattcgacataactctcactcaaatgatagagaaaaccaaaaaactgcttgaagaaaaaccaaatgtcatcacagaggcatcattcagctatgaaaacaatttctgcagcgtagacatcctaaaaaacgatgaagatggtgttgaactctatgaagttaaaagctccacatcaataaaagagatataccttgatgatgttgcgttccagtactatgtattgtcaagccttggcctaaacgttaagaaggctgctcttgtctatgtaaacaatgaatacataaggggagaagacttggacattagccaatattttatcatagaggacataactgagattgcaatggcaaagcaggatgaggtaagggccaatatagagcatatcaacaactttatggaagctcacgatagggacaatgagccaaatatggaaataggaatgcactgttgcaatccttattcctgtgatttctgggcatattgtacaaaagaattgccaaagccaaatgtatttgacataagcggaatgtataagtcccagaagtttgaaagctatgccgaaggcaaggtctcatttgaggacttgaggagtgcaaacatcaatccaagatatcttgagcagatagactttgaactaaacgacagagggccaaaggtagaaaagcaagccataaaagactttttaaactctcttaagtatccgttgtactttattgattatgagtcctgcaattatccaatccccgagcttgaaggaactaagccataccagcaaatacctttccaatactctttgcatataataaaagaagagggcgctccattggaacataaggagtttctaggagacatcaatgacaaaaacatcatcagaacatttgcagagcatatgataaatgatctccaagaagacggtagtgtaatcgtatataataagtctttcgaatcagccagaaatagggagattggagagatgtatccagacttaaagggccagatgaatagaatcaacgataatatggttgatttgatggttccattcaggcaaaggaactattatacaaaggaaatggaaggctcctattcaattaagtatgttttgccggctttatatccagatgatccggagcttgattacggcaatctgccatcagttcataatggtggtgaggcgtcagatgcattcttgaatctaaagggcaaaagtccagaagagcaagagcaaacaagagaagatctgcttaaatattgctggctagacacatatgccatggtaaaaatctgggagaaatttaaagaagttgcaaaataa

SEQ ID NO: 556 - DNA, 348 bp, Methanobrevibacter ruminantium
atgaaattaagaaatttgcatttagactataaagatgaaaatggagatctccgctatgagctaagaaacggagcccattctatgaaagatgcagaaggcttctctccagaggaattctattcatctttggataatgtaatcagagtattaagcccaaacaattcatttagaccaattgaagcctaccctagcaataatggaccaaaagctctatttggattcttattttatttcttaaaaggtatgggctgtaaaaagggcttacaaaaagaattcgattatttagaacagttcattgactatgaaattgatctctttatgattgtcaatttcttaagagaattataa

SEQ ID NO: 557 - DNA, 294 bp, Methanobrevibacter ruminantium
atgattagcagcgaagaaaaagaaaagattaaatctgatatagtagagaaagtaaattcagtcttagaaaaatataatgaatcatttaggatggacaaggtaactgtcttaaatagagcggaaacagtaaaattcatgggaagctatagggtttatgagagaagaaactactgctctgtttcaagagagatcaattctttcttaaataaatatggagacgttgagataaaatccaaaaagataagagatagcggaatgaaatttacaactgtaagctttaattttgaattataa

SEQ ID NO: 558 - DNA, 822 bp, Methanobrevibacter ruminantium
atggcagaaaatgagataaaactattcaatgataaacaaatccgtactaaatgggatgaagagataggagattattatttttcagtaatagatgttatagcagtccttacagaaagtagcaatccaagtaggtattggtcagaattaaaaaagaaaatttgtgaagaacagggtcaacctttcgaaaatatcgaaaggttgaaacttcccgctaaagatggtaaaatgagattaaccgatgtagctaatactaaacaactattacgtatcatacaatcagttccgtcaccgaaggcagaaccttttaagcaatggttggctcaagtgggaagtgaaagactagatgagattgttgatcctgaattaggtatggaaagattaaaaagtacttatcgcaaaaaaggttacagtgaaaaatggatttctcaaagaatgagaagcattgaaattcgagatgatttgactgccgaatgggatcgtgtaggtgttgaagaaggtttggaatatgctatattgactaatgaaatcagtaaggcttcatttggattgactactcgtcagcataaaaattataaaggtttgaagaaagagagccttcgtgataatatgaccaatgcagaattggttatcaatatgttgggggagttggctactactgagattagcaagacagagaatcctggtggatttgaagagagcaagcatgttgctaagcgtggaggcaatattgcgggcaatgctcgtaaggagttagaagctaacacaggtcgtaaggttcttagtaaggctaatgcgaaggataagaatttgttagaaaactga

SEQ ID NO: 559 - DNA, 294 bp, Methanobrevibacter ruminantium
atgataagcatcgaagaaaaagaaaagattaaatcagagatagtagagaaagtaaattcagtcttagaaaaatataacgaatcctttaggatggacaaggtaactgtcttaaatagagcggaaacagtaaaattcatgggaagctatagggtttatgagagaagaaactacggctctgtttcaagagagatcaattctttcttaaataaatatggagacgttgagataaaatccaaaaagataagagatagcggaatgaaatttacaactgtaagctttaattttgaattataa

SEQ ID NO: 560 - DNA, 861 bp, Methanobrevibacter ruminantium
atgaatgaaagtcaagacattgaagaaacaacaaaggtagacaacagcagacttgaagaacttctacagctctttaaggatgaccctagtcctcaaaatgttcaggaacttggagaggaaatcaaaagctcacagctttatcttccagttgtctactcccaatcaatgatagaagatatcttatctggagatgttggggaagttcgtgaattcaaagagcctgccggctttgatataaacttcctaaccaataatagaggagagaaggccataccactctttacaagcgatagaataatggaagaggcggggctaagaagctctgtaattgtaatgcatgtggaagaccttgtagatagccttcaagggacagagaacacttatcagctagttacaatcaatccgatgactgaaacaggcatcgacatgcctatccttacctttttgaatatgtttaagaaaagagagatgagcgaggaagagaaaagattccttgaaagcatgaatcgtatgctagaggtgctggaaaaccattcaatagcccttgaggagaagactgcattctttaaccgaggccctcaggactttatgaaagaggtagctgtcgatggggtctttgttccaaacataccattcagcgtaagcacaatcaaggagtttgaagaggatgtttccccatacctgaatataatactgatggatgagggaaaaaggatagtctactttggagagcctacggaggagaatccgtttaatgtattattggctccaggatgtgaaattgagatggtggaagaggtggatgagtttacaactgtgtggaaatgcggcaatcagccattctatgatggcatgaaatga

SEQ ID NO: 561 - DNA, 144 bp, Methanobrevibacter ruminantium
gtggcaaaagccacaaataaatatcgaggtgattatataacaagattaaatgaaaccaagtatgtcgaatttaatattggaaatgcaccaaaggctatgatatttagccgatgcgatatttcaaaaggaggaagagagacttaa

SEQ ID NO: 562 - DNA, 321 bp, Methanobrevibacter ruminantium
atgtccttccctactcaaatcaggaatgagcaagaattccgtcttgcccttctgcattttttaggcgatatcaatgtgggtctagtttatacaaagaaatttttcaaggagtttatgggtcttgacaattctgtacggcagatattggtaaatcagatcaagaacgctttgaaaaaccctggttgcggcaaattcatgtctcataattataagggtgaaaaagccgttagggttgataaacgttatagattgcattttaaatatgataaaaaagaaaacttatttgagctagtatctttttataaaaaagactatcaataa

SEQ ID NO: 563 - DNA, 1332 bp, Methanobrevibacter ruminantium
gtgtctaatgaatgtctaagatgcggctatgcaaatgaagataatgaaaaattctgcattaactgcggtgcaaagcttatggaagctgattcatctattccagatgatataatttcctgctatttttgcggctataaaaaccatgaagacaacaagttctgcatcaagtgcggcacaaggattcatcatgaattgccctatgaaaacgaattgactgagatttacactagatacggcgatgttgtggatttcaacaaagtttcctacaatatttattataaatacaacttgcctcaagactgctttctcctaaatagcgagcttaataactatgaaaagtatcatgaggaatatgatatggaatgtcccttttgccatcaaaactccttttccgttatagactctgatatctctataggaagcgttaaaattacagagttccatgaagacgagtatcattgcagcagctgcggtttggaaattaaattatgcaagaaagatgataaaaagattcccggccgcagatatttgatagcaaatatggacaataaggaacattggatctggaagaaatacggcaaaactccattgtacaaatatgaattggacgaaattttcaatggaggccttagtgatgacgataaggcaaggctactcagcatacatgcggattataatcgaaaagccataaaaatagttaatagattcagcatttatgtttctgtaaggtttgctgcagaaatcctatcagaggaggaaaactctctaaagccaattgacaccaccttctttttggatgatgacgaggaagcctatttcatgttcacagatattgattacagcaagcctatggtccgttattccacttttgggcaatcccaaggtacctatgatgcagtcacttacggccaatctttcgataatgcattttcctatttgaatggcaggtcattctatgccgacacaatgggatatttttccaccagcacatactcttcaaccgtatcctatgaaaaggtcaaggttgtagacaggggaattctccttttaaccaataaaagattgatattctcaggctccatccactcactggatatcgacatcgacaagatcttgaacctggttcatgacagacaatcccttatgatccatgtcaaaggacgaagcaacattgttaaattctctaatctagatagtaatacattttatttgaatttagatggcagacaacttagcctaaactttacaggctacctcttaagaaccttgattgtcaagttcatgagtccaaagaaaaagaggaatcttttgaaatcaaaaggaagcctttaa

SEQ ID NO: 564 - DNA, 318 bp, Methanobrevibacter ruminantium
atgaatataagtgaaaaaataaaagaaatgcaaggggatttaggcaaatatcatgctttggagaaaaaagaaggagaatgtggattggaaaacctgattatgctcatactaaatgacggaggccaattcggtccgggcaaaatcattggtgaaagcagtgaatttttagactttatgttttataagagacaaggaccgatcttctctctcagcataaagaaggaacaccttagcggattttcaattttccataaggcaattgatgatgagaaacaagcagcagccaatattggaatccccaaggcattgtatcaataa

SEQ ID NO: 565 - DNA, 324 bp, Methanobrevibacter ruminantium
atgaatttcagtgaaaaaatcgaagaaatccaaggaaaagtcaagagttacaattcagagattaaaggcatgaaaaacattccatcagaaaagatgattagggtcatgatggcagaaggagaaatacttgagccatgcatgatcattggtgaaagtgatgaatatattgatcttatggttgtggatttagacaagggaccagtttttacagtttccataaaaaaggaaagaatagttggatttggcactttccataagcctttagatgagttggcctatcctgaagaagagctaaatgcagtccctgctgcattatatctctaa

SEQ ID NO: 566 - DNA, 309 bp, Methanobrevibacter ruminantium
atgcaaataattgaaaaagtggaaaaggaactggaaaagcttggccttacagtggatacggttgcaaacgatcatatcattgaagcatgtgtcaccaaggtttcattggaggacaacttaagcaaagtaggaatcgatttcgaccaaattgaaaagaagctttatccctattcaacatttgtcattcaaatgattcaacatctcgatgaagggggatccactgaagatatgattagggcattcctaatcgaagcattaaattattcactggaattaggggatgcatttggaatctctttagaggaatag

SEQ ID NO: 567 - DNA, 786 bp, Methanobrevibacter ruminantium
atgaaatattgcaagatatgtagaaaggaatttccaagggacttgatgttttgtccggaatgcaactcctttttagaacctgtatcacactctaaaacccttgacgaaggaattgtggagcatggaatcaatagaataatattctttgatactgaaacatccggattgaatcctaattactgcaaaataatcgaacttggaatgcttgtcattgaagacgggaaaataatagaggagtatgataagcttatcaatattggagaaaggatagattccacaatcacaagaattaccggaatcactaatgatatgctgatagatgaaggagtgagtgaaggggacgttgctcaggatttaaaggaaaaattaatctctggaacattgatgatagcatataattgccaatttgacttgtcattcgcctatggtctgcttaaaagacattaccctcatgaggcagaggcaatcattgaggatgttaaatggctagatccaatgaccgtttttaaggatagaaaggcctatccccataagtttagcgatgccgttgagcattatgatataaggaatgttaatttccatagggcgattggtgatgcaaaaggattgtatgaagtttgtttgtcactgaaggatgaacgtgatgaccttggagaatatataaatgtctttggatataatccaagatatggaattaatggattgaaattcccatttatagaatataagaaacattattataatgattctatggtttctccaaataatattcttcctaagatatga

SEQ ID NO: 568 - DNA, 948 bp, Methanobrevibacter ruminantium
atgaaactggaaaactttaaatacgagacaaatgacaataatttgataaattattatgaaattgacaacgacaatcccatactgcttataattcatgcccaaagcacaaattcaagtagctattctgatgtggtaaaggatttgtctaaaagatttcatttgattcttgtggattgctacggccatggaaaaagctcccacaacagggataaatacaatatagtcagtcagggggatgacttgattgattttatcaaatcaaaaactgatgaaaagatatctgtactgggccattcctcaggagggctcatcgcctgctatatctcttcaagatcagacctttgcgacaatctgatactggaggaccctcctctcttttcaagctctggagagaaaagatttgactattacaactatcatgacctttccacagtctgccataatttcatcaatcaggatgaggagaaggactttgtctattattacttcatgaatcagtatatgtggaactttttccctgaaagctcaagagaaaaaattagaaataaatccggagcatctgcattaaaatacagagaaaaacatccagataagcccttgaaggttcgcttttggcctaaaaatgttttagaggcctttaatggaatggaggaatatgacccttattttggagagaacttctataatgactcctttaactgtgatatagactatgctgagctactttcaaacataaagtgcaaaaccctgtttttaaaggcaaatacgaaaataggggaagatggcattatccagggcgccttaactgatgatgacttaaatcaggtgatgaatctgattgaaaatattgaagttgaatactttgactgtggccatggcatacacaatgaaaagaagaaagaatttgtaaaagcggttattggaacaacaaagatttttacaatttaa

SEQ ID NO: 569 - DNA, 3282 bp, Methanobrevibacter ruminantium
atgatgaggaaaacaatatttggagttatatttatcgtttttattttattcagcatttcaacggtttcagcaaacgatgctcaagttgacatgcttaatgatgcaagtgatgtggaattaaatcaagacttgaatgctcagcctatttcatcaaattgctatgataataatcagaatttaaaagctcaacctatttcagattgctctgatgagctacagaaatctgatgatgatttaaagctttccgaagggggatcaacaagtttcaaacagctttgtgaagatttaaataaaagcgacggcgaatttaatctaactcacagctataaacatgatgaaagtgatgaagagaatacagcggttttttatatggaaaatttggtgataaatggaaataataatattatagatagcagcaaatcaaatttcaactttaaattttccaatgaagcaaacattaccatcaatgatttgactttcacaaatttcaataaatccctatttgtaatcagtgacagccaattgacctttaataacgttaactttactaattgttcctcaaatctttcattgattgcgataatgtttcctagcaatttgactataaacaactgtaatttctattcaaattcatttgcaaattatctcgacggaccatttaacaaattagagatttataattcaaattttgatgggacaaattgtttagattctgctattaaagagaataggggccaactagtcattgaaaattccagctttgagaatttcacaggggttcatggaagcataataaactacaagggagactatttctctattaaaaactccaaattcatcaattccaattcaaacttcactggaggagcaatcattgtaaaatatttccctattgcctatgaagaaggagattcatttgtctatcgtcactctaatgacatgctgattgagaattgcacattttataatctttcatcttccagcaatggaggtgcaatccatcttgaccttgattcaggctctgaaggtattgtagaaactttaattgtaaaatcttccaacttcacagactgccactccaagtttggaggagcaatatccattttaggcggttatttaaacatttcctattccaatttccaaaacaatagcgccagctttgaaggaggggcgatctactcctcatggaccaatgcaaagattgaaggctctaattttactgccaatgaaggaagtcaaaatgcaggggcattatactttgacaagggaaaattgacaatcaatgactgtaagttcattgataataaggctcttaaggaacgagagagaactgcaaatgcaatctatgctcatgatgtagctgcctatttctccaattccacttttgacaatggaggagtatcagtttatgcagattttgcaagcgattcaaaaattgagaatgtggataaaaatgatgacatcttcctaatggacaaccatgattatatcgtttcagttgaaagcaagggaataaagcttaacttgaccggaaatgaaataaatgtcgacagcctcccatcccactttgacgcaagagactggggatggacaacttctgcaaaaattcagggagacaatactgactgctgggcatttgcatcaatatcctctttggaaacctcatttgcaaaagcctcaggggttttatataacctctcacagaattatcttcaaaagctccaattgaaatatttctattcaggagacaagagaaacagcttgacaggcttttcatatagcggtccaggctatgcattaagctggtatggggttttgcctgttgacaatggatatgatgaccgcggaatgattgcagacactgaccttgaggatgaaagaattcatgttcaggatgtgctgtttatagataccggaagggatgacgctgtggaattgataaaatgggccatactgaaatatggcgctgtcactgttcagcgaggcataaacggaccttatggtgaactaccaaccgaaggtgacgacattgccattatgagtcatggaacccatttcatttcacttataggatgggatgataattattttgaattagaggaaggtgatgacgatccgcttcataaatttgcttggataactaaggactccttatccggtttttcaactgctgattacacaaaatttgatgctatagacaattatgcaattgtccctcaaagggctgcagttgcctatatcttcgaaaatgacattgactatcatgtgaactatcagacagacctaactggattggtcggattcgatgccaattacaactattattccaatgagtttgtttcaaagtatgatgagtttatcggagctgtaggaacctacttcaatgaatcaggaatcgattattcctttgatgtttatctaaatagtgagaagatgctttcacaaagtggagtgagcgaatttgcaggtttcaggacaatcaaattagatgaatatatccatataaaagcaggggatgtgtttaaagtcgtctttaaaagcaattccattcctttccaagcatattcaagacagcattatattgaaggaatgtcccttgcaagcgctgacggtgaaagctggagtgaccttgcacctttaaataagaccgtatgccttaaggcatataccgtaaaggaggataaggaagtgagtccaagcagagcatccactaagatagattgcagtaacatgaccaccactgctgtagcaagtgcagatggaagaattggagagtactttgttgtcacattaaaagaccaaaacggaacagtgatagcaaataagccaataaaaataggtttcaatggaagagtctatgacagagtcacagatgaaaacggaagcgcaaagctgcaaataaacctcgcatataagggaacttacacatttgccataggattccttggagatgagaactatcttggagcatttgaagtagctaagataactgttaataagcaaagcccaaagcttgcaagtccaaacaaatcatataaattaacagcaaaaacaaaaacattgaatgcaagccttaagagtggaaatggaaatccagtaagcggtaagaagatcacatttacagtcaatggcaaaacttatacagcgacaagcaattccaaaggagttgctactgtaaaggtaagcctaaataagaagggaacatatagttttactgtaaaatatgctggtgatgatacctttgctgcagttacaacaaaagcaaaattaacaattaaatag

SEQ ID NO: 570 - DNA, 1146 bp, Methanobrevibacter ruminantium
atgacaaaattaggtatgggaatgatgagacttccccttcttgatgaaaacgattttaaaagcatcgattatgatgaagtaaacaagatggtcgatttgtatatggaaagcggattcaaccattttgacactgcattcgtctatcatgaaggaattggggaagaaagcttaagaaagtcagttgtcgaaaggtatcctagggactctttcaccgtttcaactaaattgcctctatttgtaatcactgaggagtcacaattggaaggtctcttcaagcagcaattggataattgcggtctggattactttgactattatctattgcataatgtaagcggatttacagaaaacgcctggaagaatgttgacttgtattcatttatccaaaagaaaaaggaagatgggtttatcaagcatattggcttatcaacacatggaaattcagaattcttagatgggattttaagcaagcatcctgaattggaatttgtattacttcagataagctatcttgactgggaagatgaggcaatcgagtcccgaaaatgcttggaagttgcaaagaaacataatgtgaaagttatgattatggaaccatttaaaggaggatttttagcagatgttccgcaagaggcagaaaaaattatgaaagattataatccggacaaatctgtcatttcatgggcaatgagatttgtagccaatcttgatggcgtatgccttgttttcactggtgcaagcaacagcaaacagcttgaagagaatattgaggaatttaaaaatgctgatccgttgaatgatgatgagattgagattctaaaggaggtttctcaaatcattaataagaacatcactgtagactgtaccaaatgcagatactgtgttgacaattgttcaagcaatattgatatagcaaagctctttgacatctataataagcataagctgcttgatacagatgagtggacccctcatggaaacgcttacttgaattattcaaagcttccagatgttggaatagcctctgactgcaccgaatgtgaaatctgcatagaggaatgtccgcagaaaatcaacatacctgaagttttaaaggatgttgcaaaaacctttgaaactggaatttatggatttgggaatgaatga

SEQ ID NO: 571 - DNA, 201 bp, Methanobrevibacter ruminantium
gtgagtgaaataccagttgcaccagttgtacgtatcttaaaagaagcaggtgcagaaagaattactgatgacgctaaaaaagcatttgctgacgcagtggaagcttccgctgaagaattagctaaaaaagtcatcaaagcagcagcacacgctggcagaaagaccgtaactgtagatgacatcaaattcgtctgcgaatag

SEQ ID NO: 572 - DNA, 1407 bp, Methanobrevibacter ruminantium
atgaccactttaaaattaacaagattaaacgaacctaacattgaaaaactttacgaaatgaaatcagccctcagaaacatccttgaagaaggagatttcaaaaatctaaacaccatattagatttccaggacaaggacggtagcttcaagctattctccacatacagaatcccttcagatgcaagggttgacttctgccatgagccaacttacatctgctcatccattcttatgaaagcatacttaacaggagattctgaattaagacaaaagatagaaactccactaatccacggattagaaagatgctgctgcagaaacttaactggccatggatacgattcacttcaaggacaaatcgacgccttaaacatctttatgaaaggagggcttagagaattcattgatcttcatcctgatttaaattcaaaattcacagaaatgatattgaatatcatggttgaatttgatgctcgcgaagagcaaggaatttttaaaggcacatggggcgaagactacaaggaagacatactcaaaataaacgaatacttcagcactagaaaagtgtttgtttatggaacactcatgaatggagaaagcaaccatcacttccttgaaaacagcatatgccttggaaaagctgccattgaaggatatgacatgtataatgtaggaggatggtatcctgcaattatacctggaaattcaagaatcattggggaactttacgaagttcctgaaaatgacatggcttcaatagacatgcttgaaggagaaggaagcctttacattagaaaatgcgaaattacaactggcaatgaattggcttacatctatgaatacgctcaagacactgaaggacttgaaaaaatagattcatggaaggattacgtctggtatgtatcctatggaagcaacatgctagaagaaagattcctttactacatcgaaggaggatgctttgaaggcagtgcctcctatagatacccttgcgaagatcctacaagacctcttgaaaaaagagccatagacatcccatacgacatgtactttggaaattattctgggtcatggcatggaggaggagtgtcctttttggataccgagaaagaaggccatgcattgggaactgcatatcttataacaagagagcaatttgagcatgttgcagctgaagagaacggcggacgccccccaaatggaaatggctattggtatgaaaatatcattaatctaggggagatggatggctttgagatgcttacagtcaccaataaggatcttagggaatataataggccttctgatgaatatctggagaccttagaaagaggaattagggaaaactggcctgatatgtctgaagaggacatagatgactatcttaatagttgcattagggaatag

SEQ ID NO: 573 - DNA, 1059 bp, Methanobrevibacter ruminantium
atgaagcatagattaaatttagataataaagacccaaattatattttgttgaaagaaatatttaaaattatggattcaagagaatccaaaagaatattggtatcctatggatttaaaaacctaaacagaacaatatttgcttttaaaatcatttttataagcatgttctttgaaattgacattccattcatcctaaatgaactcaaatccaatagaagactctgcaaattccttaatatttctgaagttctgactgcagatcaagtttataaaatcttttcagaaataaactctgaaaaacttataaaatcattaaacagaatcttaaactcaaggaatatggttaaaaggagaggaaaaaagacttttattgttgatgcgaccccagtggacttagatattaatttccacagaaataaaaagactaaagaacatctggaaaaaattaatctcaaatggagttattcttcctctaaaggttattatattggatttaaagcgactgttgtgatggattacgattctatgaatcctgtttgcattttaatccattctggagctccaaatgatgcaggactttttgaagagattttagaaaaccttcaaaaaagacgaataatcagaaaaggagacacattaatctttgataaaggatattacaggtataaaaactaccaaatcggaatcagcaaatacaaaatcattcctttcatttttccaaaagaaaaattcagcagaacccgattggatgacattttaacttatccactagccgtatttaacaaaacaaagagaataatgaaagaaaaaagattatacaacagtttaaaaatggaattaatgaaaaaaatagattcatgggaaaaatttaaaccaataaggggcaaaatagaagattttttcaaattattaaaacaaggcttgaatatgagagaaatccacaaatatactctaaaatcagtagaaaaaaccgtttatctaaatgtatttttgggagcactgattatatcacaaggattttactcaaaaacgaccatacaacaattatctgaaaactaa

SEQ ID NO: 574 - DNA, 2427 bp, Methanobrevibacter ruminantium
atgaacaatgagacaaacgctttcactggaaacaatccagaattatacaataggctcaaatcaagcataaacaatgcagagagcattgatatcatagtttcttttctcatggaatctggagtgaaattgattatcaacgacttaaaggaagccatttccaaaggagtggaaatacgcatcctaactggaaactatctaaacatcacacaacctcaggcactttatttattgcgcaaggaattgggatataatttagacttgcgcttttacaatgttgcaaataaaagctttcaccctaaagcatatatatttcacaatgaatcagacagtgaaatctatataggctcatccaatctatccaagggggcattgaccgactcaatcgaatggaactatcattttaaaaggtcaaaaaacctagaagacttcgattccttttaccaaaacttcgaagatcttttttataatcaatcaaccattgttgatgacgaggctttaagggattattccaagaaatggaccaagcctagattcccagtcaaagaggctgaaagcatagaagaatatacacaaacccctagcgaaaccctatttgaacctagaggccctcaaatagaggcattatatgctctggagagaagccgtgaagagggctttgacaaggctttggtagtggctgcaacaggtattggaaagacataccttgctgcattcgattcaataaaatataaaaaagtcttattcatagcacacagagaggaaataataaaacaagcagcaaaaagctttaaaaatgtttttccaaccaaaacaattggattcttttataaccagcataagcaaacagacaaagacatgatattctccctggtccagacattgggaaagagcagctatctgaacgacagctatttcaagagagatgaattcgactacatcgtcgttgacgagttccatcatgcagttgcaaacaattataaaaagatattggactatttcaagcctaaattcctattgggacttactgcaacccctgaaagattggacaacagggatgtatttgcattatgcgactataacaacgtctatgaaataagacttaaggaagcgataaacaagggatggcttgttccattcagatattatggaatctatgacgatacaatcgactattccacagtcaacatgagaaacggcaggtatgatgaaaaagatttagaggaaaagctgatgataaaccgccgtgccaatcttgtctatcaccatttcctgaagtacacctctaaatcagcaataggattctgcgcctcaagaaaccatgcagaatatatggcaagctatttcaacgagcatggaatagctgcagcatctgtctatagcggcgagcagggagagcactcccaaaaccgccaaaaggccatagatgatttaagagatggcaaactcagaatcatattcactgtagacatattcaatgaaggtcttgatctcccctccatagatgaggttctcttcctaaggcctacacagtcacctacaatattccttcagcaattgggaaggggacttagaaaggacaagggcaaaaagtacctcactgtccttgactttataggaaactataaaaaggcgaatatggctccattcctattgagcggaaaagactatgattcaagaacccttctaagggaagctgtccttgactttgaatatcctgaggactgtttcatagactttgatttccaattggtggatctctttaagtatcaagcaaagagtgaacttaaggccaaggatagggtagtcattgaattcaattctgtaaagacagaattggaccatcgtccaagcagagtggaactctttttgcatatggatgatgcaataataggagcaatgaaaagaactccaaagattaatctcttcaaggattacatgagctttctaaatgacaacaaagaactaatggacgaagaggaagagtttctaaacagccctgcacatgagttcttaaaggccattgaaaacacaaatatgaccaagtcatataagatgccaatattaagggcattctataacaatggaagcataaagatggccatttcagatgatgatgtctatcttgccatgaaggagttttatgactacggttcaaatggagtggacatgcttaaggataaaagctcaagagactataagtcatggtcaaagaaagactatgtaaatcttgcaaagagaaacccaattaagttcctcaagaaaacccatggagacttcttcatagacaaggaaggattcgctttggcattggcagacaatctagaacaattcataaatctcgacagctttaaaagacactttgaagacattattgaatacagaacccttagctattataaggatagatttgagaaaaaacaagtataa

SEQ ID NO: 575 - DNA, 579 bp, Methanobrevibacter ruminantium
atgagtgaaaattattatgattccaatgcagatgactttttcaatggaactgtaaatgtggacatgagcccccaatatgaggactttctaaatgaaatacctaaaaacggccatatcttagatgcaggatgcggttcaggaagggacaccttggctttcaagtcattaggatacaaggtaacctcatttgacggctcaattgaaatgtgcaggcttgcaagcaatcataccggccaagaggtcctccatcttcagtttcaagaaatagatttcaaagagacctttgatggaatctgggcatcagcatcccttcttcatataccaacaagtgaaatagatgatgttttaaaaagattaaaaaagagcctaaagaaaggaggagctttctatgcctccttcaagtatggaagctttgaaggagagcgcaatggaaggtatttttatgacttaacagacataactgcaaaggaactcttcacaaaaaacggatttaatataaagaagatctggtttacccaagatgcaagaaaagaaagagaagatgaaaagtgggtaaacatattggcaatcaaggattaa

SEQ ID NO: 576 - DNA, 630 bp, Methanobrevibacter ruminantium
atgatatgcccaaattgtaacaaattttataatgataattttgctttctgcccacattgcggtgcagaaaaaccagaacctttaacttgtcctaaatgtggatttaaatctaatgaatttaaattttgccctaagtgtggcgctgaacttaaaaaatctgctattaaaaaaccaaccaaaacctgttcaaactgtggacatgagaatgcaattaaccggaaatattgtgaaagatgtggaactgatttcccaagagaagaaaacagaagatttgaaacaaaaatagaacaacccaaaagaatacttttagattatgtgaataaattccaaatagaagaaaatattaaaaaagaaattataaatgatataaacaatgaaaaaatcactaccaaaactgaaataactataagagtaagacaagctcaaaaagaaaaaaaagagcaagacaaaataagaaaagaaaaagaagaaaaagaaagaatgttagaaaacgaatattatagaaactccgaaacaaatactcaatatcatacatatgatgataaacctgacgttttttacggaggaaatgaatatcgtgaaatagaagaaaatacattaggagaatacaattactatcgagaatattga

SEQ ID NO: 577 - DNA, 540 bp, Methanobrevibacter ruminantium
atgactgaatacaccatatgtcctgcatgcaaaagaaaaaacagcataaaagaaaaatattgtttagactgtggacagaaactaatagaagaaaaggaaaatgaaataatcagagatgataaactcgaaattccaaaggataagatcatccttttggatttgaactatactctcatttctaattcctggaaaataagacatgaggaattgcctcaaaagattcttaaacgccaatatgaagatgaattggtggaaaaaattaaggacaattatgttattttaatcacagcaagtccttataagacctcttttgattcattgaagcatattgaagagaatactgacttgaaaatctctgaatcctattggaattttggcaaacgtcctcctgagctaaaggaatactggcttaagaaagcagttttgccaagtcatggagatgattcaagcaaatatcttgcactcgaatccaacaaggatacaagagaaatgtatgcaaggtttggaatagaggcaagaccgaaaagtgattttatataa

SEQ ID NO: 578 - DNA, 837 bp, Methanobrevibacter ruminantium
atggaatattatctccagcagttaacaaacaatcacttggaatacttatttgaattaaaatttgttacatcagaattcgaacttccaggattggctgatgatattgactgcaaaaaactagaggaatgtggtaaaaaatcagaatccttaaggattgatggtttaggatttgataataaaacaaactcatttgttattatagaatataaaaatcagtatgataaatgtgttatagatcaagctaaatgttattataaaaatctactagacaaaaaagaagcatatatcgaaaaatattatgaaaaatttggtaaagataaagaagttgaatttgactttgataagacaagagcaataataattggccctgaattttcagagcaacaaaaaaacagaaaagatcctgattttgattttgaactttacacagtatctttatgcaaatacaataataagatttatcgagctttatacaaaaaggttgattcaaattttaaaagagaattatatttcagctcagaggatttgaaaataactagatgttcactgttagagaataaatcagataaagtgaagaaattatataaggattttgaaaatatattatttgaacgatttgatgatgatttcattttagatataaggtatattgttgatggagtttccattacagcagaaaaatcttctatatgtcttttacgggttaataaaaagtcaattaagatacatttttatactgatgaacttgaagatgaaacattaaatcatgaaaatatatgtgatgtgattgataatattaatacaatttataatcaaaaaaggagaaataaaaaatga

SEQ ID NO: 579 - DNA, 561 bp, Methanobrevibacter ruminantium
atggaaaatcctgtagatattactgccattgacggaatcaagagaatctcaaagtcatatgacattgatacatcagaatactatgatgatggattatatatctcatggataagccttataaagtccaaaaacgatactgtatgtccagactgcggaagcaaactgatgccgcttacattatgtcctagcgaagaaatgatggaactggatgaaatgggctttgatctggagaatcataattattactgcaggaattgcgattatgaactctatatcgatgttttgaatatagactgcgaaaatcatccgatagaatgtgcttatctatattataaacttgatgaaattacaaaatatattaggcataatgaatatagtgatgaattgaagtcaaagatggattactttgatgatgaggagttcaatgcattcatcagtaagctgaaggaagttgattacatctatgaagatgaagaagggtatgtgaaacttgtggatgatgtggaaaaccattggtttaggcattacataaaatataagaggctttgcagagagctttga

SEQ ID NO: 580 - DNA, 120 bp, Methanobrevibacter ruminantium
atgtcaattgataaattacttttagaaatatacgaattaatcgaatctgaggattatgaaaaatccttagagctgtgcaatcagattttagaatttgatgaaaacaataaagatgcttaa

SEQ ID NO: 581 - DNA, 1500 bp, Methanobrevibacter ruminantium
atgagaatgacaccaagttctcatagcagcttgaaaaaagctttttttaaaaaaaatacatacggaggcatcaccatgaataaaataaaacttactagacaagacgaacctgattttgacgaactttacagaatgattggagaacttaaagacttcctaaaagaggatatgggctctcgaaactggatgaagaatctagagactattcttgatttccaggacaccgatggcagcttcaagctatttacaagctacgaaataccatctgatgcaagagtggacttctgccatatgccaacatacatatgcacagccattctaatgaaatcatatctgattggagattctaaattatctaaaaaaatagataggcctctcagaagaggattgaaggcctgctgcatgagaaatcttatggggcatggatatgaagcacttgaaggccagattgaagcattgaatatctttatgaaagcggggcttcgtgaattcattgatctttatcctgacatgagtagaaaattctccaaaatgattagcaatatttgcggatccaattttgaaatgcttgaaagcttgaggaacgctttacttggcccatggggagaggactataaggaagacatccttaagataaacaaatacttcaatacaagaagagtatttgtatacggaaccctcatgaatggagaatcaaaccatcatttccttgaaaacagcaattgccttggggcaagcactgtagaaggctaccagatgtataatgtgggatggtatcctgcaattgtacctggagatgggatgatcattggagagctatacgaagttcctcaagaggacatggctagaatagacatgcttgaaggggaaggaagcctttacattcgcaaatgcgaaatgacttcttctaaatccttggcttatatctatgaatttctggaggatactgaagggcttgatagaataagttcctggaaggattacatctggtatgtgtcctatggaagcaatatgctttatgacagattcatttgctatatagaaggaggatcctatgaaggaagttcctcttatagaatgccttgcgaagacacttcagcccctgttgaagtgagagcagtagagattccacatgacatgtactttggaaattattctgggtcatggcatggaggaggagtgtcctttttggataccgagaaagatggccatgcgttgggaactgcctatcttataacaagagagcaatttgagcatgttgcagctgaagagaatggcggacgctacccagatggaacaggcaattggtatgaggatatcataagccttggagatatggatggctttgagatgcttacagtcaccaataagaagcctagggaacaaaatgagccttctgaggaatatctggagaccttaaaaagaggaattagggaaaactggcctgatatgtctgaagaggacataggtaggtatcttaatagttgcattagggaatag

SEQ ID NO: 582 - DNA, 843 bp, Methanobrevibacter ruminantium
atggttaattatggtgatgatagtttagagaatccggatgatattactctacctttttttgcatatgggatatttaaacctggagaaatagcatactctaacattaaaaagtatattggcaagaaaaatgaaaaaactattaactatgctatgaaacaaagggacggagttccaatattacttcctgaagagaataatggaaaaacccatggttatatattcaaatttaatgataatgaaagagcttatgatacaataaaccataacctatcaaataaattatatgaatggggcacaattgaacaaggaaagattaatgttttatttggaaaagaccctgatattggaagtgatgatattgggccggactttgatcgagagaactataaagggaaagatgacccattttttaaagaagcgcttgcaataaaacaatatgtcgaatcaaatgatttcacttcaaaagatgatttttatgatttacagaggtattacatattattgtggtctgcaattgaaagatgctgtaaattaaaatacaataaagagagtgatggtaaaaatcgtgaggaattttcaaaagaaaaggaatttatagatgcattagacaaatgtgatgaaacaaattatagggaaatctataaaacagatgatttgactcctagaaaatttgacacagatgaaccaaaatggtgtataaattattattatactcttagatgcaatattgtacatagaggcaaatcaaatgttaatagagatatgggattgcttttacaagcaaccaaggatttattaaatatatttgaacacatacttgatgaaacatttaaagaagaataa

SEQ ID NO: 583 - DNA, 414 bp, Methanobrevibacter ruminantium
atgaaaaaaataattcttggaacatgtatcttattcttgttgattagtgtcgcatatgcaggaactgtcgatatattcacagccccttccccattgcaaccattaggcaatagtggtttcggagatggacaaggccataatattcaaatttttgagtttactgaaaacctttacaaaacctggtttgaaaatgataccgactatgttgtagaaaagtatgaaggaaacaatggtctttatttatatgccgatgatgaaaatgactgcggtattttagagattgttgaaaaggatggcaaaaaatatatcgtaaattcctggactcctaaaggtcctagcgaagctcaaacagttgtggaaaacttacatgactttaatgagttaaaccatctgactccaataacaacattataa

SEQ ID NO: 584 - DNA, 954 bp, Methanobrevibacter ruminantium
atgaatattgattatgacggccacaacagtaccaatccaaacaataattctatagttgaaaacaacaataataatcaactatctcttcaagttcctcaaaaatatgaggattatgacataatagaagaattacaatgctttaattgcaatcaacatacttttatccaattaaataaaaaatctcttttgtcaaataaggtggtttactactgcactaattgtggaatgtcctttgaaaagcaaggcaatggattcaaattagtggacatatccgataaaagcaatcgcatgtgggagttatataacttaaaaaccttaacttggcctgaatgggaaagaatagcaaatggaggattatctgataaggatcaagctgaaaaggataagcagctagccatagaaaaacaaaaggaattggaattgcaacgcaaaaaagatttggaaattgtagtccaggaattggctaaaggagaagttaatttaaagccagtaagctctccagttattttgaaaaagaatgaaactgcttatcttagtttaccaaacattacattaagcgagcctcgtgccgttagagtgtctaaaagtgggggttatggaacttcatataggtttgctaaaggattcagtgttcattctggtgttggggaaagcagaagcgtttctcatgatgaaattatggcaatagataccggaacatttgtcataacaaacaaaagagtaatatttgtaggcaataagaaatctgtaaatatagatttaaagaagatattgtccatgactgtatataaggatggcatttccattcaaagggaaaataagcagaaaatagaatatttcacaaaaacaaatcgtcattccatggactttactattgatggtaggacacattctttgcctttggaaggttattttataaaagcaataatattaggtcagattgctaatttataa

SEQ ID NO: 585 - DNA, 1044 bp, Methanobrevibacter ruminantium
atgttttgtcataactgcggaagtgaaataagtgatgatgctaatttctgcgtaaattgtggagctaagctaatacgacttgatgaagaaaaagctcagccttccaaatcttccagtagaggcttatccaacaagaaaacagacgaacaaaaggaaacatcctccggcagaggattattcaacaagaaaacagacgaacaaaaggaaacatcctccggcagaggattattcaacaagaaaacaaaggaacaaaaggaagccataaaggaaatcaagtcttacactaagggtaattataagagattcaggcagatcattccaagatatggcatattagcaatggaagtttcacatactaaggttttcaatggaataatcaaaacaatcagaaaagaaattgaaaacgagaatctgactgccgatcagattgaaggaagagtctttcagcttctaactgaagagtatggagagcctatgagtcaggaagaagctgatgaattgttcaatcaacaaaatctccaaacaaaacttgaaaatgaaagaaagttggaacaaaagttcggcgttccatttcaaaatagggtatggttcaaatgcactgttgaagagatgaggcattccactttcaccaacactaatgacagagacattgttgacggatatgtctttgttgaagacacttttttggagatagttaaggaatcagttttcttaaagtcaaaaatggggactagaaaaatattctatgacaacattgcaagcatagaccatgatgccaaaggcaggcttaacttaagcagcagtctagaaatctatttaaagtcatctgacagagttcagctaaagcatgtgaacaaagggatggtagaccttgtcaccggcaagtataatgagtatatggagaataagattaatgacaatgctgaaaacgtcaccaatggcaccaatagcaatgttgatgaactgatgaaatatgcggatttatatgaaagaggcttgttgacccaagaagagtttgaacagaagaagaaagagttattatag

SEQ ID NO: 586 - DNA, 732 bp, Methanobrevibacter ruminantium
atgagattgaaaattatattaaaatctaaaaagaataggttgaagattccttttaattataatcatattgtttctgctataatttataacaaaattgcggatataaaatatgcagaggaattgcattcttctaattcttataaatttttcactttttctcaattaaatattcataaatttaaaagaattcattcaggatttttatctcaaaacggcaaaatagattttttaatttcatcacccgatgattatctgataaaaagtttagttgaaggatttttaaatgatttgactattaatttcattggggaagatcttcttatagagaaagtagaacttctaccagttcccgattttgaagaagaaattaatgtaaaaacattatctcccataatatcaagaactaaaaaagaagtggatggtgaattgaaaatttgggatttggctcccggtgatcatttcttcaaaaatttagaaaatactcttatatacaaatatttggagtttaatggattagaatcaaatgataaaaatataaaaattttttcagaaatgagaaatgtgaaacgtaaacgaataattattgaaaaaggtgataaacaaacgtatcatagggcatatatgatggatttaattctaaaaggtgataaagaattgttaagatttgcttatgatgcgggtttaggtgaaaagtctggacttggttttggcatggttaaggtgattaattaa

SEQ ID NO: 587 - DNA, 2160 bp, Methanobrevibacter ruminantium
atgatatctgatttagttgatttcggtaaatggttagttgaaaataacgaagacggtattggatatatggttaaggaagatgattatcttctaaaaataacttataataatgaaattgatgattttgttatagatggtatatttgagaatgacaatgaaattgttttaggtttttatgaaaaatctatatttaatgatattttaccgactcctagaggatcatctgatcaaaatatcactattgcaaataatactaatttaatgggattttcaccttttttacttaatttagatagtgattttttagggcgaaaaattaaaccagagaattatgataatgaaagtgattattataaagtcggttctgagagatttttgaaaaaaaaggcagggggtaagtttaaattagaaaaaactcttgacaagtttactcgatcattagatgataataaaaataataaacaatttaataatgatataattactaaactatttgataatcccaatgagctttttttaaagaatattccttcacaatatgaagatatttttattcaggaattttttaacaatctttcaaaagaagaatatattaaaattataaataaattttataaattcttggatatgaataaaaacgacattttggatagggtcataaaatttaaattagaagaaaatgttagcagtagattttttatagtgggcgtttttggagactatagggatttaataaatgatttatgttttttatattgtaaattaattaaaaccagaaataaacatatagagaattatgatggggggatttgttctatcccaaattgtaataatcattcaataacctatccttctatccagttttatgctgccgataaaaaattttattttaattattcaaataatattgaaaattctagtttaagattatgtgatttatgtaatagatatatgctttttgcatttgaaaaacttaaagctaattttaaaggaaatatattagttatcccaaagacttatgacggagattatagtgaatttttagagattattcaggaggataatgattttgaagtaattaatgaattacttgaagagaattctaaaaaatttacttatgatttcttaatatatactccttcaaatgctcttttgaaaatagaaaaatatattgataattatcaagctttccttactaaatttgatgacatcaatctatataattatggaaatttaaattatttgtacaatgaagttctagttaatgatgaaagttccttagatgaagatagaattattattaagatttctaatctttttgattttcaaattatttttaaagaattattttatgaagttgatgatgggagattaaaatatcctaaaatgaattatttttatcaaatttataacaaggagttaactggagagaatggtatatttaatggttttagttcaaaaacagttaatatattttcaaaatataaagataatattttcagttttatttatgaagcgaattttgatgcattaaataaaaatatgattaatacaattgttttaaattcattaaccatttttcaaaaaaattctattaaaaaatctattagatttgaaattgttaaaagattaaattattggtttatgtttaaaaaagaatttttaggagatactatgttattaaatgaaaatgttttaaagttaagacaaatatttggacatcctaatattactactggtgaaaataataatgaaaaaattgaagtagtctttgacgatgttgagaaaaaacaagttttagatttaattaaagaggataatgccattaaatattatttgataggtcaattaattgcatatattgatgatttcaaatatagttctggcaaaaaaagagaggtttttactaattttattacaaatgctcataggaataatattaaaaaactttttgcaactgaaatattacaaaaaaatgttttttatattaatcaaatgaataaaaaaggaaaatttttatttactatgctagaatctgattatgggtctttatttaatgaggaagatttatcttatgaagattatattttgttgttatttactggatattacacaacaaaatttttgaaaaaaaattatgtatacaatggagatgaataa

SEQ ID NO: 588 - DNA, 960 bp, Methanobrevibacter ruminantium
atgactgaaggaacacctgtaagaaactattaccaaggaatttacttaactgaaactataatgggcaatccaaatggggattttatagataattctccaagaaatgttgatggtgcggtatttactactgataagtgcattaaatataatgttaggaaatatattcatgatactttagaaaactttggtgaaaaagaaaatattgttttctttttcccacgtcttattgattcaacaaatgaagaagatatgaagtttaaaactagagatcaggttttcgaacattttaaaaattttgaagaaattttaaaagtatctcctgatgtaagaatgtttggtggaacatttagtgttgataataatgctaaacaaatctatgggcctatacaattaagttatggtttagatattaatggagcacaaatcatccgtcatcaaattggcgccccattcgctacaagtgaaggaagccaaaaaactgttggttctgaatcagttgttgatgatgcaattattgcttatgacattactatcaatccgaataattataaagatttattattagaggatgatttagaactatttaaaaaagcattatgggaaggcactaatttaagaaaaacaactagtaaaaagacagattccaaattattaattttaattaaatttaaaaatgattctgaaaatgataaagttgatgcaataaatatgggagaattgaaacagttaatttccataaaaggcggcaaatctaaaaaaatggatgaaaatactatttgtttggattgtgaaaatctagttaaaaaaattaaaaagtatgaaaagtacattgaatgtattgatatttattgtgattctgatgatgttgaattgaattcattagaaattgatggagaaaatttaaaagacactaatattaaagtcaacatctatgaacctttatcattactttctgattaa

SEQ ID NO: 589 - DNA, 864 bp, Methanobrevibacter ruminantium
atgaaaattattgaagttgatatttggagtagttttggttgttttagcaaacatttctccaacactggaggtgttttgactcatttaattcctccaaaaacatcaattattggtattattggagctattttaggttatgatgtaaatgattatgaagataatgatgatgggacaaaaacttataaaattgagtctttaaacaatataaaagtatctatttatccattatttgagtttaaaactaaaagagttatatttaatctggttagtgggactaatttagacttggatattaaaaatattaatcaagatgttttaatatccccaagatataaattatttatttcattcccttcagaattagatgaagttgaagaattatttttaaatagggtaaaaaataataaaactatttataatttatatatggggagaaatgaattccctttgaatttggagtttgtaagagaaattaatgctgaaaaacatatatttagcaatgacaattcagatgagttaaaatccattaaagtttatggctcattaaacagatcttccattaaatcattaaatttatcttatgaagataatgattctaaagttgattctgatgcactcagtttaataagttcacttttaatttctaattctgctgatggtgtgagacatttaaaaagttttcatgagtttactattaaagattatcctattaaaagagaaaattttacagatttttcttattctccagtatctttttacagttcaaagaaatttggagagtgttttttctctaatttgcaacttaaagatggtgaaattgaattagttaatattggtgatgataagtggttatctctcatttaa

SEQ ID NO: 590 - DNA, 2826 bp, Methanobrevibacter ruminantium
gtggttatctctcatttaaattttaatgaaaatgagtctgtaattgagattaatagcgattattttaaagtatatgctcataaaaatgaattatttaatgagcatatctctaaaactttaaacatttttaaaacaattaaatcagagaatattttaatcaatttctatgattggtttaaagatcaggggtatattcatttaacttttgaggagtttaattttttaattgaggaatgtgtcagatttcatgatgtggggaagttatcatttaattttcagttaaaaagattaaataaaaacaaccctgctaaaaagaaggaacaaattaatgttttaaaaaaatttggattagattctattttgaatcaatttgaaggaaatcactccttgtctggtgcattatcttttttatcaaaatattatgatgttttaccaaaaaatgaattattttttcttattttagcttatgttattataggacaccatacaaatttaaaagacattgtaagtcaggatgattttttttataaggaatttgaagaaaatcaagctcttagcactactttaaaattttttgcattgttttttggtttaaatcaatccacaattaatcagaagttttttcaagaaattaatgatataggatttgattttttagagaatactataaatcattatgattcttccttttcatttttttattcatacatttattctttattaattagtgcagattcactagccactagtgaatataaaaactctacagaccaaattgattattcaaaatttaatcatagaatatcagataagttatttgcccatatgtataaatcattttataatgttaaacataatagaaatcttttaaatgagacatttaatttaaatgatatatgcccggaggatattaatgttttaaggaaagcgatgcttttagaatcatcagaaactttaaataatgctttaatggatgatgataaaaaaatatttttcttaaatatgcctactggaggaggcaaaacaaatacttctatgaaattagctttagatatggtaaaaaatactgatgctaatcgtattatttatgcaatgccttttattaacattattgagcaaaattttgatgtaatttgtaaatcctttggtttaaatgaagaagaggggaatatacgtcaaatatattccgcatctgagactatttttaataaaagtgatgaagagacattagaaataattttatctgatgatttttttaattatccggttatttgcactacttttgttagtttatttaatcctataataaaaaataataaaaaatataaatatcgtttaaatgcgttatctaattcagtaattattcttgatgaaattcaatctttacctttgaggaattgggtgagtttatattttatcattaatgagttatctgaaaaatataatatttattttttaattatgagtgcaactttacctagttttgataagttaaaattagaaaatattagggatgatgataattttttaaactataataatgtttcattaattaacaatcctgaaaagtattttaatcatgatttgttctcaagaactaatattaatggaggaattaaaaaacttggaataaatgatgattgtagtatagattactttttagaaattattagagaaaattttagtcaagattataataaaggacttatcgtcttgaatacaattaaatcatctagattgatttatgataaattaaaagacttttctcaggaatataattttgatattgacttattaaattcaagtattttgcctaataggcgaaaaaatattattcataaaatcaatcaggaagatttatcaaattatattttaattagtacccaaagtattgaagctggagtggatgtaagttttgattttgtaattagggatttttcgattttagattcaatagaacaagttcgaggtagatgcaataggagtagggaattaaatgataagtttcatgattctaatattaaaggtaatgtttatttaattaatttggaggatgataatagtaatctttataaatatatttataaagatgtggaacttaaaacaagaattaaagaaacaattaatctttttaatgaaggttttgagttaaatgatgatttaaattatcaatatagtaacatattaacttattatgataatgtttctttagatataaatgatgtgcatgattctatggatcaatcattcttgcgtaatgatagaagaaatatcgtgttttggaataaaatgaagtattctaaaattcaaaaaaagaaaggcattcatattatattaaatgatttaaagcaatattctatatttattccattagatattaaaatttatgatgattctttaaatttggataaaacaatagaggatatggatttgaatgagttaagagagatttatgacgaatttgggaaacattttattttttcattgaatgagattttatttatgaaagaaaatagtgattttttaatagaaggagattatgttataggggaggaggtattaaaccattttcaaactatggttgctagagtaaaagatgattataatcaaaaattattagttgaaaaggtattttcatctattttaagcaattttattatgaatatttcttttaataattccgatcttgaggaacaaattaaagaattagataaagaaagttatttctatattttagagaagaatatgattggtgattctgaggagcatttctattctgaagaatatggttttaattttaaacctactataacaaatatattatga

SEQ ID NO: 591 - DNA, 507 bp, Methanobrevibacter ruminantium
atgagtgactatatgaaatcaatcaatggaacccaaataaactactatttcatatgtaaaaccaagctttggctattttcacacaatatccaaatggaacaggaatcagataatgtttctttaggtaaacaactccatgaaacatcatataaaaaagaaaaagagtttttaatagacaatctaataaatgtagactttattaaaaacaaagacccaattgaaattcatgaggttaaaaagacccaatctatggaaatatctcatgaatatcaattactatattatatgtactatctaaagaaagaaaaagacatcagcaatacagtgggctatttaaattatcagaacatcagaaaacaaattgaaatagaacttactgaagaaaaagaagaagaactggaaacagttcttaatgatattaaaagtattgtcgattcagatgttccaagtcctaaaaagtcacgaatttgtcgaaaatgtgcttattttgaattttgttttgcttaa

SEQ ID NO: 592 - DNA, 969 bp, Methanobrevibacter ruminantium
atgtctaaaaagaattattacttattatcagaaggtattctaaaaagaaaagaaaacaccatatactttgtaaatgaaaaaggttcaaaaccacttccaataaacaagatatactctatgtatgcctatggccaaataactatttcttcacaagtgattagtctgtttgcaaaagaaggaattccaatccatttctttaactattatggctactacaatggcagcttttatccaagagaatcactgttatcaggcgatttattaatcaagcaagcagagcacaatattgatttttcaaaaagattaaaattagccaagctttttgttgaaggtgcggctaaaaacatcttaaaagtgcttgcatattataaaattgaaaacaatattaaaaacaccttaacagaattgaatgaatcttcaaaaattacagaagttatgaatgtagaaggtcgaatccgtgcagagtattatcagtattttgatgacatacttccagatgagtttaaaatggaaggtagatcaagacagccccctacaaatatgataaattcgttaattagctttggaaattctatgatgtatgctagcgtaattactgagctgtacaatactcaattaaaccctactatctcttatcttcatgagcccgctgagagaagattttcactcgctcttgatttaagtgaaatatttaagccaattattgtagatagagttattttttatttagtcaataagaaaatgataactgaaaaggactttaatcaagatcttaactgctgtcttttaaatgataagggaagagccacttttgttaaggaatataataaaagacttgagactaccatcaaacataaagatttaggcagaaaagtttcttatcaaaggttaatcagactagaagcttataaacttaaaaaacatgtttttggtatgaaagagtatgatccatttgttatttggtggtaa

SEQ ID NO: 593 - DNA, 267 bp, Methanobrevibacter ruminantium
atgtatgttataatagtttatgacattaaagtagaaagagtaaataaggtaaaaagtttccttagacaacatcttttttggatacaaaattcagtatttgaaggagaattgacaaatagtgaatataaagcagtaactgatggtttattgaatattattgaagaagatgaagattctgttattatttatcaattaatgatggaagaatctttaacaagaaatgttttaggggttgaaaaggcatcagtggatgatgttattttgtaa

SEQ ID NO: 594 - DNA, 702 bp, Methanobrevibacter ruminantium
atggacgaatggaaagtaggagacccttctgattggggagaccatgttggagtgccagacattccctatatgggatacataaatgatgatggatatgaagaggactattccacattccctgaggaaaatggtggcagcaagcctaaaagcctgggctctccagaggaagatcatggaaagatattgttagtaaaggcaaaggtatatctgaaatggggaaatcttgatggtgccatgagctgcataaatcaggcaatagacatattcaagaatagcagacggatcggttactatgagaattcattgcatgtaaaaggaatgatttatgaaaaaatggagcaatatgcaagagctctctttttttatcacaaggcatttaaagtcggagaatgcgtgagcaatgcttttgatgacagaaataaattgattgatggagacaagatagacatcttgaaagagcagttcaaggattatcgcactgcctatccctttggaagttctttaaagagggatgatttcataatctattgggatttggcatggcgcataaacgaggatagtagcgacactgaaaaattggaattggcattggaagtgattggttttgtcaaaagaatggcgccgagtattgaatttgtaggaagggaaaaggaactttatgaaaaccttgaaaaggagattctagagaagatcaataaataa

SEQ ID NO: 595 - DNA, 180 bp, Methanobrevibacter ruminantium
atgggagaatgtccttattgtggtaaagatgtggactttacagaagtctgtcctcattgcggggctgatttaagtgaatttgatgaccgatgtcccttttgcggagtacttataagccgtgcagcattgatctgccctcgctgtgggtcagatgtatacgaattttggtatggtgattaa

SEQ ID NO: 596 - DNA, 177 bp, Methanobrevibacter ruminantium
atgcattatttagaaaaatataaattaaaatcttttagaaggaaacctaaagtttttagaagaaaatacaatcccttccctgaaggatttgtagagaattttgttagaaaaagctttggagaaattttggattcaaaaatggataattcaaatcaactttcaaaagaagataaatga

SEQ ID NO: 597 - DNA, 681 bp, Methanobrevibacter ruminantium
atggaatatgaaattcaaggcggaaccttccctattgtagtctgcacattgcaagagggagaaacaatgaaaaacgaaactggcgctatggcatttatgacttctggaatgaaaatggacaccaatactggaggaggcctcctaaaaggtcttggaagagcattatctggagataccatcttcttaaactacttcactgcacaaagggacggcgagcaagtaggattctccgcatgcagtccaggcaggatcatgcctataagattggatggaaccaatacaatcataggccaaaagaatgcattcctcgctgcagaagacagcgttgacattgacatacactttagaaaaagccttggagcaggtctctttggaggagaaggtttcgtccttcaaaagttcagcggaacaggagttgcattccttgagattgacggagaaataatcaagaaggaattggctccaggtgaaaagctattgatagatccaggacatttggctgcaatggaagaaagcgttggatttgacatagaaagggtcaaaggagctaaaaacatcctattcggtgaaggactcttcttctcaagattaacaggtccaggtacagtatggctacagaccatgccaataagcagcttggctagagcattggttccatacttgccaaccactactgaatag

SEQ ID NO: 598 - DNA, 252 bp, Methanobrevibacter ruminantium
atgagaagaattgatgagctgacaatagaaattgatcaaacaagccttgaacttgaacaaaccaaaaaagaactgagcatcctattcaaggagctgaggtcatttaaaaagaagattgaaaacggtatcgaaatcgacagaaaggaatatgaagactgtgtgttcaacaacaagctgcttcagatgaaaagaagacggctgattacacatctcaaattcctaaacaaggagttctatgaaatcctatattaa

SEQ ID NO: 599 - DNA, 579 bp, Methanobrevibacter ruminantium
atggattttaattttcacagaattgcaaatgagattgcaaagataccagatgagaagataaaagacttgtcttgggaagatagagtaaaggagctcttaagctttagacaatactataatcaatatcatgaatcatatggcaaggattatttggactttttagaaaaagcgaataaggaaggggacttagagaaaaaggaggatctaatttacttctttaaaaaggagactctaacaaaggacataaatctggacggactgaactatctgtttgtaaacatattcttaaaatatggctttgaatatttggattataatgatacaataaacaatctaaaggacaaatatgatttgaattttaagcatgattggattagtctcctttcaaaggaggatttaagtctttttgagtcaataaatcttttgaattatattcagcgctctgattattgggactatgagcatatgccgttgtcatatgcaatattcgatggaacgattgataatattttaaagggcatggaaaacaatcttgatgaggacaatctagagcttttagatgttttattaaaaaaataa

SEQ ID NO: 600 - DNA, 1413 bp, Methanobrevibacter ruminantium
atggcagtttataaatgtagcgtttgcggatatgaatatgatgaagagaaagagggaaagcctttcagcgaattggaaagatgtcctgtttgcaagcaaccggcaagtgtttttgaaaaaattagtgataattcaaccgaatcagattctaattctaatgaaatatcatctaataatgaaacagccagtgaactgtcttatccaactgaaacttcaaggacagacagctctattgctcatatgtcagacatacataagatggctgtggaaggaacttccatcattgatgcgatgtccacaaggcttccaatgcctagctgggatgatattctaataatggcaaaccagcttaatccatttcctcttgaagagcatgcagatgtgagcacaactacagttatcggcaagaatgccttaaagccaatggttcttgaaagcccaatatacatctcccatatgtcctttggagcactctcctatgagacaaaggtggctcttgcaaagggttccgccatggcaaagactgcaatgtgcagcggagagggaggaatacttccagatgagatggcaaacagctataaatatatttttgaatatgttccaaaccattatagcctgactaaagagaatctgatgaactcagatgcaatagagataaagataggtcagggaacaaagcctggaatgggaggccatcttcctgccgagaagataactctagagatagcagagcttaggggaaagcctatgggggaagatgtgataagcccgtccctatatggggagataaaatcaaaggaagacttaaaagaccttgtaagtcatctaaggaaagaatcagaaggcagacctattggcgtaaagatagctgcaggaagaatcgaggaagacttggagttcatttcatatgcagagcctgatttcattacaatagacggaaggggaggcgctacaggtgcaagcccaaggcttataagggatgcgacatcagttccgaccatctatgcattggcaagggcaagaaagtatctagatgaaaataatctggatattgatttggtgataacaggaggccttagagtctccagcgactttgcaaaggccctatccttaggagcagatgcaatagcgattgcaacaggggcattgattgcagcaggatgtcagcaatatagaatctgcggaagcggcaattgtccagttggaatagcaacacaggatgaggcccttagaaaaagattggatatggataaggcttcaaagagagtatttaattatcttaatgtttcaaatgaggagttaaagacctttgcaagaatcacaggtcatgatgatgttcatgatctttctgtggacaatcttgcaaccttcaatagcgaaatatcagattacacagatattaggcatgtatga

SEQ ID NO: 601 - DNA, 1527 bp, Methanobrevibacter ruminantium
atggaagaggaatatttaactgtaactaaactgaattaccacataaaaagattggttaactctgattcatcacttaaaaacgtttatgttcgtggtgaactctctaattttaaacgctatcccagcggacatttgtatttcactcttaaggaccaaaacagtgaaatcggcgggataatgtttaagggacctgcaagcagactaaagtttgagcctaaaaatggcatgaaagtgctcataaacggctatgtagatgtctatcctaagcaaggaaactataagatatatgctcaaaagcttacagaggatggaatcggcgatttatatatagcatatgaacagcttaagagaaagctatctgctttaggctggtttgatgatgaacataagcaggaaatacctaagtttccaaaaagggtaggtgttgttacagcttcaaccggagctgcaatcagagatatagtcataaccattaagcgaagatggccattatgcgaaatcattctatttccttcattggttcaagggaatatggctccaaaaaacattatcaagcagataatacttgcagacaatgagtttgatttggataccctgatcataggaagagggggaggaagcatagaggacctttgggccttcaatgacgagacccttgcaaaggtgatcttcttttcaaaaactccaataataagtgctgtaggccatgagatagattggacaatctctgattatgttgcagacttaagggcagccacaccaactgcagctgcagagcttgcagtgcctgacattaatgaaatagaatcaaacattaagaatctggatgataggctaaacaaggtgattgacaagcagttcaatgaaaataaggattcatttgaaaagctagtcaacagaaacctctttaaaaatcctgatttattatacaataagaagatcatgtatctggattctgcaaagtcccgtttggcagtatgttcaaagaacatgatttatgataataagattcgggtgtccaatgtaaaaagttctcttatatttaagaatccaaaaatgctctttgaatcaaagtcaaacaagtataatcaattgaaatataatttaaactccagcggaaaaatattaattggcaaaaaggaaagcaaattggataagtataggaattcatttgtcttcaagagcccaaacaggctgtttgaatccaaggcaaataggtattttaaggttaggactaaccttgaatacagttcaataaacctgctgagagataagaaagacaatctgaatgagattaaaaaatccaatccaattaagaatcctcaatccattttagagcctaatgaaatcagattggataagtatattgataagttggatgttttaaatccattgaacactttaaagagaggttatactgtatctagagttgatggaaaggttgtatccaaggcaaaggatgtaaaaaaggatgacattttggaagttgaatttgatgatggcaatgtaagcactaaagttttatga

SEQ ID NO: 602 - DNA, 252 bp, Methanobrevibacter ruminantium
atggaaaatatagaatatgtggaaagcaatattgaaaatttaagttttgaagaaagtttagcagaattagaaagaattgtaaacagattggaaactggtgaagttcctttagatgatgcaattgatgaattcaataaggcaatgaagctagttaaaatatgtgatgaaaaattaaacagcgcagaagaagccattgcaaaaatagtaaatgaaaacaaggaagttgttgattttgaagtagaagaagaataa

SEQ ID NO: 603 - DNA, 735 bp, Methanobrevibacter ruminantium
atggttaaatttgaaattaaaagtcatgacgggcctggaagatatggcaagcttgatggtatggaaagcccagttattttaaaggaatctgatttgaatatggctccagatgaatcatcagcctatgacattgaaagggaaatcgctgaatggagcgttaatgaaacattaaagcttgctcgggaatatgaagataaggatattgcagttattcatggaagcaaatatattgatttgagagtcaaatgcttgaaggaattggaagagatgggatattccggatttatcatagcaaatgcagatgaccttcttcttcatccaagagaccttgtggacttgattgtagagcttagaagaaatatgaaatcaagcagcatacttattttcccacatgctgaagcacagttcattcctcttcttgcttatatgggaattgatgcattctttgatgacattggagagtattacagctatttgaatgtattgatgagccctacaaagaactatgacttaaaggtctatgaattatatgatttaactagagaagagcttgaggaatataataagaatacaattgactttgttttaagggaagtcagagagcatatgaaaaatggaagccttaggaatcttgttgaagagagatccgctacaagtccgcagtatgcttctgctcttagaatacttgataaggagtatgctgattacttattagagtatagtcagttgtattag

SEQ ID NO: 604 - DNA, 447 bp, Methanobrevibacter ruminantium
atggttgataaagatttagtggtgccacgatatttaaatcaattgatggatattgtaaaaagctatgaaatgtacattaggtctaacatcaaagatttagacattactatgggggaagtaccgattttactggctatttatgatgatgaaggtcttaatcagatagatcttgttaagaaattccatgtgactgaagctaatattagtaagactacaaaacatttattgcaaaaaggatttattattaaggaaatcgatagtgacaacaacactaaaaaattattatatgttacagaattcggtgaagagatctgtaaggaattgattgaattctatgaagtttggaagaatgaaattatttccgatgttccaaatgaaaatctatcaatcttttcacaggtattggatacttttacaaacaattcacagaaatattttgaaaaatag

SEQ ID NO: 605 - DNA, 1077 bp, Methanobrevibacter ruminantium
atgtctgtgttagatcgacttaaatccctaatcgatggggcaaaagaggatatcgatagtagtttaactaaagaagcagaatctattaaggaagctgctgattcaatgcagacatcttcagaagaggaaattgagaatatatctgattctgaaactaattctgatgaagaaacttcaaaagtagaagatgctgaagaggaggtaatcattcctattcatgcagaagaagctgaagatgctcctgaagaggaagctgaagaagttccagaagaagctgaagaagctcctgaggaagttgaagaagctcctgtagaagaagctgaagaagaaactgatgaagaagtttctgttgaagaaattaccgaagaggctcctgaagaagaagctattgaagaagttcctgaagaggaagtttctttagaaactgaagaaattattgaagagccttccgaagaagactcaactgaggacgaagagccttccgaagaagaagcttcagaagaaaacgaagagagcgataatatgactttattaaaagaaaatgatatatattcaatggatgatattgataaagaatttacccaaaaattcattgatgctggtattgaaactgtagaccactgtttccaatgtggtacttgtggtggaggatgtccttccggaagaagaactccttacagagtaagacaaatcgtaagaaaatgtttattaggactcagagaagaagtagtatccgatcctgcattatggatgtgtactacctgttacacttgtcaagaaagatgtcctagaagtgtcaaaattgtagatattattaaaatggcacgtaacgaagcagctaaagctggatatatggctgacgcacacaaagctactggttctttcgtaattaaattcggtcacggtgtaccaatcaacgacaaaaccaaagaattaagaaaagctattggacttgacgaattacctccaacagtacattcttacccagatgctttagaagaagtacaaaaaatctgtgcagcttgtgaatttgataaattaatcggcttcaacatggaaaccggtgaattagaatag

SEQ ID NO: 606 - DNA, 885 bp, Methanobrevibacter ruminantium
atggagattgcatatttcttaggttgtattatgaacaaccgttatcctggtatcgaaaaagcaactagaattttattcgataaattagacattgaattaaaagacatggaaggagcttcctgttgtcctgctcctggtgtattcggatctttcgaccaaaccacctgggctactattgcagcacgtaaccttgctattgcagaagaaatgggcgcagacatcatgaccgaatgtaacggatgtttcggttccttacgtgaatgtgaccacttattaaaagaaaaccccgctaaaaaagatgaaattaacgctatcttagctgaaactactgacaaacaatacaaaggtgaaaccaaagtaagacactttgcagaaattttatacaacgacgtaggtcttgacaaactttctgaaatgttcaccaaagacttaggtattaatgtagctgtacactacggatgccacttcttaaaacctaccgctgaagtaggtattgaagaatccgctgaaaacccaaccatcttagatgaattagtagaaatcacaggtgctaaatctgtagactacaaaaacaagatgatgtgctgtggtgctggtggaggtttaagagctagagacattgacgtaaccttaagttacaccaaagaaaaactcgacgctatggctgaagctggtgtagacgctattgtagaagtttgcccattctgtcacttacaatttgacgtaggacaaactgaagtaaacgcaaaatacggaactgacttcgcattccctgtaatgcacttagctcaattatacggattagctatgggattaagtgctgaagaattaaccttcgacgcacaattaatcgacgcagctcctgtacttgaaaaattagcataa

SEQ ID NO: 607 - DNA, 270 bp, Methanobrevibacter ruminantium
atgtttattgcaattttaggtggaatatttagattcaaagatcttccagaagaatatggttcttatgtacagtttaaagcagctattgaaggaagagatgaaatcaaggacaatgatgaaatagctattttagacattacaggcactggaagtcaccatgttctattcttagacagatataataacattaatgaaatcaagaaagaattgagagaagcggatgcaaaagttaatgtcactactttaaaaatattggaaggacatttatga

SEQ ID NO: 608 - DNA, 528 bp, Methanobrevibacter ruminantium
atgagcgatttgcctatagatcaatcttggttagttattgctaacctttcaaatgatctgcataagagaggaattcaaattcccaaacagattaacagtgatttaggtttggtaaagtcccagattggattttataagaaagaccctactcatccagacatgatcaatgagatggcaagggctgaaatgtcattgaatcagattcaaggcatcttattgtcatttgctgaaaatattggggaagactattataatgaatggctggacaagctaaacagagctaatctgggagagaagatatatgagactcctagcacccaatccaaattccttattaatgcacctccaggattttcctatgcaaagatgactttaaaaaagccacttgctgaagatagggtacaggaaatcgctgaatattatggtcttattcttgaattcgattcagatgtcactatagcgctatatggtgataagcctgacattcaagcggcattaaaggagatggcacctttcttctctgaatag

SEQ ID NO: 609 - DNA, 717 bp, Methanobrevibacter ruminantium
atgaaaattttagcaattagtgatatacacggtaaaagaagtgaaaatttaattaattaccttaaaaaagaagacatttctttagttttgattgcaggagacattacagactttaaattggaaggttacgatgacccattagacttcgtcaaaccattcattgacgaacttgtagaagaagcggatgtagatgtatttgcaattccaggtaactgtgaccctgctggaatatgtaatgcaatcaaggaaagcggtccggatgaaaagcctgcattctgtttgcataatcaattgattgcttatgaaaatgtggttataatgggttacggaggatctaaccctactccattcaacactccaggtgaaatagatgacgataagatctatctccacgtttatgagcttttagctgagtatgattatattggaaacgattccattcctagagtaaccatcttgcttacccacgcacctccatatgacactaaggcagacactattgaaagtggagctcacgtaggcagtcaaggtgttaaaaagcctattcatgaattccagccaaacattaacatttgcggacacgttcatgaagcttgcagcatagataaggttggcaatacaaccattgcaaatccaggtatccttgaagaaaatcatgctgtcttgatagaagtcaatgaagacgcaagctacaatgtagaaatcgttgaattataa

SEQ ID NO: 610 - DNA, 915 bp, Methanobrevibacter ruminantium
atgattatcgttcgcggttctgtaaacagaaaagagtacaccagccgtttttcaaagggcattctctctcgatcacttattcgttctgaattaagcccagataaggcatatgaatttgcctctagaatcgaagaggatttgaaaaacaagggagtcactgaaataactacagatgagattgctgatattgtagttaagctccttgatgaggaggaagaaaaatcagtctctgaaagatatctcaattggagaaaggtccgtgaagctaaagatcctctaatcatattgattggaggagcatctggagttggaacatcttcaatggcttttgaaatatccaacagattgggtattaagaccatgataagcacagacatgattcgcgaagtcatgcgaaagattgtatctgaagacttgagccctgtaattcatgaatcctcatttttagcctatagatctatgaaagtagctcctccgccagagtttgactttgtattggctggttttaaagaccaggttgcaactgtaagcgtcggtgtggaggctgttatcgaaagggcattaaaggaaggaataagtattattatagagggagtgcatatagttccgggatttattcgaaaggaattgatggaaaaggataatattgtcatgtttacattgaccttaagcgatgaggagatgcataagaacagattctactctcgttgcggagacatttggaataacaggcctcttgaaaagtatatgggtaactttgaggcaatcagaaagacaaatgcctatctggaagatcaggcaagaaaggaaggcactcctataattgacaatattgatgtaataacaactgttgactttataattgaaacattgactgaaacatatggaggaatgaaacatgttagaaaagactaa

SEQ ID NO: 611 - DNA, 369 bp, Methanobrevibacter ruminantium
atgagcaaggatgttcttacagtggaattggatgaagctactgtatttgcatttgagaaactgatgaagcataagataagcgcaatgcctgttgtcgatgaagacggcaagatggtaggaattgtaactgcaaccgacttaggacataacttgattttagacaagtatcaatatggtactaaggtaaaggatgttatggtaactgatgttgcatacgtttcatctgactgcacaattaaggaagccatttctgtaatgtttgaaaaggctcctggagacagcatcatcaatcaattgcctgtcttggacaatggcgagcttgttggaatcatatccgatggggacataattaaaatccttaaggaataa

SEQ ID NO: 612 - DNA, 2028 bp, Methanobrevibacter ruminantium
gtgttattaatgaggaaaaagatccttttcctaactttgatgatactaatctgttttactttaaacagcgtttgtgctcaaagtttggataatattaactacgctaatgatggatttgacagtgatgagatgattaattgtgatttacacaaagattcaagtcaaaaatccctgaaatcaaatgctttaagcaataagaaaacaaccaatactgttaagttaacagatatgaaaaaagctgaaagcaatgatgttaaacagacaggcgctgcaaaagcaagcaatactaaaagcacaagcaaaagcacaactaaaacaaatgctacaaaaagcaatactactaaaagtaccgctacaaaaacaacagcaaatagttctagcactaagaaagccactcaaaacacaactaccataaacactcagactttagcaaaaagctcaagcagttatatggcttatgttgagaaaaacgctaagctacaggaaccaattacaatcagcaaaaagaaatacaaatctccggaatatttgtatttggtttctaaggctgtaagcaatatttccaaaacaaaagtggaaattaaagataagctaatcacaaattacagcaatactgactgtaaatcagttaacggaactataaataaaactgaatatgtacaagtagctaagaaaacagttagcttcattgaaaagaatcatagagctcctaattggattgcatcatctaaaggcaatataccacgtaaccaattgattttggtatttagcaaatgcttagaccaatataacaaaagcggcaaattacctagctccattaagttaaatgacttagatttaaacaaaatgaagcaaaagattgacagcagtaaaaaggtaaacagtaccagcactaaaaaaaccaacacaagcagtactaagacaaacagtacaagtgctaagaaaaccaacacaaccagtactaaaaagaccaatcctactgcaactagcactaacaataacaaaagcttagtcgaaagcactttagattcaataaaatctattttaaacaatatagaaaataaattgaatcccactaacaaagttctgtctacaaccggcactaaaaagaacacagttaccgttaattctagcaaggtaaatgttcaaataagcagttcttcaactgtaaatgtgaaaatcagtgctaaagacaatacaaatagtggaaagaacactaattctggaagtgctaaaaaaaccaacactacaagcacaaagaaaaccaacactacaagcacaaaaaagatagatacaaacagtacaaagaaaactaacactactagcactaaaaacaacacaagcagtgcaaagaaaactaacactactagcactaaaaacaacacaagcagtgcaaagaaaactaacactactagcactaaaaacaacacaagcagtgcaaagaaggtaaatacaagcagtagcaaaaccaacacaagtgctaaaaacaacacaagcactactgcaaaaagttcttcaaatagcaaatatctgagtacttctgtattaaacgataaatatcttggagaatctctaaaaaagtatttggctgttggtaagaattgtcaagtaaccaacaaagcaattaaaactttagcaaatactcttacctctaaacttaaaagcgattataagaaaggagaaaagattttcaattgggttcgtgacaatatcggatacgaaaagtacagaaacactaaaaaaggtgcattaaaaacactgcaaaccagaggaggaaactgtgttgatcatgcacacctgattgttgcattatccagagcagcaggacttcctgcaagatatgttaatgcaaacaactgtaaattctcttcaggatatgtttcagggcatgtttgggctcaagtattggttggcaatacatgggttgtagctgatgcgacaagcaatagaaataaatttggtgttgtaaagaattggaatgtgaatagctataaattagttggaaaatacagttcaattagtttctaa

SEQ ID NO: 613 - DNA, 1674 bp, Methanobrevibacter ruminantium
atgttttatgaaaagaatttaatcaagaaaaatccattaagagtggatataaggtttggattagtctatccaaatgtatataaaactgctatgagctctttaggctatcaaatcctttataattatgtaaatcttagagaaaacacatattgtgaaagaataatctatccctcctatcgcagtttggaaaccaacagccccttaggggatttcaacatagtatcattttcccttcaatatgaacaggactatttcaatattttagaaattctccgtgatgcaaatattcctttaaggagggctgatagaactttagaagacccattaataattgcaggcggaccatgtgccactgcaaatccgcttccattgtctgactttatagacatttttgttgtcggtgaagcggaagctgtcttaaacgatctaatagataactataatgaaaataaagacaaatttacaaataaaaacgaattcctatccacttttttagacattaagggcctatatatatctgaattcaataacaaaacagatattgccttgcttgatgagatgtctgatgcctaccatataacatgtcctataattaccgaaaccgatgataaggaccttattccagtcttttcaaattcaattctattgaatgtatccagggcctgcacaagaggatgcagattctgcatgtccagctatctctataggccacttagggaaacagatcttcaacagttgtttgatatagcagaagaagcccgtcaaaacacaggattgaataagatatccctaataggtgcagcggtttcagactattccaaggtcaatgagcttactgaagggttgaaggatatgggatttcaggtctccacaccctcaatgagaatagaatcaatcacaagggaaacattggtatcgcttagagaaagcggccttaagaccttgacaatagctcctgaatccatctaccaccttagaaaaagaatcaataaggacatttcagatgatgatgtattcagagtaatcaaagacgctgtggatttaggttttaatcttaaattgtattttttaattggtttgccctatgaggatgaagacgacattaaagaacttgcatgtctgatgaagcagattgattccatgaagtatttaattgattcaaatttaaatgaatccattaaaaaggaggaagttttaactaaacataagtcaaaatcctctggaaaaaaatccaagtcaaagcaaaggaaaaaggccagggtttcaataaagttcagcgtcaatcctgttataccaaagcctcacactccccttcaatgggaaggctatgacatgaagagaatcaagtcaaagataaaatatcttaagaagaacttaaagggattggacattaagtttgacagcggaaagatgggattgattcaatatgtcctatcctgtggggatagggatattggagatcttttagaagagtcattaaatagaaagataagcattaaggagtggaaggaaaatgctccaagctatgagattggggataacttaccttgggattgtattaatgtaagtgtgagcaaggagtttttagagtctgagtatgagaagatgaaaagcggagagcagactccatggtgtgaggatggctattgttacggttgtggggcttgtaattag

SEQ ID NO: 614 - DNA, 1116 bp, Methanobrevibacter ruminantium
atgttaaatccggctaagagagttgaagcaatagaactgtctcaaattagaaagatgtttgaagtgaccaatgagaatgcaatcaatctgggaatcggcgaacctgatttcaatgttcctgaaaatattcgagaggctatgaagaagtcaatcgatgatgggttcaccaaatacacttcaaacaagggaatcatcgagcttagagaatccattgttgaaaagctatcaaaggacaataatatcaagacagattctgaaaacattatagtgactaccggtgcaagcgaggcattgtactgctgtgcacaggccctatttgaaaagggagacaatgtattggttccaaaccctggatttctctcctattactctgttgtgaatctggctgaagcaaatattgttgaagtcacaactccaatggaaaatgagtttaagatgaaggttgaggatgttcaggaaaaattggataagaataccaaggcattgattataaactctccatccaaccctaccggtgcggtaatggataaggaggatgtcaagggaattgcagatttggcaacagaccatgacttctatatcatttcagatgagatctatgaaaagataatctttggaagaaagaactattctcctgctgaatattgtgacaatgtaattactcttaacggattttcaaaatcctatgcaatgactggccttaggataggatatatggcagcaaatgaggagataactgaaaatctccttaaggttcatcaatattgcgttgccaatgcaacttcaattgctcaaatgggagctcttgaagctcttacaggtcctcaagactctgtagaaatgatggctaatgagttttcaagacgaagagacttgatagtctccagcttgaatgatatgggttatcctactgttaactgtgaaggggcattttatgtcttccctaaggtggaaaggcctatggactttgtaaagaaggcagcagaggctggagtcatttcagttccaggtgcaccattcggaagccttggagagaatcatgtgagaatgtcttatgctaattcctatgagaatattgaaaaggcaatggacatcttaagagatttggagtattag

SEQ ID NO: 615 - DNA, 2349 bp, Methanobrevibacter ruminantium
atgctatttgtcatgatagcgggggtatctgcaagtgatataatggatgcatcagataatccaaataatgatgattctattaatctagtatctcaagagtctggtaatgatcaaatatctaatgaagccatttcagtttcaaatagtcttagtgctaatgatgattcttatagtccggaatctgaaaagataagctctaaaataaagacttcaaataatttaagtgcttcaaacagcacaaaaaccactactaaggccgctgcggctaaaactactaaaactggcactagtctacaaccatctagcaccagtatatattcaggccaatatcttgtcatcacattaaaggacaagaattccaaggctttaagtggtcagaaggttttaattaacatttccaaattcaaaaacacatatacaaaaactacagattccaaaggccaggtcaaattggctgtaaatcctgttggaagctttaagttagttgtttcatatgctggaaatggaaattattcctcttcaaagtattccggaaccctaaaggtttcaaaaagtgatacaagtctaacggttgcaagcacttccgttactatgactactcccttagttgttacattaaagaataaaaagaccaatgaggccttatccggcaaaaagataaagttcgttatggatagagtaagctattcaagaactaccgatgccaagggtcaggcaaaacttaaggtcaatatgaaatatgtctttaatgtcacagttaaatttgacggaacaggcaatcttaaatcttctaaggtgaccaagaccattaagcctaccaagattccggtaagctttgtctattcagcaaactctgtgaaatatggccattccataacagtcagtttaaaaaataatttaaacaacaagactctctctggcaaaaagattgtagtcaagactagcgactctaaaaagtcaacaacaaagactacaagttcaaaaggaacaatcagcgttcctatcaattctgtcggggatgtcactgtaagcctttcatatgctggagacagctcctataaggctgcatcaagcagcaagaagatcaagggacttaaggattcaagtaaaatcactagctccactggtaccattcctgttggagacagctatacagtgactttaaaggattcttcaggtaaggccttatccaataagaagattgtcttcactttcgatggaaagtcatacacaaagacaaccaactctaaaggacaggccagcttggctatctctaaaggtcctggaacatattctgtaaatgtgagttatggaggagacagttatcatagcggaagcaagctaagcaagaatgtcaagacatccaattcaatgattagcattgccaatgtgattaaggctgcaactaccttaagggctcatgttgactatacaaacaggtttaacaagtcctatgtggtaaccatcaatggattgaagtattctcctgatgaatttgcatatatgatgtctcaggctatagtcaagattaacaatggccaaaaaagcggttatgtgaccttcaagaaccttactggagattatgattctaaaggatcttccataaacggcaatttgatgaaaaagaattacatcagcctagccaatacactcattagcagcgtaaataagaacaataagatacctgctaacatatctaccaatttaggcaagatcgaagcaaacctttatatcttcggtttggctaaggcattgcagttctatggagaggaaaaatacttgcctaagtatttgattcttaaaaacagtttcataaaaggctcatcctcaactactgtcactcaaaaggcaaagattctaaattgcaaggaggcattcaatgccactgaatttgagaaataccttaagacaggaggaaagtctgcccttaactcagcgattgtcgctaaggcaaaatccctaacaaaaggattgaccagcgataaggctaaggcaaatgcaatattcaagtatgtaagggataaggtttcctacagctactattcagacagtaagaaaggagccgctaagacatataagacaaagtctggtaactgctgtgacaaggcaaacctaattgttgcaatgtgcaggtctgttggagtatatgcaagatactcacatgctcagggctgtaccttctcaagcggattggttgcaggacatgtatgggctcaaacatatgatagggctacacagacttggtatactgctgatgctacaagctccagaaacagtttgggaaaaataaacaattggaatactaagaaatatagtcaagcaaagaattatgtgcttattccattctag

SEQ ID NO: 616 - DNA, 453 bp, Methanobrevibacter ruminantium
atggcaaagtataagagagtggcagttggcggaacttttgacaagtttcattatggccatagaaaattaatttccactgcatttgaaattggggaaagcgtagagataggagtaacctcaaatctatttgcaagcaataaaggagatgtagactcctgcaacacccgtatggctaatcttaacgcttttttaagcaagagccatgacaatttccatatatcccgtttggatgatgcttacgggccaaccatttatgatgaaaactttgatgccatagttgttagtgaagagactgagccaaatgcaataaagatcaatgaaatcagggaatctaaaggcatgaagccattagatattgttgtggtgagctttgttttggcagatgatggaattcctatttcttctacacgtatccgtcaaggtaagattaatcaaaagggtgaattgatttaa

SEQ ID NO: 617 - DNA, 975 bp, Methanobrevibacter ruminantium
atgatttttattcaaagagatggtgcagaatctagaaaattatcttatgataataaagtatgtttggcatgtggtatttgtgcagacacatgtccaacagattccctagccattgctgatgttttggcaattgctagaggtcaagctgagggaaataatattgtattggaccaggatacttgcgtattatgtggtttatgttcatttgcatgtccattcggtgcattggaatttgatataggcggacaagatgcaagtgaattgccaaactatcctaaatggactcatgaatcctcaatcagtcaggatgactgtgaattctgtggaagatgctacacagcatgtcctcaagatgcaatcctattcaaaagagagttgccagatagaaatgcgcttctaaagggtgaaatctccataaatgaagatgactgtatctattgtcaggtatgtgctgaaatctgccctgcaggagctataagtctcactgcatctgacggcaagatattagacacaatcgaagtggatgaggataaatgtgtatattgtggagtatgtaagagagcatgtcctcaagaggcaattaagactgtatgttcaacttgcatgtacagcgatgagattgaaaagatcgctatcaccggtgacatattcattacagaagactgcattaactgtggatggtgtaaggaaatctgtcctgttgacgctgcagaagtcactaaaccgtttgatggtgaaatctccgtcactgaagaggactgtgtcgcttgcggatcctgtatagacatttgttcatgtaatgcagtaagccttcaagacaatgttgctgtattcaatcaagactactgtgtcttatgtggagcatgtgcaagactctgtccacaagaaagaattgctattaatagaacagatatgaaattgactaatattagctctgcttcctggaaagctaatttagaaaagctacttaattag

SEQ ID NO: 618 - DNA, 237 bp, Methanobrevibacter ruminantium
atgaatcgacttccaagggaaactgtctttgagcaaatcaaaaggaactttgtccaattgaaggatgaaacttccggccaaggagctgcagaatatattctcctattcggaggagttattgtaattgccttagcaggtcttttaatctatagatcctacttcagcaataacaccagcggattgaatgcgactcaggacatcaactccatcagagacaatatgagcaatgtcttatag

SEQ ID NO: 619 - DNA, 714 bp, Methanobrevibacter ruminantium
atggaaattagatggttaggtcattctgcatttgaaattataagtgatgaaggagttaaaatattaatagacccattcataagcaataatcctacttgccctattcctgtagaggattttgaggcaaatatcatctgcataacccatggtcactctgatcatttcggggacgctatggaaattgcaaacaatactaatgcaacattggtggcaaatcatgaaatctccctctttttaggggaacaaggatttgactgtgttggcatgaatactggaggaaccgtttccattttaggaatcaatataaccatgcttgatgcaaggcactcctcttcaatcgactttacagaggaagtccgtcctggaggagaccctggaagctttttaataacccttgaggatggaactaaaatcttccatgcaggagatacaggattattcggcgatttggaaactgtagtgggaaacatattcaagccagacattgctatggttcctataggggacagatttaccatgaatccattccaagcagctttagcaagcatgtggatatctcctaaggcagttattccaatgcattacaatactttcccagctattgaacaggaccctgcagtattttctaattttgtatatcagctaaatcctaatatagatgtagtgattatgaatccgttagaaacttatgctccagactttgataaagaataa

SEQ ID NO: 620 - DNA, 687 bp, Methanobrevibacter ruminantium
atgagagaattgaatatggatgaaataaaaaacgctgaaaagatagaatcctttgaccaagtcagcgcaaagcttaataaaaccgagaaagaagaaatagttattgatgaaatggacatagttttccttttagataaaagcggatcaatgtttggtatcatagatgacactcttggaggatttaactctttcattaaaagggaaaaggaaaaggaagtgaaaactcgtgtaactcttgttctttttgatcataagtataaggtcttatacactagaaaaccaattgaagaagttgaagagcttacagaagaagactattacgcagacggatgcactgcacttttggatgcaattggaactaccatcaatagaatcgagaaggaagtctgcgatgaggtcctttttgtaatcactacagacggacttgaaaactattccaaggaatacagtagagaggacgttaagaagcttataagaagccataactggaatttcatattcattggagcggacatagactcttatgaagaagctgcaagccttggaattcctagcacacgttctgccaattatgaaaaaagcagaagaggagttggttctttatataggagcgtttcctatgcaaaaagactacgttccagtggagaatctttagataaagttaattggaaaagaggtttagattaa

SEQ ID NO: 621 - DNA, 663 bp, Methanobrevibacter ruminantium
atgacaactgtagctgaaacagtatataaatgtccactttgtggatttgcacatacaactgactgcatgacaagcacaagtgcttttggagctccagatttagatggaagaccttcccctatggcaagactaacaatctatctattcattaaggaatgtccaaattgcggctttacaagctatggctttccagagcatacaagtgtctctagagagttcatccaaagcgataattacctaaactgtgataatattgatttcaaaacagaaagggctaaactgttttatagggtctatctaatatcaaaagaagaagggatgatgaatagggcacttacagatcttgtccattgcgcttgggtttgtgatgatgacgatgatgaggaaaattccatcaagctaagacttctcataaacgacttattcaatgagctatatgactttaaaagtgatgaagaggactacgcccatttgattaagcttgattttatgagaagaggacatctattcgatgagcttattgaagaagttcgccataagacctttagcaaatccttttataataaggttaaggactttcaaatggaaaaggcaaaaaacagagatgccggtaaatacacctttgatgatattgaaggctatgaagagtataaatatggttaa

SEQ ID NO: 622 - DNA, 2010 bp, Methanobrevibacter ruminantium
atgaaatcaatgaccaatgtagacataaacataatatgtcaggaattaaatgagttattagctggagcaagagtggacaagtccttccagcctacaaaagacacagtggtaatgagattccacaaggcaggaacaggaagaatggatcttgtcatacaggcaggtaaaagaatccacataagccaatatcctcttgcaaacccacaaagtcctccaagctttcctatgcttcttagaaaaagggttaagggtgcaaatgtagtgagcatccaacagcacaactttgaccgtgtagttgaaataaaaatgaaaaaggacattacatacaccctcatcgtcgagctctttgcaaagggaaacataatccttcttaatgaggaaaacgaaatcctccttccacttaagcgtaagcaatggagcgatagggacataagcagcaaaaaggaatatgtcttccctatcgaacacggaataaacccaatgacaatcactgaagatgagtttaaggaaattatcaagtcttcagatgatgagattgtaagaatccttgctaaaaatggacttggaagcctttatgcagaggagatcatgcttaactgtgagataaacaagaaaacactttcctcagaacttacaaaggaagacatactggagatatatggagccttgaagaaagtctttgaaggccttgagaaaaaagaattcactccaatgattgtaaacaacagaaaggaaatcgaagagcttaaaaaacaaaacccagacaagcaatacaaggtcaaggaagatgtagtggccataagacttcaccagtatgaaaacttcgaagaggaatcctttgacagcttcaatgaggcctgcgatgagttctactcctcaaaggtaaagcatgaaatcacagacatccaggaagccgtatggaacaagaaggtagggaaattctccaaaaggcttgaaaaacaggaagaaacattaagaggatttgaaaaaacaatagaagattcccaaaagaaaggagagctcctatttacaaattatgttcaggtggaaaacatattaaatgtaataaaggacgcaagggaaaaggactatggatggaaggaaataggaaagaccctaaaggatgcaaagaagtctggaatggctgaagcacagatattcgaatccatggatcccctcggaaacatcacattaaatatagatggaatttcaatagcccttgattcaaagaaatctattccggacaatgctgaagtatactatgaaaaggccaaaaaggctaagcgaaaaataaaaggggcaaaaatagctattgaaaacacaaaagcccaattgaaggacatggaagagaagaaggaaaaggcaatggcaaatatcatggttccgcaaaagagagtcaagaaaaacctcaagtggtatgagaaattgagatggttcgtctcaagcgacggaacattagtagtatgtggccgtgatgcaggtagcaatgaggcagttgtgaagaaatatttagaacaaaatgatgtttatctgcatgctgatatacatggtgctccttcagtggtagcaaaaatttcatccgataaattaaataacaatttgcttaaagaattaggcatctttgccgcttccttttcaagtgcttggtcaagaaattacggaacacaagacgtatattgggtggagccagagcaagtttctaaaaccccggtttcaggtgagtttgtgccgaagggtgcattcataataagaggaaaaagaaactatatcagaggggctaagctagagatagcaattggaattgttgattatgatggtgaaaagagaattatggcaggcccggttgatgcacttaaggcatatactgaaaagtatgttacaataaagccaggatatactaaaaaagagaagatagctaaagagatactctctagaataaatgaggacaatattattgaattggatgatgttgttagggtattgcctagcggtaaatgtgactttgtctaa

SEQ ID NO: 623 - DNA, 8640 bp, Methanobrevibacter ruminantium
ttgaatcgaaatagcaaaatcatattaatttcattatttacactgctattgcttgccattccagcaggatttgcagcagatattgaatcaaatagccacaataatttagatgattcaaatacagtaaattttgaaattaatgcaaattcaaaggatacaaacttagagagtaatttaaatactggcaatttagaaatgaattcaaataatactaatttggatatgaattcaaataaggcaagattagcaatgaattcaaatgccagtgatttggaaacactaggtttgacaagaggggaatttgaaaacggatcaaacaatccaagcctagaatattcaagcaattcactctcagacaattcaaataataaatatatatccccatctagtgataaaaacacatatggctccaacaaggtaggtgacggtaacgtaaacatatactactttgatgctagtgctagtgacgatacaggtaacggcagcttagaaaggccttataaaacccttaaaaataatagaattgtagaaaactccataaattatcttgcaaacggagtatacaacctagatgctacaataaataaaaataatataagctttattggtgcagactcttcaagaacaataataagctacgcttcaactgcatttatcacaaacaatatcctaaactttgaaaacatcacattgaaaggattaaacattcaaaatagaggaaacctaactgctagaaacaccattttcataggtggaaaaggatattgggatagatcttacaacaatattttcggaggggcaatatatacaccccaaaacgaaaattacactacaataatcattaactgcagcttcataaacaatacagcagattatggaggagcaatctatgcatgcggcggaaacgtgactgtagaaaactccagcttcataaacaacactgccgaaaggtttggaggagccattgcctctgaaaataccttaacaaacaatataagaaatgtcgaattcatccatgacgtttcactaaacgatgcagggggaggactattcatatcattcacccaattaaacggcactgacttgcacttttacaattgcagcgcagactttggaggtggaattaccgcactttactccaacgtttccctaaatagattcataggaaaagacaataaggcaagatacgatggaggagcaatctatcaattctactgctcattgctcattgaaaactccctatttgcaaataactctgcaaacaatggtggaggattatatgtcgacaattcaaactccctaaaggtcacaaagtccaatttcacacagaacaatgcaacagagaagggaggagcaatctattcattatggaataccttagcagaaggaaactccatatccaacacccgcttcaacaatagcttcagcaacaacaatgccaagaattattctaatttttatgaaggcaaggatgtcaatatgagaattggaagcggcaatgtcaccctataccatcgtaacgaaactgaaatcgatgagattccaagctattacagtcttatagatttaaatcaggtcacttccataaagaatcagcaaagcggtggaaactgctgggcatacgcctcaattgcagcccttgaatcagcaatcataaaggcaggaggcgaggcacttgacctttcagaggaaagcatgaaaaacctgatagtcctcttttcagattatggatacccatggctaaccaataacggaggaaatggggacttcgccaacgcttatttgacctcatggctagggcctgtctttgaagatgacaatccaggagatgacagatcatacctctctccagtcctaaacagcagaatacatgtgcaaaacatccagtatctaggcagaaacaactatacagacaatgaccgaatcaaggaagcgataatgaaatacggagcagttgcaacaagctattatatggataacagctattacaattatagaacttccgcatattattgtccttcagccactagcagcaaccatgcagttgcaatagtcggatggaatgacagctattccaaaagcaacttcaaaaccaccccacaaggagatggggcatggatagtgaaaaacagctgggatactaattggggagacaatggatacttctatgtttcatattatgacattttgatctttcctttagggtctatggactggggacatgcatatgtcttaaacgatacaatcaagcttgacaagaactaccaatacgacatttcaggactcacagactatttctataatgcatcctctacagcatggtataagaccaagcatactgcagatgaggatgaatacttagctgccgtgtccacatacttcctgacaacaactgactatacaattttcataaaagtgaatggagaagagctatataatcaaagcggaaacagcgaatatggctatcgtacaatttatctaaatgatttcattccactaaaagcaggagatgtctttgagacaatatttaagataaatgtaagtggagaaactggaattccagtatctgaaggctctgccttcaacaaggtcttatatgatcggaaccagtcattcgtaagctatgacggcattaactggctggacatttatgatatttattggacatataactccgatgtttacggatcacactattatgtatctgcagcactctgcctaaagtcattcagcttcataaatgaaatcggaacaaacctgaccttggaattcaattatagcctagataatgaaggagatagaataagtccagtgaatataatcgctcacgtcattaacgaatacggtttcaatctagacaacggacaggtaaaattcatcattaacggtacagaaacaatagcagacttaatcaatggatatgcaaacataagctggaactttacagatattgaaaatgaggtttatgcattatttgagaaaacaggatacctctcaagctccgctaatgagacagcaacactttccgaaaagtatgtcacacttgatttgaatactcttttaagtgaagacaagctcacaatcactgtagacagctcaagaaagattaatgaaactttaatactagagataaatggagaaaagcacccatttaacctttcagaaggccatgttgtatacgacttatacgatattgaagatatagactacttaattagagcctatctgaatgacactgggttctataactgcgaagagaaaagcacaatatttagattaaatacagaaattacagagataattgcttcaaattttacaacagatgattatagcaatgccatctatgagataagtttagttgattcacaaggtattggaatagccaataaggaaattttatttaatatatctggcaatttaactaataataacaacaataataacaattttaacaatataatatttaatttaactacagacaatgatggaaaagcaaggattccaatcaaccttccaggaggaaatttcacaataaatgtccaatccaaagggaattatctatattcatcagctgaagttgcccttaagctaaaagtcaaggataaagtaagactagacattgatctcaatttgaacttcaatgatttggaagtgattattgaattaaacagatcattaaacgaaacagttaacttcagctttgcaggagaaagctcaatcatcagattagaaaacggaagagcttcagttaatttcacaggattaagcaacaataattatacagcaatcgcttatttggaaaacgacattgattatctttcaaacattgctcaaaaaacaatagaaatcaatataagaaacttaataatccaagcagatacaataaacactacaaaccgttactatggcaattatacaattcttctaactgatgaggaagttaatgaagtagccaacaaaacattaaatgtaaaaataggtgaagaaagcttcaataaaactagcgataatgatggaaaagtaatcatccctcttgatttaggaattggagaatatgaagtaattattagcttcaatggagataaggatttctttaaagcaaatgcaactagaacaatcaccgttttagaaaagctatttgcaaatatcacagtttccacattagtggatgaggccacaatagacatcattatcgataagaagattaatgagacacttaatatcagcatagaccaaagcgaatatccagtattgtttgaaaatggaacaggacagttaatcctagacggattggaagaaggaaaccacatagtcaccatagatcttctcaaatacctattatttgaaagcaaagagttcgaaatagataaaagcataaatctaagctctgatgactttaactgctatgagcacacaaacagcacttataccgtgcttttaaccaacaatggcaaagccttagcaaataaaaccataagattcgtcctaaatgacacaacaaccataagaaatacagatatggaaggaaaagccagcattgacattgatttaagcccaggagtctatgagctgaacattacttattatgatgatgagagaagcgtgattaatacagtctatgtattgtccaacataaccaatagcacagatcctaaattcaatgtgacacttgatatggacacagttcttagtccagacaagctaacaatcaatgtaaactgctccaaaaagattaatgaaactttaattctcgaaataaatggagatcaacactttataaaccttacagatggattcgtaagctttgacttatatgagcttgaaaagatagaatatgtgattacagccaaactaaacaacaccgacctttacagatttgaagacaagtcagttaattttgaattaaaccaagaagcaacagacataatagcttcaaactttacaacaggtgactacagcaatgaaagatatgaaataaccttagttgactccgaaggaattggaatatccaataaagagatttcatttaacatttcaaacagtttaatgagcaatgagaattatatcatatttaatcaaactacagacaattcaggaaaagcaagcattccaattaatttggctagaggaaattacacaataaaagtccaattcaaagaagattacttatatttagcttccgaatctactgtagatttaaaagtaaaagaaaatgttaaaattgatattgaattcaaacaaatgatcaatgacttggaagtcattattgaattaaacaaaactctaaacgaaacagttaacttcagctttgcaggagaaagctctatcatcagattagacaatggcaaattctccattaattacacaggattagcaaacaataattacacagtcattgcatatattgaaaatgacaccaattatcattcaaacattgctcaaaaaacaatagaaatcaatataagagaattaataatccaagcagatacaataaacactataaaccgttactatgacaattatagaattcttttaactgatgaagagggcaatggaatagcaggtaaaaccttagatataagaatagctgaaggaaactatattgaaactagcgacaatgatggaaaaatagtcattcctcttgatttgggaattggagaatatgaagtaaatattctatttaatggagataatgagttctttaaagcaaacgtaaccaaaacaatcactgttttagaaaagctatttgcagacatctccatttcaactttagttgatgaagctacaatagacattataatagataagaagattaatgaaacacttaatgtaaatatagaccaaacttcatatcatgtaatatttgaaaatggaaccggccaattgactgtagacggattggatgaaggaaaccacatagtcaccatagatgttctcagatacctattatttgaaaacaaagagtttacaatagatagaagcataaatttaacttcagatgactttaactgttatgaacacacaaacagcacttacactgtatcattaagcaacaatggcaaagtcttagcaaataagaccataaaattcatcttaaataatcaaatcattttaaggaacactgacagcgaaggaaaaacttcaatcgacattgatctaagtccaggagtctatgacttgaatatcatatactatgatgatgaaagaagcagaaccaatacaatttatgtactgtcaaatataacccatagcacagatcctaaattcaatgtgactttggatatggacacagttctcagtccagacaagctaacaatcaatgtaaactgctccaaaaagattaatgaaacattaattctagatataaatggaaaagagcaaattttaaaccttaatgatggattcgtaagctttgacttatatgagcttgaaaagatacaatatgtcattacagccaaactaaacaacacagacctttacagatttgaagaaaaaactattctatttgaattaaaccaagaatcaacagacataatagcttcaaactttactacagacgattatagtaatgcgatatatgaaatacgcttagttgattcctacggccttgcaatagccaataaggagattttatttaatatttcaaacagtttaatgagcaatgagaattatatcatatttaatcaaattacagacaattcaggaaaagcaagcattccaatttatcttccagggggagattacacaataaaagtccaattcaatgaagatgacttatatttatcttccgaatctaacgctcacttgaaagtcaaggacaaagtaagaatcggcattgaattcaatcaaaacatgaatgatttagaagtgatgattgaattaaacaaacccctaaacgaaacagttaacttaatatttgcaggagaaagctccaatgtcaaattagaaaatggaaaagcttctcttaaattcacaggattagcaaacaataattatacagcggttgctcatcttgaaaatgatagggattatatttcaaatatcggcgaaaagacaatagaaatcaatcttagaaacttaataatcatagcagactcaataaaaactaaaaatcattactgggacgattatacaattcttttgactgatgaagaagggaagaatgtagccaataaggcattaaacattaaaatcgatgcaaacagttttataaaaactagcaataatgatggaaaagtaattatccctcttgatttaggtcttggaatgcacgaaatcaatattgcatttgatggagacaatgaattcttcaaatcaaacattacaaaaacaataaatgttatagaagaaatctctgtcaatgtcaatatttccactttagtagataatgcattaattgaccttaaattctctaaagaccttaatgaaaaaattgatgtccttatagatcaaaacttatatccagtatctttagagaaaggtgccggacaaataagggtcaatggattagaggaaggaaagcacattctaaccgttgatcttccagaatacctattattagaaagtgaagagtttgaaatagataagacaatcactcttatttcagatgactttagatgctatgagcattcaaacagcacatacactgttgttttagagaataatggcaaagctttagcaaataaaaccataaaatttgatttgaataagattgtgaccataagaactacagataataatggaaaagcatatttgaacattaatttaagccctggaacttataaattgaatattgcctactatgataatggcagaaataagattcataatatttatgttttagctaatactagtggtgataataagacaaatgaaactaattcaagtagtaatactaacccaataaacaatcaaacaaataatactaatccaactaataatacaaaaccaataaacaacgaaacaaacaacacaaacccaaccaacaatacaaatacaaccaacaatacaaatacaaccaacaatcaaacaaataacacagacccggttattgttagaaaaggaacaaatatactctgtcaaaacatgattacaactgcatttgacagcaaagtagatggcagaataggtaaatacttcgttgtaactttagttgatgcagactacaagcctatggccgataaaaccatttatattggttttaatggtaaaaaatacattagaaccactgattcatcaggtcaggcaaaactgcagataaaccttgcttatgaaggaagctacacctttgcaatagcattcttaggagacgatgactataagggcagctttgttgttgcgaatattaaagtaaataaacaaattcctcaactaaaatcatcagataggacttatagatcaattgcaaagacaaaaacattaactgcaagcattaagacagcccaaggaaatgctatcaccggcaaaaaggtcatatttacaataaatggtaaaaaatacactgcaataatcaacagcattggtattgctagcgtaaaagtaagtctttctaaaaaaggaacctatagatttacagttcaatccgaggcaagttctacttatgcaagcactaaagtcactcataaattagttataaaataa

SEQ ID NO: 624 - DNA, 1818 bp, Methanobrevibacter ruminantium
atgtccagtatgagcagtgttgcaggattatccaaatacattagaacattgcctaaagccaaaagcacttttctaatgataatcgtattgagctttatcataggcgcagttctctttttagtaaagcctatgagccttggaagcggtttggagaatttcttctacggtggtgcattcggatttgtagtttatgggcttcctgctattatcactggtgcaaccgatcagaaatgggttagcaccctaaaggggataaacctaaagatgaagcattccatgttccttgcccttgtatcaatgaccatggcaggggtaataagcatcataggaacaatcataggaaatatcctccacttcgacctgtttataaactcaattctttttggaatagtaattgcatttgcattcaatatccttgtaatatggagcgttacacggattaggctcatcaaatccgttcttgttgcaatcattcagccattgctcatgattggagtattgattatcacaagctttttaaacaacctagaaagcgtctttgagcttggaatatttacaaccttcttcaaggtaataatagcaagtgcagtcttcttgcttgcaatctattcattcatttcaattgtagaatccccaatgaaaaagaacttaggattcggagctttggaaatcctcagtttcttcatttcacatatgaacgaaggttccaagtcaattgaagagcttttcgacaatgctggagaagcaattgacacacttgttggggtctgcagcttcagaaagccagacggagatattaaggcattgttcattagcccttgcgttcacccaggacctcttggagacattggaggttcaaatatgcctacaatccttgcaaacagatttgattcatttgcaatggttgcacatggaccatccacccacgacttcaatcctgtatcaagcgatgagatcgttaaaatcgagtcatcagtgagaaccgcattggaaaatatggaatactcatcaaaggcaagcagattcgtcagatactcccataagaaagcaaacataggcacccaattcttcaataatggatgcgtcatgctatcaacattcgcaccttccggaagcgatgacatcgagtttgcagttggtcttgcaacaatgattgaaagtcagaaggagttggaaatcgacaatccgattcttgttgactgtcataactcattcaatgcagagaagggaggagtgcttccaggaaacccagagctcttccagctattggatacaatcaaattgattgaaaaaaaagacttggagcatgagataaaggtaggatgctattccacagaccttggaggctttggcaagcatgaaggaatcggtgacagcggacttaagacaatggtcattgaggtagacggccaaagaactgcttatgtgcttttcgactccaataacatggaacttggctatagggagaccatattcaatgcagttgaagatcttgagattgatgagatagaggtcatgaccacagacacacattcagtaaacaccttatcagcaggatacaacccagtgggaactgtagaaaaggaaaagatcattgaatatgtgagagaatcaatcattgaggcgattgacgacttggagacagttgaagccggaacaaggacagaaagaatagaaaaccttaagacattcggccctaacaactcaacagagcttatctctacaatcagctcaatcgtatctgtaagtaagatagctgctcctttaatatttattatggcaattatctttgtattcatttggatctacttattttaa

SEQ ID NO: 625 - DNA, 531 bp, Methanobrevibacter ruminantium
atgatagaattaaaaactccaattacagatgatgacattgataagctgaaggctggagatgttattacaatctctggacagattttaaccgctcgtgaccaggctcataaaagaattctagagcaaggagctcctttagatataaaaggtgctgtactcttccacgcaggccctattattaaggaagaatcagatgacgcccagactaaatatgagatggttgctgtaggtcctaccacttcaatgaggatgaatccatatgaggcagatgtcttggatatgggtgcaaaaattattataggaaagggaggcatggatgatacagttagagaagcccttaaaagaaacaatgcagtctatgtggttgcaactggaggctgtgccgcattgtatgtggataaggtaaaagagattaaaggagtggactggttagatctgggcatgcctgaggccatctgggatttggatgttgaatcattcggtcctttgattgtagcaatggacagtgatggaaacagtctttatgactaa

SEQ ID NO: 626 - DNA, 6198 bp, Methanobrevibacter ruminantium
atgaaattaaaatacttaatgtttattggcttattattaataggtctattaatcatccctataagttttgctggtgatgcagacagttattctgcatattctggtgattctattagtttagaggatgataattcttatttagaatcaaatacagttttaaaggattctaaaaattcattacaatctattgatgatgattgtttgattggaaataggactttagatgatacaagttattctgattcaactaattcagaggatttaacaaatcctgattcaactaatcccgattctactaattcagaagatttaactaatctagaaagttctgcaaatacagactcatcatctgaaatcaaaacaataacaaagagtctaaatgaccaaaatacaaacataaaaagcttaaattatgatgagtacgcagactacatcaatttaaacaatcagcttataaactacgactttgcaatttcagactcaaatacaatattcgtaaatgcatcctatacaggttcaacagagaatggaagtcaagcaagtccatataagtcaatctactctgcctacaattatgcatttggattgtcctctgatacaagaacaaatgtgtatatagctaaaggggtttacacagtaacaagaagaatgaccatcaacaaaaatctaaatctcattggagaggattccttaaatacaataattgattgcaatgggaatggtgcattctttattagtcctcgacggtcttatactacagtatatagcccattgctaaacatattcaatctcacatttacaaatggacgctattccagtggaggggcaatatacattaacgaaagtacagttaactttgtaaatgttatttttaaaaataaccgagcggaagcttcctattatggttcagtagaagggggagccctatataacaataaaggatttgttcgaatctacaactgcttatttgaaaataacactgcaaacgatacttcagatgcatgtggaggcgcaatatataacgatatgggtgagatgacaataatgggctcccaatttataaacaacacagcaaaaggagagaatgctgccggaggagccatttatgatttttcaggaattcttgtaatcttcaactcaacaatctcaaagagttcacttctctccaactattcaatgggaggaggacttgcaagctggtcaagccataacatattcataatcaattccacctttgattcaaatgagggccatggaaaatacgtctttggctctgcaattgcaaataaggcaatcatgatgtatattgaaaattccacattctcaaataaccttgcaaatggaaccagcgataagaatggaacatttttccatttgaatggggtccttgactttgacaatgtgaatttcacaaataaccgtgcaataaatccaaaagaggatatcttgatttgtcttgaagatcaatttatcatatccgaggcatttagccaagaggatatagcagaaatccttagtgaaatggaacttagccagttgccttcatcctatgacctaagggactacaatcttgtcacttcagttaaggaccaaaagaattccgggtcctgctgggccttttccactcttgcagcccttgaatcctatcttttaaaatatgaaaacacatcatatgacctttccgaaaacaatatgaagaatcttattggagcctatggtttgaatggaaccgactggtatgacggtggaaaccactatatgtctcttgcatatctccttcgctggagcggacctgtaaatgagtctcaagatccattcaacgatacaagccataattcaagaacattcacaaatattgtaaagcaggttgaggatgtcttatatgtcccattgcgtttgaattatctagatatcgatcagataaaggcagctatcttaaaatatggcgcattgtatactacattatgttcagatgattcctttgataataatccggattattattgtgatgtcatttcaatttccaaccatgccataaccattgtaggttggaatgacagttattctgcagataattttgctgtaagacctccaggtgacggagcattcattatcaaaaacagttggggtcctagtgaaggctatgatggctattggtacgtctcctattatgacaagacacttgcaggctatggctatgatgcaatcgctgcaatggcatttacttcagttgcaaatgcctccacctataagaacaattatcagtatgacactttaggaaacacctttgagtcaatcggatatggctgcagcactgcatggattgcaaatcagttcactgctttaaacaacaatccattggctgcatttggattatatacctatggaagcagcagctatttagtaaacattacagtaaacggcatttcaagacttgttcaagagggaaatgtcaaaggtgcaggatatcatacaatcaagctggatgatgttgttgaactcctttcaggtgacatattcaagataattgtcaagctaagcactccagattccaattatcctgttgcaatagaatctaaaagaagcgactatagcagtcgtgctaattcaaatcctggagagtccttcataagctttgatgggcaaaactggcaggacctttatgaagtgggagatatccttaagttctatatgtatatgaataataagacttttactgaacctaatatctgcttgaaggcctatactatcggtccatctgatgtgcaccttcatgctagggcaaatgcaaccacttatacacaaggggatactgtagagattaagataaccgtatccaatgaaggagctacagtaaatgacttgaatatcagcatgaagtggaacagttcatttttcttaaagagtttcactaagcttaatggtgaatttgatagcacaaaaaagatatggcattttgacacattctccgaaggccagtcaagcacccttacccttgtatttactatgaggggaaataatgatgtggccagcttgtcatatgactataactattcaggattcaatccaggtgatgccaacactactcaagtattaaatctttattatggaagcctcaccaaatttgtagaagtccctaatgtctcaacttcagtgaaatccggagacgttgttgacattcaattgactgaccttcagtctattggaatttcagataagcaaatcgttatatccttgttagaaagcgacaacgaatatctatttgagaatgtcactttaataacaaatggcagcggtcaggcagggtttgtattggatttattggaaggaaattatgttttcttagcctcatttgcaggagatgactcttatatgtcatctaacgtgacatttaatgtttcagtatcaaaatctaacacttcaattagcttggataatctggacccttccaatataactgtattttcaaaatctggtgatgtaatcaatttcacactctctgatggaatcaataatctttctgataagaatatagttatttcactcattgaaagcgataatgactatctatttgagaatctcaccttaattacaaatggcagcggtcaggcagggtttgtattggatttattggaaggaaattatgtatttttggcttcatttgcagaggatggatattataaggcatctaacttgacattttatctaaatgttttaagaagggcttcatcaatggaatttgattcctctagcctaatttacaatggttcaaattggatcagcttgtcccagtcaaatgatctgatagaatttatcttatctaatcaaaccggtcctttagcagataaaactatcatcttaacagttgaagatttaaattcagttgatttggcagaaaatccattgatttataatctgactactggcccaaatggaattgcatcatttaatttaaatctaactaaatccaattatgaaatcattgcaagctatttgggagatgaatgttactctccttgtgagtttggatttaatttaagtgttttaaaaagaaatgctcctcatatagttgctgacgatatagcaataaactcttccaatccatatcaagctcatctattggatgatgatttcaatcctatagcaaatcagtcccttttatttgctttcgctaaaaaggacagtcaggatttattcaattattctgcaataactaatgaaagaggaattgcaattatcgatctttcagatattgaaagcggagattacaatcttttaattgcttttgaatcaaatgacttatatgatgattctattttggagattgatgtttctgtagtgaatgattctttaaatggcgataatggcactaatgatactggcaatggtactaatggaacagataacagttcaaaaatcaatacattatttaaaatagacatgtctgatttaacagtatctgcaaatgtggataagacaattgaatttgctttattggacgaatcattaaatccattggcggataaaactctcaatttgactatagttgatttggatgaagatactgaattgattacagattctgatggaattgctagttgcgttcttaatttggatgagggagtttatgaatttgtccttagtttcagtggagatgagaattactctccatctcgcttgattttcaatctttcagtttctaaagcagataacggtacaagtcctggtggagataatggtactagccctggtggtgataatgctactaatggcaccgaccctagcggaggcaatggaactgctcctataaatgataatggcactaatggaactgatcctagcggaggcaatggaactagccctggtgataacggaactgaatcatctaaaatcaataccctatttaaaatagacttgtccaatttgaacatctttgcaaatcttgaaaaggtcatcgaatttgaattattggatgaatcacttaatcctctttcaaataagacagttggcttgaccataagcaatttagatggagtcagtctgattacagactctaatggaattgcatcatgccctattaatttggatgagggagtttatgaatttgctctaaaattccttggagatgacgattactcagagtctgcaatgattttcaatctttcagtttcaaaacgcattgcccaattattatccggagagactttaatcaatctttcaagtgagaagagggaatatgatgtttatctagtggatgataaattaagtccattggcaaatgagacaatattgtttgccttaagttcaatggatggccaagtcttgtttaattatgtggtaaagaccaatgatgaaggtaaggccagcttgtcaggcttggctaaacttaatgagagcaattatattgtcaagaccgaatttgcttcaaatgacttctttgaaggcgctgaactaattaagacaataactttaatcaaggatgctccaaatggagatgatgctaatgacaccaatggcacaggaaatcaaactgataatggaacagacaccggaaataaaacagataatggaacagatacaaatggcacaaacggttctgatgttcctgtttcaaggaaagccacaaagatcatatatgaggatatggtgacccaatcagttgttcctgatgtggatggaagaataggagactatttctatgtcacattagtggatggaaacaacaatcctttggcaaacaaggaagttaaaataggatttaacggcagaatctataacagaactaccaatgccactggcggagtgaaattgcagataaaccttaaaatgccattcacttacacctttgcaatctgcttcctaggtgatgatgactataatgcatcatttgaagtggctaagataactgtaaataagaagaaaatgagtcttactgctccaagtaagacctataagtcaactgccaagacaaaagccttgacagctaccttaaaggacaataataataaggcagttgcaaataagaagatcactttcactgtaaatggaaagacatattcagctacaacaaactcaaaaggagtcgcttccgttaatgtgagcttgtccagtaaaaagacctattcatttacagccaaatttgcaggtgatgcttgttatggtgcagttacaaaatctggaaaaataactattaaataa

SEQ ID NO: 627 - DNA, 318 bp, Methanobrevibacter ruminantium
atggcagatattggcgaagcagcagaaaagaaattaaaatccagaattagaaaattaaaaaaatgcaataaggatgaagaggaaaaggtaaagttcttcaatcaattaggtctttcattcactatcagtttacctactaaaaatcctgaaaagcaagaggacttcataatgctatacaccactcctgaaggacatatagtacatgctgaatacagctattccgaaggagaagagtttgcttccatggatattcctgaaaaggatttgaaggtaatcattgaatcattctctgattatgaattgaaacttttagactaa

SEQ ID NO: 628 - DNA, 1143 bp, Methanobrevibacter ruminantium
atgattgtaaacaattcattagatgagcttaagaaaagggaatcagcccttaagattataaggtcaattgtggaaaatgagggcagatcatctttatatgatgtcactggactttcaggtggcttcatatcaagtgaagaggagttggatctccttgaaacctatgtaggtcctgccatctttgaggatgagcttcaagttgttgcaaaggagcatcttggcggtgagaaggcacttgcagtaaacaggacaagttcaggcatccttgcaagtatactgtccttggtgaaggagggagagcatgtaagtcactttttagcccaataccctgcccatccgtcaattcctcgctcatgcaatattgtgggggctgactatgatgaatatatagatctaaatgaatttaaaatagaggacaatacaagtcttgttgttgttacaggctctacaatggaccatcaggtgatagatgaggatacatttaaggaagtaattgatatggctcatgataaggacattccggttttagttgatgatgcttcaggtgcaaggcttaggactgcagtattcaatcaaaagagggcatgtgacttaggggcagaccttgttgtaacaagcacagataaacttatgccaggtcctcgaggtggattgatggctggaaaagaggaattgatcgataaggtaaaggtcaaggcaaaccagtttggccttgaagcacagcctcctctcattttagccatggtaaatggaataaaaaactatagcgaagacaatcttataaatgcaatctctagaaaagacaagttctatgatatggtttcgaaggactatgaaatgtttgaaaaaacaccaactggtgttatggtaactgaagatgctcttaaaaaacaagtggacgctttagatattgaaacagagctatctgaaaaggacctttctttcctatgggctatgattttattgaaggatgaaggaattattacaatacctgctgttgggatgccaggggcatctgctacagttcgatttgacctgtccacccaagatgttattgatatgaatttaggtatcttgcatgataaggtggatgattcatttaacaagttttttagacagttgtcaagatgtggaaaagtctag

SEQ ID NO: 629 - DNA, 912 bp, Methanobrevibacter ruminantium
atgaaaagagaaatgattaagctcttagttagctatgacataatttccaaagaggaagctgaaaagattgattcaatcaatgatgaagcaattgaagagtcaatcaaggaattaggatttggaaaaactgaacacattacaaaagaaaggatatctgagtttttagaaactgaagaactcggagaagagattctatgtttccgtaaggtattctctacaaacagcatttccaaattcttggcaaaccatggagcaaaggaaggaactgtattgatttccgaaatccaaacaaacgctagaggaagatccggcaagaaatgggaagctccagacggcggagtatggatgagcatgattttaaggccagatgtccctccggcaaagataggattgatcacacttgcaacaggtgttgcaatagctagagctatccgttcatttgacgttgacgctaaaatcaaatggcctaacgatatcttaatccatggaaataagatatctggagtattgactgaagtaattgctacattcaatcaaatcgaatatgttatcgtaggtgttggaatcgacagcaaccttaaattggaagacttctctgaagacataagagaaggaacaaccaccttggaagaggaaatccctgtaaaagtagatgaaaatgaactcattggaatcttcttaaatgaatttgaaaagatttatgacatctacttaaatggagatgttgaagagattcttagcgaatggagagccctttcagacaccataggaaaatatgtaagcattacccaaacagggggcaagacaactcaaggatatgttgttggaatcaataaggaaggaagcttaattattgaaaaacaagacggaaacttagagaaaattatttcaggcgaattaagaactctttaa

SEQ ID NO: 630 - DNA, 1494 bp, Methanobrevibacter ruminantium
atgtttgaaaaagtacttattgcaaacaggggagaaattgccatacgtattatgagagcatgccgcgaattggatatgaaaagcgtagcggtctactcagatgcagataaaacttccctttacactaactatgcagatgaaagcgttcctttaggaaacccatctccaagccaatcttatttaaacattgaaaagatcattaatgctgcacttgatacaggagcagatgccattcacccaggatacggattcttggctgaaaatccagagcttggaagacaatgtgagaaaaacggcatcaagctaatcggacctaaaggggagcatattgaaaagatgggagataagatcacttccaaacagcttatgaaagaggctggagtccctgtaattgaaggaacccctgaaggaatcgatgacgttgaagaggctaaggaaatagctgaagcaatcggataccctgtaatcatcaaggcttccgctggaggcggaggtatcggtatgcgtgcagtctatagtgaggaagagcttgtccgtgcacttgaagccacccagtcagttgctcttaaaaactttggagacgctacagtattcattgaaaaataccttgaaaagccaagacacatagaattccagatattggcagacgaatatggaaacaccatccatgtgggagacagggaatgttccatccaaagaagacaccaaaagcttttagaagaagccccttccccaatcatgactgaagaattaagggaaaggatgggtgaaagcgctgtaaaggctgccgaatatatcggatacaacagtgcaggtactgtggaattcctttacgacaatggagactactacttccttgaaatgaacacacgtatccaagtagaacacccaatcactgaaatagtaacaaacactgacttaatcaagcaacagattaaaatagcctgtggagaagagcttgaatacagtcaaagtgatatcacagtaacaggacatgctatcgaatgtcgtatcaatgctgaaaacccacttgcagacttcgctccaaacccaggaaaaatcacaggttacagatcacctggaggacctggagtacgtctggacagtggtgtttatatgaactataccattcctacattctatgactcaatgatttccaaactggttacaagcggaagaacaagaaacgatgcaatcaatagaatgaaaagggcattgagcgaatatattatcttaggcgtaaagaccacaattccattccataaggcaatcatgagaaatgagtcattccttgcaggtgacttgaacacccacttcgttgacgagcataagaaaggaattgaagaggaaatggaaaaggtaattttagaagatttagaaagagtaaatcgtatgaaatctacttttatgcctggtaaaaagatagctgcaatttctgcaacagttggaacttatttcaatgctgcacaagcacagcagatgaaaaagaaataa

SEQ ID NO: 631 - DNA, 120 bp, Methanobrevibacter ruminantium
atgattagtattaaaatcgttataaacccttcatttgacatggtgaaaagcacattaaaggaaatgattaaattttccttagaattaatgaaaattttcatcatggtattgttcgcttaa

SEQ ID NO: 632 - DNA, 831 bp, Methanobrevibacter ruminantium
atgatttttaattattcaagtgttattatgaaaattagaaaaaagaaacagcttgagatgatcctgcaaaatgttccatctcatccaaatccaaaagttgagcttgagcagtactcaacaccatcctctattgcatctgatcttatatggaatgcatatacattaggagacattagcgacttaagcgtattggaccttggatgcggcactggcatatttgcaattggctcttggcttatgggtgcaggctattcattaggccttgacattgaccctgaatcaatcgctcttggggaaaaaacaataattgatttaattggcctaaatcaaccgagtgatgtagatgtatttaatattaatttcatagttggagacatcaatcaatataattcaatatccgaactattaaatgataagagtattcaatctgatgaaaaatatgataagttaatagaatattataatagcaattctcttggtgatgattctaatcttaataattccaatgatggtttgatgaatggctcttttgatgagaaagatttcaagtttgccactttattccagaatcctcccttcggttctcaggagagaggaacaagacatgcagatagaaaattcatggaatttgctatggccagtgctgaagtgatatattcatttcatatgaaaagcacagaagagtttgtgattgattattataatgatttaggtggggatataagccataagttcgtctataatttcccccttccaaagatctatgactttcataaaactgagtcaagggatgtaaaagtagttgttttaagggttgaaaactttaaataa

SEQ ID NO: 633 - DNA, 816 bp, Methanobrevibacter ruminantium
atgcaaaatagtaaagtgtctgtctttataccgaattcatttctcgctgaaaccaaggatttaaagctaaaaacctctaaagtaggtttgattggccgtgccttggctgtatttgaagtggatgaagtggtgatttataaagatctttcaattccagacagcgaacagactgatgatggagatttcattgcagaagtcctcaattatatggacactccacaataccttaggaaaaaggcaattcctatcaaggcagaattgcgtcacgttggaatattgcctcctttgagagttcctcatcatccaactggaaagcctgaattaggtgattacagacaaggattcactgtaaaaaggaataagaaaggtaccttcgtagatataggtatggataaactggcgttttgcaaagagcaacttacagtaaataagattttttcatttaaaattactaagtttgctaaagaggtaatagtcacacctgatgaaccagatgacatttactggggatttaagacattatctacaaataaaagtcttaaaaatagcttaaaattagttaatcccgatcttgttgtagaaacaacaaggtacgcagaaacaatcgattctatttttaatgaattgaaaactaaagtggaaagctctaatcatatagcgattgtctttggaggcccttactcatctataagtgagaatgtcgaaagttccaaatgggaaacagttaaaatcaatacaatcccaaatcagggaacagagactgtcaggaccgaagaggctgttatttcaactttagctattttcaatatactttaa

SEQ ID NO: 634 - DNA, 1011 bp, Methanobrevibacter ruminantium
atggtaagacatcaccaaccaagaaaaggttcagtggcatttagccctcgtaagagagttgctaaagagaccccaagaatcaaagcttggccaagtaatgaagaaccaaaacttttgggtcttgctggatataaggctggtatgactcatgctatggttgtggacaatgataaaaactctccatcccatggaatggaagttttcactcctgtaaccgttttggaagtaccaccccttgtaattttggggataagatcatacgaaaaaactgctcacggacttaaggctatcactgaagtaattgcagataatttggatgaagagctctctaggaaaatcacccttcctaaggactacgaccaatccgaagctattgcaaaaatacaagatgctttagaaaagactgaagaggtaagagtcttagtacacactaatcctaaaatggctagcgttcctaagaagaaacctgaaatctttgaatgtgcattaggcggaagctctgcagaagaaaaattaaactacgctcttggaattttaggtcaagaaatcagagccagtgatatctttagcgaaggacagtatgtagacgcaattgcaaccaccaaaggaaaaggagtccaaggggttgtaaagagatggaacatcagaattcaatatggtaaggcaatgagaagtggaaaaggtagacacgtaggttctatcggtccatggtctccggaaagaaccatgtggactgttgcacaagcaggtcagatgggataccataagagaactgaattcaataagaaagtcattaagattggagacgtatctgaagttgatgctgttaaccctgctggaggattcattagatatggtttagtcaaaaacgactatgtccttgtaaaaggctccgtaccaggtccaaccaaaaggttagttattctcagacaagctatcagacctaagaaagctgacgatgcagctcctcaagtgaactacataagcactgcttcaaaacaaggtgtatag

SEQ ID NO: 635 - DNA, 765 bp, Methanobrevibacter ruminantium
atgaaagttaatgtttattcaattcaaggggaagtaaaagaggaaatcgaacttcctgctatttttaatgaagaatacagacctgaccttatcaaaagggctgtcctttctgctcaatctgcaagaatccaaccatggggtaatgaccctatggcaggtaaaagaacctcagcagaatcctggggttccggtagaggcgcagctatggtgcctaggataaaaaccggcgctagagcagcattcgtacctcaagctatcggcggaagaaaggcacaccctgtaagagctgctaagaatcatcatgaaaaaatcaacaataaggaaagaagatttgcaatcagatctgctgttgcagctaccgtaaatgaagaattggttgctggaagaggtcacagaatcgaaaatctcgaacaagtacctgtaattgttgaagatgatttggaaactgtcaagaaaacaagcgaaacccgtgaaatcttcaaggctttaggggtttacgatgatgtaatcaaggctaaagacagcaaaaagataagagcaggcagaggaaagacaagaggacgtaaatacaaatccggtaaaggacctttagttgttgtatctgaagacaaaggcattggattaggtgcaagaaaccacgctggtgtcgatgttgttgctgtagacaacttaaatgctgaattattagctccaggtactcatgcgggtaggttaaccatttacactaagtccgctgttgaaaaattaggaggattattccaataa

SEQ ID NO: 636 - DNA, 261 bp, Methanobrevibacter ruminantium
atggatccttatacaattattgttaaacctcatgtaactgagaagactatgaacttaatcgatcaaaacaacgagctaaccttcgttgtaagaagaaccgctacaaaatctcaaatcaaaagggcattcgaattcctttacgatgaaaaggttgtaagagtaaacactcacataacctctaaaggattgaagttagcctatgtcaagcttgctgaagaaggcgaagctgaagatgtagcagttaaaatgggagtattctaa

SEQ ID NO: 637 - DNA, 726 bp, Methanobrevibacter ruminantium
atgggaaaacgattaatacaccaacgtagaggaagaggaactcctgctcatcgtgtagcatctcacagattcaaggataaaatccaatacagggcttacgatgacttagagaaggaaggaagcttaaaaggaaaagtcgttaaaatcattcacgaccctgcaaggaccgcccctattgctcttgtcaaattcgaaaacggtgaaaagagacatattttagctcctgaatcaattcaaattgatgatgaaatcgaatgcggtatctcagctccaatcagctttggaaacactttgccacttgctgaaatccctgaaggtactcctatctacaatattgaaaacagaccaggagacggaggacgtttcgtaagatcctctggaacttacgcttctttaattactcatgatgcaagtcaagctgttgtggaattaccatctggtgaactcaaatccttcaacccaagatgccgtgcaagtatcggtgttgtagctggtggaggaagaaaagagaaacctttcctcaaggcaggtgtcagatggcatgcttataaggctaaaggtaagaagtttatgactgttagaggagtagcaatgaacgctgtagaccaccctcacggtggaggtaacagacaacacccaggtcgtccgaccactatctcaagacacgcaccacctggaagaaaagttggttcaattgcagctaaacgtactggaaagagaagataa

SEQ ID NO: 638 - DNA, 411 bp, Methanobrevibacter ruminantium
ttggctagaaaaatatttaaatacagaggatatactattgaagaattaaaagaaatgtccttagacgaatttattgaacttttaccagcaagacaaagaagatccttaaaaagaggattcttacctagacaacagtctgtgttggataaaatgagaaagatgcaaaagatggataagaaaggtggaaaaccgctagtagttagaactcactgcagagacatgatcgtaattcctgaaatggtaggaaccactttcggaatctacaacggcagagactttgtggaagtaaccttcacccctgaaatgctaggctgcttctttggtgaattcgcaccaaccagagctagagttcaacacggtgacccaggtatgggtgctaccagatcatctatgtttgtgccacttaaataa

SEQ ID NO: 639 - DNA, 468 bp, Methanobrevibacter ruminantium
atggcaaaaaacaaatacgcttataacaatcctgatgctgacgaatctaagacagcacgtgctatggcaaaatccattaaggtttctccaaagcattgcgttgaaatctgcagtgcaataagaggcatggatgttgcaaaggcaaaagcatacttaaatgatgttattgatatgaaaaaggctgttcctttcaaaagacacaacagagatgtaggtcacagaaaaggaatgaaaggctgggctgctggaagataccctgtaaaggcttccaaagcaatcttaactgttatagaaaacgcagaagcaaatgctgaatacaaaggtatggatgtagaaaacctcaagattgagcatatctcttcccacagaggaatggtaataagaggagctagaccaagagcattcggtagagtcactccattcaacactccaaccacccatattcaagtagttttagtggaggcttaa

SEQ ID NO: 640 - DNA, 756 bp, Methanobrevibacter ruminantium
atgatagaaaaagatttcgttacagaaggtctcagaagaaccagaatagatgaatatttagaaaaagaacttgaaagagcaggttacggtggaatggaaatccaagtaactcctttaggaaccatggtaattgtctatgcagaaagacctggtatggtaatcggtagaggtggaaagaccgtaagggcaatcacccaaagccttaagaccaagtttgaccttgacaacccacaggttgaagttaaggaagttgctgttcctgaactcaacgcaagaatcatggcttccaagattgccaacatgctccaaagaggaatgcactttagaagagtggcttattccacaatccgtaaaatcatgggcgctggagctcaaggagtggaagtaaccatttccggtaagatcagaggatcaagatctgctgttgcaaaattcaccgagggatacatcaagaaatgtggtgaacctgcaaccagattcgtaactgaaggttttgctaccgcacctttaaaacctggtgttttaggtattgtagttagaatcatgcctcctgaagcaaccttacctgataaggtggatatcattgctcctgttgaagtagaggaacctgttgtagaagcagctgaagaagatgtcgaagagatcgaagaggaagtcactgaagagattgaagaagtcgaagaggacttagaagagcttgaagaagagcttgaagatctcgaagagcttgaagctgctgaagaagatgtcgaataa

SEQ ID NO: 641 - DNA, 207 bp, Methanobrevibacter ruminantium
atggcaattttaagaagtaaagaaatttgggaaatggaaattgaggacatcgaagaaaaattggtggaactcaaagcggaactcgctaaaaacgtttctaaaagtgctgctgcaggtgttaatgaaaaccctggtaaaattagagaactcaaaaggactattgctcgtgttcttacaattatgaaccaaaaacagaaggagaattaa

SEQ ID NO: 642 - DNA, 345 bp, Methanobrevibacter ruminantium
atgtcaaaaatctgtgatgtatgtggacttcctgaagagctttgcgtatgcgaagaaatcgcaagggaagtacaatctgtaaaagtttttacagtaagaagaagattcggtaaacttatgactattgtcgaaggaatagatgaacatgatatagatattaaggagcttactaaaactcttaaagccaaatgtgcctgcggaggcactgccaagaagggtcaaattgaacttcaaggagatcataaggcaagagttaaggaagtcttatctgaaatgggattctcttctgacactattgaaatcagagactctgataagaaatacaataagaggagaagacactag

SEQ ID NO: 643 - DNA, 336 bp, Methanobrevibacter ruminantium
atgataagctcaaataatatattctatcatgaattaattgggttagagcttaaagttgttgacagttccaatccctctttgatagggctttgcggaactgttattgatgagactaaaaagactctcttgattgaggttgaagaaaaagtcttaagtgatgacttaggttctaatcaacaaaatcattttaatttaatttataaggaaaaattaattcagaaagatgtttctgtatttcaattcaaggttccagatggaaccatagttgaaattgatggtaaaatattattgaatcgtcctgaagataggataaagaaaagatataaaaaaatttaa

SEQ ID NO: 644 - DNA, 321 bp, Methanobrevibacter ruminantium
atggttggtcttaatgttaaggaaccagaaactaaatgtgatgatcctaactgccctttccatggtaatttatctgttagaggacaagtccttgaaggtgttgttactactaataaagcagaaaggactattactgtagaacgtagtttctacaagttcattagaaaatatgaaagatacgaaaaaaggaaatcaagaattaacgttcacaaacctgattgtattgatgttgaagttggcgacgctgtaaaaatcgcagaatgtaggcctttaagcaagactaaacactttgtattagttgaagtaaagggtgatgattag

SEQ ID NO: 645 - DNA, 399 bp, Methanobrevibacter ruminantium
atgaaacctactacctcaagcgtaactaaggctttgccaataggcgcaagacttcaatgtgttgataacaccggtgcccgtgaaatcgaaattatttccgtaaagggattcaaaggtgttagaaggagacttgacgtagctggagtaggcgacatggttgttgcttcagttaagaaaggaaccgctgacatgagaagagaagtcgtcaacgccgttgttgtaagacagaaaaaagaatacagacgtgctgatggtcttcgtgtaaaattcgaagacaatgctgcagttatcattactcctgaaggagtattgaaaggttctgaaatcagaggacctgttgctaaagaggcagctgacaaatggcctagcgtaggcagtgcagcaagcatattgatttaa

SEQ ID NO: 646 - DNA, 342 bp, Methanobrevibacter ruminantium
atgtcaattcaaccaagaaaacaaagaaaagctctctacactgctcctttacacattcgccgtaaaatcatgagcgctaacttaagtaaagaattaagagcagatattggcaaaagatcattgccaatcaaagtaggagacaaagttcaagttgttcgcggagactttaaaggtcacgaaggaaaagttgaatctatcgacgctaaaagatacaaagttaccgttgaaggcgttacattaaacaagcctgatggaaacgctgtatttcttccaatccatccgtccaacttgatgattattgaagctgatttaaaagacgaaagaagaattaaggaggaataa

SEQ ID NO: 647 - DNA, 735 bp, Methanobrevibacter ruminantium
atggcaaaaatgggatctagaaagcatcttaaaagatacaacgcacctaaaacctggcctatccatccaaaagaagatacttggacagtaaaacctgctcccggtactcacgcaatcaatgactcattgcctttgcttgtaatcatccgtgatatcttaggtattgcagataactcaagggaagctaaaaggctcatcaacactggtaatgtattgattgacggaagagctaaaaaagattacaaattcccagtaggattcatggacatattatccattcctaagactggtgaaaattacagaatacttttagatactaaaggaagattaactttacaccctatctctgctgaagacgcagagttcaaattagctaaaatcgtaaacaaatctaccatcaaaggcggaaaaactcaattaaaccttcacgacggtagaaatgtaattgtggaagaagacaactactctgcatacgatgttgtatgtctcaacattccagaacaagagattaaggaaaacttcgaatttggcgaagacgtagttgtacttgttaccggtggtaaacacactggagagcttggtaaaatccaagaggtcattgtagaccaatcctctaaagcaaataccgtaattatcgaaaaggctaataaggacactttcttaactttaaaagattatgcatttgtaattggtaaggatgaacctgccattgacttattggaggttaatcaatga

SEQ ID NO: 648 - DNA, 522 bp, Methanobrevibacter ruminantium
atgaacccaatgaacgaagtcgtcatagcaaaggcaaccatcaatatcggtgttggagaagctggtgaaaaattatccagagctatgacccttattgaaaacatgactggtcaaacccctgtaaagacctattccaaagtcactaaccctgaatggggtataagaaaaagacagcctattgcatgtaaggtcaccctccgtggggaaaaggctgaagatgcaatcaaaatggtattggatggtatcaacaacagattaagaccaagtcaatttgatgcacaaggtaacgtttctttcggtattagagaacatatcgacattcctggaatgagatatgaccctgatattggtatttttggtatgaacctttcaatcacttttgaaaaacctggttacagaatcaaaagaagaaaaatccaaaagaaatccattccaaaaagacacagaatcactcctgaagaaactatgaaatttatggaagagaactttaatgtaactatcgctgaggaagaagaatactaa

SEQ ID NO: 649 - DNA, 153 bp, Methanobrevibacter ruminantium
gtgattgttttgccaagaaaatacggaaaagcatccaaaaaatgtagccgttgtggagaccactctgctatcgtaagcagatacggactcaacttatgcaggcaatgttttagagaaattgctcctaaaataggatttaaaaaatacaattag

SEQ ID NO: 650 - DNA, 393 bp, Methanobrevibacter ruminantium
atgactcttatggatcctcttgcagatgccttaacaaacatcagaaataacgaacgtcaagtaaatgaccactgtactatttctccagcgtccaaattgatcggacgtgtgttaagcacaatgcaaaaagagaattatattggcgaatttgaatttatcgatgataacaaggctggaaaattcgaagtggaattggaaggtaacattaatcagtgcggtgtaatcaaacctcgtcatgctgtaaagaaagatgaatttgagaaattcgaaaaaagatatttaccagcaaagaacttcggtatcttaatcgtaaccactcctgaaggtatcatgacccacagggaagctaaggaaagaggtatcggcggacgtttgttggcttacatgtattag

SEQ ID NO: 651 - DNA, 534 bp, Methanobrevibacter ruminantium
atggtattagctgcagctataagggaagaaattgaaatccctgaaggcgttgaagttataattgatgatgaaatttctatgaaaggcccaaacggcgaaatttctagaaaattcacttaccctaatgtgactattaagaaagaagacgatatccttgttcttgaaaccgctttcccaaaaaagaaagacaaatcaatgatcggaactaccagagcacatttaaacaatatgattaaaggagtaaccgaaggtttcacctatcatatgaaaatcgtatacgctcactttccaatgaccgtaaaggtcgaaggagataaggtaaccattgacaacttcattggggaaagacatcctagatcttcaaagattgtaggaggagcaaatgttcaagtaaaaggtgatgaagtaatcattaccggtgtaaacaaagaagacgtcggtcaaactatggctaatttagaacaagccactaaaatcagaggcaaagaccctagagtattccaagacggtatctacttaaccagcagggaataa

SEQ ID NO: 652 - DNA, 345 bp, Methanobrevibacter ruminantium
atggtgattttgatgagtaaagattttaaaagacaggaatatgctcgttataaaaaattaggaaccaaatggagacgtcctagaggtaaaactagtaaaatgagaagatacgaagcaggtaaacctgcaatgccatcaattggttatcgtactcctagagctactagaggattacatccttctggttacaaagatgttcttgtttataacatgaaagatttagaagctcttgacgcagaaactgaagctgctagaatcagcgcttctattggtaaacgtaaaaaagcattgatgttagaaaaagcatcagaattaggtataaaagtattaaacagacaattataa

SEQ ID NO: 653 - DNA, 447 bp, Methanobrevibacter ruminantium
atgaatcttactacacaaagaagattagctgctagtatacttaaagttggagtaaaccgtgtatggatagatccagaagaagtagaagaagtttctagagctattacaagagacggtgtcaaacaacttatagatcaaggtattatcaaagctagaccaaaaactggtattagtagctacagatctaaaaaacttaaagagcaaaagaagaaaggaaaacgaaaaggaagaggtagtgtaaaaggagcaaagaacgctcgtacacctaaaaaacaagtttggatgaaaaccatccgtgctttaagaagcgatcttaaagaaatgagagacactggtgaaatcgatcctactacctaccgcaaattatacaagatggctaaaggtggagctttcagaagtaaatcttacatgaaaacttacgctagagaccatgacttaatcaaatag

SEQ ID NO: 654 - DNA, 582 bp, Methanobrevibacter ruminantium
atggcaagcggatcaaattataaagtggctttcagaagaagaagagaaggaaaaactgactttgctgctagagctaaattagtggatgtagacaaggcaagattagttgtaagaatttccaatgctaattgtattgttcaagtaatcaatgtaggcctaaccggcgatgagactgtcgtatctgcacacagtaaggaattaaacaagttaggctggaaaggcggaaacaaaaacaccagcgctgtatacttaaccgcatacttatgtggtaagaaggctcttgcagctggagttgaatacgctattgcagacattggtttaaaatcccctattaaaggagctaaagtatttgcagctgtaaaaggtgctgctgatgcaggattagatgttccttatggcgaatctatcattcctagtgaagatagaatcaatggtgagcacattgcagcatatgcagaaagcttagatgaagatgaacttaataaaaaattctctcaatatttagcaagaggtcttcaacctactgatttacctcaacactttgaagagattaaaaataaaattgatgaggctgaagtatga

SEQ ID NO: 655 - DNA, 642 bp, Methanobrevibacter ruminantium
atgagctttaatatggatgattgggaacctaaaaccaatttaggtaaggaagtaaaagcaggtaacattaccgatattgatgaaatctttgaaaaaggtctccctataatggaacttgaaatcattgacgcattgctccctgacttggaagaggaagtaatggacgtaaacttagttcaaagaatgcacaaatctggtagaaaagtaaactttagagtaatcgttgctgtcggtaacagaaacggttacgtaggtttaggacaaggtaaagctagagaagtaggtccagctatcagaaaagcagtggataacgctaaatacaatgtaatcaaagtaagaagaggctgtggagactggggttgtgtctgcggaagacaacacacagttccattcaaggtaaccggtaaggcaagcagtgtaaaggtaaccttaagacctgctcctgcaggtgtaggacttgctatcggtgatgtaggtaaaaccattctcagccttgcaggatataaggacgtatggtcccaagcaagcggccaaacccaaaccactgtaaactttgctaacgctgtattcaatgctttaaaagaatcctgtaagatgaaagcttcagaacaagaccttaaaaatatgggagtaatccaataa

SEQ ID NO: 656 - DNA, 459 bp, Methanobrevibacter ruminantium
atgtatttagttattagagtaagaggtactactggtgttattcaaggcattgcaagtaccttagaaatgttaagacttaacagaatcaatcacgctgtattagttgaggaaaacccaagctacaaaggtatgcttcaaaaggcaaaggactatatcacttggggagaaatcgatgctgaaactctcactgaaatcattgaaaagagaggaagattagttggcggtgctcgtatcagcgaagaatacttagctgaaaacaccgattattccagcttcgaagaattggctaatgcattacttaacggtgaacttaaagctcaagatattaatatgaaacctgtattccgtttacatcctccaagaaaaggatatgaaggaatcagacattctatcaaagaaggcggatccttaggttacagaggagaagatattaatagtcttgcaaagagaatggcttaa

SEQ ID NO: 657 - DNA, 444 bp, Methanobrevibacter ruminantium
atgattagaaaaggcaaaaaaatcaacaagatgagaggttccagatctaacggtggaggctctgtcaaaagaagaagaggagcaggtaacaaaggtggtaaaggtaaggctggagctggaaagcaccactggtccaccactgtaatcgaaaacagatattactttggtaaacacggtttcaaaagacctcaaaagaccatccacagatcctatcctgtaaacttaaacttcttgaatgataaggctgaagagttcttggaaaaaggaatagcaactaaagacgaagacgatgtaattgtcattgatgtaaccgacttaggctacaacaaagttttagctactggctctcttgacattcctttagttgtaaagtctcctgcattctccgaagcagctatcgaaaaaatcgaagaagctggtggagaagcagttgaattattctag

SEQ ID NO: 658 - DNA, 1371 bp, Methanobrevibacter ruminantium
atgtttttagaaaattttaaaccaatatttcagttgcttcctgaggtaaagactcctattcataggcaggactttagggaaaagcttaaatggacagctatagttttagttttatattattttttaactcttattccattatatgggttgagtccagctgcagttgaccaatttgcacaattaagagctgttatggcaggtagtttcgggtcaattcttacattagggattggtcctattgtaacagcgtcaattgtattgcaattattagtcggtgcaaagatattggatttggacttgaccttacacgaacataaggctatgtttcaaagtactcaaaaattattagctattattttcactatatttgaagcaggagttcttgtattcacaggaagtctggttgctatcgacccatctttctatccaatcatgctcttgcagcttgttattggagctattatgatcttatatttggatgaagtagtatccaaatggggattcggtagtggtgtaggtttattcattgctgctggtgtagcagaaacaattattgtaggtacatttaacttcttgccagcttccgctgcctcaacaactgcttcaggtattcttcctgcatttattcaatcaataattggtggagcacctaatttccaaatcttgattccattgattgctaccattgtagtgttcttgatagcagtatatggtgaaagtatgagaatcgagattcctatttcccacggcagagtaaaaggacacggtagaatcagaggggctgtaggtaaatatcctttgaaattcatctatgcaagtaacatgccggttattttaaccagtgcgcttcttgtaaacgtatcccttattgcaagtctcttccagaaattaggattccctatatttggagaagtttcaggtggaagggctatcagcggacttgctttatggcttaccacccctaacagcataagcgtattgtttaccaatcctttaagggttttattctacgcaattgtatttttaggctgttgtgtactcttctcatggctatgggttgaaatcagtggttccttaagtgctaaggaagttgcaaagcaactctataactctggtatacagattccaggttttagaagtagtaaaagacaactttatacaatcatgaaaaaatatattccagctcttacaatccttggtggtttattcgtaggtattttggcatttattgcagaccttaccggagctttaggcggaggtacaggtgtattgcttactgtaggtattgtatacaagctctacgaagagatcgctcaagaacaacttatggaaatgcatccaatgttaagaaaattcttaggaaacgattag

SEQ ID NO: 659 - DNA, 558 bp, Methanobrevibacter ruminantium
atgaaattagtagttttaacaggtattccaggttctggaagtactactgtacttaaaaaagctttagaagaagtagattatcttcatttaaactatggagatataatgactgaaattgctgttgaaaaaggtcttgttgagactagagacgagttaagaaaattgcctgcagacactcaaaaagagattcaaaaggcagcaggaattagaattaaagaaaagtctgaaagtgaaaatgtaattgtagacactcactgtaccataagcactccatctggtttcttacctggacttcctaaatgggtattggaaggtttaaatccagatcattttgttttaatcgaagcatatcctgatgaaatcagggttagaagaacaaatgatgacactagacaaagagatgctgaatcagctgaagctattcaattgcatcaagaaatgaacagagcagcttcaatggcttatgccactttaactggagcaactgtgaaaatagtttataatcatgacaatgagctagatgacactgtcgctggcttagttgaatttttaaaataa

SEQ ID NO: 660 - DNA, 267 bp, Methanobrevibacter ruminantium
atgcctgcaaatagatttagatcaagatcatataaaagaacaaatacaaagactcctggtggagttaatgttttaagatataaaaagaaaaaaccatctaagcatgtatgtgctgaatgtggtgctgtattacatggtgtaccaagaggacgtccttttgaggtcaacaaattagcaaaatctaaaaagagacctaaccgtccatttggtggaaacttatgtcctgaatgtactcgtaaacatttcaaacaagaggcaagaaaataa

SEQ ID NO: 661 - DNA, 519 bp, Methanobrevibacter ruminantium
atgataattacaatcggtggcgtagctggcagtggaaccacaacagctgcaaaggtattatctgagaaattaggggttccgtatatttcagctggagctatctttagagagatggctgaagagcatgggatgactcctgtggaatttggcaaatttgctgaaaataatactgacatcgataaagagattgataatagacaagctaaacttgcagaggaagctgatgatcttattattgaaggaagattgtctgcatactttattgatgcggatttaaaggtttgcttcaccgctccattagacgttagagctaaaagagtatgtgaaagggaaaacaagtcagttgagactgctcgtttggaaataatcgctcgggaagaaagcgaagctataagatatagggatattcataatattgacataaagaacatggatatttatgatttgataatcaataccaatagcttcgatccggagagcatttcagaaattattataacaacattaaaggtgatatga

SEQ ID NO: 662 - DNA, 168 bp, Methanobrevibacter ruminantium
atggcagctatagaagttggtagaaaatgtattaagactgctggtagagaagcaggtaaagaatgtgaaattgttgcaattattgatgaaaacttcgtagaagtaaaaggagacgaagttaaaaacagacgttgtaacattaaccacttagaacctattatggaataa

SEQ ID NO: 663 - DNA, 2514 bp, Methanobrevibacter ruminantium
atgattttggtgtttaagatgggcatatttgataaggtcaagtcagcttttgaatctagtaaaaactttaaatatttagatgatttaattcatagcgggctgaatgagattgttttggatgatgatatcagcttaagtaaaaatgaaaaaaacaagtattctaacggcattgaaatagaaattgataatctggttattgatggaaatggccatgcaatagatgcccaaggaaatggttctatctttttatgcactggtaaaaatatcgtagtaaagaatattcattttaaaaatggaatccattccaatggaggtgcaatagaaaatcgtggggaattaactataatggattccacatttgatggaaataatgcatcccttggaggggcagtttttaacgacggccctaaactaatgatagctaaatccacaatcactggaaacatagccaaagagggcggcggagcaatatataataatgatggcgaggtttatatttcagaatccatgattaacgaaaatgtctctagttttcatcagtattctggcggagcaatttataataagggcgagttgactattgaaaaatcaacactcattagaaaccatgcaagttttggcggagcaataggaaatattggtcagttaaacataatcgattccacaattagcaataatgaatccagtggtgatggcggtgcaatttttaatgataatgctagcttatcaatatccaattcaatgattgaagctaatgtctcagatggattggaaggcggaggggcgatatataataaggaaggcgagcttaacattactggatctgtccttaaacaaaacgaattggtcggccaaataggaaaagggggagctatatataataatggaggcaatctcaatattgcaggttcatcactttgcaatcattccataaacttttttgggggagcgatatataatgatggaggcaagattaatattgcagaatccaaattcaatgaaaattcctctaacaggaatggcggggcaatatataatgaaggtgaagtcaatattagaaagtcatccattaagaaaaacaagtctgatggcggagtaatagagaatataaatggagattttaagatatttaattgcgaatttttctcaaacgaatctcaaggaaatataatattcaatcaagattcattagaaattaattacactgattttaaggataatcgatcaaaatctatgctgcttaatgatggagtcaaatccaaaatgagccttgttaaaggagagattaatggtaatgatgttaaagatacattaatcctcaatgaaggaaattctttaaccatatctgaaactgtttttgaaaataatttgattcctaatggggatgccatagttaattcaagtaatttgatattgacaaatccaaagataaatgatgataatcaggaaataagaaatcaagggaatcttcttttaaaaaggtcatctctagatattaaaggcaaaatcaatggggaaggaaaaattgaaacagatgaccattccaatgaagataaatttgattttggatatcttgacagcctaattcatggaagtcccgataaggaaattgtgctggataaagatataaaacttgaaaattatgaagttgatttttatgaagggggcatagaactggatttcgatgatttgattataaatggaaatggcaaaactattgatgctagaggaaaatcccgtattttcacaataagtggaaaaaacatcactctaaagcacattacttttaaaaatggacactcttataaaaattacgacaaccctttaaataataatggaggggcaataagaattaatgccaatgcaaatctcacaataaccgattgtaaatttttagataatctctcagaggattatggtggagttatatattataatggctctggagacttagttctcactgcatcaacaatgaaaggcaatactgcagaaaatgatggcggtgccatattcagtagcggagaggtgaaaataaataaatctaaatttatcaacaatagcggaaataatggcggtgctattgcaattgtaaatagtaatgataaagcatctgtcactgaatctatttttaatgaaaacgccgcagattcgaaaggaggagcaatctggttccataattcaaatattgcattggcagattgcactttcaatgataactatgctacttgtggagcggcaatttaccaagaaataagcaagggaagcataagcaattccacttttaagaggaatttatcatcttatgcatattggcatgatggaaaattagttactaataaaaatcatgctatcttcattgatacaggttctggattaaatgacttcaatcaagatagagacaatatcatcaactgtgattttatagataataataataatctttatgctcagaaacatgatttaattaaatctagacttgatgagcacttggctctatggaaacgcaatttataa

SEQ ID NO: 664 - DNA, 834 bp, Methanobrevibacter ruminantium
atgttagaagttagaaacattaaatattcatataataaggattatcaagcacttaagggagttagcctaaaggtcgaagaaggacaaatggttgctcttttaggaaaaaacggtgcgggaaagtctaccttgttccttcatttaaacggcatatacgaacctgatgagggacaggtcttcatcaaaggggaagagctaaagtatgacaagaaatcattgcttaaattcagacagaaggtaggaatcgtattccaaaaccctgatgaccaaatctttgcaccgactgtagaagaggacgttgcattcggaccgctaaaccttaagcttcctatggaagaggttcaaaaaagagtgacagaggcattggcaagggttggaatgagcggatatgaaaagacagctcctcaccacctaagcggaggtcagaagaaaagggttgcaattgcaggaatccttgcaatgaaaccagagataatggttctggatgagcctacagcagggctagaccctcaaggggttacagcattaagcaatctattgaaggaacttaatgatgaaggaatcactgtaataatctcaactcacgaggtaaaccttgtacctacctatgcagaaaaggtctttgtattggttgatggggaattagttgcagaaggaactccaaaagaaatatttgcacagcctgaaattcttgaacaggcaaatcttgaagttccgattgttacagagctattccaagaactagaaaaagaaggatatgatatgaatgatgactatcctttaaccattgacgaggcaaaggaaaagttcttagaattattaaataaaaattaa

SEQ ID NO: 665 - DNA, 693 bp, Methanobrevibacter ruminantium
atgaaatttgatatggattatattgctcatcacaatgaacttagcgaagcaaatccttattataaattatttataaccataattctactgattgttacattggcattggacaacctgtactttgacattttcatgttcatactattctccatcataattcttggagttgcaaagataaacatccgctcttacataaaattcctgaccattccgatggcattccttataataacatgtctatttctgatattcttcttcggaagcggaaaggtcatctaccaaacaggattctttggaatcgtagtcaccgacgactcatggcattacggtctctacacattcttcagagtgttagggtgttttcctatcctaggattcctagcccttacaacacctattgcaaagatcttccactgtttggaaacacttaaggttcctaaaatagtgattgagatagggcttttgatgtacaatacaatcttcatattcctaaatgagattgatgtgatgcagaaggcacagaagacaagattagggtataattcctattggaattcattgcagtgcttaggatcgcttgtaagcaatatatttttaagatcattggaaaaaagcgaaacattgcaaaacagtttagattcaagaggctacgacggagagcttccggtttatataccgccaaaggaggaataa

SEQ ID NO: 666 - DNA, 687 bp, Methanobrevibacter ruminantium
atggagaaaggaaaattatatggtgtaagcattggcccgggagatcctgagctaataactgtaaaggcaatgaatataatatcaaaatccaagtatattgcaactcctcatactggaacaggggaatccttggcattgtcaatagtgtcccaggcgatagacttgtccaataaggagataatgcttttggagtttcctatgacaaaggataaagatatattgactaaaagccataatgaggctgcagaagcaattattaaggttcttgacagtggagaggatgttgcaatgttgaatctaggtgatgttactatctattcaacttttgactatactaaggataaattagtggaaagaggctatgatgttcaggttattccaggtgtcacaagcttttgtgcatctgcatctgagcttaagataggcctgacaactatgaatgagcctttgcatatcattccagcaagcggaatagacattaaagaagctcttaagatgccgggatccaaggtcttcatgaagattggaaggtcaatgcctaagctgattgaagcgattgaggaacttggtcttcaagacaatgtttatgcagttgaaaactgtggtttggaaaatgagaaggtttataaaggtctaaaagagtttgatgaaaaaatgggctattttactatagtcgttgttaaataa

SEQ ID NO: 667 - DNA, 1140 bp, Methanobrevibacter ruminantium
atgcaagataaacgattagtaaaccagcagttattgcgttgcggatatacaacaggaacatgtgcagcggcagcttcaaaggctgcaactaccatgctatttgaaaaggagagggtagattcagtctctatcacaactccaaatcagacaagccttaatatagatgttctaaatccacaattaactgataagaaggcatgctgctgtattcaaaaggatagcggagatgatccagacattacaaatggaatattggtctctgcagaagtgtccttaacagaatctaagggtatcaatatcgatggaggaaagggagttggcagagttaccaagcctggtctggaccagccggtgggaaatgctgcaataaactcagttcctcgcaagatgattgaagattccttaaatgaattggcaaggcattatgattacgatggaggattcaatgtcatcatttcagtccctgaaggtgaggagataggcaagaaaacattcaatccggaacttggaatcgttggaggaatttccatattgggcacaacagggatagttgagcctatgagcgctaaggctcttgcagattcaatcaaagtggaaataagcgtaattgcagcagagagcaatgagtcaattctaatatttttaggcaatttcggaaagaaattcaccgaagaagagttaaaattgtctacaagccctggaataatgtgcagtaactttatagatgttgctttggacagttctgttgagtatggatttaagaatattcttctgattggacatataggcaaattcgttaagctaggcattgggctcttcaatacacactcccataatggggacggcagaatagaagcattattgtcatgtgctttagaggcgggagctgatttagagaccctaaaggcaataaatgcttgtgtaaccaccaatgcagtattggatatcttgtatgaaaaggagctattggataagaccatggaaatattaaatgataggattcagcatagaattgataaaagggtgcctccagaggcgaatattggctttatttgctttgcaaatagtggagagtatgagggcatcctatttgaaagcgataatgcgaaagaactaatgacaatttggaaaactgattaa

SEQ ID NO: 668 - DNA, 756 bp, Methanobrevibacter ruminantium
atgattcattttgtaggtgcaggaagcggtgctgttgatttaataactgtaaggggagctaatctcttaaaagaagcagatgtaataatctatgcaggttcattagtcaatccggacttattgaattacgctaaagactcctgtgaaatttatgacagtgctaaaatgactttagatgaagtattagatgttatgtttgaggccgaaaaggaaaataagatgacagttcgtttacacactggcgactccagtatttatggagctatccgtgagcagatggaccgtttggatgaggtggaaattgattatgatgtttgtcctggagtctcaagcttttgcggtgctgcagcatctttaaaggcagaatataccctgcctgatgtaagccaaagtgtgataatcactcgtatggcaggaaggactccggttcccgaaaaggaaagcattgcatcatttgcagagcatggagcaaccatggttattttcttaagcacagggcttcttaaggatctctctaaagaacttgtcaagggaagatacactgaagacacccctgcagctattgtctataaggcaacctggcctgatgagaagattatgcactgtactgttggaactttgtatgaaaccgctaaggagaataatgttacaaaaacagctttaataatcgttggagatgttttagacagtgagtattccctttcacgcctttatgccgatgacttttcaacagagttcagacaggctaaaaaataa

SEQ ID NO: 669 - DNA, 1023 bp, Methanobrevibacter ruminantium
atgaagatatcaatcattggatttacagataatggcatggaaatagcctataaattatcaaattccctatcagaggataataatataagtttcactagatgtggaaaaggagagttatctatttggacagaagaacatttttcagatagtgatgctcttatatttataggtgcgataggaatagccttaagggcaattgctccttacattaagaccaaaacaaaggatcctgccgttgttgtagtggatgaattgggacaattctccatacctattctatcagggcatattggtggagccaatgaattggcacttcagatagcagatatattaaatgcaattccagtcattacaactgcaactgatataaataatctatttgcaatagatacttgggcaaaaagccaaggattgaagattttaaatccagaatgcattaaactggtttcatccaaattgctgaagggggaaacaattcatataaaatctgattatcctattcagggaaacttgcccaagaaggtccaaatcaatgatttagaagattctaatagtgattatgatgtcataatcagccataatgattatagttatatggagaataaggatatattgttattaataccttcaataattacaataggtattggctgtagaaaggatataagttttgataacattgaaagatccgttttaaatatattggataaggagaattatcatatactgtctttaaatgcaattgcaagcattgataagaaggctaatgaaaagggaatattggaatttgcaaggaaatacaatctgccattcaatacttatagtgctgaagagctgaacagtcttgaaggagatttcacaaagtcagaatttgtaaaaagcgttgtggaagtggataatgtctgtgaacgttccgcagtcatagaaagcaatggaaacttgattagaagaaaggacacttgtgatggtgcgggagtgactgttgctttggcaatgattaatcctattctttcatgggattga

SEQ ID NO: 670 - DNA, 732 bp, Methanobrevibacter ruminantium
atgaaatgtgtgtctgttgtaggtattggtcctggaaatgagttgtatcttagcattgcagctaaggaaactcttgaagattcagacttaattgtaggctataagaaatatgtggagctagtagaagaatatttgcctgaaaaggagtatctctacactggaatgacaaaggaagtagatagatgtaaaatggctttggaaaaagcatctgaaggcaattgcgtatctgtggtctgcagtggggatgctggagtatatggtatggcaggattggtttatgaattgtctgtagattatcctgatgttgaaattgacattgttccaggcataagtgctgtcttaagtggttctgcagttttaggagctccaataggacatgattttgcagtaatcagtttatcagatctcttaactccatgggaattgattgaaaagcgcttggccttggctggagaaggagatttctgcatttgcctttacaatccttcaagccataagagaaaggattatcttaaaaaggcctgtgaaatattattaaaacataaaaaggaagacactgtatgtggttatgtcagaaacattggaagagaaggtgaagaatatcatatattaagtcttaaagaacttaaagacactgaagttgacatgttcactacagtcttcatcggaaatgcaaatacaaaggtaattgacaataagatggtaactccaaggggatacaagggagtatag

SEQ ID NO: 671 - DNA, 759 bp, Methanobrevibacter ruminantium
atgcacaagattgttttgtttggaggaactacagaaggacgtttattgactgaattcctatctcaaaataaggttccatccattgtctgtgttgccactgaatatggggagaaagtcttggattatgagcccccagtcatagttcagcctaaaagattaaagcctggccctatgagaaagctatttcaagaggagcagaccgagtttgtctttgatgctacacatccttatgcaactgaaataagcaagcacatcaaggaagcctgtgatgaaatgggcattgaatacatccgagtattgcgagaatccattgagattgaaggtaccactaaagtttccagcatggatgatttgattgattatttaaaccaaactgaaggtttgatattttcatctatgggagctaaggaggctgaagctttaaccgctctagagaatttccctgaaagggtctatttgcgaatgttgccttctcccgaagggattggccattgcctagatttgggatatcctatgaaaaacctttgcggaatgcagggtccattttcaaaggaatttaatatggctcaatttaaggaaattggtgcagacatactagttactaaggaatcaggcaatgttggaggatttttggaaaaaaccgatgcagctaaggaatgtggtatggaagtagttgttttaagcagattgcttaatgaagaaggcattagcgttgaagaggctaaagatgccataatgagtaaatgcttaaggcgttag

SEQ ID NO: 672 - DNA, 1188 bp, Methanobrevibacter ruminantium
atgaaggaaatcaatattattggaatgggaatgagtgaaaagacactcactcatgaagctttggaactcattcaccatgcagatatcttaattggtgcaaaaagattaatcaatgagttttctaaacttaataaacctagttttaatgcttatttatctgatgacatattgaaaataatagaagaaaccgatgcagaaaaaatagcaattcttgtttcaggagatgttggcttttacagtgctgcggaaaaactgacagatgtcctaaaggactataatcctaatttaattaccggaatctcttcagtttcctacttttttgcaaaatgcagtcttccttggaaggatgcaaatctgataagctgtcatgggatagatacaaatatagtttcatcagttcgaagaaacaggtatacctttgcattaacaggcaaaaacattccagaattgcaaaatgaattggttaaatatggctttggcgatttgaaggtttgggttggagagaacttaggttcagaagacgaattcatcaatgattgcaggattgatgatttatgcagtagggaatatggctcattaactgttttgattattgacaaccctgattttgattctaaatcaagaacaggcattccagatgaggaattcattaggggaaaagtcccaatgacaaaatcagaggtccgtgcagtatgcgcatctaaactctcaataggtcctgacgacatagcttatgacattggatgcggaacaggctctgtaacaatagaaatggctttatcagcatacaatggaaaggtctatgcctttgataagaaggaagaggcaattagtctcctaaatgaaaactgcattaaattccatattgataatgttgaagcaatttgcggattggcgccagactgcttaaagggtcttcctacacctgatgtggcctttattggaggtagttctggaaacatggatgaaatagttaattatctctatcaattaaacccaaatatgagatttgtcataactgcaataagcattgaaaatgcaatggctgcattggattcattaaaagatattggaatagaagctgaaatagttcaggtggctgtctctaaaggcaagaaaattgcagatttgcatatgctgattgctcaaaacccaatatttatcataagtggtgatgccaatgaatag

SEQ ID NO: 673 - DNA, 1362 bp, Methanobrevibacter ruminantium
atgaataggttcttaatatctggaacaagcagtaattgcggcaagacaacaatcacaatggccttgcttgcagcatttaaaaacagaggtcttgatattgcttcattcaagtcaggtcctgattatattgacccaatgtttcatagaaaggtctttaatgtaaagacacataaccttgatccctatttctgcactgaagagatgctttgtgagcagtttattagaaacaaaggaaatgatttaagcataatagagggggctatgggtttttatgatggaattggagttgaaggaagagcaagcgcttgggaagttgccaaatccatcaaggctccagcggtgctcattcttgatgcaaagggaatgagcaattctgcagctgcaatcataaagggctttaaggaattcaaagaagacagtatggttgaaggagtcattttcaataatatttctccaatgttatatcctcttttaagagacattgttgaaagcattggcataaaggcttatggtttcttgcctaggagggaagaatactcaataggaagccgtaacttaggattaatcactgcagatgagattcaggacataaaagataaaataaatggattaagtcaattggctgaagagtacattgatttagatggcttgtatgaattggctaagtctgctcctgaattaaaaactaatgattttataggagaagttttaactgattcccaaaatgaagaaagtgcagattcaagtaataaaccacgcatagcagtctctcgagataaggcattctgctttatgtatgaagaaaacatagaaatactagaggatttaggatgtgaagtggtctatttcagtcctttagaggataaaaaacttccagataatatttctggtttatatctatgcggaggctatcctgaattatataaggaggaactatccaataataaggacttatgctcttcattaaaagaaataatctctaatggaatccctacaatagcggaatgcggaggatttatgtatctgcatgattccattgagaatgtccctatggttggatttataaagggaaactgcattaaaacagataaattgcagcgctttggctatattgaaattaaggcattaaaggataatctattatgcagtgaaaacgatagtatcagagtccatgaattccattattatgacagtgagaactgtggagaggatttcatggcaaagaaagcatctaatggcttggaatatctttgctgtcatggttcggatagtctttatgctggttttcctcatatttatctacctgcaaaccctgattttgcaagatcttttgttaggaatgctagaaattggaaacattaa

SEQ ID NO: 674 - DNA, 639 bp, Methanobrevibacter ruminantium
atgaaaattgaattggaacaggtcgagcctgctgaaattgaaaataggagtatggaaataatagaatctgaattgcctcatgaaattgaccctaaattggcacctatcattaaaagggcagttcatactgctgctgattttgattatgtggataacttatgcttttcagaggatgttgttgataaggcattggaagcgattaaaaatggagcttgcattgtcactgatactcaaatggcaaaggcaggaatcaataaggcagagcttaaaaagcatggcggtgatgtcttctgctttatgagtgatgatgatgttagggatatggctaaaaagaatcattcaactagagctagagcatctatggataaggcatcacagctggacaggccattgatatttgctattggaaatgctccaacagctttgataaggttgtatgaattgattcaggaaggcaagctcaaaccagaacttatcattggagttccagtgggttttgttaatgtggttcagtcaaaagagcttattatgcaatgtgatgttccttatatcgttgctcgcggacgcaaaggtggaagcaatgtagcagcagctatttctaatgcattgctttatatcttaagagatcaaatgaagtaa

SEQ ID NO: 675 - DNA, 789 bp, Methanobrevibacter ruminantium
atggttgataaaattattttagtggttagttttggtacatcttataacaataaccgtgctcttaccattggagctattgaaaaggatattgatgaggcatttccagattatgaaatgagaagggcatttactagtcaaatggtaataaacaagcttaaaagacgtgatgacttggatattgacaatgttcaagatgctcttgaaagggcagtgaatgatggtgtcaagacagtcattgtacagccaactcatgtaatggacggaactgaatatcatttcaaaatcaaggacactgtagataagtacattgataaatttgataatattacaatcgcagatcctttattaatcactgatgaagactttgaagacttaatcagcagcataactaaagatgatgaatcaagtgatgaaacagctattgtttatatgggtcatggctctcctgctgagtctaatatggtttataccaaattgcaatccatgttaggagaaaagggattcgatcattattatataggcactgtagaggctaagcctgattatgatgatgtcttggctatggttaaggaaggagactataagaaaatcatcctaaagcctctgatggttgttgctggagatcatgctcaaaacgatatggctggagatgaagatgattcttggaaatccatgttccaagatgaaggatacgatgtggattgtctaattgaaggtctggcacagtctaaagacatcagggatgtctatatcaagcatgttcaaaaggcaattgatgatttgagttaa

SEQ ID NO: 676 - DNA, 393 bp, Methanobrevibacter ruminantium
atggaacgagaaagttattattttttattattgctaattggacttgtcatctgtgcaggtgtcttttatttccaatttaactatgcaactcccacatatctgatattcaatgcaactgaagtcaatgagggaggctcatttacaggggtattgaatgatgcttatggatttccggtggtaaataagacaataacctatcataagccaggatatgaaatggggacattggtggatgttcaaacggatgacacgggagagtttgttatagaaaatgcccaatacctgccggatgccggtgaagacaattattatggtgcattcacctttgcaggggatggcaaatatcaaggatgttcctttgatggaaatataactgtaattccaaagaaataa

SEQ ID NO: 677 - DNA, 669 bp, Methanobrevibacter ruminantium
atgtctaatcaagatgaagaaaactatatggatgatgaattattgcttaatgctcgaaagcctaaaggagaattaggggagaaactaattgagaacatgaatataaaccacgaatcccttgcacagtggagcctaaatcatttagagattgataaggatgattttattttagatattggctgcggcggaggagttaatgtggaaagattccttaaaatgacagacaataaggtctttggtcttgattattcagagctttcagttgagaaatccattgaattgaatagggaatcaattgatgatggaagatgtgaaataattcaaggttcagtttccgatatgccctttgaagaagggatttttaatattgctacagcctttgaaacagtttacttctggcctgattttgtaaatgacctaaaggaagtccatagaattttaaaaaaagatggaatattctttattgctaacgaagctcttccaaatgagtatgacaagcgtcaacagcgcatcattgaattgttagagatgcatatttattcaaaagaagaattagaggattctttagaaaaagctggtttttctgatgttaaatgttttataaaggaagccaaagactcttttactggcgatgatgcatattggatttgtgtgattgctaaaaagtaa

SEQ ID NO: 678 - DNA, 963 bp, Methanobrevibacter ruminantium
atggatgattatttaattaaatcaaaatctgaaactaatcctgaatatggatgcaatccatatgaaagacctattgaagaacatatagctaaaggaataatcaatttagacaagccttcaggccctacctcccacgaagtggactcctgggttaaaaggatcctcggatgcaataagacaggccatgggggaacacttgatcctaaggtgactggggtgcttcctattggcatagacaacgccacaagagtgagccaacttctccttccagcaggtaaggaatatgtatgtcttatgcatttgcatagggaaataccagaagatcaagtaaaagggatattcaatgaatttacaggcaagatttaccagacaccccctgttaaatcagctgtaaaacgtgaattaagggtaagaaatatttattactctaccatctatgaaatagaaggacaggatgtcctctttaggataggatgcgaagccggaacatatgtcagaacctattgtcatgatatcggtgaggcattgggctgcggagctcatatggctgagcttagaagaactagggtaggtccattcgatgagcgaaacaatgaccttgtaaacttgcatgaccttacagatgcatatcatttctatttggaagacggagatgaagagcatattagaaaggccatccaaccaatggaagtggctagctcacaccttcctcagatattcattaaagactctgcagttgaagcgatctgccatggggcaaagcttggtgcaggtggaatttgcaaattgtccaaggacattcaaaagggcaatcttgttgcaataaagtctttaaaaggagaactggtagctgcaggaacttctcttttatcctctcaagagataatgaatgcagattccggtttggtggttgatacaaataaggtctttatggatacaggaatctatccgaaaggatggtaa

SEQ ID NO: 679 - DNA, 183 bp, Methanobrevibacter ruminantium
atggatgataaagaaaaagtaattgaagcatttaaaaactctgaagaacctttaaacgctaaaaaagtcagtgaactttctggtgttgaaaagaaagaagtcgataaaatcatgaaagaattaaaaaaggatgaaactattgtttctccaaaaagatgttattggactcttgcagaaaaataa

SEQ ID NO: 680 - DNA, 552 bp, Methanobrevibacter ruminantium
atggtaaaaaacaataatgaaagatttgaacttgatttaagtaaaaatgaaactcctgaattcagcaatgaagaaatattaagcaaaatgagaagaggattcaataatcaatatgtatgctttgaatatccatttttatggcagaatatgccaattgacgaagaggatgaatttacagacataatgcttttcaataaagctaacaatgcaattgtaaaaatatcaacacagccatgtctcattgataatatagacgatttaaaggaagagattgaaaaggacttaaaatccaatggatgcaccattcaacagtccgctatggaaaagatggaaacccaagacatttgggatgtcttttataccactaaagaagggctagaagtagagcagttctctattttaaaggataataacctatacaatctggaattatataccaaaaacaacagagatcaggcaactgtcaaatcctttgttgatgttattcaaacatttacaatcttaaaaccaacttataaggtagatggagacagttatgaaaagatagagtaa

SEQ ID NO: 681 - DNA, 144 bp, Methanobrevibacter ruminantium
atggatggaatggatcctgaagactatttgatttataattattattttgaagaggaagagaataatggcttaagcaagaatgaaagctgttgtggtgttttaatggttttaatgattcttacaatccttttaactgttgcatag

SEQ ID NO: 682 - DNA, 504 bp, Methanobrevibacter ruminantium
atggcaagaagggaagagaatacatttgattttttaggactttttacagaagaaataggcggaaagaagaataagtcaaatggagctataaaatttcaaaaggataaacttttcattgaaaaaagaagcagattgaatggaaagcttaaggacagctatgaaatcagttatgatgaattggatagtgaaagcatcgatcgcccagctatcaatagggtggagattaaattaaaggataagacaatttcattgaagaccttagaccatgagatgttagataattttgaagataagcttttagatattgttgaaggtcctaaacttgctgttgaagattctccagttgcaaacgctccatacaatgctgcagagattaaatcagattctaagattggtgagatagatattccagaccagattagaaagtatcatgagctctataaagagggaatcatttcagaggaagagtttgagaataagaagaaggagcttttggatctatag

SEQ ID NO: 683 - DNA, 867 bp, Methanobrevibacter ruminantium
atggaaattaaatcaatccctcaagtaattaaggaaattcaagagcttgtagataaagaggattacgaatcagcctacaatatagcaaaagacaatgttgatttgaataaggaatacacagaaggagaatatgtatttaaaaacctgcttgaagagcttttgtttcaggtattaattcaaaaggagataaaaaagaaaatccctatgattttggattattcaagcttatattccaattatggagaagttctgattcaattggataagattgacgatgctaaaaagagctttgaattatcaagaaactataatccaataaacattaaagcaaacttcggattaggtgacttatataaaatggaaaacaaactaaatgaattttataaattagccatagaatcatttaaaatagcctattatccaaaagaccttgcaaaatcatttagaaacttatcatactattttttaaagatagccaaagaggaaaatgctgatgaaaacttaaaaatagcaatccatttaaaaaagatcagcaaagattatgatgatgaatcagagcttgccaaaacagaattagatgaaataaatggaatcattagtaattttgataaagaaacagtagaagcacttgaaagcacagatttaaaggaatgtagaaatgaattaaaatcaaaagggcttccttatgaagcaggaattgaaataatcaccatctgcaaaaacctaggattccagttagatgaggctaaaaaagtagttccagcattatattactttaatatagcatatgacctaactaaagacccagacattaaactagtgattgatgacttaaatgaaaaagtagaaagaagattggatgaataa

SEQ ID NO: 684 - DNA, 450 bp, Methanobrevibacter ruminantium
atggaagacgactttaagcacttagtgcgtatatccagaaaggacgtagatggaaacaaaactatcgaacaagctttaactcaaattaaaggtgttggattatccttatctagatctatctgtcttactttaggtttaaatactaccgataagattggttacatctctgaagatgatgttaccaaaattgaagaccttttagaaaatcctcaaaactacagcatccctgattggatgttaaacagacgtaaggattacgctactggagacgaccttcatttgattgaatctgaccttgacatgactttaagggacgatttaaacagaatgaaaaagaccagaagttacaaaggaagaagacatgaagttggtttaccagttagaggacaaagaactaaatctactttcagacacagttctactgtcggtgtaagtcgttccagaagataa

SEQ ID NO: 685 - DNA, 537 bp, Methanobrevibacter ruminantium
atgggacatccaagaaaagcaaggaaaaagtatgatactccacctcatccttggaatgcagaaagaattaaaactgaaaataaattaatgtctaaatacggcttaaaaaacaagaaagaaatttggaaagctgatactttagttagaaaatacagtagggaagcaagatacttattagggttctctcaagatcaagtacaagttgaaaccgaagaattactcggacacttgaaaagaaccggtatcctcgatgaagctgctcacttagaaaacattttagacttaactgtagaagatattttaagaagaagattacagactatagttttccaaaaaggtttagctcgcacagctaaggaagcaagaatgtttgtagtacacggacacattgctttaaacggcaaaaagattaactctccaagttatgtagtaaaaagaggagaagaagaagcagttggtttctaccactcttccccagtagctaaacagattgaagaatacaataaggcagctagtcaagctggagaaaatcaataa

SEQ ID NO: 686 - DNA, 393 bp, Methanobrevibacter ruminantium
atggcaaaagacgaaaaatggggaatagctaatatttattcatcctttaacaatactatcttgactgtaactgatattacaggagcagaaaccatttgtcaatggtctggtggtagagtagtacgtgcagacagacagcaatcatcaccttttgcagctatggaagcagcaaacagagcagctgaagatgcaaaggaaaaaggatttgtcggattgcacataagagtaagagctcctggtggaaatggtcctagaagtccaggtcctggtgcacaagcaaccattcgtgcattagcaagagctggaattaaaattggtaaaattgaagatataactcctatacctcatgatggtactggaagaccaggcggtaaaagaggaagaagagtataa

SEQ ID NO: 687 - DNA, 849 bp, Methanobrevibacter ruminantium
atggaaattgatgtcaaaaaacaagatgaaaattctatggttttcatagtccgtgatgcagaagtgccttttatcaatgcaatcagaagaatcgcaatgatgagagtaccaaaattagctatcgaagatgtatttattgtaaaaaacgattctgctatgtttgatgaagtgttagctcacagattaggattgactcctttggtttctgatttggaatcaattgaaggattagtcatgagagaagattgtgactgcaaccatgatgaaaatggaaactatgtggataagggtgaatactgccctagatgtagcgtatccttttcattaaatgaaaccggaccaaaagtagtttattcaagggatttaaaatcttgtggtgactcaaggattaaaccagtatacgataccatacctcttttgaagttaaaagaggatcaagatgttgaattggaagctgtagcaaagttaggaatcggaaaggaacatgcaaaatgggttcctacaacagtttgcgcatataagcaatatccggaaatcactttcaatgaaggtgaagatgtggtctatcaagttgctgatgcatgcccaaggaatgtgttggatgcaaacagggacgatggagtcattgaagtcattgatattgaaaactgttcattatgtaagacttgcgtaaggacagctaaggcagcaggttctaaattcatcaatgttggatatcgtgaaaatgattttatttttaaaattgaaactgatggatcaatgcctcctaaagaggttttattaaaagcttgtgatgttttggatgctaaaacagacgagtttatcacatttagtgaaggaggaagctaa

SEQ ID NO: 688 - DNA, 366 bp, Methanobrevibacter ruminantium
atggctagagaaattaagaaaactaatcctaaccttattgcacttatttacaatcttagaaaacagtcttatgaagaaggagtagctatctggaaagatgtagctatcaaacttgagaaacctgctagaaaccaagcggaagtaagcctttctcacattaataaaaatactgttgaaggagaaactgtggttgtaccaggtaaagtcttatctgacggcaaattggaccacaaggtaactatcgcagcattaggatttactaaaaacgctgaagcaaaaatagaaaagttcggttgtgaagctttatctattgcagagcttgcagaagcaaatcctaaaggtagcaatgttaagattatgttataa

SEQ ID NO: 689 - DNA, 429 bp, Methanobrevibacter ruminantium
atgatgattattaacggtgaaggacatattttaggaagacttgctagcgttgtcagcaagcagcttcttgaaggcgaagagattgtagttctcaacgctgaaaaaataatgttaactggtaataaggattgggcttacgctaagtacaagcaaagagtggacagagcaagcatctctaaccctcgtgacttaggtcctaaatatccaagaagaccagaagatatattcagaagaaccgtaagaggtatgttacctatgaaaaaagcaaaaggtagaaatgcttttaaaggattcaaggcatttgtaggcgtacctgaagagtatgctgatgctgaacttttaaccatgcctgaagctgaatataacgacattaaaaaaggaatggaattaggagaaatctctaaacttttaggtgctaaattcgattag

SEQ ID NO: 690 - DNA, 399 bp, Methanobrevibacter ruminantium
atgaaagttgttcatgcaagcggtaagcgtaaaacagctattgcaagaggtaccatcagagaaggtaccggtaaggtaagaatcaataaggttcctttagaactttattctccagaacttgcacgtttaaaattaaccgaaccattagaattagcaggagaagttgcagacaatgtggacatctccattagagttaatggtggaggagttatgggccaagctgaagctgcacgtatggtaattgcaaaaggtttagttcaatggactcaagacatggacttgaaagaggtttatacccaatatgacagaaccatgttagtaggagacccaagacgttccgaacctaagaaatacggtggtcctggagctagagctcgtaaacaaaaaagttacagataa

SEQ ID NO: 691 - DNA, 171 bp, Methanobrevibacter ruminantium
atgatacctatacgatgtataagttgtggaaaacccgtttctgcatattttgatgaatataacagcagattagctgatggtgaaaagtcaaaagatattttggatgatatgggtattacaagatattgttgtagaagaatgttaatttctcatgttgaaacttgggaataa

SEQ ID NO: 692 - DNA, 219 bp, Methanobrevibacter ruminantium
atggctgcaaaaaaaagcactgcaaaaaaattaacaagatttgaaaaggctagggttttaggtgcaagagctattcagctttctatgggcgcaaagcctatggagcataaggaaattgaaaagttcattaaaaactcaaaatctcttgatcctatagacatagctactttagaacttgaattaggtattttacctttagatgttagaccaaaagaataa

SEQ ID NO: 693 - DNA, 1248 bp, Methanobrevibacter ruminantium
ttggatagtgtaatcgaagatgttcgtgttagaaaaattttagatagcagaggaaatcctactgttgaagtagatataattacttggaacggatttggaagagctgcagctccaagcggagcaagcacaggttccagagaagttgtatccttccctgaaggaggggttgatcaggtaatcagtgaagttgaagacttgatttcttccgaacttatcggaatggctgctgaagacattgaagacattgatgaggtcttaagagaaatcgacggaactgacaatatgtctgcaattggcggaaatacaagtgtggctgtttccatggctgcagctaaggcagctgccatgtcctttggaatgcctctctatagctttttaggaggcaatttcgtcagtgaaatgccttatcctttaggcaatatgatgaatggcggagctcatgcaggtccaaatgcaccggacattcaggaatttctagtagttcctataggtgctaaggatgtggaagaggctgtatttgccaatgtggctgtccataagaaactaaaagagctcctctctaaaaaagaccctgatttcactggtggaaaaggagatgaaggtggttggattcctaatattactaatactcaagctttagaaatccaggcacaggcatgtgaagagacaagagacgaattaggcattctaattaggcctggtttggatatggcatcctctgagttttgggacagtgaaaaggaaaaatacgtatactcccaagacaatattgaaagggatgttggcgagcaagtggaatatgtcaaggacttgattgaaacatataacctgttctatgttgaagatccttttgatgagaatgatttcgaaggattccgtgagctcacttccaaggtaggaaacaaatgtcgcatttgcggtgatgacctctttgtcacaaactcaagactccttaagaagggaatcgatgaaaaggcagcaaatgcaattatcataaagcctaatcaaatcggctcacttactgaaacctatgctactgtaaaattagctaaagaaaacaatgtaatgcctgttgtatcccataggtctggagagacttgtgatgagaccattgctcacttggcagtggcctttggcgctcctatgattaaaaccggtgcaataggtggagagagaatagcaaaattaaatgagcttattagaatcgaagctgaattgtctaatccgaaaatggccagattgttctaa

SEQ ID NO: 694 - DNA, 192 bp, Methanobrevibacter ruminantium
atgtcaactgtaattattgatgcaagcaaatgtgaaaacgcagactgtggtgaatgtgtagacatgtgtcctatggaaatcttttccttagacggagacaaaatcgtaactgatcatgaagacgaatgtactttatgtgaagtttgtgtcgacatgtgcccaaatgattgtattacaattaaagacgaatag

SEQ ID NO: 695 - DNA, 597 bp, Methanobrevibacter ruminantium
gtgtcagatttattaatcccattagataactacttagctgctgggttacacattggtacccaacaaaaaactcacgatatggaaaaatatattttccgtgtaagatcagacggtttatatgttttagacgtacgtaaaaccgacgaaagattaagagcagtcgctaaattcttagcaaaatacgaccctgatgacattttagtagtggctacccgtcaatacggtcaagctcctgttaagaaattcggtgaaatcaccggttgtaagaccattcctggcagattcatcccaggtaccttaaccaacccaggatatgctaaattcatcgaacctaaagtaatcgtcgtaactgacccaagatcagactctcaagctatcttagaatccaaacaaaacggaattcctgtagttggtctttgtgatacagaaaacttacttgctaatgtagatatctgtgtaccttccaacaacaaaggtagaaaagctatcgctttaatctactggttgcttgcaagacaaatcttaagagaaagaggaattcttggcgaagacgaagacttagacttagagccttctgactttgagcttaagttctaa

SEQ ID NO: 696 - DNA, 897 bp, Methanobrevibacter ruminantium
atggataatataaaagataagaagatcaatgataaaattcaaaagcaattggctaatgagtcagtcaatgagcttttaagcattacaggtatcaaatcaaatgttatccaacctttaacagtagaatatgtagatgttgcagacacaagaatagcagattatgtaggattagaagaaaatgacagtatccgtcttttagagtttcataccggcgcacctaatgaaaacttggattttaaaatgtttgattattcttccatgatttataaaaaatataggaagcctgtaaatgcggtagcgatttgtacagaacgaataaacgagccagaaggcaaactggaatggggtgataggaacaaatattattatgatattgttacatacaaagatatcgatggggaattagaattaaatattattaggaacaaaaataaattcaatcaaaagttatcttcactggagatttttactttaaaaatgattttatacacttcctttgataaaaaacctcatgagataatgttagatgcctgtaaattaactaatgaagctaacttaaatcaatacctgttggatgaaataaaaaagtttcaggaattaacttgcagaaaaataattgatgaacaatatcatagggggattgccgacgtgatagcgatgaaaaatactttgttttatgaagacttgaagaagagtgaagaaagaggtatacgtattggtgagaaaagaggtataagtattggtgaggataaaaaggaatttcatatgagaatccatataattaaaaatctgttaggcaagatttctaattctgatttagcaaaatctttggatatttcagaggaagaacttgaagagtttattaaagaaaataatttaactccttcaaaggattga

SEQ ID NO: 697 - DNA, 246 bp, Methanobrevibacter ruminantium
atgatcaattgggctgctgaaatgaaaactatgaaaaatactttgttttatgaagactttaagaaaagtgaggagagaagcatccttattggtgaggataaaaaggaatttcatctgagaattcatataattaaaaatctgttaggcaagatttctaattctgatttagcaaaatctttgaatttttcagaggaagaacttgaagagtttattaaagaaaataatttaactcattcttccatttaa

SEQ ID NO: 698 - DNA, 849 bp, Methanobrevibacter ruminantium
atgattagagaagctgtcgttgcaggtacattttatgaaaataatgtcaaatatttgagagaaagcattgaagactgttttacacacagattaggcccaggagaaattccaaagctttccagagtaaataaggaaaaagaagtaaatgcaatcatggttcctcatgcaggatatgtctattcaggtccgacagcagctcacgcatattcaaagcttgttcaagacggatatcctgaaacctttgtcataatagcccctaatcacactggctttggagaacatgtttccatcttcaatgaaggatcttggatagttccaaatggggttgcagatgtggatgatgagcttgcaaacgcaattataaatcaatccaactatgcaaaggcagatttcctggctcataggaacgaacacagtattgaagttcagatacccttactaaaatactttgatagcaatttcaagatagttccaatctgtatgatggatcaatctcctcaagcatcaatcgaccttgccaattctatattcgaagcggccaatgatttgaaccgaaaaatcaccttgattgacagcactgatttaagtcattttaagtcacaggaaaagaccattgaacatgataacttagtgtttaatgaagtgataaatggaaatactgaaggcctttatcaagttgttaaaaaagagcagattactatgtgtggatacggtccaactatggtaagtatggaatattgcaagaaattaaatcagaagaactttgaattgctccagcattctactagcggtgatataactttggattatgcttctgttgttggatatggatctggggtttggttctag

SEQ ID NO: 699 - DNA, 984 bp, Methanobrevibacter ruminantium
atgagaaagatgtctgtggcttccgcacctggaaaaaccatattgtttggagaacactctgttgtttatgatgagcctgctattgcaggagcagtaaataaaagggcttctgtaaagatacaagagtctctaaataattattctaccttaaagtcttatgacctgggctttgaagtcatattgaatacaagaagagggacctataagctagtaaagggcaagccaggaatcattcgctatatattaaatgcaatgggcaagttccatgaccacagcaatattgacatgacattgggacttaatctgccgataggttcaggattaggctcttcagcagctgtaactgtagctacaattgcagcattgcatgactatcatggggttcctataaccaaggaaaagttggcagaggaggctcatggggttgagcaagacgttcaaggaattgcaagtccattggataccttggtaagcactaatggagggcttgtttatctctctcgcgaaaagcgcatcgtccgctttgacaagcctttggatgctccttttgtaataggctttaccaataagtatggaaatacaggaaagatggttaagcatgtaaggcatctgaaggacaattatccggagcttataaatcctgtaatcagcactatgggcaagattgcaaatgaggcaagaattgcgattctaaagaatgatattgataggatagcggatttgatgaacttgaatcaggggctacttgatggattgggagtcaatacatatgagttatctagaatgatttatacagctcgtgaaaatggtgctttagcttctaaaatcaccggttccggtggagggggaagcataatttcattatgtaaaaatagcactgtggataatgttgcaaatgcgataaataaggaagacagtacgataaaggttaaattctctggagagggtgttttggtaaataggcgttctcctccatttaattaa

SEQ ID NO: 700 - DNA, 816 bp, Methanobrevibacter ruminantium
atgattattttaaaaattggcggtagcatattaactgaaaaggattctgcagagcctaaagtggattatgctaacttaaacagaattgcagaagagatcagacaatctttatactcagatgaaatgagcaatgaccttattgacgggcttgtaattgttcatggtgcaggctctttcggccatccacctgctaagaagtacagaatcggagagccttttgatatggaagactatctttctaaaaagataggattctctgaggttcaaaacgaggtaaagaagctgaactcaatcatttgccagtcccttatagagcatgggattccagctgttgcgattccgccatctgcattcatcacaagccataataagagaatctatgattgcaatttggaattgatcaagacctatattggagagggatttgttcctgttctctttggagatgttgtcttggatgatgaggtgaagatagcagtcatctctggagaccagattcttcaatacattgccaaattcctaaagtcagataggatagttcttggaacagatgttgatggggtttatacaaagaatcctaagacacatgatgatgcggttcatattgataaggtaagctctatagaggacattaagtttttagagtccactacaaatgttgatgttaccggagggatggttggcaaggtcaaggagcttctagacttggcagagtatggcataagctctgagataattgatgcaaacgagaagggagccatttcaaaggcacttcagggtatggaagttagaggaactaaaatttccaaggaataa

SEQ ID NO: 701 - DNA, 1053 bp, Methanobrevibacter ruminantium
atgatatctgatagaaaattggaacatcttttgatttgcaagaattatgatgttagctataatgataagactaccggatttgaggatattgaactcatccatagggccttgcctgaaatcaataatgatgatatagatttatctactgaagtatttggaaagaaactggattctccattattcattacagcaatcactggaggacataaggctgcaaaggatattaataaggaattggctattattgcagaaagcagaaatatcggtttaggtttaggaagtcaaagagcagctatagtaaatccagagctaagggatacctatgatgttgtaagggaaaatgctcccgatgcattgattttaggaaatattggagctccacaaagcgacttggcaattgatgctgtagagattctagacagcgatatcttggcaattcacttgaatcctcttcaggaatccattcagcctgaaggagatgttgatgcaaggggatatgtagattcaataaaggagatctgtaagacagtggatgttcctgttatggctaaagagacaggcacaggcataagagctgaagatgcaatagaacttgaaaaggcaggagtcagtttcattgatgttgaaggagctggaggaaccagttgggctgctgtagagacatatagagctgaagatagatatcttggagagctattctgggattggggaattccaactgctgtaagcactgttgaagtggtaaattcagttgagatccctgttgtatcctctggaggaatttcgttcaggactcgatgcaagctaagggcaattgcccttggagcagatgctgttggaatggctttgcctgcattgaaaggagcctatgaaggtcaagaagctttaaaccagatggtaaacagattcaatgaatctttaaggattgcaatgttccttttaggggcaagcaatttagaagagttaaaacgatctgatttgattattaaaggcgaaactaagcagtggcttgaagcaaggggctttgacacaaagcattatgcacgaagatag

SEQ ID NO: 702 - DNA, 1350 bp, Methanobrevibacter ruminantium
atgacagtagaagtaatagcaattggtggatacgaagaagtaggaaagaatatgactgccgtaaaggtaggggaagatgtaatcatatttgatatgggtatccacttagacagaataagtatccacgaggatacagatatagacagaatgcacagtttggacttgatagagcgtggagtcattccagatgacacattgatgaaggatgtagacggtaaggttaagggaatagtcttctcccacggtcacttggaccatattggagctgtagcaaagcttgctcacagatacgatgctccaatcataggaactccatatacaacagccctcattgaaaagcaaatcaagggagagcgcaagttcaaggtaaacaatcctataagaccactcaatcctggaagcaagatcaaactgtcaaaggacataaccttggagtttgttcagtccactcacagtattccacaagcggttttccctgtattgcacacttcagagggaataattgtctatgcattggactttaagtttgacaatcatcagaaggtctctccaccacctgactataacaggcttagggaattaggaagaaaaggagtattggctcttattgtagagaccaccaatgcaatcaactatacagaaacaaggacatactctgaaaaggttgcaagaataatccttgaagacttgatgaagagagcctttaaaggccaaaaggaaggaatgattgtaaccacattctcttcacatatcgaaaggattcaaacaattgcagacattgcaaaggacagcaatagggaaatattattccttggccgttccatggaaaggttctgcggaatcgctcaaaaccttggaatattgaaattgccacagaatgcatatgtatatggctctccaaaggctgtaaacaaggctcttatgaaagcagaggacgatagggatcaatacctccttgtaaccacaggtcaccaaggggaaccggatgctctccttccaagaatagcaagcgcaagaactccattcaatgtaaagaaaggagataatgttatattttcagctcctatcattccaaatccgaccaatgcagctaacagacatattttggaaagcaaattaaaggcaaacggtgcaagaatctatgcaaacgctcacgtttcaggtcacgcaggaagggaagaccatagggacttcttaagaatgctaaggcctaaacacatcattccagctcacggagagttagagatgcttgtggcttatggagagcttgcagaggaagaaggctataggatcggaaacaatgttcatatattaaggaatgctcaagctcaggtttttaatggtgattag

SEQ ID NO: 703 - DNA, 996 bp, Methanobrevibacter ruminantium
atgtctgatgtaactgatgttttaaaggaatattctgcagatgtcattaaaacaattgaagagaatttagctcctgttcaacctcaaaacttacaggatgcttgtatttatttaactaaggcaggaggcaaaatgcttaggcctgctcttactttaatatcctgcgaagcggtaggtggaaataaggaggatgctcttaagaccgcagcagcaatcgaactcattcacacattttcacttattcatgatgatattatggatgatgacgatatgagaagaggcatgccttcagttcataaggtatgggacgagccattggctatattagctggagataccctattttcaaaggcatttgaaatgattatctcatctaaggaagagaacgctcatccggaacatgttgcaaatgcccttgcaactgtagctgatgcatgtgttaaaatctgtgaaggacaggcttcagatatgagctttgaaggggactttgatgtcaaagaggccgaatactctgaaatgatttataaaaagactggcgcattgattgcagcagcaactaaggctggagcgattatgggtggcgctgatgaaaaggaagtcactgcattatatgaatacggcagaatgattggtattgcattccagattcaggatgactatttggatgtaatcagtgacgaaaaggaccttggaaaacctgttggcagtgatattgcaaaaggaaaaatgacccttatggttgtaaaggctttagctgaatcagatggtgaagatcacgaaagacttcttgaaatcttaaaggacaatgactgttcacaggatatggttaatgaggcaatagatttattcaataagtatggctcaattgattatgcttataatttagctttagaaaatgtaaatggggctaaagaggctattgcatttttaccagactctgatgcaaaatcaatgcttattgcattggctgactttgtaatagccagatcttcataa

SEQ ID NO: 704 - DNA, 873 bp, Methanobrevibacter ruminantium
atgggttttaaagacaaggttttatcctctagcaatcaattcaattattataaggacaattatgaaaaattgcttaatgagaataagcaattgaagcaaaagcaaaatcagcttatcgaagagaatgagcaattgattaaggaatttgaattaaataagcaaatcataatcaataaagagaatttatctaccgaaagcaactattgcccatattgtgggaggatttctaattttgaaccttatggtgttgtcaaaagggaaaaggcaatgtgcccatattgcaagtctttagaaagacacagattaatttatcttttctttgaaagaaactatagttctatttttaaaaataaggacattaagttattgcactttgctccagagagaattttctataattatttcacccaattcgaccatgtggattattatcctgtagacatagaccctgaaacatatgcaaaaagaggccttaagcttaagatgaaggtcaatatggaagaggttccatatggcgatgaggaatttgacttcatctataacagtcatgttttggaacacgttccaaatgattttaaagctatgggtgagttatatcgtgtacttaagcaggatggagtctgcataactgtggttcccctatctggaaatgaagagactctagaaaaggaagagtataacactcctgaattaagagaaaagcattatggaaacaaggatcatctaaggttttatggtctggatgttaagcaaaggcttgaatctgttggatttaaggtaaaagtatctaaattagaggatttgaatttaactgaaaaagagattgaactctttaatgtaaaggaatctttaatttttgtatgcactaaataa

SEQ ID NO: 705 - DNA, 660 bp, Methanobrevibacter ruminantium
atggatttgccatctggagacaattatgaaaataccactgttaatgaagcaattcgtcaaatcaatgatacaaaccgtgatttaactgttttattctataatagtgaagacaatagtactgtagcccgggtagaattcgaatttaccataaatgattttaaagccactgctactgaacagactgttgcaaacagaactgtctggtataacgaggaaaatggtacttatatggcatttttaggtaattcagttacccatgacaatataatcatcatcacaaatgatgttgagatattggaacatctcatatcaagcgtgaaatttattttcctaaatgaagacggcactgtaaattccacatctgatatggtcaataatcaaagcataaatgtcactggcggtacggcttcaaatggaactgatgcaagtgcatctacagctacttccaatgtttcaagctctaattcccaatctacaggcaatgatggatattattggtctggacaagatcaggattatattaaggagtataccgacagcaatggcatacagcatatagaccgtaggaacggacctaatgaggcttatgatccaaacacccaaaggcattatactgatggtgtagaggatacagcagcttataatcaagactttaattaa

SEQ ID NO: 706 - DNA, 573 bp, Methanobrevibacter ruminantium
atgatagaaaaggtacgattcgatcagattgcagatatctttacgggagtaagggtaaaaaggtatcagaaaggtaaaggaactacagttgaaaggcccattctaaagaaaacatattccgaaaacagttcaaaattggatttggaatatgaagaggtatcagaggagatccatgaaagattctactcacaggaaaatgatattgtaattctccttgcaggatctaaagtgagcaaaatagaagaggctggaattatcattccaatgtattatgctgttgttagagtaaaagaaggttatgatgttgattttatctaccatctgcttaaaagcgatatcttcccaagggaattgcataaaattgaagagggaactacattaaagattataaagacaactcaccttaaatctatttatttgcctgttccagatttagaaactcaaataaactatggaaaattgtttaatttaatggataagcgcatcaaattaaatatggaattggcagaacttgaaaaacagattgaaaagtcaattatcaatgagatgctcctggaggaaaaaactttttaa

SEQ ID NO: 707 - DNA, 1905 bp, Methanobrevibacter ruminantium
atgtcaagcagattaggacgccaactatgggataaatatgaggaattaagaacaaacagcatggttggttttttaacagatgaagatttccagaagtactttttaggtttcataacctacaagtatctctctgaaaatttggaattgtatcttgataaggaattggaaaaggacgatttgaagtttgaagaggcatataactttgaaaattatggcaaggttttagcgaaaaaggcaatctataacttaggctattttattacacctaaccatctatttagaaatgtcatagcctcctataatcagggtgcagatatttcaagagaattgaaatgggcttttgctgaaataaatagttcctgtaagaaaaccgaaagtcaggaagattttgaaaacctatttgaaagcgttaatctccaagccactccattaggtaaaaagcaggaggatagaaatagggtaatctataatatattgaacgctttggatagtgttgactttggcttggatgagttcaattcttcactctctttaattaaccattattctgagcctgctcgagagcttggtgtgaatctggatgctttggaaaaggaattgctttcagatcctaataagaatatctttttagatgattctcccctaaatgaaagttcttcaattccattaaatgaggctccatttgaagagtatgcatctatggaacttttcttagacgatattgctcctgttgaagagtttgattctatggaactttcaaataaagagaatattgtcacaggtttagaaaatccaaatcatcccaatagcttagtcaatgagggatggaatgacaggtcctatgacagctataggattcaaaagcaatattccataggtgacgcatttgaatatctccttgataagttttccctaaatgcctcaaaatctgctgatttttacactccaaatgatgtttcagttttggtttcaaagcttgtggccacaaacaaaagggctattgattcagtttacgatccttgctgcggctcttcctcaatgcttctggaattaaacaaacatgtttccttaaatcttatctgcggccaggaagtgaatgcatattactataatatttcaaggcagaacatgatcttgcataacattcactttaaggactttgacataaagcagggagattcattggatagccctcatcatatagggtatgataaatttgatgttgtagtctctcagattccattcaatgtaagttggaccgccaagaaaagcttcttaaatgatcaaagatttaaggagtacaatgcattggctccaagggtaaaggcggaatatgcatttattcagcacatgctttatcatttggatgatgatgggattatggttgtaatagctcctcatggggtattattcagatccgcttctgaagaatcaataagaaagataatagtctctaagatgaattatctggatgcagtcatcggtcttccgtcaaatatgttctatagcacaaatagccctgcatgtgtactgatattcaagaaaaacagaagatatgatgatgacgtattattcattgacgcttccaagaacttcaataagataaagcttagaaacaatcttagaaaagaggatatcaataagattgtaggcacttatgtctcaagggctgaagttgacaaatactctcgaagagtcagcttaagggaaattgatgaaaacaattgtaacttgaatatccctagatatgtggatacatatgaggaagaggaaataaacatccaggaaatttataaaagacgggaagaagcctctcgtgaacttaaggaagttacttatgaaatagatgagctttgtaaggaattaggtattgagaatcccttaataaataatatctttgaataa

SEQ ID NO: 708 - DNA, 921 bp, Methanobrevibacter ruminantium
atgagcaaaacttatatttttggacataaaagtcctgatactgattcaattacttcaagtcttgtaatgtgtgacttagaaaacaaattaggaaatgctgatgtagtgtcatgcagattaggaaatcttaataaggaaactgaatttgttttagattacttcgatattgaagcccctcaattgattgaaagcatcgaagatgatgccgaggttattttagtagatcataacagtccaagcgaatctgttgacaatattgaaaatgcaaagattttaaagcttgttgaccatcacaagattgcttttgaaacttcctatccattattcattagaacagagcctgtaggctgtactgaaacaatcttatttaaattatataaggaaaatggcctcactccagataagaccattgcatccttaatgttatcagcaatcatatcagacacattgcttttaaaatctcctacaacaactgaagatgataagcaagcggtaaaggaacttgctgaaattgcccaaattgattatgaggaatacggtttggaaatgctaaaggcaggaactgacttatcaagtttctcaattgaagagatcttaagcttagacgctaagcaaattgactttaaagatgtcagatccattgtaaatcaggtaaacactgcagatattgatgatgtgatgacaatgaaagatgatttggaagctggaatgaataaaatcatagaagatgaaaatctagacttgttcatgcttttaatcactgacattgtaaacagcaattctcaagtaattgctcttggaaaagatgtgtgccttgttgaaaaggcatatggagttaaattggaagacaatactgttcttttagagggtgtagtctcccgtaagaaacaggttgttccaataatgactgaaaatgcttaa

SEQ ID NO: 709 - DNA, 396 bp, Methanobrevibacter ruminantium
atggaaataaatgattttggccatgatttagatgaatctgctcagtttttagttcaaaagctattgattctccatccttgggatgaagaatgggacttaagcgtaactgccaatttggttcccttttataaggaaaagatagatatacaaatatctaagcaaggaaaatgcgatgaggagttttttgataagcttatccgattttcctctattttagatacaaatcaggttagacttctttttatggaacaattagttggtatgcctttaatccttgatggcaaatatctaaataatgatgagcgcattgatttattgatagaatctttaaatggaaggttaaaaagagttgataatggtttatatttatttttcaatcacgaagaggaattttaa

SEQ ID NO: 710 - DNA, 1170 bp, Methanobrevibacter ruminantium
atgatatataggaaactaggaaagactgatttggaagtgtcaaatataggctttggatgtatgcgtttgccccataaagagcatttttaccaaatagatgaggcagaagctagcaaaatgtttgattatgcaatagatcatggaataaactactttgaccttgcctattcatttcatagcaaaaacaaaaatcttggaggaaatgcagagccctttgtaggtaaatacctggctgaacgtggaaaccgtgaagatatggttattcaaacaaaactccctggatggctggtaaataaaagggaagatatggacaagttccttgatttgcaactcgaaagacttcaaactgattatattgatgtatatatgctccattcccttaagatagacttttggaacaagttatatggcatggatgtattggaatttttagacagcatccttgaagatggcagagtcaaatatgtcggtttttcctttcacgatgatttggatgttttctttagcattatggattcatatgataagtgggatgttatcctaactcaagtaaattatcttgatgaggattataaaagtggccttggcggtttggaatttgttggaatggcaggacttggtaatgtaattatggaacctttaaggggcggaagcctaataacaaacattcccgatgaagttcaagctctttgggatactgctgataagaaaagaactcctgtggaatgggcattggaatatctttgggataagcctcttgtaacatctgtattcagtggaatgagcaatatggaacaggtaaaggagaatattgccatagctgaaaactgccagccggattgtatgagcgaacatgataggcaaatattaaaggatgttgctcaagtctataagtctagggaagagattccatgtacaggatgcagatattgcatgccttgccataatagagtggatattccccactgttttaagcagtataatattgctaaaagcttgaattatattgataagactgcagcaccttatttctggttggtaaataaggatgaaagagctgacagctgtacattttgtggtgagtgtaatattcaatgtccgcagggcatagatattcctgcagagatggaaaaggtctttgacttcttccatgaggaaagtcagtattag

SEQ ID NO: 711 - DNA, 828 bp, Methanobrevibacter ruminantium
atgaatcatgacgagctaataaaccttgatgcaatagattgggaagaagtttggcaaaagtcccttaaaaagagttttaaaaaggaaaagaactgggatgatatagcaaaagattttggacaatggcttgaaaatgacgactatcctgatgtattgcttgaagagatgagaattgatgaagaggacaccatactggatataggctgtgctgagggaaccataagcagaaagctagcgaaaaaagccaaatcacttactggtatcgataaatccaaattgatgttagaggaattaaataaaaaagcagaaaaagagagaatagataatattaccaccattcaaatggatataaatgaacttaattatgaggaaattggagactatgacatcattcttgcttccagatgcctaaatggaatatataatataaaaaatacacttacaacccttaatgaaatagcaaataaatatgtttacattacagtatttggttcaaaaagccataaatacaaaaaagagaaatgtgaaattgcaggaaaaccatttaaagcaggaactgactatatggttttagtgcttcttttaaaaagtcttggaattgaagccaatgttgttcagttagagtgtaaaaatctaaaggaatatcgtgactttgatgaagcaatcaatagatctgtttggagatttggagagttggaagaagatagagaaattgcacttagacaatatttcaaagagacccttgtaaaaaatgaaagaggaaattgggttaatccaaaggacaaaacagatttagttttaatttggtggaaaaaagaagaagaatag

SEQ ID NO: 712 - DNA, 825 bp, Methanobrevibacter ruminantium
atgactaagaaaataatcattgaagatgagaatgaaattgattgggaccaattatggactgctaagatggataagaagggagaccgtggaaaagactggtctaaagcagcagaaaagtatagtgagagagccagcaaagataactataccgaacaattgatttcaaaaatgatcatatctaaagaggataccgttttggatgtgggctgtggagaaggaagcgtaaccattcctttatctaaagaagtaaaatccattacagccatcgatgcaacagacaagatgcttgaaatactagatgaaaaaattaaatctgaaggaattgaaaatataaagacaattaaagaggatattaatgatgtaaatcttgaaaaatatggcaaatttgatattgtgcttgcatctcgcgtagtaaacggcataaaaagccctaaaaaggttttttctaactttaatgaaatggccaataaatatgtattcattacattgtttggaccaaacaattggaaattggaaaaagatttccatgaatatttatctaaagagtataatggagctccctcttataccatacttctaaatctccttgcagagatgggaatttatgcgaatattataaatttagatgttgggccagtgcgcacttataagacaattgaagaagccatagataatggaaaatggaatttagctaaatttagtgaagaagaacaagagaaactgcctaaatttttaaatgaagtattaattagagataatgaaaccggtttgctatctaattctgaagacaaaccagattgggtgcttctttggtggaaaaaataa

SEQ ID NO: 713 - DNA, 816 bp, Methanobrevibacter ruminantium
atgagttttcaaatagatgaccctgaagatatcgattgggcttacttctgggctaaaaaactggaatctaaaaaggacagggctaaagactggaataaggcagctcccaactttggaaagtctgcaaaaaaggacgattaccatacaaagattatagaaagaatcaatgtcagcaaagaggacacaatccttgacttaggctgtggcgacggaagcataacaattcccctagctaaaaaggcaaaatccgtcactggagtggattctgcatataagatgcttgagatactgaatgaaaatgccaaaaaggaaggaattgaaaacataagaacccttgaagaggacttatcaaatattagagtcaatgatgtgggaaatcatgacattgtagttgcatcaagatccttgaatggaataataaacattagggaaacaatctccaatataaatgaaatagctgacaaatacgtttatattaccctatttgggccaaacaattggaaaatagaaaaagagttctttgaaagcattgataaggaatatgtagagtttccatcccatagatacttcttcaatatacttgttgatatgggaatctatcctaatgttgaaaaccttaacatcggccataaaagggaatatgaaaacattgaagaggccttggaaagtggaaaatggagattggaacttttagacgatgaagaaaaggcacagctttataaatatttagaggatatattagaagaggatgataatggaaagctctccaatcctaatgataaagcagattgggttttatattggtggaagaaatag

SEQ ID NO: 714 - DNA, 495 bp, Methanobrevibacter ruminantium
atggatggaagattagatatagattcttttgaaaaggcaatcaacggtttaaataaaaacttatacgatgttggagcactctttcaagcaaatatgcctcttttagcaagtgaagcaagccaagctgctaaagaaaactgcgttaacaagatggcagacagggttgatgaaagattagactcctttagagaaaactatggatattacaacgacttttatgagaaattaaaagaaaacgttaaaaatgacaccatagaaaacccagaggagtatgatgtgttcctagaacatgcaagcaacacttttccaaagtatattgatgaattgggacagaccattgatagtttatctggaattcctataaggactgaaaagtttgattcaacaatgagagaattaggatccattattgaaaacttcagatttgactttaaaaggaccttaacagtagctgatgtttataaagttcaaaaagaaatgaaaagccaagaataa

SEQ ID NO: 715 - DNA, 264 bp, Methanobrevibacter ruminantium
atgaaagcggtctcttatatcaagagatccaataacagatatgtattagtaatgaatatgaatggaaaattcaagatgcccagtgaaatagcaagtgaaatggatctaagaataaatcagataagtgcagtcttatcggatttaaaaaaagaagatattgtaacttgcataaatgaagaagaaaaggtaggcagactttataagttaaccgacaaaggtttagaagcttataaagtcattaagactaacgaagagatacaatag

SEQ ID NO: 716 - DNA, 1671 bp, Methanobrevibacter ruminantium
atggacgaattagaagaaattgtatttaagcatgcattattgaatgcagcaaagcataagggaagcgcaaaccctggagcggttatgggctctataatgagcaatgaacctgaacttaggcctagagcaaaggagatcggaccgatttccggtaagattgtagctcaagtaaatgccatgtctcctgaagaacaaaagactaagatggaagagctaggagtggaagtggaagagaaaaagaaaaagaaagaggaaggattgcctaagcttccaggcagcaataagaatgttgtcatgcgttttgcacctaacccaagtggaccattgcacattggacatgcaagagcagctgttcctaatggtgaatatgttaaaaaatgtggcggaaaattcattttaagaattgaggacacagatcctaagcgtatttacgaacctgcatatcaattgattcaggatgatttgaaatggcttggtatagagcctgatgaagtctattaccaaagtgaccgttttgaaatctattatcaatatgctgaagagcttataaagcgtggagcagcatatatgtgtacctgtgacgggggagagtttaagaagcttaaggacaactgccagccttgcccatgcagagacaatagcgtagaggagaatatggagctttggaaaaggttccctgaaatggaagctggagaggctgtacttaggattaagactgatataaatcataagaatcctgccattcgtgattgggtggctatgagaatagttgaagaggagcatcctaggcttggaactaagtatagggtctatcctatgatgaacttttcagtatctgtagatgaccatttgcttggaatgacccatgtattgagaggaaaggaccatcttgcaaacagcgaaaagcaaaaatacctttacaaccatatgggctgggagattcctgaatttatacattatggtcgattgaagatggaagacattgcattaagcacctccaaggctatggctggaattgaagagggcacctacagcggatgggacgacccaaggcttggaaccttaagggctatagctagacgtggaatccagcctgagacaatcacccaattgatggttgagattggaatcaagatgtctgattcagcaatcagctggaaaaagatatatggattgaatagaaatctcattgaagagaaggtaaacaggtatttctttgtaccgggccctgtaaaaatagacattgcagatgttccagaggacattttaggatgggaggtcattaggccgctacatccagactttgaggaaaggggcaatagaactctaatctttgataaggaactatatattcctaaagcagactgcaaagatggaattatccgtctgatggatgctgttaatgttgaaatcagtggagaggatgtcaagttccatagcgaatcctttgaagatgctagagaggtcaaggcaagaatcattcaatgggttcctcttgatgcgataaaggctaaaatagttatggatgatgcttctatagtggaagggctttgtgaaaaggactgtggtgatttgaaagttggcgatatagtccaattggaaaggtttggatttgcaaggcttgatgagattaaagatgatgaattaatcttctattttgcacataaatag

SEQ ID NO: 717 - DNA, 447 bp, Methanobrevibacter ruminantium
atggataaaaaattagcagttatttttatagggattcaaggaagcggaaaaacaagcttctataaaagatacttcccagattttgcccatgtcaatctggacacatttaaaaaaagaagcaaggaaagaaaattctttaacatgtgtatagaagaaggaaaatcatttgttgtagacaatacaaacccaactaaattcgatcgccaacgttatattccaactgcccgtgaaaatggatatgagatttggggatacttcttcaattcacctttggaagagtctatggaaagaaacaatcaaagagaaggcttggctaggattccaagagtgggagtcctatcaacctataaaaaattggaagttcctgaatatgatgagggatttgataaactgttctatgttaaaataaaagatgggcaatttgtggttggagaattagaagaataa

SEQ ID NO: 718 - DNA, 2289 bp, Methanobrevibacter ruminantium
atgaaagaggttacagcaattttactagttattattgccctaattgggataatatcaataataatagtgaaactatattacagagaaaaagaaaaagatcatgataaagaaagattagaggaattccttaactcaagcgattacaattccagcattgaatcacatgagaagattagctcaaggcaaaaagctgaaggctctaaaaagcctcagaaagtccaaagacgcagaagagttagaaaagtccctaaggaatctcaaaacagaaatgaaaacctaagcgaagcacaaatttatgctaacacactacaaaacgcatccaataatgatttatttgtagattatgatggtgataataggggagctcaaagaaccagaaaggttagaagagttgctaaagctgaaacagcagaaactactcaagctaacggcactgccgcattgttaagacaaagggcagaggctgcaaaagcccgcgaacaagctcctaggaccaaggtcagaaaggttagaaaagtaaaatcccaagaggatacagttcaaaaagttcaaagaactccagatagagtcaaagaacaaatgaacaaggaagagaaagtaaaacctatccaagaacctattacaaaagagcacaaggaaaccatcaatagcgtaagacaaggtgaaagtgaagtcaaacctcgtcaagtccctatgactaaagaacagaaagagttcatttcatctgaaaccgctaaaaaacttattgttgaagatgatgacggtgctgttaaagtagttaaatcaattaaaccagctgaagacattgaagaaatcaaggaaagcgctttaattgaaaaggctgaaactactgaagaagctaaagtaaaagttactgaagaaactcctaaagtagaagaaaaagctgaaactgctgaagaagaagctcctaaagtagaagaagaagttcaaactgaggaagctccaaaagtagaagcagaaccagtccaagaaactactgaagaagtaaaaactgaagaagctccaaaagtagaagcagaaccagtccaagaaactactgaagaagttaaagctgaagaaactaaagtagcagaaaaacctgcagaagaagttgctgaaaaagtagaagctccaaaagcaggaaaacctgcagaagaagttgctgaaaaagtagaagctccaaaagcagaagaaatcaaagaagaagtaaccaaacctgctgaagagcctaaagcagaagaagtaaaagctgaaactactggagaaataaaatcagacgcaccaaaagtagaagcagaacctacagaagaacctacagaagaaatagaagtagcagaacctacagaagaacctactgaagaacctactgaagaaatagaagtagcagaacctacagaagaacctactgaagaaatagaagtagaagctgttgacgattacatagaagctctagaaacagaaggcgtttatcaagatgacctccacattctcctaggagaagagaaaatcgaagatgaaggccctgaaaacgaatttgtcacaatcaattccgatagacaatcaagctctggaggaaacgacatattcagagatgctataaactccattagaaaattcagaggagcaaacacccaacagcataaggttgaagaaatcaaagaggaagtagttccagatgactacatccacaactttggaaacggtatagaagaaatcggagacacaatcacaatcactcctatccgtgaagacgaaatcgatgatttggcttataatcaacctaatgaagatgtagatgaaatctataaggaagtcaatgaagaagaatacaataaaaccattgattccgaattggatgaagcatacgaggatgttacagatgaaacttccgaagaagaagctaacacctacactgtagaggattataagcaaatcgaaaaagaggaagaggagaaaaaggcaagagaagaaaatacccaaaagattttagatcttaagggaattgaatccaaaaagcctcgctcttctaaaaaagaatctgtatctacagaacagccagaagatcctgctcaaaagcaattggtctttaccgaacaaagaagcaatgttgaagaggtttatatcaatggcaaattgattgaactcaaacttggccagactgtaatgtttaatcacaacaatgaaacttactctagccaaatattaaagttaaaaccaggatttgttggcgtcaaatacagaggcaaaaaagtctggattaaagcaaccgatgttaaaagagtgctttaa

SEQ ID NO: 719 - DNA, 1233 bp, Methanobrevibacter ruminantium
atggttaaaattaatgaaaattatcttttattgcaaaacagttatctttttgttgaagtaaacagacgtgcagagaaatatatggaagaaaacccagataaggatgtcatcaaaatgggaattggggatgtaaccaaacctttaacccctacagtaattaaggcattcaaggatgctgttgatgaaatggcagatggagaaacatttatgggttatggtccagagcaaggatatgactttttagctgaagcaatcattaaaaacgacttcaacagatggggagtcgatttagaccttgatgaggtcttcatttcagacggtgccaaatgtgataccggtaacatacaagagatttttgaccttgacaatgtaattgctgttactgaccctgtatatcctgtttatgtggacacaaatgttatggctggcaggtctggcctaataaaggatgatggaatgtatgcgaatatcgtatatctcccatgcactgaagagaacgactttgtaccagctcttccagaggaagatgtagacttgatctatctctgtttccctaacaaccctaccggaaccaccttgacaaaagatcaattggctaaatttgtcgaatatgcaaaggaaaatgacgctctcattcttttcgatgcagcttatgaagtattcataacagaagatgacgttcctcacaccatctatgagattgaaggtgctaaggaagtggctattgaatttagaagcttttcaaaaactgcaggattcactggtacacgttgcgcttacactgtagttcctaaggaaatcaagataaagacatctactggagatgagcaatctgtaaatgctttatggaacagaaggcagaccacaaaattcaatggagtatcctatcctgtccaaaaggctgcagaggcagtttacagtgaagaaggacaaaaggaaattatggaaaacattgaatattatttagaaaatgccagaatcattcgcgaaagcctatctgatattggattgaatgtttatggtggagttaactctccttacatttgggtaaagacccctaatgacatggaatcctgggacttctttgaccttcttttagaagatgcaaatattgttggaactcctggatccggatttggtccaagcggtgaaggttatttaagattaactgcattcaatactttagaaaatactaaagaggcaatgaacaggatttctaaattgtctttctaa

SEQ ID NO: 720 - DNA, 681 bp, Methanobrevibacter ruminantium
atggaagctgattttagccttgttaatgaaaatgatgatttgcaggatttattctccaaatacggagctcttgctttggaaaaacaggaaaacctctccaagcttgttggcgatagcgagcctgaattggatattgaaaatggaatagtcaagtttggtgataaggagtttcctattcaacttctagggtttttagatcctgatgaggacacttggtcatgggcatgggacaatgaggaaataggattccctgaagagctcattgaggaagccaaggaagttaaggaatttggagaagatcagaatatagttcagtttaagcaaagcatgtttgctgcaagctttgaggaagcccatattttatccatgactgtatcttcaatttttggagacgacgcatactgtggagttaattatggaaactttgtattctttgtaaccataaaatctgatgagattccatcatctgagggtcctgaagaattctccaacattttcaatgaattccatcgcagatttgaagtaaatcatttaaaggctttggaatcctatgcaatgcttaagggttatgaatacaaatacagagatgactttgctcttgttaagattggagacaatagggtagttgtaggattaaccgaaagaaaaaatgttcaaagcattaagtttattctagcttaa

SEQ ID NO: 721 - DNA, 627 bp, Methanobrevibacter ruminantium
atggatagtgaattaattgaagaaataagctttgaaattcaattattgcttaagatgggcttctataatgatgaagagattttagaaataattgatgatgaatttattgaagaggacattccaaaggaaaagcttttagaaatattctcaaatgttaaagagaacttcgattgtccaaaaagcgattcagaagactttttgaatctgaaagaggcttttttaaacttgtctaaaaatcataatatattaactattcataatgccggatacgatattgaagagggaatccaagactcatttgaactattcacccatcttagaaacaataaatatgaagtggaaggattctgcttctatagctttgaggatattgaaattgcaattgaagaaaacagccttttaatagcctttggcgattttgaatttgatgaagataaaggcctaaagatagctaagacagttaaagatgagctagtttccaagggattcaatataaattgggatgaaagcattgatgagagaattgaaatagtggatttcaattggcaaaaggcttatgaagatagggattattccatggatggagctttaagtgattatattgaattaaataacttagaagattaa

SEQ ID NO: 722 - DNA, 669 bp, Methanobrevibacter ruminantium
atgaacgctcgttcttttgaaatcattgaagaggccatttcaaatggagtttggacatggcttgagttggattgctattcaaattcactctatttagagtttgaaaggcttcaattattgtctaaatccattgtaaatccatttaagcctgttcaagaatctacttataacgattataggggagaattggctattcgatttggcacaaacatttatttggctattctttatgatgatgaggattcttttgactttttagaccttgaagaggatattttaaattccttcttaaattcagatgccaaattaagcgataatgattcctatttctataggcagtttaaaaaggaaataagaggattcaagtttcaggatgaggattattcaagtaatctcactaaaaaatataaaaaagagatagttttagcccagcttcccaataaaaaagatagttatgactttttattgtcatttgaattagacaactttgcaataatcgttaagggagacattatttcatgctttaatgatttcgaatccttaagtgatggcgatataaagagagcttccaacgattggatcttgtattatttggattattggataaaaaaaggaactgaagaggagtatgatgaagatttcctttgtgaaaatatttcatttgactga

SEQ ID NO: 723 - DNA, 543 bp, Methanobrevibacter ruminantium
atgaatcaattaagaccaggatataactttttagccactcatgaactgttttttgatgagattcctcatcaaagggccattcatttggcaaactatgaattcttttggaacatcctagatgagcttgggccatttggaacagaagagtcatatcttgccttttgcgaactatgcgattggctaatagataatcccaatacgcccataatagaatgttttagatggatattgtcctcttgggacattgaacttgaggattttgacgataaggttattgaaaacgagaatatcctaaagataatctatgacttggatttctatgaggatttgatgatgctggactttaccatcataagcacagggttcggtcagcttattcttcaaggaaaaatcgatgctgatgtaaagaacattattcaattgtcccttctgcgtcagatgaactctcatgtactggatgagtatttgggaagtaatatgcagtataaatacgaaagatatttgtatcttcaaaagcttttggacattttggaagaggcttag

SEQ ID NO: 724 - DNA, 1020 bp, Methanobrevibacter ruminantium
atgacttgtagtatattagttggaggagcttggggagatgaaggcaaaggaaaatgcattacttacctttgcgatacagacaaaccggatatagttgctcgtgcaggtgtaggtcctaatgctggacattcagtggaattcaatggagaaaaatatggattaagacttgttccatctggttttgttcaaactgaagcccaattgcttattggcgctggagtattagttgaccctgaagtgcttttccatgaatttgactatttaagcaaatacaatgtgagggagagaactttagtggaccctagatgttcaatcatcgaacctgaacacaaagagagggatcaagcttcagagcacttggctaaaaagataggaagcacaggatccggttgcggacctgccaattcagatagggttttaagaactgctaaaatggctaaggagattccagagcttgcagactatttgactgacgtttctttagcagtcaatgacgctttaaatgatggtcaagacgtattcatagaaggctctcaaggatttgccctttcattatactatggaacctatccttttgttacaagtaaggacaccacagcaagcagctttgcagctgatgttggggtaggccctactaaggtggatgaggtcatcaatgtattcaagtcctatatttcccgtgttggagaaggtcctttcccaactgaaatgagtcaagaggaagctgaaagcaaaggccttgaagagtatggtgtagtaactggaaggagaagaagaatcggttactttgatatggagcttgcaaaagagtcatgcagaataaatggggctactcaaattgctttaacctgtgttgacaagttatatgactgtgcacgtgttagggactatgctgaattgtctcaagaaactaaagacttcatttcagaaatcgagcaagagactggcgttcctgtaactattatttctactggaccagacttgcaagacactattgatttaagaaaagaattattataa

SEQ ID NO: 725 - DNA, 1185 bp, Methanobrevibacter ruminantium
atgagatgtgttggtacagttgtacgcggaataagaacacctattattaaagaaaacgacgatttagcaactatcgttgtagattcattgatggcagcaaaagaaagtgaaggatttgaatttagagacaaggacatcgttgcaataacagaagctgttgtagcaatttccgaaggaaactatgtgactgtggatgacgttgcagaggatgttgcaaagaaattcccatctaaagaaatcggagtgaccaatcctatcctaagcagaaacagattctcaataatcctaaaaggtattgcaagaggaatggataagattacccttttaagctctttccctgcagatgaagtgggaaacggcattttagacgaacgtgctttagatgaaagcgaattcaatttaggaagcgtcatcactgaagaggactacgaaaagaacttcagttcctggattcatccatttaccggaatcaacatggttgatttctatagggaattgattgaaagcgaagactgtgaagttgaatttgtcttttcaaatgacgtaaagaccattcttgactataccaatgacgtcttgacctgtgacatccatacaagaaagaaaaccacaaaaatgcttaaggaaaaaggagcaaatgtatatggattgcatgagattctagttgaacctattggagattcaggttgcaacccagaatacggattgctcggttccaataaggcaacagaagaaagattaaaactattcccaaaaacaggagataaattagtcaatgaagttcaaaagagacttattgaacttaccggcaaacagattgaagttatggtctatggtgacggagcattcaaggatcctgtcggaaagatttgggaattggctgaccctgtggtttcacctgcacatacagcagggcttgtaggctatcctaatgaaatcaaattgaaatatgtttcagacaatcaattcgctgacttgcatggagacgaattgaaggaagcgattaaggaagagataagacaaaaggctgaaaacctaaccggacagatgattaccgaaggaaccactccaagagtattaactgacttgattggttccctttgtgacttaaccagcggttctggagacaaaggtactcctgtcatattcattcaaggatacttcgacaatttagcaaatgactaa

SEQ ID NO: 726 - DNA, 384 bp, Methanobrevibacter ruminantium
atgaaagatattattaatccgaatgtagaaattcctgatgaacaggtagctatggcattttttagaagtgtccgttgggttaatggggtctattgtcctaaatgcaagtcatataatgtcaataacagaggaaaccaaggcagaactcgtcgatatgtatgcaaagattgcggatctaatttcaatgacttttcaggcacaatcttccataaaagcaagataccgcttaatgtaatgctttatattttattcaatttggatgaaaaaaccaccactcaattgtctgaagagttaggctacagcaggcaatgcatctcaagaatatctaaattatttagggataagctattgagcaatcctgagttttttgacattgaagaatga

SEQ ID NO: 727 - DNA, 744 bp, Methanobrevibacter ruminantium
gtggaaattaagaaaaaatttttaccatttatcctaccggcaatacttcttataatctggtaccttattacagatggtttgcatttgattccttattatatcctgccaagtcctttaaatgtatttaatgcggcatggactttaataactaatggaaaactcttcatgcatacctctagcacacttataaaggtattctcaggtatcattttagcatctgtagttgccattccacttggaataatccttggatggtatgagaccttagacagattaagctccttaatcataagtatcctaaggcctattcctcctatctcatggattccattctccattctttggtttggtataggattatcctctgcagtattcgttatctttatcggttgtgttttctcagtacttgtatacacaattgacggtgttaaaagaaccgataatgtattaatcgaagcagctcagactttaggtgcaaacaattgggatatcttgcttaagattgtccttccatccactttgccttatatagtctctggacttaaggtaggtgtgagcatagctttaatgtgtaccgtatctgctgagatgattgcttcaagcagaggtttaggttatatgattctaactgcaagtcaattgttccagcctggaactgtggtagttggtatgatagttattggtataatcggtattttatttgattatggatttagaaaagcgcaagagagaatattctggtaa

SEQ ID NO: 728 - DNA, 762 bp, Methanobrevibacter ruminantium
gtgtttatattggcaattgatataaaaaatgtttctaaatcatttgttacaaaagataaagatttcatggcattgaaaaatattaatctccatgtggatgatggagaattgatctgtctattgggaccttccggctgtggaaagaccaccttgcttcgtatggtgggtggtttggaaaaacctgatgaaggagagatatatgataggggagagcttgtaacaggtccttccaaagacagaggattcattttccagcaatattctttattcccttggctaaatgttttagataatgttatgtttggattgaatttaaataaagatacaagcaaggaagaaaatttggctgctgctgaaagatatcttgaaagggtaggattggctgaatttaaatacagctatccccatgaattgtctggtggtatgaagcaaagggtggctatcattcgttctttattaaatcacactcctgttcttcttatggatgagccattctcagcagttgacatgcttaataggcatagtcttcaagagcaacttataggagtttggaaaagatttaataccacaattctttttgtaacccacgacgttgacgaggcagtctatttggctgataagattgtgattatggataagaatccgggcagaattcaagatgttgttgaagttcctcttgaaaggcctagacaaagggaatcaagagaatttttagacttccaggatgaaatagaaaagctgttaggtgtttgggaaccttag

SEQ ID NO: 729 - DNA, 801 bp, Methanobrevibacter ruminantium
atgataggactttcaatagctggatttgacccttcaggaggagctggaataagcacagatatgaaaacaatggctgcacatggagttcacccctgttcagtaatcaccgcactaactgcgcaaaatcctaaaaaagtgttttctgtgcaagctatagaaacctcatatattaggcagcagatagattccatatttgatgagtatcctatcaaatactcaaagacaggcctattatactcaaaagaaatcatccaacttgtaagtaaaaaggtcgaagaattaaatttacgcatagttgttgacccagtgatggtggcaagttcaggtgggcaacttgcaaagaaggaaatggcaaattcattaaagaaatatctcttgaaaaatgcacttcttgttactccaaatgttaaagaggctgaagagctttcaggaatcagcataaaatcaatagaagatgcaaaggaagctgcatataagattggagaatgttgcaatgtaatgattacaggtggccatcttgatggaaacaatgtcatttacaataaacaaaaggatgagctaagcattttaaagcagaatctaatcaaaacagataatcttcatggcacaggatgcagtctctctgctgcaatatgtgcaaatcttattatattaaatgaaaaggacaaagacagcaaggatgaaaacaatctagagattgcaatagaaagatctaccaaattcatttatgaagcggttaagaagggtaggtatggcacattaaatcctaattttaacagcaatcttgactttttaaaatag

SEQ ID NO: 730 - DNA, 705 bp, Methanobrevibacter ruminantium
atggataagatttatgcaataattcctgtaaatcaatttgcaaatgctaaaacaagattatctccttttctaacacctgaagaaaggagggatcttttaaaagccatgctaaaagacattacagatacattaaagcctattgtagataaggtcgttatcatcagcagagatgaggaagttttagcatatgcagaagaattggagcttactacaattgttgaagaggaatataaaaaatccaaagctgttaactcctctgatgacaaccctttaaataaggccttaaaacaggcaatgaaatggtcaagaaagaaaacccgaaaagtgataatcctgccatctgacattccacttattggaaagaccaatgtaaagctcctaattgaccaggcaaagaattttgattttatcatcgttccttcaaagggaggaggaaccaatactcttatcataaagccattggcaattgacatgaaatttgaaggatttagcttcaataaacatatcgaagaggccaaaagaaaaaaactagttcctattgtacatgattcattctatatggccttggatgtaaacaccacagaggatcttggagaaatcatgcttcatggaaatggaaccgaaaccaaaaaatacttagaatcccttggaatcaaggtagaatcctcccatgaccatgaaaggcttaaagtgactagagattag

SEQ ID NO: 731 - DNA, 1407 bp, Methanobrevibacter ruminantium
gtggaaaattttagtgaatggttccatgagatattagaaaaggcagaaattacagactcaagatatcctattaaaggaatgagcgtatggctcccttatggatttcaaataagaagagcatgcttaaacatctacagagacctgcttgacagcgaacatgatgaagtattgttcccactacttattccagaagaggaacttgcaaaagagggaattcatgtaaagggatttgaagatgaggtctattgggtaacccatggaggtcaaaaggaattgaatgaaaagcttgcaataagacctacaagcgaaactgcaatgtatcctatgttttccctatgggtaagatcacacattgaccttccaatcaagcaataccaagtggtaaacacattcagatatgaaaccaagcatacaaggcctcttataagagtaagggaaattaccacctttgcagaagcccacactgttcactcaagcccagaagaagcggcagaacaggttgaaactggaattgaaatatataaagagctctttgatgaaatgggaattgcatatctcatcagcaagaggcctgtctgggacaagttcccaggtgcagaatacactatggcatttgatacaatcatgcctgatggaaagaccttgcagattggaacagtccacaatttaggccagacctttgcaaagacctttgagataacctttgaaaacaaggaaggaaaccatgaatacgcctaccagacctgctatggaatctcagatagggtaattgcagcagcaattgcagctcacggagatgaaaaagggcttatcctacctccaagaatcgctccaaagcaaataacaatcattccaatcatatttaaggatggaggagaggaagtaatggctaaatgccttgaaatcaagaaatccttagaatcaaaaggaatcagagtccaaatggacacaagagacataaggccaggtaagaaattctttgattgggaattgaaaggaactcctcttagattcgaattaggtccaagagacttaaagaacaatgtagctatccttggcagacgtgacactggtgaaaagatagaaataagcctagaagatgatcttccatcaaaagtagaagacttattaatggaaattgaagaaaatctaaaagcaaaatcctggaaagcacaggaagataaactaatcactttagaaagtcttgacaatgttggagaaattgtagatgaagaaaaagtggttaaattctactggtgcggagaagaggaatgtggtaaggaaatagaagaggaaacagaagttgacattcttggaatcaatgaggaaaacataaaaacagacaagatatgtcctcattgcggaaagcctgcaaagcatgttgcgcttatggctaaaacttactag

SEQ ID NO: 732 - DNA, 1044 bp, Methanobrevibacter ruminantium
atggattctaaaaagattcaaatgccaagagaagtacatataggccctaatgttttagatgaagttggggaaatatgtaaggatttacgtttatttgatgaagctcttgttgtatccggatttcatacatttgatgttgccggtcagcagacagttgacgctttagaaagttctgattttggtgtggatgtcgtaaaggttaaggatgcatctgtagaatcagtggagaaggttagagagaagattgccaatgcatctgttgtattgggagtcggaggaggtaagataattgatgttgcaaagcttgcttccacttatgagcattcctacttcatttcagttccaaccactgcatctcacgacggaatagcctcccctatggcctccattaagaatgacaagggatccatctctaaaaatgcaaattctccaatggctgttgttgcagacactggcataatcaacacttctccttttagattaatcgcttcaggctgtgcagatatcgtttccaattacactgcaatcaaggattggagattggcttataggttgagaaatgaaaagttcagcgaatctgcagctgccctttctgaaatgactgcaaagctcattatcaattcctctgacagcattaaggaaggattggaagaaagcgctagaatagttgtaaagtcattgttcagcagtggaatggcaataagcattgcaggttcaagcagacctgcaagcggttctgaacatctcttcagccatgcattggatagaatcgctaaaaagccagcattgcatggtgagcaatgcggtgtgggaactatcatgatgatgcacttgcatggcggtgattggagagctattcaatctattttaaagacaattggggcacctacaaatgcctccgaattaggattggatgatgatgagataattgatgcattaacaattgcacatacattaaggcctgaaaggtataccattttaggtgataatggattaactagggatgctgccattaagttagctagaaaaactgaggttatttaa

SEQ ID NO: 733 - DNA, 441 bp, Methanobrevibacter ruminantium
atgataactttaattggtaagaaattagcaaaggaaggagaaagctttatattttatgagcccgcagaggaatgttcgacttgtaggtttaaggcttcttgtatagattcccttgaagagggacataagtatacaatcacggaagtccgtgatgtggaacagaagtgtcctattcatgaggatgaaaaggttcaggtggttgttgtggaaaagggagagaccactattttaaccgattccaaaggagtctttgaaggatccagctttgaatttaatagacaaggatgttcaaataaggattgtgactttagggacatgtgtttccctgaagagattggaaaaggagaaaaatgcgtttatattaaggaccttggaaagttcaatgactgtcctcgcggaaactctttgattaaatgtgttgtaaagatatatgacaaataa

SEQ ID NO: 734 - DNA, 669 bp, Methanobrevibacter ruminantium
atgagtcaaatgaaaaaagattgtggttatgctgctgcagaattggtaaaagacggtcaagtattagggcttggaactggttcaacaaccctttattttattgaaaaggtagggatgagagttagagatgaaggaattgaagttatgggaattccaacttcctttcagtcttccttgcttgctcgcaagtggaacattccaataacaagccttgatgagcatgagattgatttggctgttgacggtgcagatgagatagatccggactttaacttaatcaaaggtggaggagctgcacatactatagaaaagatagttgactattctgctaaggaattggtaatcattgcagatgattccaagctcgttaatgttttaggtgccttcccacttcctatagaaattattccagtttccttaaaccctgtaacaaaggctttagaggatatgggaggggaagtaaacattagaatgggccaagctaaggatggtcctgtcataaccgacaacggaaacttcattttggatgtttcttttggagagatagacaatcctatttctatggaaaaagagttaaacacccttcctggagttgttgaaaacggattgtttactgaaatggtagataaggttattattggttctaaagatggtgtaaaatacttataa

SEQ ID NO: 735 - DNA, 1335 bp, Methanobrevibacter ruminantium
atgaaagtagttatagtaggtggaggagctggaggtatatccacagcttccaatcttagaaaattagacgaagaagtagagattgttgtattgactagagataatcaagtgtcttactctccttgtgcaattccttatgtactttccgataggatccattcatttgatgacattgtaatgaggactgttgatgattataaggcaaaaaacattgatgttatgcttgagactgaagtgactggagtcgattcagctaaaaagcaaatcacctattctaaaaatggtgttgttcaaaccatgaactatgataagcttgttcttgcaactggaggaagtccatttgtccctcctatgaaaggggttgatttagatggcgtatttaagataagaactcttgatgacggaaaacaagtaaaggaatgggctgaaaactgtaaaagcgctttagtaactggcgcaggtcttattggtattgagatagcatatgcatttaaaaagatgggcttgaaggtaaccttatgtgaaatgttgccacagatcgttccacgttcacttgatcctgatatggctaaaatccttactgactatttgattgaagagggaattgatgtggttcttggccagcctattacagagcttaaaggggaagatggcaaagtcaaaaaggctgtctttgaagacggaactgaagcagatgcagatatggttattttggctacaggtgttagagcagagcttaatttagcaaaaatggctggatgtgactgtggaagatgggccatacttgtaaatgataggatggctaccaccgtacctgatgtctatgcagttggagactgtgtagagtcttacagtgcaattctcagatcaaacactgtttctcagttaggaaccactgcagttcgtcaagctaagaccttggctcagactcttgccggcaaacgttcaagattcaatcctgtgctcaattccatggtatctaaagtaggcaaattggagttcggtgcagtaggccttaccagaagctttgcacagcagaacagcataaaggcagttgtaggaaaggttgaggcattgacaagggcaaggtattatccaaatgcaaagcctatgaatgtaaaggtcatctgtgatgcagatggtacaataataggttgccagataattgcagaggaaagggtagctgagagaattgataccatgacattggcaatcactcaagagcttacctgctttgaactcagtaatatggagtttgcttatgcacctcctgtttccatggtaactgatccattggtaattgctgtagaggaagtcagtaaaaagtttaattaa

SEQ ID NO: 736 - DNA, 2076 bp, Methanobrevibacter ruminantium
ttgacaaaaatatttatttcatgtgcccttccatatgcaaacggtccatgtcatttaggtcacttacgttcaacatatattccagcggatatctatgcaagatataaccgtatggctggaaatgatgtcttgatggtatgtgcaaccgacgagcatggaactccaattgcagttaaagcagatgctgaaggcaagaaacctattgaagttgcaaaacgctatcatgacatgatagcccgtgacattgaaagctgtgacatcagccttgacaattttgcaagaacaagcgacgagttgcattataagatctcacaagacttcttcctatacctttatgaaaagggattgatctatgaggaagccattcaacagctttattgtgaaaactgtgaaaagttcttgccagataggtatgttgaaggaatctgtcctgtctgtggggctgaagcaagaggagaccactgcgaatcctgcggaagagctttggaaccgactgagcttcttgagccacactgccttacctgtggaaatactccagtaataagggacagcacacaatatttctttaagttaagccatttccagaatcaattggaagagtatattacaaccaacgagtatcttcctccaaatgtcagaaactatgctcagaactggcttaaggaaggccttgaagattggataatgacccgtgatatgaaatggggtattccagttcctcttgaaggcgctaaaggaaaggtcatctatgtatggggagaggctttcatcggatatatttcctctgcagctgcatggagcagaagaactggaattccttgggaagactattgggatggacatgttgttcatttcattggaaaggacattatctatcaccattcactcttttggcctgctatgcttatgggacatgactgcaagttacctgatgacatttttgcaggtgaattcttatcccttgaaggcagaaagatgtctaccagtaagaattgggttgtctgggtatctgattttgtaaaagacttcgaatcagacttgcttagattctatctaactattagcgctcctttaaataaagacactgatttctcatgggatgactttggaagaagggtaaatgatgaattggcagatataattggaaacttcttgcataggacttttacattcactcataagttctttgacggtaaggtccctgaatatgcaaatccaagtgaagaggacttggaatttgaagctgagattaaggaattacctgctaaagtgggagagcttatctcaagcatgaagtttagggaaggtttggttgagattctcaagactgccaaatctgccaataagtactttaatgatcaagagccatggaaagctgtaaaagaaaacccacaaaaggcttctaactgtttatatttatccaatcagttctgtaaatccttggcaattcttttaaaaccttatattccaaataaggcagatgcaatctgtgatataattaatatttctaaggaaaacgtttgggatgatgcaagcatattcctagagaatggtcatgagataaataaggcaaagccactctttaagaagattgaagataaggttattgaagctcaaaaggaaaagttatatgctaacctagaggattcagaagaaactaaagatgataaagacaataaaaaagataaaaaagataaatctaataagaataaatcaaataaagacaaaaaagataaatctaaatcaaatgatggtgaaaaaatggatttaattagcattgatgaatttgcaaaagtggaaattagaataggaaagattgtagagattgaaaaaatagaaaaatcaaataaattattaaagacccaaattgacattggagataagaccattcaagttattgcaggtcttggaaaaagatatgctcctgaagacttattaggcaaaaaggtacctgtagtaaccaatcttaaaccagctaaattgatgggtgaattatctgaaggaatgattatggctactgaaagtgcagctattttaactcctgacgattgtgaaattggcgaattacttatgtaa

SEQ ID NO: 737 - DNA, 1578 bp, Methanobrevibacter ruminantium
atggatgaatcattaatgataacagagtctgagaaatttttaaatcaaatagagagggagaagttagatctaaccaatcttaagtctgactttagtgacttggagtcatatttagaggtttacgaacttctaaaaagcaactttgacaagctccaggacatgaaggaaagtatggatgagagaggttatactgctccattcagatctctcaatcgttatggttctcgtgtaagtgaggatgttgattatgaggaactaggtgaattgaaccgccataacactatttttagaaacaatgcctctgctaaaaagaacagctttgatagggtaaaatatgccatagcagctcataggattgccttaggcaatcttgaggaatatgccaaaatcagatgcaaggactgtcaaaagtcatataaggttagcacattccttgaaaactctaagacctgcaaatgcggaagcactgattttgagcttaaggtaaaccactctggaatccatagattggaaatcattccttatcttccattatccggcaattatatggttcttctctccagcttatccggttggggaagggattcattcagaagaatcctaaacatattgcagcagaaaagaaaaggtgttgtaaagactgtaactcctataatccgcataaaggaaaatggcagaaccattactaaaagggtaaaccttgatagtgaatttgcagattgctatgaagaggaacttagaagaatatatggtaagggagttagaatagaaaggcttgaattccatagtacaaagccaacaatagttaatgataagtatacccgtaccaatctggccttggcttatgtcaagcatgctgaagacattgtttcaagacatgaggaagagatttttgaggaaaacatcaaggacttgaataatcttaagacctatgatgagcttatctattcagtcaatcttgaaaagcctgaatatatggatgaggatgacttagactcttggagagagcaaaagattcaggacaatcttttggaattaggccttatggacaaatatgggcacttagataagcaattaaagaaagacctaaaggaaagggagagaataaagtctaagatttttgcagacattgcaccaacccttattctttgggacatttccaaatattatctctgcacatcctatgaccgccgtaaaaggtatggatctccattccctttcattagaaacgatttagacagacagcagcgtaaggtatttgcaaatccccatgcaaatgtagtaggtctccttagggaaaaggagaaaaagcatatgatagcaatagatgagatggatttattgctgtataaaaagtttaaattggaaaagagaattaagaacactaattttaagctgaattatgcagcactaggacccgctattgtatttgcaaattctgattacaacattaaggaagtttctagagcatataaagttggagagaaaagcgtaaaaagagagattatgaatattaagagctttagaaagccaaacagtaaaaaatcaagagagtttttaggtaagattaaggggtag

SEQ ID NO: 738 - DNA, 708 bp, Methanobrevibacter ruminantium
atgagttatgattttgatgactttgatgaggatttcgatgatgatgagtttgatgaatctgaggattatgatgactttgatgaagatttcgaagatgattttgaggacgattttgaagatgactttgatgactttgacttcgatgatgactttgacaatctagactcaaaatcaaaggaagatattgatatatttgatgaaaaaccacttgaaactgattcaggttatgaaagaaccgctgtagaggttcatgtttcaagtcctttaagttcaagaaagcttgttgaacttatggacacttatccttccttaaagagaattacttgtcctaaaagcatttatgatagaatgtcttcaaaatatattaaaattttaaaggaagatttgaacatcactgttgaaatcaaatataattggggaaagaaaaaatacacaaaaaaggaagtcgattctgtaattgaattgttcaatgagggaaaacgttcaggtgaaattgcttcacaattggatatgcctatttccaatgttaattatatcaaatccaaatactctgataggatcaatgtaaagcattataaaaagaaatatgatgatgaatgcagattaaggataaaatccatgaaggaagatggcttaaagccaaaagagatttctcaaaatctgggcattccagttagatctgtttattatattttgaataagaaatga

SEQ ID NO: 739 - DNA, 14790 bp, Methanobrevibacter ruminantium
atgaataataagacattatttatcattggtttattcatatgtcttttatttaccatacctatggtatcagctgcagatgctgattccaatttaattgataattcagtaattggaacaaatatcaattcacaagcaattacaacatctgatgcaagtattgatcacagttcaaatgcaaatgcaatcaatactaatattaattctgatgatattgtttctaataacaataacaataattccataattgatattaatgattccgatattgaatctcaaaaggatggttcaagtaagaatattatcaagtctaccaataaaaatacaaatgattccaataatgaaactgaagataatattctagtaactgatatcaatttaggtaaaaataataaaaattcaaatgataaaaatattttaagtgcaaatgcactaactgctgatggaactggtacaactttcggtgacttgcaatatatcattgaccaagatacaaccggtaccattactttagataaaaattataaattcgaatctggcactgatgatgcttatctcgatggtataactataaataaggccattactataaatggtggaaatcatactatcgatggagaccacttggctagaatatttaatattaatactggatctgcttccgatattgttgttttaaatagcatccatttcattaatggtatggcagatggcagtggcgataatgccaatggtggtgctatttatattggttctccaactaccttaaattatattactgcaatcaattgtacagctactggtaatggtggtgccatatatgcacatgcagatggtaccaatattgcagctaattacctatacctatataacaacactgcagtgaatggtggtgcattatatgtttatggtaatgattatacagtcacagtagtggatgcccgatacaattctgcaagtggaaatggtggtgcaatgtatgcatacggaaacagtttccaccttaacaaggttaacttcattaacaatacggcatacggtgaagattcagaaggtggtgcaatattctttgcccataattctgatgatagtattgttaacaattcctactttgcaaacaactctgcaaatagagatggtggtgcaatagtttgggatcaaggtgcacacttcggtgaactttataattccaagttctacaacaatactgctaaccatagttcaggtgctgttcgttggagtggtgaaaatggtaccattgacaattgtagttttattgacaacaaggcttatggaaccaatttagaacctggtgattttgatcaaggcggtgaccagattcttggtggtaatggtggtgctattacttggttaggttctgtgggtattattaggaattcaaacttcactgataactatgcagaggcaaatggtggaggtatgttccttatagctttcgatattaatgaccctaattccatatgtaacgatacccatattatcaactgtaacttcattagtaatgatgctggacttaatggtggtgcattagattgggacggtaaggcttacaatggttctgtatctggttccaaattttataacaataccgctgcacgtagtggaggtgctatcttctggaaaggtaatggaggtatcataacacaatctgactttaagtataactctgcaaatggtactcatttagttcagcctgaaggattccttacccctggtggtaatggtggtgcggtaatcatcacaggtagtgatgttaatattacatattccaatttcactaacaatagtgctagagctcgtggtggagcggtttacttgcagctcaataacaataccatggttttgaattcctcatttgaaaataatagtgcaggtactaatggtggagcacttgacttttatactggtgctgaaaatggtaaggtaattaactccacatttttgaataatactgctaatcgtagtggtggtggtatatactggaatggtgaaaaaggtgtaattaatggtagtattttctatgataataaggctttaaatcaaggtacatacgtaaatggaagccaaattaccgatggtggtgacggtggtgctatcatttggacaggttcacatggtactttagaaaattcaacctttaaaaacaacaatgctactaaccgtggtggagctattttccttgagaaacataatctggaggaccctaatgattattgtaaaaatattacagttttgaattgtacatttgaaaagaattctgcaggtaccaatggtggtgctattgattggtttgaaggtgcagaaaatggaagaattattaattcaacattcactgaaaactatgcacgtagatctggtggtgctgtattctggaatggtgttaatggtactatatccaattcaacatttacattaaacgaagtaggtcttgaaggtgcagatactggaactggtgagacaattccaactggagatgatgatggtggagctatcaaatggacaggtgcaaatggtttaattgaaaattccatatttagagaaaataaggctttagaaggtcgtggtggagcaatttatcttgaaaacaatgagaatggtactgttaacaattgtactttcgaattgaatagtgcatttacaaatggtggtgctatagactggcacgaaggtgcaaagaatggtcagcttatcaattccaccttaacaaacaacactgctggacgtagtggtggtgcagtatattggaatggacacaatggtacaatcaatggaactaattttacagataacaaggcattaggaactcatcacactgaaggtcagactgaaggtggagatggtggtgcaatcatttggacaggttcctatggtactattgagctttctaacttccataataacagtgcacgttggagaggtggagcaatcttccttcagaaaaacgtgcatgaaggggaagagcattgttataatacaaccgttaagaattcctactttgaagagaactttgcaggcagtaacggtggtgctatcgattggtctgcaggtgctatgtatggtaaattgattaattcaacattcataaacaacactgcggaacgtagtgcaggtgctgtttactggaatggtctatatggtgaaatattaaattccacatttgaaaacaatactgctataggtaacttcactcatgacgttcgtcctgaagtggatgaaacctatactgttattggaggtaacggtggtgctgttgtaattactggaagccatgcaaaaatcgatggatccaactttacattcaacactgcaacaagacttggtggtgcaatcttcttccacgacaatacaaacggtactataaacaattccatctttactaataacactgcaggtctcaatggtggagcccttgacttctatgaaggtgcgagagatggtcaggtacttaattccacctttatcaataacactgcaaaggatggaaaaggtggtgcaatcaactggataggtacaaatggtactgtagatggctgtgactttataaacaacactgcaaatggatctgatgatgagtctggtgcaggtggtgcaataaatgtagatggtattaacacctatattgcaaattcaacatttacaaacaacagctgttgggacgatggtggtgctatctgttggaatggtgacttaggtaaaatctataatattacctgttttaacaatagcgctataggaaaagaccacaaatcttcaggcggtaccataagtatttatggttcaaacctcacaatggacaaggttaacataacattaggtacagtgtcctcagtaaatgatgacaaggtatccaaaggtggaggtatatttgttacaggtaattatgtaaacattaccaatgccgaatttacaaactgttctgcattggctcctattgacgattcctctgcaggagcattgtacattatcggtaacaataccaatgtagtgaatgcaacattcaaaaacaacactgcttatgaagacggtggtgcagtatatattttaggtgaaaattgtaccttgaacaatacattattcctcaataacgttgcccacaacgatggtggagcaatccaatgggatggtaacaatggtagaatctacaatctcactgctgatggaaactatgcagacagtgcaagtggttcctctaaaggaggtaccctcactattgaaggtaataatacagttatacaaaaaatcaatatttccaattcctatgttgatagcgaccatgatttaggagcaggtaagtctacccaaggtggagctatattcctaactggtaatgactgtaacattacagatgctgtatttgacaattgttctgtaaaatatgttgcagatgaatcatctggtggagcaatgtacattatcggtaacaataccaatgtagtcaatgctaacttcacaaataactctgctgttgaagacggtggtgcaatatatattgatggtgactattgtaccttgaacaatactgttttcatcaataacactgctcataatgacggtggtgctgttgactgggaaggtaattatggtcatgtttacaatttaactgctattgataaccatgcagatagtgcacatggtagttctaaaggtggtactatcctgcttgaaggtggtcattgtacatttgaccagcttaacatttcaaacagttatgtaagcggtgaaacctacacaggtacaaaacctgttcaaggtggaggtatagctatctccggtaatgactgtaacatttccaattccgtatttgacaattgttctgtaagatatgaaggaaccaattcctctggtggtgcattatacatttggggtaacgatactcatatagcgaactgtaatttcacaaacaactctgttccttccgatggtggtgcaatctatgttggaggttctgacgtaactgtagtcgattcaaatttcatcgataacaatgcttcccaatctggtggtgcaatcttcttgactgacaataagaattcacaaattaatggttcaaccttcaagaacaattctgcgaaagtgaatggtggagctattgacttctatgcaggtgcagaagacggtctagtatctgcttgtgaatttgttaacaacactgctggtgcttccggtggttccatttactgggaaggtaccagaggtgtaatcgaatactctagctttgatggaagcagagctttaggtaatcaaacaagtgatgcaaacaatggtagaggaggatctatcatttggctcggagaccacggtacaattcgtggttgtgactttaatgacagtcaatccgctaaagaaggtgctacattatatgttgtaggtgaccttattaaggttcaacaatctaactttaccaattctcaaaccaatactagtggtggtatttacatccaaggttcagaaggtactataagtaattgtcatatggaaaacactactgctaaggaaagtggtggagcactttatgtaaaaggtaattatatctatttattagattctgatataaataatgctacttccgttaataatggttctgcaatttatattactggtaacactacccatatagagaattcaaatgtaaccaattgtagttcaagttctggaaatggaaccataatgattgcaggttataagacagtaatggatggtgtaaatgtagataacaacaaagctgtttctgctggtgcagttctaattagtggaagtcaaaccaaaatatctaactctaacttcacccataacaatgcatccaaggatgcagggggtataatgattaatggtactgacaataccattacaacttcaaatatctctgataactatgctaaagaaaatggtggaggtatttactatacaggtgatagaaatacagtaagttattctaatattgaccataacagtgctaataatggtgcaaatgtatatatggctataaaagctaaagattgtaagcttataggttccaatattacaaatgccaaggctagaaactttggtggtggagtagaatggtgtgaaaattctgaaaatggattgattcaagattgttacttctataactgtacttcaactgcccacggaggtgctattcactggtacccaggtaaatatggtgttatagataattgtacttttgttgaatgtcatgtagctggtaccaaaaacggtggtgcaatatatgcaggtgcaaacactaatgttaaaccagttggaacagttttatcaaacagtacattcattaactgtacaacaggtaccagaggtgctgtaaactggaattcacaaggtggtttgatttataataacacctttattaattgtggtgtagctaacacatctgttactacatcttggggtggtgcccaagctttacaaattgaaaaaggtaacaacactcaaattattgcttgtgaattttataactgttccggtatcggtggaggaggagcattaagagtacaaggtgatggccatagtggttataatattacaattgcgaactgtacatttgacaattgtaataataccggtttagctggtggtgtatatttaagtgatatggctagaaatataacttttgaaaacaatacctttaccaataacagtgctcctaatgtaggtgcattctttatggaccctaaaactgtcattgtttcatttgtaaataacacatttattaataactctgctactggcagttctggttatgcgggtgccgctcaattaactggaaatcttgaagtaatcaattctacattcatagaaaattcagctgttagtaaagcaggtgctattaatgctgttgaagattatgatggaaataacaatttagctattattggatccactttccaatacaataaagctaaagaaggttctgccatcaatgctattaatttggatatgactgacacagttttacttgaaaaccaagcagcatttgataaatggacaaaccaaagaaattcaagagctaatggtcatgtatctataaatggtacttttgtaggtaaagataactacttgaatggtattaaggctaatggagctactttcgataatgtaacatattgtggtgtaaatggtggaggtttatatgaagatactgtcaccaataccgatgatgtaacttcagctaaatccacaaatgaggttcatcagttaatagtcttagagatttatgattataataataatttagtggatactaaaaccacatttactgatgaaaatggtaaattcaatttcgaatttgacatggaaaatcctcaagattactcatacaaggttattcaccctgaagataattattacactggtgcagaatattctattggaaaagctatatctaatataacaatcaaatctcagaatattactcacccagaagatgagaatataacatttaaggtaactggaggaagtggaacacctactggtaatattactgtatttatcaatgatactgaaggtaatgtgatatttaatgatacaattattcttaacagtaccggtgaagcaaaattattcttcccaagattaaatgcaagcgaatattacatagaagccaagtataatggtgataacaactacttgcctgacaatgacacttccatattccatgtaaatatggcagaatcattcatcaaaattggaattgaaaactacacttataatgaaactagaaatatcacaatcacagtgccatatatagaatcaggtaggatatccgttatcgtaactaatgaaaacttcactcaattatacacagtctatgttaatgaaggaactgaagaagtgcaaattcaacttcctatattggatgcaggtgtttatgatattgaagcaatattccatggaaacaacaattactatccaagccaaaatacaactaatttcactgtatttaaagctgcttcaataattaacattacagcagacaatgtaagtggtggagtgagagaaactgttgatattcatatcgatcctgaagttgcaactcaaaatataaatcttacagtttatgatgctcaaggtaatattgttgatcaatattatgaccttggtttacacgattccagaattactcaaattcttacattgttacctaaaggtaaatacaatgttactgtaacttatcctggagataagaatcataatgcatcttcaaattcaacaatcttctatgtaactaatgatttattcccaattgaaatcaatgcaactaatatgacctatggtgatgatcaaatcatcaacattacagttcctgccaatgcagacccagataaattatacattaacataaattgtagtgattggcctggaaataaaactgtaactgaattaggattgactattgatgaaaatggtttaatacaaatagatactactaacactaatttatttgcaaataaaatagatgcaggtaattacactattaatgtttattatcctggtgatgatgacttcttatccaacagtagtagtgttgactttgaagtagcaaaagctattcctgaaatgaatgttactccaactaacattacatatggaaatcttgaggatattttagtcgaaattgcccaaaatggtaacgttaccctatatgtaactagtgaaaatgacccaactttaaacattactaagattgaagttgaaattattgaaggtaaagtctactggaatgtaaatgatacatacttgccagcaggcgaatatatggttgaggcaatattcaatggaaacagaaattatgaatctgtaaacaaaacagaaaaattcaatgttaccaaagccattcctaacattgtcattgatgtcgatgatatacatgttggtgacagtgaatacattaatgttactgtcgaaggtgtcgaacatggtaccaccccacaaggtaacattaagatcattgtcagaacaatcgatcaaattgttgaacttaatgccactggccaatacaacttaacattagatgatgaagttcaaggcaatggcataagtgtaaccgtaatttattatggtgatgataattataattacacagaaaaatctgtatactatgatgtaactaaaaaagaaacttccattaatgtaacaggagctactcctatttcatatggaactatagaaaatcttctagctgaagtaaatgaaactggcgttacaggaaccattaccatttatgtaaacagtactgtagatggatttatcaatcaaactcatgtagctacaatcactgttgatgatgcaggtaaagctacttgggatatagatcaaatcatattacctgtcggttcatatgatgttactgcagtttactctggtgatgacaaatttgaaggtagtgtatctactgtcaaagtaatcgttgtagaaaaggctactgattatgacatcagtgtagaagccaataacactgtttatggaactgatcaagtcatcattgtaactgttcctgataatgcaaatggtactgtaaccataaccatagaaggtactgaaatcagcttaacctcacaagtggaaaacggtaaagcagtatttactattccaaatgacctagttgacttcttagaagtacatgataattataatgtaactgcaacctataatggagatgataaatacgcagcaggagtcaaagcaagtgacttattcaatgtaaccaaagctgaatctcacattaaagttgttgcagaagatattgattacactcaaattgaaaacattactgtaatccttccagatttcaatgctaccggtaaaatagtgattacaattgttaataaatctgacaccactcaaatagtcagaactttagaagttgaccccttcactaatactactggtgttatctatccatttgaaggattattagtaggtaattacacagttaaagtcgaatacagtggagaccataactataataacagtgaaaacactactgactttgaagtacgtaaggtagatcctaccctaactgaaaactcaccggatatcatttacggtgcagatgaaaacataactgttaccatcaccggtgctacaggaggtgtggatcctaccggaaccatacaagttattgttgatggtgtaaccattgataccattactattggtgataaagacttagaattcattgtaaccaaacctggagttgatccacaacacaatataactgttatttacagtggagacagcaactataacccagtaaccattaccggtgaatttgctgtaactcaaaataacactattgaaatggaagaagtcagtcctaacattgtttatggtaataatgaaataattacaatcactcttcctaatgatgcaacaggtactgtctatcttgtagtcaatggaacttattacactcctattggtattgatgaaaaccatcaagctgtatttaccattgtagctccaatcgtaggagaatacaacttcacagcttactacagtggagatgaaaactacacagctaataatataagtggtgcattcaatgtaaccaaagcggatgtaagtttatcagaatctcacactgccacaattacttatggtgctaatgatacaattactgtaacaattactggtgttgaaggtcctgaaggagtattagctccaactggaaccattaaggtattggttgatggagaagaaattggcaatgtcaccattggtgatgatttagtatttaactccattaggccatttgtagacccacaacacaacataacaattatttacagtggagataataactataattccaaagtcatagacaataccgtattggatacccttgtattcgaagttattaaaaacaatactcttgaaatcagtgaagattctccagatattttctatactgaaaatgaaaccataactgtaaccattgctggtgatgcaacaggtaccattactgtaacagttggtggagaacaagtaggagaagtagtcactattactgaaataacagaagatgacaaagtattcaccttcaacattacaaaacctgaaggtggagtatatgatgacttaaccgttgtatacagtggagattccaattatgattccgctaccatcaatggtgaattcactgtaagtcctattgatcctaatatcactgaagacagtcctgatattgtttacacaaataatgaagttattacaataactgttcctgaaggtgctaccggtaatctaactgttactgtcaaaaacagcaaaggtgatacagtagagaccaaaaaattggttataggtactgatgatttggttgtaactattgaaaaacctgctgtagataactacactttcactgttgattacactggctgtactaattatactgaaaaaaccattacaggtgaatttaaagtaacaaaagcatcaaatgagattacagtcgtatctaccaatataacctatggacaaactgaaacaataaccgtaacagttccagaaggtgcaacaggtaatgtaacaattaccgttggtacatacactgatatgttagaaattccagaaggcagcactgaagtagtattcactattccaaaaacagctgcagatgaattgttaagtgtaagtgataactatattgtattcgctaactactccggtgacagcaattatgaatccgtggttgcaaatgctcctttccatgtagatcctgctaacactacactcactatagaagttgctgatattacttatggtgaagatgaaataatcaatgtaaccgttaatggagtaactggtggagatattccaactggatttgtaacaatcaaactcaatggtacagacattgaattaaccaaacctgtagatagtgaaggaaaagtacaattcaacgtatcaggattagttgtaggagaatacactgtaaatgctacatttgtatcaagttcaatcaattataatgatagcaataacactgctaagttcaatgtaactaaagcagatgttaaagaagctaatatgaacattacagctattaacatcacttacggtgatgatgaaaccataactgtaatccttaatgaaactaacataaccggaaacgttaccattacaatcaatggtactgaaatcgaaaccaaagaattagtggatggtaaggttgtattcaccgttcctgatttagaggtaaacggatacaatgtagtggctaactactccggtgatcataattataatgcaatacctattggagctaatttcaacacagactttaaagttgataaggctaatgtaactgttgttgttactccagtagatataatttacaaagaaacagaagaaattaacgttactgttactggtgttttcattaacgataatgttaacgacaatttaaccggtaaagtaaccatatacatagatggtgttgaaaatcaaactaaggatattagtgctgttgatgaatacggtatcttacacttcagtgtagaaggattggctgtaggtactcataatgttactgcagtttatcatgatgatagaaactacaatgataacaatgcaactgaagactttgaagtaatcaatgctcttccagaagatatgaaagtaattccacaaaacatcacttaccatatccaaacagaaaccattactgttgatttaggagaagtattaaacggaactgtccaattgtacataaacgacacattagtcgctacatttgaggtaatagaccaaagaacagtaagctacaccaataatagtttagctgtaggaaactacaccgctaaggcagttttcactgcaaatggtgatttcgttaacgctagtgcaaacttcactgtatctaaagcccctgtaactgttgatgtagtggcagaggacagtgtttatggtgaaactcaaaccattaccgtaaatgttgataatactgttccagataaatacaacctaacaggtaatgtaagcattacaattaatggtgtggattatggcaataagactgttgatgctaacggacaagcagtatttgaaataactggattggaagctaatgataactatcaagtaatcgctacatattacaacgatcctaactatctagacaatactggtcaagatacctttaaagtaagcaaagctgatgtaaaagatgtaaataaaaacattacagctattaacattacttatggtgaagatgagaccattacagtaaccttaaatgaagataacattactggaaagattaccattacaatcaatggcactgaaattgaaactaaggaattagaagatggtaaagttgtctttacagtaaaagacttagaagtgaatggatacaatgttgtagctaattactctggtgatactaactataatgctttcacaatagctgataacctaaatactgactttactgtaggaaaagctaattcaactgttgaagttgaagctattccaagcattgtttatggcaacaatgaaaccattactgtaagtgttccaattagaaaccacacaggtacaattacccttacaataaatggcagtgactatgtatttgtaaaacatctaactgctgaagatggagatacaattgtactaactaatgtaagcggtcttgctgttggaaattacaatgtaactgtaaaatatagtgatgatagaaactacaacgatagtgaagcttctgcattattcgaagtaactaaagcaactccaagtcaaattactgttgaagctcaaaatatcacttacactgaagatgaaataattctagttaccgttgctgatgaaaacgctacaggcagtgtgaccattacaattgatttaggagattccacttacacaaacactaccaatctggatgaaaatggacaagctaaattcaatgtaactggtcttgtagtaaaccactacacagttgtagccaattactctggagatgcaaattacactggtcaaactgcatctgctccatttagagtggataaggctgcttcaaatgtaaccatagatgtggctaacattacttatggtgaaatagaatatgcaaatataactatacctaactataacgcttcaggtagagtaattatcaaagtggatgataaagcttatgatattttaccaatcaacaacaatactcctgtaaaacttgaattagatggtttagctgttggaactcacactattgatgtagaatacttcgatgatgataattacaataaatctgtagcacatgtagaatttaatgtaactaaagccattatcccagttgatcctgctaatgcctcttcattaatagttctaccaactaatattacttatcttaacaatgaaaccattgttgtaagcgttggagcaaacaatgctacaggtaaggtaactataactatcaaagataaggatggcaatcctgttgatatcgatccatctgttgtaacaagcaaaaacatcacagaagaaggttcacaatctgtaactttcactgttccaggtcttgcagtaggaaattacactgtagaagttgattatacagatgatgcaaactatgaaaacgctcaaaccagcgctaaatttattgttgacccagctaattcaactgtaactgttgaagcggttaatatcacttatcttgataatgagactatcactgtcactgttcctatcactaatgctagcggtacagttgtaattaagataaatggcactcaaaaagacgaaagaactgtaagctga

SEQ ID NO: 740 - DNA, 8160 bp, Methanobrevibacter ruminantium
gtggaaggattagctgttggcgaatataatgtgactgtagaatacagcaatgaccctaactacaacaacagcaatgcatctaccttattccatgtggataaggctaatattcctgatgttccaaatactgaaggtcttgttgtaattccaacaaatatcacatatcttgaagatgaatccattacagttactttagatgttcctaatgcaactggcaaagtcactatcaacattaatggaaccgacattgaaactaaggagattggcggtggcactgtaacattcactgtttcaggccttgcagttggcgagtataatgtaactgccaaatacactgatgatccaaattacaatgatgtcaatgcttctgcattgtttaatgttagtccagctgcttccaatgtgactgtagttcctacaaatatcacatatcttgaaaatgagaccattacaattagcgttaacgtaactaatgctacaggtactcttgtagtcaagataaacggcacagaagtgaacacaactacatttacaggtgaagataagccaactattgtagtaactgttccagaccttgcagtaggcgaatacaatgtaactgtggaatacatagatgatccaaattacaacaatagcgatgcatctgccttattccatgtagataaggctaatattcctgatgtcaacccagatacaggcatcgttgttgttcctacaaatataacatacaatgatgatgaaactattaccgtaactgttaatgtaagcaatgctaccggtaaggttaccattaagattaacgacactgatatcgtattaagcaagaacattactgaagacggctcacagactgtaacattcaatgttccaggccttgttgtaggcgactataacgtaactgcagaatacacagatgacgctaactataatgatgtcaatgcttctgcattgttcaaggttgaaccagctgcttccaatgtgactgttgtgccagtaaacattacttatggtgaaaatgagactatcacagtcagcgttgatatcaataacgctacaggtaatgtaaccattaagattaacggcactgctgttgaattgactaagaacattactgaagaaggttcacagactgttactttcaatgttccaggtcttgcagtgggcgaatataatgtaactgctgtttaccatgatgatgttaactataatgaaagcaatgctagtgcattgttcaatgtaaagaaatcagctccagtcaatctgactgtaactgctactaatgtgacttatggcgaaaacgtaaccgttaccgtcactgttccagatgacgctactggcaatgtaaccattactatcggagattacacagacaagaaggaaatcactcctggatcaaacactgtcgaattcacagtaccaaatcttgaagtgaataactatgttgtctatgctaactactctggtgacagcaactatgaaagcggcatcgtaaatgctccattccatgttgataaagctaattcaaccgtaatagttgaagcaactaacataacctatggagaagatgagacaatcactgtaactgtccctaacaataatgctactggatgggtaactgtcagcgtaaacggtagtgaaatcggctctaaaaagattggcacagatggaaaagcaacattcacagtcaaagacttagaagcaggcgaatatgaagtaaccgtaacatatgatggagatagaaactacaatggaaacaacaaccttacaagattcacagtagataaggctaacattactgaagataatataactgtagttccaacaaatatcacatatcttgataatgaaacaatcgctgtaactatcggcgtaaacaacgctacaggcatagtaaccatcaagataaacggaactaatatcgaattaagcaagaatattactgaagatggttcacagactgtaacattcaatgttccaggccttgttgtaggcgactataatgtaactgcagaatacacagctgatcataactataatgacgtcaacgcttctgcattgttcaaggttgaaccagcctcatcaaatgtgactgtcgaagcggtaaatatcacttatcttgataatgagactatcactgtcactgttccaatcactaatgcaagcggtacagttgtaattaagataaatggaactcaaaaagacgaaagaaccgtaagcggagacaatccaacctacaatattacagtagggggattagctgttggcgaatataatgtgactgtagaatacagcaacgaccctaactacaacagcagcaatgcaagtaccttattccatgtagataaggctaatattcctgatgtcaacccagatacaggcatagttgttgttccaacaaatatcacatataatgatgatgaaactatcactgtaaccgttgatgttcctaatgctactggaaatgtaactatcagaatcaacggaactgatgttgaattgactaagaacattactgaagatggctcacaatctgtaacattcaatgttcctggccttgttgtaggtgactataatgttactgtagagtacacagatgatgctaactataatgacgtcaatgcttctgcattgttcaaggttgaaccagctgcttccaatgtgactgtagttcctacaaatatcacatatcttgataatgagaccattacaattagcgttaacgtaactaatgctacaggtactgttgtagtcaagataaatggcacagaagtgaacacaactacatttacaggtgaagacaagccaactattgtagtaactgttccagaccttgcagtaggcgaatataatgtaactgtggaatacactgatgatcctaattacaacaatagcgatgcatctgccttattccatgtggataaggctaatattcctgatgtcaacccagatacaggcatcgttgttgttccaacaaatatcacatacaatgaagatgaaactatcactgtaaccgttgatgttcctaatgctacaggtaatgtaaccattaagattaacggaactgatgttgaattgactaagaacattactgaagatggctcacaatctgtaacattcaatgttccaggccttgttgtaggtgactataatgttactgtagagtacacagatgacgctaactataatgacgtcaacgcttctgcattgttcaaggttgaaccagctgcttccaatgtggctgtagttcctacaaatatcacatatcttgataatgaaactatcactgtaaccgttgatgttcctaatgctactggtatggttaccattaagattaacggcactggcgttgaattgactaagaacattactgaagatggctcacagactgtcactttcaatgttccaggccttacagccggcgaatataatgtaactgcggtttaccatgatgatgttaactataatgaaagcaatgccagcgcattgttcaatgtaaagaaatcagctccagtcaatctgactgtaactgctactaatgtgacttatggagataacgtaaccgttaccgccactgttccaaatgacgctacaggcaatgtaacaattacaatcggagattacacagagaagaaggaaatcactcctggatcaaacactgtcgaattcacagtacctgaccttgaagtgaataactatgttgtctatgctaactattctagtgacagcaactatgaaagcggcattgtaaatgctccattccatgtagataaagcaccttcacatgttgaggtagatggaatagacattaattacactgatttggaaaccattacagttactgtaagcgataataatgccactggatttgtaaccattacaatcaacggcactgatattgaattaactaaagaagtttctgcaggtcaagctgtatttgatgtaaaagacttggttgttggagaatacaatgtaactgctgtatatcacagcgatagaaactacttgaacagcactgcttccgatacattcaaagtagataagtcagatgtcaagaacatgaccataagtcctgtaaacattacttatggtgaaaacgaaacaattactgtaagaatcactgataataatatcacaggcaatataaccatttctgtaaatggcactgaatatggtcctgttgaacttgacaatggtgttgcagtctttaatgttcctggattgattgtaggtgattatgaagtaactgctagctatagcggcgattccaactataatcctgcaagctcaaccgagacatttactgtggataaggagaaaccaaatgttcatgtggtctctgaaaacattgactatggaaagaatgagacaattactgttattgtagatggatttaatgtaaccggcaatgttaccattaagattaatggcacagagatagcaactaaagaaattaatgataaaggccgtgcagtatttgttgtacctggccttcaagccggtgaatatgaagtagttgccatatataacggtgatgataatcatgaatcttccgaaggcagtgatacatttacagtagctaccgtcactccaaacatggatgtggaaactgaggacatcgattatggcgacaatgagactataacagtaacccttcctaaagatgcgaaaggtagtgtaaacataaccattaccgatgagaatggcactgttgtttatgaaggtgaagctcagcttgaagatggcaaggctactgttgacgttccaggcatcacaccgggtccatacaatgtaactgtcaagtatcctggagacagaaactataatccaaccaataagacagtcagattcaatgtagataaggtagttcctgatgtcgatgtcgatactgttaatattgattatggcgacaatgagactgtaactgttacagttaaccctgttgatggtggcgtcactcctacaggtagtgtaaatgtcactgtcagagattctgatggtaaagttgtttatgaaggcaatgtagatcttgttgcaggcaaggctacccttgatgttcctgatttaggtgcaggagattacactgttgatgtacgctatggcggtgattccaactacgatgattcaactggaggctcaagcttcaatgtagctaaagtctctcctgatatggatgtgcaaactgaagacattgattatggcgacaatgagactgttactgtaacccttcctaaagatgcgacaggcactgtaaatgtaaccattaaggataatgacggcaatgtcttttatgaaggtgaagctgagcttaaagagggcaaggttactgttgatgttcctggtttgcctgctggcgattacactgttgatgtagcctatggcggtgatgataattacaacccagtcaatagttccgatagcttcagcatagataaggtaagtcctgaagtcgatgttggtactgaaaacattgattatggtgacaatgagactgtaactgtcacagttaaccctgttgaaggaggatctgctcctacaggcactgtaaatctaaccgttaaggatagtgacggcaaagttgtttatgaatgccaagcagaccttgttgaaggcaaggctactgttgatgttcctggtttgcctgctggcgattacactgttgaagttgcttatggcggtgatgagaattacactgctacaaactccaacggaaactttgctgtaggtaaagttaaccctgatatggaagttgatggtgaagacattgactatggtgacaatgagactgttactgtaacccttcctaaagatgcgacaggcactgtaaatgtaaccgttaaggatagtgacggcaatgttgtttatgaaggtgaagctaagcttgatgatggcaaggctactgttgatgttcctggtttgcctgctggcgattacactgttgaagttgcttatggcggtgatgataattacaacccagtcaatagttccgatagcttcagcatagataaggtagctcctgaagtcgatgctgacactgaagacattgattatggtgaggatgagcctataaccgtaaccattgaccctgttgaaggaggttccactcctactggcactgtaaacgtaaccgttaaggataaggatggcaatgtcgtttatgaagaccaagtagatcttgttgatggcaaagtcaccctagacattccagatttagatgccggcgactacactgttgatgtggcatacagcggtgatgagaattacactgctagaaactccagcggaagctttactgtaaacaaggcaaaaccagaattgaatgtagattcagaagacattgattatggtgatgatgaaaccattactgtaagccttccagaggatgcaacaggcactgtaaacataaccattacagataaggacggtaaaaccaaggtattcaatgatgttcctattgaaaacggcaaggctacaattagcgttcctgatttggatgctggagactataatgtaacagtagactatccgggagatgataattaccttggctctaaagctacttcaagctttaaagttgtcagatcaaacagcaatatcactcttgagactgagaacatcacatatggtgacgaagagcctataactgttgatgtaaatccagtggaaggaggagtcactcctaccggtactgtaaacataactattacagataaggatggaaatactaaagtattcaatgatgttcctcttgaaaacggcaaggctactgtagatgttcctgacttggccgctggaaactacatagttgatgtaaaatactccggtgatggcaattacgatccagatagcactgaaggagcatttgaagttgcaaaagcagttcctcacattgaaattcatgtatatgacatttactatggcgatgtagaagtgctcactgtcacatgcgatgctccaggcactgtggacatcactgtaaatggagtcactgtaacagtacctcttgatgacggatatgataagcgtgtattcagttcaattgttagagcatacagcggcaaggcaactcttgaccttgtaaacttggctgttggcacataccctgctaaggcagtctataacggaaatgaaaactacacttccgtcagcgacaatgacactttccatgtatacaaggagaataccactaccaagatatctgtagatgatatcaagctaggtgaagatgcagtgattgatattgaagttacccatgaagacggctctgaaaagatcaatactaacataactgtaactgtcgatggaaaagattatactgttgagctcattgatggaaaaggcactttaaccattcctgatttggatcttggaaaacatactgtcaaagcggtatatcctggaagccacaactacacaaacagttcaaacgctaccagctttaaagtgacaaaagttactccaagcttcgatatttcaactgaaaacatccaagtcggagatgatgaaaccgttactgtaactcttccagatgatgcaacaggaaccgtaacccttaccattgacggcaaagaatatactgctacagttgaaaacggcaaagctacatttgttattcctggcattaaggcaggcgaacataaggtcaatgttgcatatagcggtgatgacaagtacgcccctgctaaaagaagcgacagctttacagtaagcaaggttaaacctgatatgggcatggacgctcctgaaatcaaagtaggccaagacggcgttataaccgtaactgttccagaagatgcaacaggtacaataagcattaccgtagatggcaagacttacactgcaagcattaaggatggcaaagcggtattccatatctctggattaggtccaggcacacatattgtcaaagcctactactctggtgacggcaagtacttggctggctctgttgatggaaccattgttgtagagcctaagaacggtacaagcccacaagataagggcaaagctcatggtggtattgatttagaaagcaaaaagaccggtaatccaatattagtattgttcatggtattgttcagcttaattttaatacctataaaaagaagaagagatgatgatgaagaagaggaaaatgaagatcaaattaatcgtatagattaa

SEQ ID NO: 741 - DNA, 141 bp, Methanobrevibacter ruminantium
atggctagaccaattagcccaactcctactttgtatggtgaagatgctaggaggtttttaaagaaaatgaatgaacctccaacagaaaaagaaaagaaattttggaaagaagtagaatcacaaaggtttgttcctttttaa

SEQ ID NO: 742 - DNA, 225 bp, Methanobrevibacter ruminantium
atggatagtcagtacattaaagataattattattttgaaactttaaacgaaagccacaatttaaataatttttattgtgaagatgaagaattgaatgaatttttaaaggaagacgcattaaaacaacaaaaacagaaactaaatttaacaaaattgattatatgtgatgacgaaataattggttttgtaagtttactcagatggaataagaataaaagatattaa

SEQ ID NO: 743 - DNA, 507 bp, Methanobrevibacter ruminantium
atgataaaaacagacaataaaggacagataacagtcgaactgctccttcttttaagctttacattcataagcatcatagcccttacaaacatcataagcgatgcaaatgaggtaaacatagccatggctgcagcaagaaacggagcattcgaaggagcttcctcaaacggactggcaatctatccaaaggacacctttgacaactattcaaaggacaagagaaaggaaggcctattcaatatgaaaaacattaagataataaagattgcacagacctttaagggaaaggacaacttcaataaaacgaggatacagctaaaggtctatgcctcatcaaagatcataaaaacaaaggaagagaaggagtctgcaggagatcgtataaattacaatatgagaagagcaatcaccaattcatttaagacggaaaatataagcaatagactatttaatcctgccttttcagacagctatagttttacaactgcaaatgtggaatgggtttga

SEQ ID NO: 744 - DNA, 1344 bp, Methanobrevibacter ruminantium
atggtgattgtttcttatttaaatccactgtcttcagagggccaaaacatagtcagaggactctctagtcttgacgacatattcgcccctaatgatgaccttattgacatagtcattcatagccctcgtcagaccatttcaaatcaggaatatgtgccagagactcttgccgacttggccatcaacagaatcaaatggtatatcgacaaaaagaacaataaggatttcaatccaagcaattacgcctatttttttaatgaagagattgctgaatatgacactatcgcattccacatacttgcccaggctgttgcaagccaatttagggcggggtctcgtgagataaagctttttgtcgaatcctatggacttcttgttgaggacagattgataagattacttgaaacagaaaaaagagagcttgttgaagagatattaggggactttcttgttcaggacggcatagaatgggccttcctgaaggacttagttgcaagcaaaagaatctcccttacagaccttgtattggataatggtaagatagtccttgacagggaagagtttgtctatacattcggcgatgagttcactgaccgctctccagagagaatctatgacatcctaattggagacggccttaaggaaatgatcgtatccaagcttctcattcaaaagtcagaggaatatgttgcacatattcaggatatgcttagaacaattgagccacaccctgccattgtaaggcttggtgagatgcttggcgagacaattacagagcttatgacaaagtacagcagcttctatgcagctggaggagcctatggtaatatggaaataggcaagctagtgagggaagcattccctccatgcattgcaaacaccgtcgaaggggtctcttcagggggaagaaacgatgctatagtccttcttcttacttcatttgtttcatatgcaaggctttatcctggaatattcggtgcagatgccagcgtaaaggtttcagacattgactcaaaccttaacatcacaatgaatgagatacttcctttgatatatgaggcagcggataactgtactcctcccttgtttgaggaccagccacaggagaagataaacattacttcaaaattaggctttgggatgcatgagactccagagctggagcatgaaggtgagacaaagtggtacactcctatgagctgtgaaaagattaagatgcatcttcctcagctgtgcaaggagaataaggattgcgctaagataaacaatccattaagctattattctaggatgaggtggattctaagcaagaaaggtggagaatctaaatctgaggaagaatag

SEQ ID NO: 745 - DNA, 294 bp, Methanobrevibacter ruminantium
atgaacatgtcatttgaggaatatgcagtaatggcaataaatcaccacattgaagagagaaataaatatttgaaaaaagagatcaaagcaaaagaggaagaaatacaagcaatagacgaaaaaatacaagcaaaagaggaagaaatacaagcaatagacgaaaaaatacaaacaaaagaggaagaaatacaagcaaaagaggaaaaaatcaataaaataagaaaattatttaaagacttctgtgaaaatgaagacgaagaagcaatgaataccattaaaagcatattattataa

SEQ ID NO: 746 - DNA, 1107 bp, Methanobrevibacter ruminantium
atggtgaatttaaaaaagttaaatcaaatctcaaccgaaaataacaatacagtatcatactacgaaacagaagaaggcaaagtatataaagtattagtagatgaaaatggagaattaaaaaagattgcctgtgaagaatttccttttgagcctgcaaagcaatttaaaaaggagaaaattaataaagtacatgacagaatcttcaagttcattgcagagaacaatatacaggcatttttgaatgtctttggattaaagcatataatattcaagcaattcttaaatgttgaaatcttagatcagacattgaaccaaagctattgcgacttggtaatagaagctgaagacggaaaaatctacattatcgaatttcaaagctcaggccctgcaaaaaaggataagataagatttggagactatcagacgaccctgcacagaaaaaagaaggggcagaaagtcatagttataatgataaccataaatgatgatcccgataatgatgaaccatatggatatgataaggagtatcgctacaggataaacaagagaagcacaacctgctttaacacagagaaggtgattaaggagttggagtttaaggctgagaacgattgctttgatgatgaggcatatgtcaaactgcagctactatattatatggaaagcaatggtgatgaacgaaaaaaactattgaaaaaaggagttgaaataaaaaacaagataaaaaacctatcaacagacagaaaagttggattgacactgatatacatggctttagcagtccataattttgaagaagaagaactagaaagattcaaggaggaacttaaaatgaacatgtcaatagaggaatatgcagtaatgggaataaaccaccacattgaagagagaaataaacatttgaaaaaagaactcgaagaaaaagacaaagagcataaaaaagaactcgaagaaaaagacgaagagatccaagcaaaagacaaagagcataaaaaagagatccaagcaaaagatgaagaaatcaataaaataagaaaattatttaaagatttctctgaaagcggagacaaaaaagcaatgaatacccttaaaaccatattattatag

SEQ ID NO: 747 - DNA, 492 bp, Methanobrevibacter ruminantium
atgctaagtgaagaagagctcaggcgacttatagaaagccttacaataagggagattatagagcctgcattggacaattggaccaggtacgaatcaaccggaaagaccgtcattgaccttaaaagcggaagggtctatggaatttcactaaaatcaaatgagctgttggagctggaccatgacaacaatcacatagagctctataagatagaaagccatgaggacctatttgatgaggaggaccttctaagcgaggacgaatacaataggtttcaagagttcaaggatagaaaggagcttgaggatgaggactttgatgactatgatccagagcttttaagcgaattctgcatgatggaatcaatagatgagaaggaaagaatcatttccatcctgattgaagactaccaggagtatcatttcaataactatcaggactttgagcattccattatcctaaactattatgatgaggatgactatacctattaa

SEQ ID NO: 748 - DNA, 993 bp, Methanobrevibacter ruminantium
atgtatggtccgtcaagcttggcagaaagaagaatatattacagagaggaatggtcggataaggaccttccagacttcatagcccaaggaatcaccaaaagggaattcggtttcgaccatcttggaaacggtcctaacgacagatataaggtcttcaagggaacagacaccctaagaagattcttaagatacaagacaccatttgcagcatacatttcagtggccttctatcagaaccctagaaagaggggaggctgggaaaaggcagaatacatctttgacatagacgccaaggaccttccaatcagatcatgcaactgcgacggagtatgcgagatatgtcttggagaggccttggaaagggtcaacataatgcttgacacattgaagggagacctgggattgaagaacatacatctcatctattcaggcaggggatttcatataaggatattggatcccgatatgatggaggccgacagcgacctgagggctgaggtattgaagtatgttgctggagctgaggttccaagggcacagtatcctaacatagtccctggagccaagccattgaacttcgagcacttctccatccctatagcatatcctgcagtctttacaaacaaggttaaatataatatattccaccttaggggagatgagacaatagatggaataaacaataggctccttaaggacataataaaaaacagggaatttcttattgacgacaagtggggactctttaaggaaaggataggtccaaggagatataaggatatggtgaatgcgatggcaagggtgaaccttgccactatagatgcaaaggttacaatagaccttaagagaattttgaggctgccgtcatccctccactcaaaggtaagcatgaagtgtgtggaggtaaagaatcctgagaccttcgatccattcaagcatgcagttcctaagtttgtatatgagagaaaggatgaggagattgctcaaaactag

SEQ ID NO: 749 - DNA, 303 bp, Methanobrevibacter ruminantium
atgtctaaaagagttctagtcagttttgcattaattttcatttgcttattttctataagcgcagcctgggctttagatatggattcgagcgatttaaataagaatataggcactaatttagaaaataactttaacacagattcaaacaacaatttagacagtaatttaaactctaattttaacagcaatttaaacagcaatatagataattccacccaagaattagacttaagcactaaaaatttcaaagccctaagctctaattcatcaattgggggggggcaaatagctctgttaatttaa

SEQ ID NO: 750 - DNA, 4473 bp, Methanobrevibacter ruminantium
atggatggatcttattccaatctaacaaatctaaacttttatacaaatgcaacaagtgagaattccaattatcttacaccaatctacatcaacgaggcatcagatttggtcattgaaaacaacccaatttatatagactattctgatggatgtaactacaatctagcgggaatctatgcatttggtgcatccaataataatataataggaaataacagaatatccatctattcaaggtctctaagcaatacatcaaaacattacatttatgggatagacttctcttcatattcctcaaatgcctattctaaagataatgcgaagggaaatgacatatcatcaaatacaatagatatcatttctgactattatgcaaatgcaattacattgtcctgtgcagttgacaccactcttgaatcaaacagcctccatttaaaatcagattcatttgtttatggtatggttgcagagtattttgactttggaaatggtttgaatccatcaaataactttaattttacaaaaaacactattgaagctagctcaaatatggtatatgccattcaattctttaatgtatttgatgttaatattaaggaaaatacaatcaaaaccaattccaacggtagttatgggataagtgcatatgagtcttataatcatgatataggatataacaatctttttgtaaatggaaatgacgtttcaatgattggaactaattttgatgccataggaactggccatagtggaatatactatatgagggattcacatgatttaagcattcatgacaataatgttttatccaattactctcttgggggagattatgcaatcaggttcgatgcaagctccagcgagaatataaatgtttttaaaaataatttaagttctaataatggaaagtatctaggaaatgatgcagttaacggtaatgtgactgtttctgaaaacaatcattattatggagataatgatcttggcactaatgatttacgtatttttgacatctatgttgatttgaatggaaatgacaataagggagacggctctataggaaagccattcaaatccattagcaaagctttgtcctatttaaagaatttaactaacatttatggttctagtgcttcatctagttccaccactaaagtaaaaggcataattcatctaggtgaaggtaaatataatggctatggaactaatttgagaatatatataacaggtttggatgtggaaatatttggatctggctataataagaccattattgatggagtgtcttcacactggttctttgatatttcagaagattcttcagtttctataaaaaatttaagtcttgcaaatggagtttatcgttataatgatggaggattgattcacaataaaggtaatctatatcttgagaattgtatttttgataatgcaaagatgtctcctagttctgcaatcatttataatgatggcattttaaatttaaagaacaatttgatgaatatgactgcaaatggctatcatatatataacaatggatttattgatggtttgtatttgaattttattggagacagccttagtgaagatgaaagattattgaatacagattcccttagcttcatattaaccgcatatgttcatgatgacaatggaaaccctataactggaggctatataagattctttatcgaaggcaaggaaatattggtaaattctagcctcattgaaggtttggctaaattatacacattctcttccttaaatggaatcatcaagatatcaggatactattcaaatgcatataccaatctttttgtcaatattgggaaagtaaacagtagcatcatcagcgatacaataaaagtttatgttaattacagtgctaatgaatcaaaatcagacggttcctttgaaaagccgttcaagagtataaatgatgcattggatgctctcaacacatgtatagaaccggttactatcactgttcttgatgatgaaactacagaacagattgacgattcaagattgaataggaataatgtcattacaatagaatccattaataagacaaacatttcaactaattggacatttaaatcagatgcaaatatccgattgaaaggtcttatttttgatggctatggattagttaaggacaacacttatttgacaatagataattgtttgtttaataatactcctgcaagtgctatagtgtctacaaatggtagtttgactcttttaaattctaattttacaaataacaatgtaaaggacaatcacacattctacacaggctttagcacccctgtaataactacttctctttgggacattcagtatgattatgataagggaggggctgtggataattccttttccaatctaactattttaaattgtaatttcgcttttaatgaggcttataatggaggagcaatctttaacaatcaaagcgatcttcatatttcaaattcaagtttcacatctaatcttgcattcagcggattttatgaaaatcctcgtgcaatagacttttcaaatgcaatggataaggatcaggaccgtaatgtcgcaagcaagggtggagcaatcttccagtatcttggcgaagaagttgtagtaaccgacactggctttttaaataatactgcggggggctatgggggagcattttattcttctggcatctatccttataggaatgacagttccagcatcattgaaggaattccattcattgtttatgaaacagaagatggattgatggataattttggaaattatgctgataatcttttatctccacaagacatatactttataaactgtaattttgattctaatgtggctccaataaggggaggggcagtttactgcattaataattcccaaacccaatatatttcctgtaattttggcaataatcttgtttatacttataatatgtcccaactgtttggaggattaaataagaattcccataggaaatggatttttgaagatgaattggaccaagtctacagcatcttcttcaccgccgtaaacaatggtggagcgattcatgatgaaaatttaaaaattattgacagcacattcactgcaaacacattgcaatctggaggttcaattcttctcccttcagtaatccgctattccgctgatgtctatactttgcctaaaaacactgcaggcgcaatcatcactaattcaggcaaagggggagaatcagtctatgtggcagactcttcattgctcacatctgaagattcaaaatatattggaataaatggatggacaggcactagcacaggaggttcaatcagaagaatcatccatgaaaacggccaagaaactggcactggcggaaacggtagcggaacaggaggttctggaaatggttcaggaacaggaaagggggcttatggaaattcattgtcttggagcgatatattgtctgcattgggcggtgacgctcgaggcattgcaattaatggcgaaggatccagcttttctgatttcattagtggtttgataaatggaaaatcctcttcaaattcaagttctgatagtcaggataatggttctggctcttccaattcttcttctcaaaatcctgttaatggaacaatcccttctaattcaagttctgatagtcaggataatggttctggctcttccaattcttcttctcaaaatcctgttaatggaacaatcccttctaattcaagttctgatagtcaggataatgtttccagctcttctaattccagttcaacaaaacctatggatgattcaaacaagactaattccacttctgatgttccggctaatgatacagtaaatgccactgacggtagttctgactcttcaatttctgaaaatcctgtaaatgggactgcttctaatgataataattcctctgatgtcaatggcggagcttctgatatggatgatgataatatttctaatttaacaaatagcagttctgagattccagttgatactaatattaatgatactaacaattcatcttcagaaaattctaattcaacaactgacttggatgattctgaagataaatctgatgtggataaggatgataagagcgaatctgatgatgtcggacttagcgataatcctttaaatggagatgtttcagaaagttctgatagtccagatagtccagatagtcctgatagttcagaaagttctgacagtccttcaagtccagatagtagttcaagtgattatcaatcaagttcttcagcggcatctcctggagatagttcaaatagtccttcatcatcatcttcttcaagtgcatataagatttatgaagaggagattgatgataatattttggaaaagaatgttgaccttgaaaatcttttaataattattgtcctgtttttaggattgataattttaggatattataaaaaatcaaaagaagatgaggataattaa

SEQ ID NO: 751 - DNA, 6606 bp, Methanobrevibacter ruminantium
atgagttattttaataaaggacatatatggaatattttattaatttgtcttctcatcggaactttggctatgatgggttcagcaagtgccagttctgctaatttagatgattttagcaatcttgcatgtgactctaattcatataatgatttaagtgttggctttgaatctgatgctaattcatataatgatttaagtgttggctttgaatctgatgctaattcatataatgatttaagtgttggctttgaatctgatgctaattcatataatgatttcagcacctattttgaatctgattctaattcatatgatatttctgatagtttggttaattctaattctgatcgtttggttaattctaatggcttaattgagttcaatatttctgctcctaatgacattcaattaaatgacaaagcacctataaaaaactctttaaaagaatatgatgaaagggtattttatgtttctttagatggtaatgatttcaataatggattaagtcaagaaaattcatttaaatccctaaataaggctttagaaaatcttcatgatgctaataaaacaacaatatatgtttttgaaggaacttttctaagtgaaaatagctacgatctattctttgaaggggttggaaatagtcagatgatttccattataggttctggggtaaataagacaatattggatggtgaaggtttgcataggctatttaatgtggataattctatcaatttgacattaagggatttgacctttgtcaatggttttgacttttcatctggcggagccatttataataagggcaatctgactttagtcaacacttgcttttataataataatgtctattctgaagatgcatatcagcatgtgtctctgcttagcggcggagctatagaaaatgagggattcctgacaattgaaaactcttcattcattaaaaatagtgtgggttctgtttttaatcaatatgcctatggaggagccatttgcaatcatggaaacttaactataaacaattccattttcaataacaacagccttgagacatatattgatttgaatgagaattcctatttccgtaagtggaacgctcttcaaactgggggagcgatagcaagtttttcagatggtgctcttatctcaaatacagagttttctaatcattcaatttccatattgaacaagtatcctttcgttcaaaagacattcatgacattctcagctgggggagctgtttatattgaaggcaataatcataatttcatcaattgttcattcttaagcaatgatgcagataatggtggggctgtttactttaagggtaacaatacatgctttgactattgtgattttgacaataactccgcttttatgggtggagcaattatgacaatcgattataatttaaatgaggcttggatgcctactttaaagaatctgacttccaacaaatattctaatctgaacatttcaaattccaatttcagtaataatcattttatatgcactgattttggtataggataccgtatttctcctggtggagctgcaggatactttaaaatagataatattactatcgacaattctagtttcacaaacaatggggtgctggaaaattgcaccatattcgtttcatctaggtgtgggggagcagtattcctttatggtcaagattcaaaagtaaacaattctagttttgttcacaataatgttgaagtaggcggagccataatgaattatggatttgatacaaatgtatcaaactctaaatttatcaataattctgcttgttattctgatggaggagccattttccattctattggtgatcttttgattgataattgtgattttgactacaatagggctgtaaagaatgggggaagcattcaagcaagttatgattatacaaataactatctctttgagcaaaaatcactctataacaattccagatttaaaaattctgctgcagaatatggcggtgcaatatttgacatgggaaatgcggttttatacaatgatttggaattcattaacaattcagcatcctatggtggagctatctataatcaaggattctccaataccttcagaaactccactttcgtcaataattctgcatttagcgaggattattccaatggaggagccatctataattatggttcaaatgcattatatgagtcatcaatcttcataaacaacagcgcagatatggaaggtggagccatttccaattttggtgaaagctgtgttgttcaaaacaataccttcaatctgaataaggcatttaaaggaggatctgtttatttgagtggacaagggggcagattccaagacaataatgtcttttcatcatttgcaatatatggaggtggattatataactcaaacataaatctcatttgcctaagcaactctttcaacaattgcagtgccaatgtttcagggggagctatctataaccttgtttccacacttgaattatattctaattcaatgaatgactgtaaagctaaactttctggacttggcagtggaaattatgtattcacctgtgccaatatctcttatttggtcatttcatttgcaaataatggaagctttaatattgttgacaataagggtgttttgctagttgctaacataagcgacaatatgggcaatcctattactggaggtaattttacttttatcttgtttaatcaaaccaatcaggatattgatctaataggtagttctggttcttccagttctaattcttcaaatccaagcaatctagaatcaagcatcataggtgtatgtgatgtggtagaaggacaagcattcttaagatatgatacttatttggaattaggctccagatatacaatttcaggaacctattcatatgcagccgaacctgtcttgacacaagtggctaatttaaattcagttctatccacaaggatgtacttctcatcaaacattacagatgatatggttaattttggagagggcttcaattatgaaatcattcttttggattctaatgacaattatattcctaatgctgaaatcttattgtatgttgatgcagtctattccaagtctgtatttaccaatgaatttggctatttgaagggtagtgtcaataatttaacttcaagcggaaagcatttctatagcttcatttatagcggagatattttccataatagggcaagctatgatttaaactttactgtattctacaataactcctactattatgatgatgtttccatcagctttagagatttgatctattcatttgtctatacaagtcctaacagtgaaattccttttgaatttttgatttctcataatgatggcgttccattgggaaatgtatcaacgcctcgttattttgtcgcttatgaaaatggcattccacttgccagtttctcttgcacagattatttgggtgtttgtaaaggtcaggaagtcttatattcaattatagagcttaacggaaaattagctaaaatctttagaacttcacctgaaggtattttccaaatgttaataaagcactcagaaagaggactctatgagtataggattgcatttcttggagatttggtaaagcactacgattctagcacccataatggcataagcaatgaagacactttttacaatccttgcaatatttcatttttaatgcttgttgatgatgagcaatccactattccaactagtttgaattataatggtcctaataagattacagaagtggattttgcttattataactttagcttaagtgaaaacagtaagaatccattggccaataaagaaatcagagtttatgatgatggaaattacttaggttcaagttatacaaacagcaaaggctttgcagaattcaatttcccgcagatgcttgataagggcaagcacataatcagttttgtctatgtcgcagatggggattataaaagtgcatactccatctttgaattgaatgtattggaaaacccttctaaagacaatgtatcatttttcaataaaagttctttaaacattactggagctaataataattttacagctcagattaaggattcacataataataatctatctgaaatggtaataaggctatctattctgtttaatggttctgacaataagccatatattaagaattacactgcagtaagcgataaaaatggtgtgttttctattcctcttgaattaggggcaggtagctatctgattaaatgttcatttgctggaaacaagcattattggaaatccagcaagacattcaatcttactcttaataaggttcctacattattatttggccagtccagtgttgaagtattgaaaaatgacacttatctaactgttatattatctacaaatgatttgaaaagtttatccgattcaaaaatcaagtatttggtatttgattcaaatatcactggcttgaacttatcctataatgattcaagtgaattaataagggacatttcaaactatgcatacacattctatgcatttacaaatgagtcaggcatctccaagcttaagataaatcttccagtgggcagttattatctggtaagtttatttgaaggggataaatggtatgatgaatctagccttatcaccaatcttacaatctatggaagttcatcaagattgattgcaaatgaaaatgtcatagttaaaaaatcaggatattacactgttaagctcgtagatggcaatggcaatcctatccagggtcagacaatagagattacagtttgcaataagacatacactagattctctgattccaatggggaggctcgattggccattaatctaaattatggaaattattccatccaatctaagtttaatggaactcttaattattcatcttccattgttgcctcaaggctatatgtggttgatgaggattataagtatccttccatattgactgtcaattcatctgatatctatagggcctttggctattatgatgtggtattgtctgatgtaaatggaaatcctttgccagagaagagcattattgttgaagtgaatggcacaggatttaatattaagacagataataatggattggctcatttggattataatttcactgtaggcagatacaatatagtttcccactttgtgggagatggggattatcaatatagcaatgtcggttccatcttgaatgtcgttaatgaaaatgcggctaacactctgctaaattcatcaatttattgggtattgaaaggaaaaggcaataattatactgtcactttgactgataagattcaaaatccgattgaaggccagataattgtattttccattaatggcagggaatattcaagaactacagataagtatggaaacgcaaatctggccataaacctcaatccaggatcttatgacatttatgcattctacaggggcactgatgtatattattcaagtgaaacctatagtaagttggttgttttagctttggaaaatgaaaatgaagggtctaattcaagttcagccattggctcttccaattccagttccaataatgattctgatgtagattctactaatacttctaattcaggtaattctgagactaatttaactaatggttcaagttctggagattctggaattgataatattaatggttcaagttctggagattctggaattgataatattaatggttcaaacgccagtacaaatatttctaattctactggcgcaggtaatgattcttccagttctgggcttgataatattaatggctccagttcaaatatttctaattccactggatctgataataactcatctagttcgggtattggtggcaatttgactaatgctactgttaatgatggaacttctatttcaggtaattcctctgttactaatggttcttctaatctttcaaataatgacactataaataaaagcgacaaaccggtgattattcctaaaagaactgtaacaaagattatttgccataatatgaccaccactgcagtttctaaagcagatgggagggtaggaaaatactttgaagtaagtcttatagatgcaaatggcaaaccattagccaataaaagaatcctaattggattcaatggaagaaaatataaccgtacaacaaatgctacaggaggtgcaaggcttcaaatcaacctagcatacgaaggaaaatacacctttgcaatcgcgttccttggagatgattattatagcggttcttttgaagtggctctcattacagtaaacaagcacagtccaaagctcgatgcatcttcaagagcatataagtatagtgataagactaaatcattaactgctaaattgctatctgccaatggaaatccaatcagtggcaaaaatataatctttaccgtcaatggcaagaattatgctgcaaaaacagactcaaaaggacttgcaagggtaaatgtttccttaaataaaaaaggaacttatacagtaaaaattaaatttatgggggacagttcatataaatccgcttccaagaaaataagccttagaataatctcccctagcgaaagataa

SEQ ID NO: 752 - DNA, 843 bp, Methanobrevibacter ruminantium
atgtctaaaggatatcccaatttttatgataggatgatgaagaatatagcatcctatgatttgaaatcattctttttattctttggactggattgcattccatatttttcaatagccaatgaggtagttgacggaggtttgaatctaagcttattggatttgcctgtttgcacttcaaaaggaattgtaaattttgaatttcaatttgatagggatgaggcggatgataggagatttataagatatggcgttcaattatatgagaaatatggatttccagttatgtctgtagtgatagactttaaagcccaagaggatgagccttttccaattgaaataagcaagggatgcgtgtttactatatatgtcaaatcgttaaacgaaagaaatccggacatagttttaaataatataaatgataaactcgcaattaatgaaaaacctttaggtaaagatctcacaggtctaaaattgcttccttttttggatttggatagaaaaatagaattgttggataaggctactgaagtcttattttccttagataagaatttagttggcttacgtgagataaaacatcttatgagggttataatgttttattcccatcaatggaattatgaggagaatttggatagattagggagatggtcaataatggttgatgatttaagtcaggatgctgttgttcattttggtaaagttaatagaaagaaaggtagagaagaaaggtcttatgaagttgcaagatatatgattgatgatggcttttcagcagaggatgtttctaaatatagtcgtttggatctatcaattgtaaaccagctaatgctaatgaaataa

SEQ ID NO: 753 - DNA, 3375 bp, Methanobrevibacter ruminantium
atgtcaagaaaaagcaaagagaaatatgagtgggactacagcacctactcaaaggtggatcctaaggtaagaagctactttccgtttgccaaggctaggcctcagcagcttgagacaatctcagaaatccatgaggccatagagaaaggatacaagtacatagtacttgaggctggaacaggtaccggaaagtctgcaattgcagccacccttgccatgtgctacggcgatgcctacatactcaccatgaccaagcagcttcagaggcaatatacaaaggactttgaggattatgactttgcccttgtgaagggcagaagcaacttcgattgcctgaagtatatggaagaggcaatagaggaaagctgtgacatgggaagatgcgtccttgaggggcataagtgcagctataaggtgaatcagttcaatctctataagaaagaccctggggaatgctgcccatacttccatcaaagggcgatagccctgaattcagacatagtcatcacaaactattcctatctctttgccgagcttaacttcaacaacgacttcaaggccaagaggcttctcatatgcgacgaggcacataaccttgaaagcaagataatggatctgatttcccttgagttcacaagacgccagctaaaggatgaggttggaataaatctctctaaggagactctgaaggaccttgatgagaagggctacacatcctggctgcagtttataaagagggtctgtgaaaggtatggggataagagcaaggaaacaaagaaggcattaggcaagcgaaaaagcctaacccttcacagaaggtctgaaaacctaaaaagaagacttgaggactttaagaggttttcaaattacattgcaatagacccggacaattggattatggattatgacccccacagccaaaagctttcattcaagccgataaggattgacaagtatgcaagcgaggtcctccttaagcatgcagatgtctgcatcttcatgagcggaaccatccttaaccatcaccagtttgcaaaatggcttggaatcgaggaggatgaaatctatcccatacgtagaaagtctccatttgatattagaagaaacccaatcagaacatactcaggctttgacatgacctataggaaccttggatcatctgcaaaaaggtcagttcctgtgataagggagatattggaaaggcataatggggagaagggaataatccataccgtcagctatcagtgcaaggagtttctaaagaaggaactcaacaatcccagacttttggaccatgagacaaaagacagggaaaaggttttggaaaagtttaaaaagtcagatgagcctttggtattaataagcccatccatgaacgagggagttgacctgccgggagacctgtgcaggttccagataatctataagataccatatcctaacatttcagacaagcagactaatataagaagaaagaaggaaaagatttggtatgactatcagactgcaatcaatcttgtgcagacctatggcaggggaatgaggtcagaggatgactattgtactacatacttcattgacagcaggataaagagttatttgaagagggacagcattaggaataatctgattccagacttctttaaggaggctgttgatgtggaggcagctgagattgagaaaaatccaattagaaaggcttctgatgcctctgctattgctaaatatgaggggtcagaattttctgatggttctgataatgataaaaatttaaaaatagatgattccacttctaaatctcaaaaggacagtaaaaacactttcaaaaagtctgatgtgagaacaaaatatgctttaatgaaaaagggaaaagacctggcaagaacaaacaagaaggaagcaatcgcattttacaaatccctattaatgcataaatgctttaagaatgattattatccatatagaaagcttgttgtcctttatgacaagacaaaggactataaaaacgaattgggactaatcaaattcttcttcaataggggaatccactgtccaagactctactatttctggtttttaaacaagcttttaaagctatctgaaagaggattgattactaaagaggaaattaaagagcttgaaaaagagtatatgtcaaagggatttaagaacaaatccgtccaaagcagctctatgataattgcagatagaatcgaacattactatggagatacatatgtgctctcagagcataagttcaacaataagttaaagtctaaggagattatagaagagggaaaatactttgagagaaccggaaactaccaaaaggcaattgacttatattcagaggcaatattcgacaggcatttcaataattactcattctatcaaaggatatgcttctctttggaagagctggaggattatgaaagggaattggaatacattaattcttattttgacaatgatagtatcaaaaagtctgaaaccagtgaaaagtggtttaataagagattggataaggtcaatgggcttttggaacttaagaataatgagaaaaacatatcttctgaggttaaatcttccgatgaagattcaattttaaacccatccaatattgatttaatggaatacgatgattcattaagtctggaagacaatatccaaagaaagatggaacttaaagagcatgcaatggaacttaggagaaataagaattattcagaattaatctcttttttaaatgcactgactaaaaactcctattttgaaaacgactattatccattcaggcatctatgttcaatatatgagcaaatcaagcattactcttcaatgaaggattcaattaaggacatgctttatgcagatgtttatttaactgactatcagctagtatggctaaagagcaaaagggaaatagttgatgctcagataggccttgatgatgtcctattcaatcaatggatagaccactacaagagccatggggcaagaaacaagtcaaaggccaactctccagtgcctcttgcagacagactaatcaaaaaagatgaaaattacaatgtttcaacttctgaggaattcgatttcacccagaagaaatatgaattgactgaaaagggaagatctttagagagaaagggaagatatgaagaggctgctgagttttatatggatataattaaagagaagaagtatcaccattatgacttttataaaaggctttgcttctccttggatgagatacctgattatgaaagggaattgaaggcaatcaagttgtattatacctgccctccaatctttacagatgataccagtgacagatggtttgaaaagaggttggaaaaggtcaattctaaaatctag

SEQ ID NO: 754 - DNA, 498 bp, Methanobrevibacter ruminantium
atgggaaagataacaaatagaaaagaggcattaagcaagagagaccagatagaaaagcttcaaggggaatcttttgaaggtgacgacaacattgactggtttggcagaatcgaggagatagtgattgatgacgattactgcatctatcaaatcggcaaatattcaaaattatctaattattactatgatgactttgaggaatattctaaagagtatggccaagagaatccattgaatctttgctttgaggaaataatttcctatttgtctaagatcgttctcggcgactttggagacaacgtcaaagccgaatgcattggcaagggagggatagttgaagtgaatggattgaacttccatcctgtttcccggatagacattgctgatttgaatggagaaagctttgtatatctttatgatgacaatgatctcattgcaagaattccattctttgacataaccagctataagataactgctcctgaagagagcgtttaa

SEQ ID NO: 755 - DNA, 165 bp, Methanobrevibacter ruminantium
ttgggggttaattgcattagagttgtaatagacaatgcagaagaaagtataacaaaggtggctaaggcccatggaaatggggctttggtgttggttccaaaacgatggatcggcaggaaggtacagataaccttgctggaggaagaggacaaactgatgttttaa

SEQ ID NO: 756 - DNA, 603 bp, Methanobrevibacter ruminantium
atgaacagttgtgctgttgatgtaaaagaaaatagtattgaatccgcaatgggcatcaatacaagtgaaagcgatagctttcaattaaacactatcagttccgttgatattggagataaattcaaatcaagcggagcaacaaactatcttgaaagcattaaagcttggaaaaacattgaaaagattatcgattgcttagtcccatctgatttggaggaagtgttttcaatctcttcaaataataatttcaagatcaattgggatgaaaaggcattatatgatgtattatacacaaatgaatcttccatatttgtcccattaggctgtatggaacaagtaggcaatggatattatatcatgaaccataaggatatggtctattctaatccagatgacttcatccatgaaaatggtgtttatggattgattatcagattcgacaataatatgattcaatccgaatatgcatattgcgaatataattccggactttccttagacggagaaaattgtgacttcgttaaaatggactttatatcaggggaagacaccgtagaaaattatattttcgattctttgaatggatttaatctttttaattaa

SEQ ID NO: 757 - DNA, 417 bp, Methanobrevibacter ruminantium
atgtattattataaattagagtcttttgactatgatgagcattggacggcattctatgtttcaaataaaaagtattccgacgatgaattcaaaaagatagttaaggatgcttatattgaaacttgcaagcatatttcagaaaatcaaaagccagtatcaaaatttaactatatgattgattctgtcatttttgatatcttgcaggaaagcgataaagataagagtcagccatgccactatttcaataggatattaaaagacaggcacgatttaattaatttggacgattgtttagattctaaattggaatttgttgaacaaaatggcggtaatgataatttgagggagttttatgacaaaagaagtgagtatattcttgtgggtatatcagatgatgataataagggatacatataa

SEQ ID NO: 758 - DNA, 1473 bp, Methanobrevibacter ruminantium
atgaactatgaatttatactaaatgatttaaggccatctcaagaggagattgatgcagtaaacaagacaacagaaaaagtgataagctttttaaataagacctgcaaagaggaaaatattccagcacaggcttttgcagtaggttcagttgctaaaaacacttggttgagtggcaaatcagatatagacatattcatacgttttcctttaaaaactgatgaggcagtgcttaaggaaaagggcctatatcttggatataaaacaaatgatgcattaaaaggaaaggcatcagagcattatgcctcacatccttatctgacctgtttaatagatggaatcgaagtggatatagttccttgctattggattgaagatggtagccaacttaaatcagcagtggatagaaccatcctccacaccagatatatacagaaacacttaaagaagtcccaagaggatgaagtattgcttttaaagaaattcatggatgccgttggcacatatggctctgaattcaagacaggtggttttgcaggctatctatgcgaattgctcattctaaaatacagcacctttgaagagacccttagacaggctcaggattggaagttccataccaaaatcgatttggaaaactatggaacctcagacaataagctctttaaaaatgaccctcttgttttcattgacccaacagacaaaaaccgtaatgtagctgcagctttaagaatagagagaatgcttgattttataatagcctctagaaactacatcaatctaattgacagcttagaggatgccgatgagaacataataaaagaaaaagtcttaaaatacttcagcccacttcttaaggagagattccaggacaaatcagttaaagaaatatcagatgacatattggatgagtttaaagaccgagaaactcaaactttagtcatcagtttcccaattccagaaatgaatgcagatgctcttcatcctcagcttttaaagacagttgaatcaatatcccataagctggaatctgaagacttttcagtttatagctatgactattggactgatgaaaaaaatctcgtcatcttcataattgagctaaatgtattcaagcaaagcaaatattacgttcatgaaggtcctaaggtttggaataagcttgcatttaataacttttcagccaaatggtcccaagagtctctatatcataaaggggaattcattgtctttgacagggagcgtcaattcgttacagctaaggaattggttaaacacttgcttgaaaaggataatattcatgagattaaggttggaaagaatttaagaaaagctattagcagcacccataccctttgtgagattgatgagtttttagaaaatattgatcaattcatttgtgatgaagcagatcaaagggagtttttaaatactttagatgatttattaaggccaggccagtatcttaaaaggtaa

SEQ ID NO: 759 - DNA, 465 bp, Methanobrevibacter ruminantium
atgaatactgaaaaagaatttaatacgactgtttataattatgaccgtttaggagaccttttgtttatttttcaaaagaaccataagacctatcttaataatctcttggcagagtatgacttaaatttgatacaggtattgtgcattttaaaaatagatagtgaagagaatcttaatcaaaaggacttatcagatagtttatatctaacaaaaggagccataaccaaagccataaagaaattagaatctaatggcatagtcataagggagaaatcccctatcgataaaaggcataatgtgcttgctttatcaaagaaaggagaggatcttattccaatcataaatgacataaatcaagattgggaaaagagaatgggtttggatgagctttctcctgagtttttaaagacttttaaggccttggcttttaaatcagctgagttgaataatgaaaaattagtttaa

SEQ ID NO: 760 - DNA, 939 bp, Methanobrevibacter ruminantium
atgagcataaaaaaagtagttgtagctggtggaggagtattaggcagtcaaattgcttatcaatctgcattctgtggatttgatgtaacagtttggcttagaagcgaaggttcaatcgaaagggcaaaacctaagtttgaaaggctcttgaacatctatttaagtacacttgaagcaatgaagactgataagtctgcatattgcagaggtttaagcaaaacagcagacctaagtgatgaggaaattgacagcttaaaggagcaggctcaaaaggcttttgatagcttgacacttactacaagctatgaagaagcagctgatgatgcagaccttgtcattgaagcaattgcagaagaccctaatcaaaagatagccttctatgaggaattgagaaaataccttccagaaaagacaattctggtaacaaactcatctaccttgcttccaagcatgtttgctgaacacacaggacgtcctgaaaagtatcttgcattccactttgcaaataacatctgggctcaaaacactgctgaagtgatgcctcatcctggaaccaaacaggaatacttcgatgcaattgttgaatttgcagaggacatcaatatggttccgattaaggtattgaaggaacagccaggctatgtattgaactctttgctggttccattcctatctgcaggtcaggcattatgggcaaatgaggttgcagatcctgaaacaatcgacttgacttggaggcttgctacaggtgcacctaacggtcctttccaaatattggatgtcgttgggcttgtaacagcatataatattgtaattatggatcctaggtcaaatgaccctgagacaacccagggaaaaatagctgcaaagcttaaagagaaaatagatgctggtgaaacaggtatcaatgcaggaaaaggtttctacgagtatggatag

SEQ ID NO: 761 - DNA, 684 bp, Methanobrevibacter ruminantium
atgatagttagtgtaattggtggaactggtccacaaggtttaggaattgctcttagattagcaattgaaggtgtagaagttattgttggttctcgtaaagaagaaaaagcattagatgttgttgcagaagcaaaagaaaaatatgcagactatgacttaaacataaaaggtttagctaacgaagatgcagctaaagaaggtgacatcttaatccttacagtacctcttgcagcacaaaagccaactgttgaaggaattaaggaattttgtactgacaagattgtattagatgctactgtacctttagaaactgcaatcggaggtaaaccattcagattcatagacctaatggaaggttccgcagcagaacgtactgcaagcattcttgatggaaccggagcaaaagttatctgcgcattctgtaacataagtaactctcacttatccaacattccagaagacattgactgtgactgtttgattgccggagatgacaaggaagctaaggaaattgcagcagagctcatcaacaagattccaggtgtcagaacaatcgacacaggaattttagaaaaatccagaatcattgaaaagatcactccacttttaattggattaaacataaaatacaaatcccattacggtggtcttagaattactggaattcctaaattggatgaataa

SEQ ID NO: 762 - DNA, 1497 bp, Methanobrevibacter ruminantium; identical to SEQ ID NO: 85

SEQ ID NO: 763 - DNA, 510 bp, Methanobrevibacter ruminantium
atgaatgcaatatttaaaagaaaaagcataagaaagtttttagataagccaatagaagatgaaaagatagaaaggcttctaagggcaggaatgcaggctccatctgccatcaattcacagccatgggaatttattgtggtccgggataaggattccataaagacaatagagaatatgagcctctattcaaagcctgccaaaacatcaacctgctgcataatcacattattcaacaaaaaatacactgataagtttgatgattactgttgggttgagcaggatatgggagcatgcactgagaatatactattgcaggcagttgaagaaggccttggggctgtatggcttggaacatatcctaatgaggaaagggtgaattatcttaaagagcattttgatattccagataatgtttatccttactctgtcattgttttaggatatcctacagaggattatcatggagaaagtcgttttgatgaaagcagaatacattatgagacttattga

SEQ ID NO: 764 - DNA, 522 bp, Methanobrevibacter ruminantium
atggatttattagatgtgatgcttaaaagaagaagtgtaagaagatatacagatgaagagattccggaagaaaagctaaataaaatattgcaggcaggtatgcttgctccaacaagcagaaacagaaagccttgcagttttcttcttataaatgataaggattccttggtggaattggcaaattctaaagagcatggtgcagagctcttaaagggtgcaaagcaagctatagcagtaattgccaatccaaatgtatcagacacttggattgaggactcctccattgcacttgcattcatgcatctaatggctgcagagcaggatgtcggaagctgctgggttcagatgcatcttagaaagtctaaggatggccagtggtctgaggaacttgcaagagagattcttgggcttgacgactactttagaatagttggcatattggctcttggaatggctgatggccagcctaagccacatagccttgatgaaattgacttaaatgatgtgcatatcttgcattaa

SEQ ID NO: 765 - DNA, 576 bp, Methanobrevibacter ruminantium
atgaaagcaaatgaaaaagagacaatcagaagctttttagcaattgaacttgacgaaagcctagtgccaccaatattagacgttcaaggggattttaaaaagacagacaccaagatcaagtatgttcccgctgaaaacatgcattttacattaaagttctttggaaacatcgatgaggatatagtagaggacataagtggtgcagttgaaaagataataaagaactattcttcatttgaacttaagatagaaaactgcggatgctttccaaatcagaaggtaataaaggttctctggcttggaatagataaggattccaagataacagaccttcaaaaggagcttgataaagagtttaaaaagcttggattcaaaaaggagagaaactacatttcacatcttacaataggaagggtaaaaagccctaaaaacaagaatgagataagggatgtgattgaaaagaataagaatataaaaataggatccatgacagtgaatagggtatgtcttaaaaagagcacattgacacctcaaggacctatttatgagaatataagagtgtttgacttggaataa

SEQ ID NO: 766 - DNA, 801 bp, Methanobrevibacter ruminantium
atgacaacaaatataggtaaaagaattcgtttagaaagaattttcaatagaaaaaccggaagaaccgtaattgctcctatggaccatggagtgtccagcggaccaatcaaaggtatcataaatatggataagaccattgaagaaatctcccaaggtggagccaatgcagtattgatgcataagggtattgtagagcaaggacacagaggatacggaaaggacataggacttattgtccacttgtcagcaagtacctccctcagccctgatccaaacaataaggtaactgtaacaactgttgaaaaggcaattcagcttggagcagatgcagtgagcgtacacgttaacataggctctgaaaacgaacctgaaatgctaatggaacttggagaaatctctgaaacctgcagctactggggaattcctcttcttgcaatgatgtacccaaggggacagaaggtagagaacgaacacgatgttgaaatggtaaagcatgctgcacgtgtaggctctgaacttggcgtagacattgtcaagaccaattacaccggtgacccagactcatttagggaagttgtggaaggagcattggttcctgtagtaattgctgggggtcctaagatagacactgatagggaacttttagaaatggtaagagattctcttgaagtgggaggagcaggtgtagcattcggaagaaaccttttccaagctcaagaacctggaaagatcactaaagcaatttctgaagtagttcacaatgatatggatgtagaagaagctttaaaaatcctcaaataa

SEQ ID NO: 767 - DNA, 1107 bp, Methanobrevibacter ruminantium
atgtccccgaaaacatcatgggacgataagaaagaattaatcacaactgcacttgaatcaggaatagaccatgttcttgaccttgaagacagtgaaaacattagaaaggtaggtaactttaacatcatttccacagaggaagacgctgatgtatatttagttggaatagacggtgaaggagacggcacccttgagcttaaagacaatctaaatgagtcatcagacttagcaaaagcaaaggaagctaaaaacagtggaaagacagtatgtgcctatataatcattacagacaagctccatgagcaattggctgtagtcttaggtaaggttgttgattatataatccttgttggaacagactggactgtaattcctcttgaaaatatcatagcagatcttcagaaggaagacgtcaagcttcttgctgctgttagcaatgcagatgacgctcaagttgcaatggaaacattggaagtgggcactgacggtgtcatatttgaagcacgtgactttgcacagataaaggacattgcaggtctgatagacgagctttcaactgaaagctatgaattaaaggacttgacaataaccaatgttgagcctgtaggctctggcgatagggtctgcatcgatacaacaaccatgatgagacctggagagggaatgcttatcggctcatattcaaaggctatgttcttcatccatagcgaaagccttgaaagcgaatatgtggcatcaaggcctttcagagtgaatgcaggtcctgtgcaagcttatgttatggttccaggtaacaagacacgttatctctctgagcttgtaactggcgatgaagtcttaatcgttgataaggatggaaagaccaagacatcaattgtcggcagatccaagatagaaaaaagacctttgctccttttggaagcggaatatgatggcatgaagataaagtcattagttcagaatgctgaaaccataagattagtcgatgagaatggagagcctatttctgtttctaatttggagaagggaatgaaagtcaaaggatttattgacgacagcgccagacattttggtatggcgattgatgagcagattattgagcaataa

SEQ ID NO: 768 - DNA, 1266 bp, Methanobrevibacter ruminantium
atgaatcctaaagaattatttgctgaatctaaaactattattccaggaggggttaactctccagtgcgtgcatttgaaccttatccattttttgtaaaagaagctaaaggctctcatatcatcgatacagaaggaaacgactatgtagaccactgtttggcatatgggcctattctattgggccatagcgacgatgatgtgatggcagacgtatataatcagatgaagatgggaaccgcttacggagctccaactgaaaatgaggtcaaattggctaaggaagttatcgacagggttccatgtgccgagatggttcgttttgtaaactcagggactgaagccacaatggcagccattcgccttgcaagaggatttacaggcagaaataagattgtcaagttcgaagggtcatatcatggtgctcatgactatgtccttgtaaagtctggttcaggcgctgcatgtcttcctgattcagcaggaattccagaggacaccactaaaaacaccctttcagttccattcaatgatgttgaggcattaacaaagcttattgatgaagaaggggaaaacatagcttgtattattgtagagcctgtaatgggaaatatcggctgtgtagagcctaatgttaaatatttaaagttcctaagggaaatcactgaagaaaacgacatccttttaatatttgatgaggtcatcacaggattcagggtctcccgcggaggggctcaagagtattatggagtaaagccagacctcgttacctttgctaaggttcttggcggaggattccctatcggcgcatatgcaggtaaaaaggaaatcatgagcttgattgcacctgcagggccagtctatcaggcaggaaccttcagtggaaaccctatatccattcaagcaggtctttccacccttaataaactggattatgagttctatggaaaccttgctcgaaagggagattatttaagaacaaacatatcagatattgttgaagacttgaatcttgaccttcaggtagtggggcttgcttcaatgttccagatctatttcaatccagagcctgtagtcaattatgagatagctaaaaagtcagatgcaaagagatttctggtttacttcagagaacttttaaagaatggcgtatttatcccacctagtcagtttgagtgcaatttcatatcaggtgctcacacagaggaggatttggataagactgctcaagggatagaaaatgcgttgaaggttgcttggcaactataa

SEQ ID NO: 769 - DNA, 639 bp, Methanobrevibacter ruminantium
atgaaccaaaaggactattggaacagcatagcagataaaaaggaatttacaactccatttcatcctgaaatattggaaaattatctaaataaagatgattttattgtggatataggctgcggctatggcagaaccttaagggagctaaaggataacggatatagaaatcttagaggctatgacatttcagaaaagatgatagaaaggggaaagaatgaaaatcctgatttggatttgagaataaaagatcccgacacaatcgatcttgatgatgacagcgtagatggaatcattctatttgcagttctaactgcaattatagatgatgaagagcaaaaggctctcattgatgaaatatatagggtattgaagcctggaggcatattatatctgaatgatttcctattgaatgatgatgaaaggaatctgaagagatatgatgaatataaagatgaattgggagtttatggtgctttcaagcttccagaaggagctactttacgccatttcgatgaatcttatatctttaagctatttgactcatttgaaaaaagggaatatgagcgtcagatatatcctacaatgaatggacatacttccaatggcttttattatattggagaaaagaatataggttaa

SEQ ID NO: 770 - DNA, 1239 bp, Methanobrevibacter ruminantium
atgttaatgaatgaacagacaaagctttctaaggatcattatatgatttttggcttaagttgggccggttgggtctttgatttctatgaccttgtcctatttacctttttgatttcacagcttcaatccagcttacatataaatgccgaaatgcttgcattatgcttaggattgtccctatttgctacaggattagggggaatcatttttggagcattaggtgataagtatggtcgtaagaaggtattggaatggacaattcttgtctattcgatagggacactgctatgtgcattctcatggtcattctattctctggttctattcagattcatcactggattgggagtcggaggagaatgggctacaggccaaatctatataagcgagacattccctgataatctaagggccaagtttggagctttcatgcaatcaggagctcctgttggagtcatattggcttcaatagtaggtggaatgataagccctattattggctggagaatgacatttttggtttccatcattccggcaatcaccattatccttattcgaagatatcttaaggaatccgatgtctggattaaaaataaggatgattttgtaaacaagaacatatttcaggagttcaagcaacttgtttcaaaggaatacagaaagatattccttatatccttggtattgtgcatattcggtatgtctgcatattggtttacctattcctggcttccaacctatctggcagaggagaggggccttgcaatggttacaacctcccttggaatcatactgattcagtgcggtgactttacaggatacacaacatttggttttgtagctgaaagaataggaaggcgtcctgcattcactatctacagtttcatcatgggaataagcattgcaatgataacaatatgctggaatcagatagataaggtcccagaccttataatggtattcatgttccttacaggattcggaacaggattctttggaggattcggttctctattctcagagctattccctacaaagataagaaatactggagttggaactgtgtttaaccttgcaaggggagttcaattcatcactcctatgataatcactttcgttggggcctactatgacttaagttatggaatcgcaatagcggcaatattcgcgttccttgttggaatttggatatgggtattccctgaaaccaagggaacagccatcaatgatttggattag

SEQ ID NO: 771 - DNA, 543 bp, Methanobrevibacter ruminantium
atgaaaattatagcattattggcaagtccacgtaaaggtggaaactgtgacgtccttatggatgaaatgattagaggagcagaggaaaacggtcatgaagtagttaaatacttccttgaaaaatgtgacatcgctccatgtaaggcatgcatgttctgtgctgaaaaccctgactgcgtacgtgaagacgacggaaatgaaataatcaacgcattggtagatgcagatggcgtaatctttgcaacccctatctactatggtcaaatgtccgctcaaggaaaactcattatcgatcgtttctatgcaatcggacaaaaccctgataagagtcttggaggcaaagcagcacttatcttcactgaaaaccaacctgaaggcacttacaaagactatattgaattaaccaaattctccccattcacctttatgggatatgatgtcatcggtcatgtagatgctggaagcgctggccctgcaggtatagtcgctgaagagcaaaaagacaaattagaagaagcttatgagttaggtaagctcttctag

SEQ ID NO: 772 - DNA, 789 bp, Methanobrevibacter ruminantium
atgattaatatagtagcaggcttaggtgaaaatgaaaacatcatattggcctcaaggcaactggaatcaatagatgacttaaatatccaacttgtagacaatgaggatgacttatttgatgcatttaaagattctaatgttggtgcggtggtaagaggctctctaaaggcttcaaaagtaatcaaattaataaagcaatataagtctgactgtgaagtaaacagagccacttatgtaaacacatccaatgaccctaactttaatgactcctatgagtttttgctttctcctgttggaatagatgaaggcaaaaacatagatgagaagatcactttagccatccagtctgccaattttattcaatctcttggaaagactccaaagatagctgttcttgctgaagggagaaaggatgactatggaagaagcgagagaatagataaaagcctgaaggagtctgaagagctcactcgacttttagaggaaagattcaattcccttgacaattttgacaacagcagcgaggatgtttctaaaaactaccagataaaaaactattatattctccttgagcaggcaatcaatgataagttcaacatactcctagcaggtgatgggatttttggaaatataatgttcagggctcttgttcttcttgataaatggcctagctatggcgctgtaacacttggaatagatgagatatttattgatacaagtcgtgatcagactgttgaaggctataaaaggagtttggagttggcatataatcttgctaaattaaaatag

SEQ ID NO: 773 - DNA, 765 bp, Methanobrevibacter ruminantium
gtgccaccacaatttttatataagatttatgaaaagcgcctaatgaatgagctggatccagatagaatgcctaggcatgtagctatcattatggatggaaacagaagatattccagaatgaaaggtgatatggaagttatcaaaggccatgaattaggagcagacactttagagaaggttttggactggagcatagatttgggaatagagatagtcactgcatatgccttttcaactgaaaactttaacaggccagagcatgaagtggaaggccttatgaggctttttgttgaaaacttcaaaaagatcgtagaccatgaaaagattcacaagcataaggtccgcgtcaaggttgtaggcagaattgagctattgccagatgatgttcgagaagcgattaaggaagctgaagattccactaagcagtataatgaaagactgttcaacttggcaatcggctatgacggccgtctggagatagttgatgcaatcaagaagatctataagaaagtggaggatggagagatttccattgacgatatagatgagaatcttgtcagcgaaaacctatacactgcaggtcttgaagaccctagccttatcataaggacaagcggagaggaaaggcttagcggtttcctcttatggcaatcatcttattcagagctttatttctgtgatagcctatggcctgagcttaggaaggtagattatcttagggccatcagggactatcaggaaagggataggaggtttggtgtatag

SEQ ID NO: 774 - DNA, 762 bp, Methanobrevibacter ruminantium
atgatagatacccattgtcatatagattttgaagaattcgacgaagatagggaagagctaatcaaaagggctcaagacaagcttaatgcagtaatcaactcaggatacagtgtggaaagcaacaataaggttctagaactttcaaaggaatataaggatttcatctatcctacatttggctttcatccggtttcctctcaaaattctcctgaagaggagataagtgcagcccataatcagatcgtcacccatctggatgatattcttgctgttggagaggttggaatggacttctattactgtacagacaaggcccttagggctcgccagcaagagatattcatgggatttgtagagattgcaaatgaatataatgttcctctattaatccatggacgggactgtgagagaaaaatcttcaatctcctaaatgactatgatgacattcctaaagtaatttttcactgttatggaggcagtctgaaggtagcaaagagaatattggataaggatgactattatatgagctgttcaaccatggtatgctatagcaagcatcatcaggagctttttaaaaacattcctctagagaggattcttacagagacagacagcccttaccttgcaatgacaaaggaggagagaaacgagcctgccaatgttgtctatgcagttgagaaattagcagaacttcatgaaactgatgtaagtgaggtagatgaacagactgaaaagaatgcaagatatgtgtttgatatataa

SEQ ID NO: 775 - DNA, 681 bp, Methanobrevibacter ruminantium
atgaaaccttatgtgattttaaatgcggctatgacattggatggaaagatagccacaaagacaggcagctctgagatttcaggcaaagaggaccttgagagagttcacgagataagaaagaaagttgatggaataatggtagggataggaactgtccttgcagatgacccaaggcttacagtccataagattaatgcaagaaaggaagataatccaatcaggatagttgtggacaataaggcaaggactccattgaacttcagaatcttgaatgatgatgcagagactatcattgcagtgtcttccatttgtgatgagagaaatgaaaattgtgatgaagaggctgtaaaaagagctaaagagcttgaaaaaagagtgaatgtattttattctacaggggaaactgttgatttggtagaatttatggaatatctctatgattatggaatcaagtcaataatgctggagggaggatccacccttaacttttcaatgattcgtgatggtttgatagatgaagttaagatatgcattgctcctatgattgttggaggaaaggattctaaaactttctttgatggagatggctttgattatatgaaagacgctgtacaattggaattgattaacagctttccattaggcaaggactttattatggagtataaggttttaaaataa

SEQ ID NO: 776 - DNA, 147 bp, Methanobrevibacter ruminantium
atgggaaatatggctgaagcaagaagaaagatgcatgaaagagatgagagaataaaaaaagaaaataagtctgatgtcaagaagattagaaatttcttcttcggatgttgtgataataaagaaaaaaagaaagtaaaagagcattaa

SEQ ID NO: 777 - DNA, 645 bp, Methanobrevibacter ruminantium
atgcacagtttattcagtgatggagagctattgccatctgaacttgctagaagagctttagtacttggacatgaagcaattgcaataacagatcatgttgactattcaaacattaacacaatccctgaaatcagcgctgcaattgatgacataaattcaaattgggatattaccgttgttttaggagctgaaataacccatgcacctaccgaatcaatccctgcacttgctgagaaggctcgtgagcttggtgcaaagatagttgtagtccacggtgagacattgaatgagcctgttgttgaagggaccaactttgcagcagtaaactgtaaggaaattgatattttaggccatccaggactcataacaaaagaagaagcagagttagccaagaaaaacgatgtggctttagagataagtgcaagaaaaggccactgccttggaaacggtcatgttgcaaacattgcaagggaagttggaaatgaccttgtcatagatacagacacacattctccagatgacattattacctttgagagatcaattgaaataggattaggagctggaatgaccaaagaggaaattctaaaagcaactattgacaatccaagaaaaatattaaagagaaatggcattgaaatttaa

SEQ ID NO: 778 - DNA, 1059 bp, Methanobrevibacter ruminantium
atgatttccgtatttgttccgtcacatatcactggcttttttagtattcatgacaatccagatcctttattgaagggttccttaggtgcaggtgtcctattggataagggggtaattacagagattgattttaaagagaattttgatttaggcggtgtaaatgataatgatttgaatcttgactctttgaattcagatgagttattaattataatcaatggcaaaagggacgaatataatgaagtaatcattctaaaaaccatacatctaatgaaaaaagcattggataaagaagatatttccttgtccggtgtggtcataaaccaaataatccaggttcctataggatgcggatttggaacttcagcggcttcagcacttggtgtggcgatttcaatcaatgaactatttgatttggggctttctcttgaagagtgcggccaatttgcccatttggctgaagttgaacttggaactggccttggggatgtcattgcagagctgtcaaagggaattgtccttagaacaacgccaggggctccaggatatggggaggcaaaatccatagttcctcatgagaagactggctttggagtctttgaatcattaaatgctgatttttatataatcacaaagtctttaggtgaaatttcaacagcctctatcataagtgatcctaagcataagaagctcattactcaagtgggtgagaaaactgctgaagagtttaataaaaaggatgatggaattgtcataggttccaaatttaaaaataagttcaatgtagctgttgacagcgaattcaatgaagaagaaaccattaaaaagtttatgaaatcttctcttttctttgctcgaaagacaggtttaatcagtgatgagctattggaattggttcacaatctccatggaaaggtcataggaagttctatggcaatgttagggaatacattatttgcaattgctacagaagagcagaaattaaagcttgaagcggaatattatggggaatttgatttctataaattagaaaccgaaggaattcgtataatcaaataa

SEQ ID NO: 779 - DNA, 534 bp, Methanobrevibacter ruminantium
atgataagattaagttatgatatgcaggtctatagaaaagacttaagagaagtcctaaaaagaacagacaatgtagttgaattgggatgtcatgtaggcaagaccagtgagcttattttatacaaattaaccactggctctcttattggaatagacaatagtcctgaagctgttcagcctttggaaaggctttcattccatcatgaaaactttactcacattataggggatgttcgccgtcatgaggtcttaaaggaagttaccgaactcataggccaatgtgatgtattgtccattgatttaggtggaggatatcatccagacactgtctttaaagtctattatatttgggcgtctaccttaaagccaagggatgtcttgattagaaatcagggattgattgactttgtcaattcagcaataactacagaagatatgatttcagagcatggctggcttgaatcatgtggagatcaaggaattcctcctcaaattaaggagttcagcttatggacagataagttggatgactga

SEQ ID NO: 780 - DNA, 1323 bp, Methanobrevibacter ruminantium
gtggattacttattacgcgatttaagaagaactcattattccaaagacgtaaacccagacatcagcggtgaagaagttattataatgggttgggtacatgaaatcagagacttaggcggaatcatctttgtaatcatcagagacagagacggattggtacagattaccgcaccaagcaagaaagtagatgcagaaatccttgaagagctaagggcacttagaaaagagtctgtagttgcaatcaaaggaactgttcaagaggcaggaaaagcaccaaacggcgtggaaatcattccaatcaagacaactatcctaaaccctgcaaaacagccattgccaatggatccaaccgaaaaggtcaaggctgaaatcgataccagactaaactcaagattccttgacttaagaaaagcaaacgtaagctcaatcttcaagataaaggcaaacatgtttaaggcagttcgccaatacttcgacgaacagggcatgattgaaatcaacacccctaagcttgtagcttctgcaaccgaaggaggaacagagcttttcccaatcacatactttgaaaaggaagctttcttaggccaatcccctcaattatacaagcaaatgatgatgggagctggattcgacaaggtatttgaaatcggacaaatatttagggcagaagagcacgacacccttagacacttgaatgaagcagtctcaatcgactgtgaaatctcctttgcagatgatgtggatgtcatgaacgtattggacggcatgattaccagagttctccaatccactaaggaaaactgtgcaaaagagcttgaaaccttagaatacgacttaagcgctatccctgaaggaccattcccagaagtcaaatatgacgatgctgtagacatcatcaactctaaaggaatcgatatggaatggggagaagacttatccagagaagctgaaaaagctttaggagacactcaagaaggtttctacttcttaaccgattggccatcagcaatcaagccattctatgcaatgccttatgaagacagacctgaaatcagccatgctttcgacttgatgtataagaacctagagatctcctcaggttcaatcagggttcaccaatatgaccttttagtaaagcagatgattgaaagggacttaaacccagatggattcggaagctatctcaaggcatttgaatatggtatggcccctcacgcaggttggggtgtaggtgcagacagattggctatggttttaaccggtgttgaaaacattagagaaactgttctcttcccaagagacagacacagattaactccttag

SEQ ID NO: 781 - DNA, 1281 bp, Methanobrevibacter ruminantium
atggaaattttaagatatgagagagaaactgcagatgagctaatcaaaaggtcacaggcagacatcaatgaaatattaaacatcgttcaagacatcctatccgacgtaaaggaaaacaaggatgaagcggttaaaagatacactgcaaagtttgacagatgcgaattagatgatttgcaagtttccgacgaagaaatcaagaatgcttatgataatctagatactgatcttatagatgcccttaaaagggcttcccaaaacattgaaaagttccataaggcccaaattccagaggaatggtctatggaagtggcaaaaggtatcacagcagggcagataatcagaccgatcaatagcgtcggctgctatattccaggaggaagagctgcctatccatcatccatattaatggaagtgattccggctaagattgcaggagtggaaagaatcatatgctgcacccctccaggagccgacggaagaatattggatgcaatacttgtagcggcagacttggcgggagcagatgaaatctacaagtgcggaggcgcacaggcaatcgctgcaatggcatttggaacagaatcaatccaaaaggttgaaaagattgtaggtccagggaatgtctttgttacaggagctaaaaagcttgtctatggtgatgtggacattgagtttccagcaggcccttcagaggtattgattcttgcagataagactgcaattccagaatatcttgcccatgacttcctatcacaggcagagcatgaccctgaagcatcatgctttttagtgactgatgatgaaaaaatagcagaagaatccaacgaccttatagaaagattcactaaggaagctgtaagaaaagagataattcaagagtccttggaaaagcacggacatataattctctgcaaagatatggaagaggccattgaatttacaaatacctatgctccagagcatttgatcatatcaactgaagatgacaatgcaatccttgataaaatcaaaaatgcaggatccatattcttaggaaaatactctccagtggcagcaggtgactatggctctggaacaaaccatgttcttcccacaagcggtggagctaagatgtattcaggcctttcaaccgaatcattcatcaaaaagcctaccgttcagaccataacaaaagagggtattgaagagctatccaagacagtcattccaattgcagaatatgaaggcttttatgctcatgcaaattcagtgaaagtaagattagataaaaacgaatag

SEQ ID NO: 782 - DNA, 306 bp, Methanobrevibacter ruminantium
atgtataaagatgaaatgattcaattacatcaatttttagtatatgttttaaaatatttagacacagataataatgctcatgaatatattgaggagtatcttgcgcttaacataagccctcatcatattcacagaacaaaagcggagcataaacaggcaatcttcgttctttcaaacactatttcagaagtgatcttgcataaggaagaaggttccataccaccaaatgtatcaaatgcattaagggatcttgttagaagatctaaaaaggaattaaaggctgctgaagcagctcaatcaaaataa

SEQ ID NO: 783 - DNA, 1389 bp, Methanobrevibacter ruminantium
atgtctactcgtaaagttgtttgtttagtggatggagagcattaccttccggtgacccgttctgctgtaaattccattaatagcattgaccatattgaagttgtggctcttgtttttataggcggaactgaaaagcttaaattaggtgatgaggaagagtatagcgaacttttagacactcccgtttactttggaaaggataaaaaccagattccatataaattgattgaagatgtcatcaaaaagcataatgcaaatattgtgatggacttaagcgatgagcctgttcttgattatgacaagcgctttaagatagcttctgttgtactgtcctgtggagtaatttacaagggggctgattttgaatttgagcctttgactcaatatgaaataatgaaaaagccttccctaaagattttaggaactggaaagcgcataggaaagactgcagtttcaggctatgctgctcgattgattgacaagaataactataatccatgcattgttgctatgggtcgcggaggtcctgaagaacctgaagtagttcatggaaatgagattgaaattaatccggagtatttgcttgagcaatccaataagggaattcatgcagcaagcgatcactgggaagatgcccttatgagccgtgtattgacaatcggctccagacgctgtggaggcggaatggccggcgatgtctttgtcacaaatatggataaggcagctaaaaaggcaaataagcaggatgctaaatttgttatctttgaaggaagcggtgcagccattcctccgattaagacagacaaatccattgttctggtaggtgcaaaccagccaataggaaatattctcggatactttggtccttatcgcataatgttaggggatttggttatcctgacaatgtgtgaggaaccgatggcaagcaaggaaaagataaaggaaatcgaagacttcatccataagatcaaacctgatgttgatgtgatatctacagtctttaggcctaagccattgtcagatattaatggcaaaaaagttttatttgttaccacagctcctgaagcggttagggatgttttatcaagctatcttgaagagacttattcctgtgagatagttggattaagctctcatctttcaaacaggcctcttcttcaggaggatattgaaaaatacaaggatgatgtcgattgcatagtgactgagcttaaggcagctgcagttgatattgtcactaaggaggcaatagaatctggaatagagcttgtatactgtgataatattccggttcctataagcgatgactatcctgacctttcagagtctattctaaaggtggttgatggggcaattgaagagttctcctttaatatgcttttagattaa

SEQ ID NO: 784 - DNA, 1062 bp, Methanobrevibacter ruminantium
atgatgtctcaagattcaaacaaaaatgatataaattcatacgattttccatcaagggtggaaaaggctttaaaattgattcatacagattctttcaaagcattggattattttaatgaaattctggatgattttttcaagttcacacctgatgaaatcaaggaaaataacttatcttcccttataataaattcattgaatggaaagggttccattttaaatgcatttgataaaatcgatgaggctgaagaatgttttgatatggttttaaatgattttgacagccaagatttcacttccctaattaataaggcattgattttaagaaaaaagggacatttggaagaatctttggattattacgatgagatagccaaatactatcctgataagaaagagcttattttagctatgaaaagtgaagtttatggtgaattgaaaattaagctctctgataccgatttggatgattatagcattgaagcaaaggacttaattgggaggggtcttgcatcccatgagaataagattgttttagaagccttggattattatcaaaaagcgattaaagcagattcaagctgtaaatatttggtcttaagccttatggatgatgttaaaagggaattttttaagctctttctctatgaggatatagacattgaaaaggacgagatttcaaagaaaaaaggagctgttttgcattaccttttcattcaaaacaatctattctatgcttatatgctaaatgaagagatccttgaagaaaataagaatgacttgtttgcattgaatgcaatgggaatgatattcttctatttggatgactgtgacttgtctattaggtatttcgacagatgtaacactattgatgagaaatatctttacccatatcttaataaggccattgcattggctagggctaaaagatttgatgaagctaaagagtcctttggaaaaattaagggattgcctaatctgattcgggatccaaatgaggaagagttggacatttttaaaagaacaatcatttcaaacagcatctattccttaggattttag

SEQ ID NO: 785 - DNA, 441 bp, Methanobrevibacter ruminantium
atgtcacatgttgaaaagtcattagaattatttgaagctaaatttaattgtgcccaatcagttttttgcagtttttcaaaagaatttggccttgatgagaaacaagcattaaaaatagccgcttgttttggtagcggtatgcgtaaaggcgaagtctgcggagcttgtagtggagcattgatggttttaggtttaaaatatggtcagagcgaacttggagatagagatagcaaactgaaatctgataagaagtgcactgactttttagaggaatttgaaagagcaaatggttcttatatttgcaatgaattattagggtgtgatataagaactgaaaaaggagttaattatgctaaagagaataatctttttatcgaattttgtccaaaattcgtagaatctgcaacattgatagttgaaaaaatattaaaagaagaatag

SEQ ID NO: 786 - DNA, 1080 bp, Methanobrevibacter ruminantium
atgggtgatagtttgaaagttattatagatgcagctaatgtggctcattatcaaaaaggggaaaattcaaaggctaaattaaagaacattaccttggctgttaaggcattggaacaggggcatcatgattttttaattatagcagatgcatcattgcgtcataatattgatgataaggacacttttgtaaggcttgttgaagatggaatcatcgatgaggttcctatcggaaatgtggcagatcactatatccttgacttggcttatgatgaaaatgcaaagattctatccaacgataagtttagggacttcatgtctgaatttccagatatcaacagcatgaggattcctttttcaataaaggacaatgagttaatattaggtaagacaaagaaacctaagaaggttaaaaatctcttgcagaacatctgtgatgaaatcttaaatgagcttgagcgcaagcgttgggttgtttataagggaaaggagacaactaagttcacacctttgaatgttgcaaaacaagccattttgattttagaccaatctgaaagggatgatatgtcctctaaaatcgaaggaatattttcaaagcttcctatgtttgacaaggtcatggaaatggttgatgacgtagagacctctgtcccttatgttatttttgttcttgtccatcctaaggattataaggctgcagtaaaggatgcaggtaatatttcagtcactgtggcagataggttaagattggttcataagcctttgattgcagttagaaatgacctctttattaagccaggatatttcggattgaatattgtccttacagatgaggtggaagatattcctccattcaatattgagattcagacaaacacctatgatgaggtatttatcaagaagaattccagaaatatagcaagtacaattgctggcagattaggttcctggaagtttccatttgtttcagttaagcctaatatgattttggaaaaacctggtgagtttgaaatctatttagagaagaattctaaaaagaaaaagaaagataaatctaaagataaggataagaagaaaaaatag

SEQ ID NO: 787 - DNA, 1194 bp, Methanobrevibacter ruminantium
atgtgcctggttaatggagttagggctgcaggtagccgccaaggcaaatacggcctagcagttatagaatctaaagacagcaatgcctctgccgtatttacatcaaataaggtagtggcagctccagttattcatacaaaggaaatgattaaaggcggtaaaatatctttagtcgttgcaaacagtggaaatgcaaactgctttactggtgaggatggaatagttgactgtgataagacaattgattttgcgtcaggtatcactggaatctcaagatctgagattgcaacagcatctaccggtgttattggtcgtaagatgcctatggatattatattgccattggtggaagagtccatttctaaattagagcattcaaatgaagcatctacagatgctgcaaaatcattaatgacaactgacacctatcataagcaatttgctgtagagacaagtattgatgggaaaaaggtcacaattggtggtgtaaccaaaggagtgggcatgattgcacctaatatgggaaccatgctttgtttcttggctactgacgcttcaatatctgctgaatatatcaataaggccttaaaaacagcagttaataaaagctttaacatgattgtagttgatggtgatgaaagtaccaacgacacagctatcctgatggcaaacggcaaatcaggtgttgaagttgtaaatgatggcgagattaaccctgatttccaggaagcattagacttcatctgcattagcttagctaaaatgatggctcgtgacggcgaaggagccaccaagtttatcgaatgtaaggtgaatggggctaaggatgaaaatgatgccattttagcttctaaatcagtcataagttcttctcttgttaagtcagctatttttggcggagaccctaattggggaaggatagttgcagcagtgggatattccggctgtgaaatggaccagaatatgataactgtgattataagtgatgacaatggaaaagaagccattttggtagataaaggtaaaatccttgcatttgaaggtacccctaaccttgacttggcagaaaaaatcatgcaggagaaaaatataaacatacttgttgatttatatcaaggggacgcatctgcaaccgcttggggctgtgatcttacctatgattatgttaaaataaatgcagagtacactacttaa

SEQ ID NO: 788 - DNA, 642 bp, Methanobrevibacter ruminantium
gtgaatgattacttaaacaattccgatactaatgacgctcttgtaaaattgcctgcaaagcaaataggaaagaatgagattggaactgtgtcaatagaaggtccttatggaaatacaagctctcctgttaaagtggcatatattctagggcagcatccaagggaattcagcgctcatgatgcaatttattacgctttacaaaacaactcaaatgaacttaattattcatattatgtttatagaatcaatgtaaccaatgaaacagccgactttgagcagagcaggatgaatggtcaattgttggctcaggagtttgtagtaaacgattcaattaacaagagctatgacctggttattgacattcactcttcaaatggaggatatatacaggacccttatatattcgctcctgtctctagcgatcttttagcatatgatgctgcaaataacattacaaaggcattgccttatgttacttattatgagcctgctagctatacaagtccacagtattctacaattcctcttgaagagggtggaattgcctctatcatatttgaaatgagaggaaatccggacaatagtttagagcatcaggctgatgactttgttaaggcagtggataaattggttttaaattag

SEQ ID NO: 789 - DNA, 1185 bp, Methanobrevibacter ruminantium
atgattatcaatggaaaacgttccttagcacatgtagagaaagtagcttggattaagccaattgaaggagcagacaatattgggcttatcggagtccttggatggacatgcattgcaaagattggtgaatttaaggaaggtgaccattgcgtatacattgaaatcgattcaaaggtacctgaaaaggaatggtccgagttccttagagctaaaaaattcaaaatcaagacaatgagacttggaaagttcaaggttatctctcaaggtcttgcattacctcttgacaagtttgatgtggaaatccctaaaaaagtgggaacagatgtaacagagcttcttgagattacctactccaaccccaaggacatcaagcgtaaaagcgatggtccaaacaaatacgaagagatggctagacgcagaaaggcattattcagaaagccttgggccaaatggcttatgaaaagagaatggggtaagagactaatgtttttcatcttcggtaatgagaaggacggttccaaaagcttccctaagaagtttgaatacgttcacaaaaccgaccaagaacgttgcgaaaacatgcctgatgtcctaaaggacaagactccattcatccgtacacaaaaatgtgaaggatcatctggaacattcattcttgagcttacaaacagcagacttggaaaaagggaatacgagttttacgtatgctcacgtaacttaagagtctttgaggatgaaaacactgacttttgggatgttgcagttaaatacgacattgaaaacaagcttaaggattatcttgaaaagcataaggactgctcttatgtagcatggcaaggagaagtctgcggaccaagtattcaaaacaaccctcataagctaagcgaaaaccatttattctgtttccatatgattgacagcgaaaagggcatgtttgacatccgtgaagctaaagagctatgggacgaatacgaaatagaatcagttcctattgatgaggaagaatacatccttccagatgactttgaagaattcaagctaactgcagatgggttctacgaccctgaggtttgtgaaggacagaagaaatgcagaagagaaggattcgtttactacaagacaactgatcctaacttcagtttcaagaacgtgtctagaaagtacttattaaagattggtgaataa

SEQ ID NO: 790 - DNA, 612 bp, Methanobrevibacter ruminantium
atgggaaataaaactggacttttacctgctaatggacatcgcattcagggtaggtcaagcgagtcatttttagacgctcgtgaaattattatggaacttggacttgaaggaaatgaagtttttatggatgcaggatgtggagacggacatgctgcaatagaagctgtagatattttggatgatgatgcaacaatctatgcagttgacatttatgaaccgtctattgaagaccttcagaaatttgcagttgaaaagggttatgataatctaattcctatatgtgcagatattcctgattatattgatattgatgatgatactgtggatatgatattgcttattaatgtatggcatggattcaaggcaaccaggagaatggatgaggctattgaagagcttaagagaatcttaaagcctggaggcaagattgcaatcatggactataagaagcaggaagctaaacatggtcctcctataactgtaagaagcagtccagaagatcttgaagaggtctttaaagaacatggcatgtgtttgttctctttaaatccagatactggagaggacattcctcaaggcaagtcacattatttgattatatttcaaaaatag

SEQ ID NO: 791 - DNA, 879 bp, Methanobrevibacter ruminantium
atggaaagcattaatcttttggtagaagcgctaccttacattaagaaattttacaataaaaaagttatgattaagtatggaggccatgcaatggtagatgctgatgcaatggcttctacagctcgtgatactgtgctcttaaaatatgtaggcatgcagcctattgttgttcatggaggcggtcctgaaattacccgttccatggaaaaattaggaaaagagcctaaattcatcaaaggccttcgtgtaactgatgaagagacaatagacattgtaaagatggttcttgtaggtagcatcaatacagatatcgtatctcagatatgtcatcatgacggaaaaggagcaggattgtccggtaaagacaataagcttattcaggcctctaagaccatgcatgagattaaggatgacgataccggtgaaatcgagcagattgatttgggattagtcggtaaggtggataagattaaccctgaaatccttgagatgtatactgaaaatgattatattcctgttattgtccctattggaattgcagaaaattctaaaactttgaatctcaatgcagatactgttgcaggtgcaattgctagtgaagttgatgcagaaaaacttataattttaacagatgttccaggtgtcttaagggaccctaatgacccatcaactctcattcaaaagatccatattgatgaggttcctcagcttattgaagagggaataatcagtggtggaatgattcctaagattgagacttgtgttgaagccttgaataatggtgtaaaatcagcgcatattttggatggaagaattaagcacactttacttattgaaatctttacaaaggatggaattggaactatgatttataagtag

SEQ ID NO: 792 - DNA, 744 bp, Methanobrevibacter ruminantium
atgggaaaactagatggtaaagtagcaatcattaccggagcaacctccggtatgggtagagaatctgcaaaactattcgctaaggaaggagctaaagtagttgtctgcggaagaaacgaagaaagagcagcagctgttgtagatgacatcaaggcagctggcggagaagcaatatatgtaatcgtcgacatggcaaaccttgacgaggtaccaaaaatctatgaggcaaccatggatgaatacggcaccattgacattctattcaacaatgcaggtgtattaagcatgtccccattgatggaccttacccttgaggaatggaacaaggtattcaatgttaacgtaacctctgcattggtcctcactcaactttgcgtacctgtaatgaaggaaaaaggaaaaggaacaattgtaaacacctgttcagtagcatcctttggagctcaccatggattcgcagcatacgtagacagcaaacacgccatgatgggacttaccagatcaatggcatgggaattaggtcctgaaatcagatgtaacggtattgcaccaggtcttatccacactgcaatggtagacagcattggaggccctggagcattgcaaaacatgattgaccaatgcccagtcaaaagatgcggtgaaggtcaagacattgcagagcttgcattattccttgcaagtgacgaatgtactttcctagatggtcaaattattaaatgtgacggtggattcgagatataa

SEQ ID NO: 793 - DNA, 1485 bp, Methanobrevibacter ruminantium
atgttaaatataaccacatttttagatgctaatgcatgcagactagagaaggaagtcttttattatccaaatagagagctaagatacaattcaaaagaacttttaacaatagtatcaggaataggacaatcattaaaggataaaaatatagaaaaaggagacagagtgctcatctatttaaacaactctccagaatacttattctcacttcttgcaatatggagaataggtgcaattgcaatccctaccaacagaatacttacctctgccgaattagactatatgattagtgattccgatgcaaagctgattataacagatgatgaagcaagagaaaccataaaagacctaaaaatcaactcatacatcatagaggactgtgagagctttaaagatagcgaggtcttacctgcagaggaaacagaatgggacgacctatgccaactccaatatacctccggaacaacaggcaagcctaaaggctcaatgctaacccatggaaactggtttacagcaatccacaatgcctgtgacgtattgacatataaggaagatgacacattcctatgcatctatcctatggctcatgtaggtattctttgggcaatagctgcactgagagccggagcattatgcataacaatggacttctttgagataaacgaatacttaagattatgtgaagaggagaaggtaagcgttctctctggaatgcctcctgtaattcacaccttgacaaaccttgaagaggaaaaaagagaaaacctatccacagtcagagagataataagcggaggaggcccacttcatagaaagatctggaaaaagttcatgggacaatataatatcccaatcataaatgcttatgggctttccgaatcaatagtcataggaacaggcactgtaataagacctgaggactatgctacagcagacagatacgaaagcgtaggacatcctgtttgcttttcagagctaaagatagtggatgaggatgatccaaacaaaacattagataaatatgagcatggagagatagcgcttagaggacctgcaatagccaagggctattggggaatggaaaaggaaacaaaggaatcattccttgaagacggatggttcctcacaggggatataggttatatcgatgaggacaatcgtcttttcattacagacagaaagaaagacatgattgtaatgagcggatggaaaatctatcctacagaagttgaggaaacccttataaaatatcctaaggtagatgagattgccatattcagcataaatgatattcataggggagagcttccagtggctgcagttgtatggaaagaagatgaagatccagagggactgcttgaatattcaagggaatatcttgcaagatataaggttccaagaaagatattcactatggatgagcttccaagagtaaatggttggaagcttttaagaagggaacttagagagatgttttcacaataa

SEQ ID NO: 794 - DNA, 999 bp, Methanobrevibacter ruminantium
atgataaaaattgcaagaattgatggagacggcataggcaaggaagtgacagaggcaggagtggctgttctcgaatcattagacctaaacatcgacttcgtagaagctgaagcaggtcgagaatgttttgataagaacggaacaaccatacctgaggagaccataaggattgcaagaaatgcaaaggcaaccctatttggagcaatcacttcaacacctggagagaaaagcccgattatcaccttaaggcaggaattggatacatatgccaacttaagaccaataaaatcattcaagggagtggactgcctctttgatgatttggactttctcattgttagggaaaatactgaaggattatactctggaaaggaaagattggaagaggataaggcaatagcccatagggtgattacaagaaaggcgagcgaaagaatctcaaggcttgcatttcaagaggcaatcaaactgaataaggaatcagtaacttgcgtgcataagtcaaatgtgctaaagaaaacagacggcgtatttaaagactcattctacaatgtggcaaaggactatccacaaataaaaacaatcgactattacgtggatgcaactgcaatgtatcttttaacaaagccacaggagtttgatgtgattgtaacaagcaatctctttggagacatcctatctgacgcttcagcaggtcttgtaggaggattgggacttgccccatcaggaaacattggagacaagcatgggctctttgagccggtgcacggatctgctccagacattgcaggaaataatatatcaaaccctattgctatgattctgtcagtttcaatgatgcttgaatacctgaatgaggattatttggcaagtaaagtaaaaacagcctgtgaaaatgtcctagaaaagggaaaagtcttgacaccagacctaggtggaaatgctaagacaatggatgtggcaaatgaagtcataaaagaaatagagaaattagactaa

SEQ ID NO: 795 - DNA, 468 bp, Methanobrevibacter ruminantium
atggaaaaatctattgatgaattgattttggatttaaaggatgaggatgactttgttcgtgaagaggcaattggctcacttgaacttaaaggggaagaggcagtatgccctctcattgaagctttaggccaaagaaataaggatattaaaataggtgccgctcaggtattggcagctatcggggataaaagagccattccagcacttgtggccactttgggtgacagaaacaagttggtaagaagagaagcatctactgcacttaccaccatgggtgatgaagctatcgaacctgtaattgcagagcttgacaatcctaaatggagagtaagaggtgctgcatgctgggtccttggtgcattggatgctaaggaagctcttccaaagcttgaagagctattgaatgatgaaagctcttttgtgcaatacggtgcaaaggatgctattaatagaataaataatggataa

SEQ ID NO: 796 - DNA, 363 bp, Methanobrevibacter ruminantium
ttgggcctttatgagcacgacttgaatgatctcttaaaaagccttgaggataagggtcttgtccattatgaaggttcctatgttcagttaagggattttgaaggggtaataaatactgtggattcaaaagaggatgttcttacagctgaactgaatcagaaggagaaaaagtcctttgaaataatcaagtccttggcagatgagaacaatttggtttcaaggtatgagatagagggcaatctattgtatggtgatttgaagcttacagactttaggatgtatcatattattctgtctttggaaaataagggacttattgaagctgtctataagcataatggggactattataagattttatag

SEQ ID NO: 797 - DNA, 792 bp, Methanobrevibacter ruminantium
atggataaggcaaaagttaataacataattttaaactataatcttgaaggagaaggccgaacaatagtgttcatccatggactctcagacagcctgaactattggaggcccctccaggagagcctaaagggagattaccaaacattgtcatttgacttgagggctcacggagagtctggtgatgataggaaagagataaccatcgacttataccaaaaggacctttattatttattgaattatttgaatatagaaaaagcagtactgattggcctatcattaggaggaaatgtggcattggactttgcaataaatcatccgaagatggttgatggacttataataatgtcaagcttctctgagttttcagaccatttgaatgagatatttgacagctttgaagaagcaatagagcagggatttgaagagttctttgatgtaattctaccttacacgctacctgaagatgtcctaaaaaagcatgaggtagaattggaatacgttaaaaaggaaggagcaaagactgcaaacattgaaggaataaaagcaggaatcaaggcaggatatagcttttccataactgacaaactaaatacaatagatgctccgacaattgtgattgcaggtgctgatgatgagctgacagatctggagcttcaaaggaaaatatatgataatattgataattctgaaatgataattcttgaagacaccaagcataatgtccttattgggaaaaatataagcagaatcttggatataattaatgaatttatgttaaaaatagaataa

SEQ ID NO: 798 - DNA, 495 bp, Methanobrevibacter ruminantium
atgagaattagtatgtctttaccaaaaaagctattggctgagtttgatgaagttttaaaggatagaggttatcaatcccgttcaaaaggtattcgtgacgctttaagcgattatattttaaggtatccatggatgaatgaaatggaaggtaacagggtaggagttattactgttatctatgatcatcattttacaggagtcatggaaaaccttgcagacattcaacatgactgcatggaagagatcaatgcaagcatgcatattcacatgacccataagtactgtatggaagtaattgtcgtaaacggtaatgtgactcatatcagagaattggcagagagaatgatgaggcttaaaggggtagagcatgtaaagcttacaagtactgcaaatggtgagtctctagaccgtgagccaggtcttgaacactctcactcacattcacattctcatttaattttttttttaaagaatttcttttttttattttcttaa

SEQ ID NO: 799 - DNA, 936 bp, Methanobrevibacter ruminantium
ttgattcttatcactttaagctttttaagagattatgagcgtcttgccgtatttaaggaagcaattgatgaatttgctatttctaatttagataaggatttggattgttcaaattcaaatggcgatataaattcagatgacgataaaaagttagattgctctcttgcatacgatttaggatgtggaagcggagttttaagctatttagcatctgattattttgataagataatatcaattgagcaaaacaggtccattttcaaatgtgcaaataaaaatttaaagtcatttgacaatattgaggctataaatcaaaatgttttggattttgactttgaaaactatcccaaggcagacttaatcatctgtgagatgctggacactgccctaatcgatgaagaggaagttcctatcctaaaccattcaaagaaatatctaaaggaaaatggaaaaataattcctcaagggataataaactcagcagaacctgttttcatgaatattgattatctccagtatgaggatgatgaatatcagccaatctatgagattttaggaaaatcagttatttatagtgagtttgaattcctggatgacattgatgaggacttctcttgtataatcgaatttgaaatagatgataaatattcagataaaaaaacagatgcatcatttgaagtagatgatagatgttcagataaaaccgattattttaataagagtaatgataaaataaaagtaaatggaattaaactgacaagctttaccaaactgaatgaaaatatcatctgtggacctactcctatgttaaatccagctatgcttgttccatttgaagagatagaggtaaataatggggataaaattagaataaggctatcctatgtgatgggtggcggagtagagaccataaaaacagaagttttagatgtttaa

SEQ ID NO: 800 - DNA, 525 bp, Methanobrevibacter ruminantium
atgttaaatcttgatgaaatcagtgagaatattgatttgtttttagaggactgcagctctcttattgtattggggataggcaatgacataaggggagatgacggtttaggcccttatataatcaaccaactgactgatttgaaagagaatctatctttaaaggaaccacaatccttagaaaatgtccatttgcttaatggaggctctgttcctgaaaactttacagggcttatcaaaaggattgatccatctcatatcataataattgatgccactttaatgaatgaagagccaggatttattaaaattgttaataaagaagacatttccaatgtaagcatatcaacccattccatgtccctttcctatcttgtaaagtaccttgaaattgaaatcgactttaagctaatttttataggaattcagcctaaggatatggatttgacctttgaattgactgatacaattaagaattcttcagatacccttgttgatttgctattttccaagtttttaaagatttaa

SEQ ID NO: 801 - DNA, 1140 bp, Methanobrevibacter ruminantium
atgaaagttttatttatcggatcaagattatatgatgacttggcttatcatgtggatgagctgggcatagaaagcataataacagaatcaaatgaagaggctcctcatttggaccttgcaagcaaatactatatagtcccaagaggaatggataagccaatggaagtggctattgaagagaaggtcgatgcaataatacctcttattggcatagaccctccattaaaggacttggctattatgaaggaaaaaatagaaaaggaaaataatattccagtgatttcatctaatttcaatgctgtggacatcgcttccgataagataaagaccaaggagttctttaagtcaatcggattgaatgtgccagaggcaaaggttctaaataaggatgacttctccaatgagggggagttcttggaaaaattaggattccaattcccaatagtcctaaagcagggagaaggacaaggcggaaaggacatttgcataacaagccagtttgaagatgttttacaatactttgaaagcttcaatcaggctttggtggaaaacttcattgaaggggctgaggtctccattgaagtaatcggatggaatggtgaatatttgcctttggttccggtatataagggagatactagtttagaaggcatacatccgataaagaggttaagatatggtccttgtgactttgaggcaattgacaatgaagagttcaggcaattggctaaaaagatagcagtcaatttaggctctgaaggaacaatcgatatggatttaatctattcaagggaagagaacaaggtctatgcaattgaaataaacacacgtccaagcggcacaaggtatttatcctatgcaactactggacttagcccattaggtcttcttgttgacattgcagctggaaactttgatgttaaagatttggaaaataaaataaagcattattattcattggaaatacctataggtgattatgaaggtcctgcacctaatgaacctgttaaggagtatgtaaatggcaatttcattgttcacggcccaaaagggtatcaaagaattactataagaggaaatactcgtgaagaaacctatgaaattgctaaagagttaactggcaatgattacaggtcttaa

SEQ ID NO: 802 - DNA, 1074 bp, Methanobrevibacter ruminantium
atggatttgaattatataattgtattgtttgttctaacatttcttgctaccgtagccttcacttactttgtaagacatactctacgtgatgcagatgtttcagatagccctattgtcagtgaacatagacataaagcaggaactcccaccatgggaggaatagctttcctatttgccattctattcatagtgtctatctattacagaaatacaaatattctcatagcctcatttatcatgctcacaggaggtgtaatgggtcttcttgatgatctattaggtcttaagataaaggaatatcaaaaggtcgtaaagaatgtaagcgattcagttgttcctataggattattggaccttggccctggagaagaggcaagggtaaccaccgacaaggctaaaaaacaggtatatggatatgttgatgaaggaaaattggaaattgttgctgaaattccaatcaagtatgagccaagcgaaaagaccaagatcatcgttcagctattgcctggactgtttttggcattgactggggttgtaacaacccttgggggattcactttaggcattttggcttatcctatttgcataatcgctattcttggttcaatcaattcaataaatctcattgatggaatggatggattggctgccggcatcgttgcaattgcatcattctcatgctgcatttatgcttatatctgtggaaatatggatatgattcctgcatttgcaattttaactggaatatgtcttggatttttggtcttcaacagataccctgcaagcatattcatgggagacacaggctcctttgtattaggtacaggatatgcagttgctgtcatcttaggggacattccttactttggagtattggctttggctgttccgattgtatcagtaataataagcctgatgcatagggcacatataataaatctccctgtagagcctttgcatcacaccttgaactataagggaatctctgaagtcaagatagtcttaagctattggctattgaccgtccttgtctgtgcaatcggcatacttgcaaagctttatatctttgcataa

SEQ ID NO: 803 - DNA, 1620 bp, Methanobrevibacter ruminantium
atgtcaaaaacatactttttaaatgaattagcagattcaatatcctctcaaaagaccttttcaatcgctcaacttgcagatgccattggaggcaagatttatggagcagatgactacaagtctccaaatggatttacaggcatctttgaaaccttaaacgaagctgtagaaggagatattgtaattaggcattggataaacggaaaaggtgttgaaatagctaatgataaaaacgttgcatgcattataaccctaactccaaaggaagatgccttggaaatggcttcaaagctcgcctttccagttattgtagtggataggattgaatttgcaaatgcatttgcattgaaatggacaattgataacctttcccctaatactcaaagggtagttataagtgggacaaatggaaaatcaaccagttcccatttgatttatcacattttaaaccattgcggatataatgtatttacaaatactgatgcaaaatcagaattcaatacactaatcgacccaatggttgcaaagctaatctcagagcaggtgatatcaaagcaggactttgatgttcgcaagttggactctgtagcagacctaaagaacctggatagcgaaggaaagccaataaataaaggcgcctttgactatattgttgttgaagtctcagaggttcagggctggggaagcgaccttatgaaagatcatgcccaaataatgtcttcagcaatcaatccggatgtaggggttgtcacaaatgttgcaatggaccatatcggccttgtaaacaatatagaagaggtgttccatgaaacttcagggcttgtaaaggctataaacaaaggaggagtggtcttaaactacgacgatgagaatgtcctggcaatgaaggatcttgcaaatgatggagtagacatattcttcacttcaatggaaaaggattcaatcctaaataatgattatgacaatgataagaaggtttattttgatagaaaaagcaatgcaatagtttatgataataaaaatatccttagatatgatgagttgccctttacaggagagcattttatcagaaatattctatctgcaatttcagcttgtatatctcttgagattccaattgaagacatctgcgaaggggtaaaaacatataatcctttaagcagaaggtttacacgtctttatgatgagccaattgttattgatgactttgcacataaccccgacggaataaaaaataccgtaagggcagcatatgacttggcagagcaatttgacaagggagatttatacattgcatgtgcaatcagaggctctaggggtgaaaccttaaatggccttaattcagaggcattggctttagtcattaaggaattgcgccatagaaatgatgatgatatagaaaaagacgaaaatgtcaagaaaagggaaatatacctaatcctttcttcaagctgtgacttggtagaccatctaaactatgttgaagactttgagaggggatatatttccttctctaatttggataaggagcacataaaatacattcatttcaataagctctacggcgctttaggatatattatgaaaaaatgcatatggaagatgatgttgtattgctga

SEQ ID NO: 804 - DNA, 1854 bp, Methanobrevibacter ruminantium
atgggtgagtttgtatttagttttttagaagatcaatttagagacatctatcttgactgtgcaaggatggataagaatctcattgaaggagatggtgttgaatcaattcttattgcaggaagaatcgctgaaaagataacaaaagccatctttgtctttgaaggcataaaagataatgaagataatcaatatttgaggatagaaaagctttccaatgcaaatattcttccaaacaacattaaaaatgacctctcccaaattagaatactaagaaacaatgtctaccacaataccttaaacagtgacggaagcggcggatttgcttcatacaatgctccaaaatatgttcaaagcggaggattgagagactataagacaggctttaatgaaatcaaggaatattctaaaatatctaaacaaaattctaactctaattctaactctagttcaaattcaagccctaataacgagttcggcagtgaattgactgcagctcgtgaagcccataagcttgtatttaatgtctgtgtctggttttatgtaaactactctggcgataaggacttcatcagaccaaaatataagctaagcagaagaacccaagatgctgacttcctaatcagactaaagtcagcaataaacgatggaaacgactttattaaattgcgccaaaacaatccaaacaatgagatcattcagatactcaatgagatttacgtcaaaaaggctcctcaagagccaaaagaggagcaggtctatggcataaacaataaggatattaaaatcagacagcctgatgttccttattcaaagtgtttaggcatctcttatgatgatgaactattcatgtggcatgcagagcatgggggaaaggacttaggtcttttcgagtcttccaaggaagcttatgaggcaagggagatttatataaattccatcccaatgccaagaaaggtaaatggagcatattcaaaggcaagaggcatttcattcagcagaattcaaaagctatggtctgcaagcgtaaagggacagattatatcatatcatggaagcgaagctgaagcaatcatggctcgaaagaaatacttaaagtctcataacctagttgacattaaggtaaaagacggatataagacaatcacccttgaagagaaggctaaattggaagagaagattagacaaaagaaggaaagttcaaaatctgatattaagacaatcccttcaaattcaaatacaaaggacgagatggaaaaggagaatattcaaaagataatggatggcgtaaagaagcttaaggatgatttgaatgaatctagtgcttctacttatattaaatccagttcattaagctcacagtccagttcttctgattctgtttcaagttattccggttctaaatccagttctttaggttccacttcttctagttctaagtctggttctttaaactctaaatccacttcaaatgaaaattcctctttttatgacattcataacataggttcaggagataaaactaaaaagaaagttaaaattgtaaatggctcaaaagtccaagcaagtcaaacaactaaaaaagtaaaggtttcagctggaaatagagtttctaaaaaacataaatccagttctaagaattcaactgtttctaataatgcaaatagttctaaaaagtctaaatctgttgccattaataagaaaaaatcctctaaatatgaaggtgtgttctatgaggatggattgttcatgtggagtgcagaggtggacggcaagcatttaggtctattctcctctgaaaaggaagcttatgaaaaaagggaagagtatattaagaataagtcaaataataactaa

SEQ ID NO: 805 - DNA, 594 bp, Methanobrevibacter ruminantium
atgtctaaatttaaatactgtccaatgtgcgcagagccaagagcagataattcaaagtactgctccaaatgcaattttgaatttttaactggaaaatatgtaaaagtccaagaggaagagataaaaatcactgaaaaggtctcccaagaggagtttgtagaatctaatcagctaatacaagatacaagtcttaaaatcaatgtattgataagcaggtatttgaattattcactaagcaataagtttaatgaaaacttaccattaagtataataagggaatacatatccagctgtttaaacagtaaagtcccatctgactttgatgacaattatctccaatccttagatgctcttttaaatgatgagggctataaaaattctattaatctttttcttcaatggatcgatgagaacagatcccatctgccagggcttgtattgaatcaatacatgattccacatcagaacaatgtcaataggattgaagagatccttgatttggagttagagaaaaatgaggataatgatttgttctttgatttattgaataagtttttaatcagtgaaaaagagtttatagaacgtttaatttag

SEQ ID NO: 806 - DNA, 189 bp, Methanobrevibacter ruminantium
atgcctgttgtaagaatttccggaaatccaaatataagtgtagagacaaaaagagaaatggtaaagaaagttagtgaaattgtagcagaatcctacaatttacctattgaaacaattactgtgcttatagaagcctttgaaagagaggacataggtgcaggtggaaaattattgatagatagagattaa

SEQ ID NO: 807 - DNA, 837 bp, Methanobrevibacter ruminantium
gtgattgaaatttcagacaaattttatgataagacattcaagttattcagatacaaaaattttgagaacttatgctcaaattgcggtatcttcattgaatttgacggtttcaatgacaaggaattagtggatgatggcggcataacttatattatggatatttcaattaatgataaaaggggatattcagtaattattgaatttcaaagttctgttgtagatgaagcggatattgaacgctttatgaaatatgccactttaacttatattcaatacaaaaaaccagttgaaatttatgttctcagtaccgttgaagaaaagaatagagttattcgccgaagatggaatttcttcaatgagtttactatatgtgtcaaatcgttaaagtctattgatggagataaagttttaaatagtttaaaaaagaaaagcagatttgatgaggattttactggagatgacattgtagatttgctgaccattatttttatgaaatccgtaaaaacgacggttgagctattgaaggaaatctgtctattggttaatgaaattaacgcattggatgaaaaggaattgtatgatatcaagacctttttattgatgtatgttaaaaaattcgtggaagataagcaagaggcaagaattttggaagagttgataggaatgagaaatgatttgtttggtaggacttgggcttccgttagaaatagggcatttttagaaggggaagctagagtggttaggtgtatgtttaatgaaggtattaaaattgaagagatttctaaaattgttggcttggaggagtcccagattttgaaaatgattgggtcaagttag

SEQ ID NO: 808 - DNA, 459 bp, Methanobrevibacter ruminantium
atgcttggtgaaatagaacttaaaaaactctttccagactttgaagatttagttcaaccatctggaatcgatttagagcttgatgaaatatttattcaaaaatcagagggctccctaatagacaatgagaagaatcttccagatattgaagctatggaagggccaatctataccctaaagccacatactgcctatttggcaagcattaggaggaaggttaagattcctaaaggatacactatgttatatctgccacgttctaccttgcttaggtcattcatttccgttcagactgctgtaggggacccggggttctatgggacccttatgtttatgatctataatcatggcgacttcgaatacaaaatcaagtctggagatagaatagctcaagccgttgtatttccagtggaaggctctggagagtataatggctcttatcaggaagaggaaatctaa

SEQ ID NO: 809 - DNA, 1146 bp, Methanobrevibacter ruminantium
ttggttgaaatatcaattgtaattccagtctataatgttgaaaagtacttaagggaatgcttggatagcgctgtcaatcaaacattcaaggatattgaaataatatgcataaatgatggctctacagacagttccttagatattttaaaggaatatcaagagtctgatgatagaattatcatattcaatcaggaaaatcaaggtcctggcgctgcccgtaatcttggaattaataaatctaaaggcaaatacgtatatttcttggattctgacgattatttggaactgaatgcattggaaaagctttacaatatctgtgaggaaaagtcattggactttgtacttttcaagctgcttaacttcaatgacaaaactggaaaaaccttccaaacaaagtattataatatggctttcctaaatgataggataggagataatgtattttcatataaggatttatatgattgcgtttttaatttggcagtgtctccaccagctaagctatataagagagagcttattacagatatcgattatccggaaggcatcatctttgaggataatgtattctttttaaagacccttctaaaggcaaaaagaatctatttccttgatgagtttctatacaatcgccgcaggagggatgactcccttacaagctcaggatctgatgattattatgatataattccttcaatgaattatctatttgacatttgtcgagacctagatgatttcgaactcctgaaggaaggattgtattataaaaagttcaaggagctttatataagattctccaaggtcaatgatgtccataaagaggagtttttcaatctaatcagagaggattgcctaaagcataaggaagaaatcgatgaggatatagcaaatgataagctaaggaagagatctaagttcatatatgaatctgtgctttcttcagatgactataaggagtttcattatagaatcagactttatgataagaataaagagataaatgacttgaaaaaggaaaataagtctcttaaaaatgagaataaaaagcttaaaagttctaataaaaagttaaaaaaggaaaataagcatttcaagtcaactaaggcatataaggtctggaaaaaatattctaaaattaaagattaa

SEQ ID NO: 810 - DNA, 987 bp, Methanobrevibacter ruminantium
atggtagaaattactcttggtcttccaaagggaagcttaaataatgtaaacagaggaaacacttatcaattgtttgtagatgcaggttatgaggtaagaggatacgaacctggaaatgaatcttatgaaataaacattttaaatgacagtgaaatcaaagcattcttaacacgtccacaaagtactcctgttgagcttaacaggggcatggtggatatttccatcgttggagaggactgggttaaggaggaatccgtcttaagcgataacgacatagttaaaataggtgacttgaattatggcgaaactcgtttgattgtagcgattcctaaggaatctccttatgacagtctgtctgaattctttagggcaaatgcagatagggaaagacctattcttgttttcacagaatatccaaatctcacaagaaagcatatcatggaaaatgaggcatatcaagagatttatggagatgcagttcctttcgtccaggtaaggggattaagggacggagacaataagaaggttcaagtaattaactctgacggagccactgaagtctacattgcaaaaggggcagaccttattgtggacaatacccaaacaggaagcagcttgagaaaggcagggctaaaggagcttgaaaccatattgcattcctctgcaggactctatgcaggagtctcatgcaccgaagagaagatggtaaaggctaaaatgatttatgaacagcttttaggtgcagtgactgcaagaaaatactttgacgtcaagttcaatatagcaaatgaggatattgaaaaggtgtctaattatctaattgaaaacaagttctgcagtcatgagccaactgtaaatcatggctcaagcttttcccagatcaatgtattgattcctaaaaacatcttccctgaaatgctagatggtatcaaggaattgggagcaagctcaattataagaagcgatgtcaagcagtatgttatttaa

SEQ ID NO: 811 - DNA, 927 bp, Methanobrevibacter ruminantium
atgttaacatctgttcaaaaggaaatattgcaaactttaataaacctgtatcagaattctgatggcaagtcaatcaagggagaagacattgctgaggtgatgaatagaaaccctggaaccatcaggaatcagatgcagtctcttagaagcttaagtttggttaaaggggtccctggacctcgcggtggctataagcctaccattgaagcatatcataatctaaacatttctgtaagcgacagcaatgccaaggttccggtatataaggaaaataaaaaaatggatgatgtttctgttgcaaagattgaatttacaagcgttcctcaccctggggaatgtgaagctgtaataaaggtattgggaagcattaaggatctccatttgggagacgtgatccgtgtcggaccgacccctgtaaacaatcttggattaatcggcgaaatcgtaggaagggacgatatggacaatatcctccttcttgatatcagcacaataaggagcatccctaaaaatactgtatttgacattgcatcactggaccttatttatctaaagccaggagattcaatcaaggacgctgcatacctcttgtcccacaatcaaatcgatggagctcctgtaataaccgaaggggtagccataggcatggtttcattgattgatatcgtcaacgcattggcggaaggaaaggaaaatgaggacgtaagggacattatgtctaaaaggcttttctttattaataaggacactttgatagccaatgcagtctataagatgtataagttcggaatcagcaggctgatagtggttgatgacgagcatgctcctatcggcgttgtaactcgtacagatcttattgaaaccattacaaactttaagaatttccctcttctttataatatggagatggatgaggaaatggaatga

SEQ ID NO: 812 - DNA, 936 bp, Methanobrevibacter ruminantium
atgaaagttaatcaaataagcataaaaaaagatatgaaggtaagcgaactcatggaggagtttaagggttctggcgtattgggggctggacgagtggctagagcatccaatctgcttgtaaacatgataaacgaccctgatatggacatcttcatgagcatggcaggtcctttggttccaggaggacttagatacatcgtaggcgaccttattcgaaacaaaagaatcaaggtgctgataaccagcggagctaacataacccatgaccttttggagtcctttggaggaaggcattatcgtgacttgggatttaatgatgaggaactgaatgatgctggaattggcagaatatctgatgtatacacccaatcagaggactttgaagtattcgagagcgaaataataaagatattcgaaacaatatccaaaaagatcgataacgataaggataatggaataatatcaattcaaaggcttttaaaagaagtgggttcattaatagaagacgaaaactccatactaagacttgcttatgaaaatgacgtttccatatttgctccagggcttatcgacagcatgttcggtcttcaattatggatgtttacccaagaccacaagcttgttgtggacgctgtgggagacatgcattacctatcagaccttgtattcgaatcagataagatcggtgcaataatgttgggaggaggccttcctaagcattatacccttgcatcaaacctattaaagggaggaatcgattcaggactccagataactatggaccgacctgaaaccggaagcttaagtggcgcccctttagaggaagctaaatcatggtcaaaggcaaagcacggttctaatctggtgacagtggttggtgatgcaactgcattgttcccattgatctatgcagctgctttggataaaatcgactga

SEQ ID NO: 813 - DNA, 648 bp, Methanobrevibacter ruminantium
atgaaagtaaaaaacaatattatacttgcaatggacctaatggatttagcatcagccgaatcagtatgcgaatcaataaaccaatacatagacacaataaagataggatatcccctcacacttgcagagggacttaagacaatagggctctttaaggaaaactttggatataaggttatctgcgattataaagtggcagacattccagccaccaatgaaaagatagcaaatctcacctttgatgccggtgcagatgcaatcatatgccatggctttgtaggccctgacagcgtagaggcctgtaaggcatctgctgaagaccatggaaaggaagtattccttctaaccgagatgtcacatcctggagcaatcagatttttacagaaggatgcagacgatattgcaagaatgggagttgaaatgggaatatccaattacgttgcaccatccacaagaccagacagactgtctgaaattagagacatagttggaaaggactcattcatcatatctccaggggtaggaacccaagggggagaccctaaagagacattgaaatattcaaatgctcttattattggcagatccatctacaatgcggaagaccctgaaactgctactaaggacattattgattcaatacaataa

SEQ ID NO: 814 - DNA, 771 bp, Methanobrevibacter ruminantium
atgatttttgcagctatcctggctggtggggtaggaaacagaatgggcgaagtggataagccaaagcagtttctaacccttggagacaagcctatcctcatacagaccgttgagaagttttatctcaacagcagaatcgatgaagttattgttctatgccataagtattggctaaaccatacaaaggacttgattgaagattatattccaaatgcagaaaacattgtggttgtagaagggggagagctccgtaacgacacaatcatgaatgcagttaaatatatagaggacaatcatgagcttagcgaagatgacataataataacccatgactctgtaaggccatttgtaacccataggatcattatggaaaacatagagaagacccaggaagtgggggcatgcgatacagtgattccagctacagatacaatagttgtctgccatgacggcaatatcataagcgacattcctaacaggaattatatgtatcaaggccagactccacagtcattcaagatattgaagcttaaggaatgcttcaataagctctcagatgaggataaaaggtcattatcagatgcagctaagatattcgtcctcaatggagaggaggttgcgatagtcaagggagaggtattcaacataaagatcacctatccatatgacctaaaggtggcaaatacaataattgacgatgcaaagctcaatatctcagatgcagagactggtgagtataaggtcaatctatatgacttcggtgaggaatag

SEQ ID NO: 815 - DNA, 1023 bp, Methanobrevibacter ruminantium
gtgattaatatagtatataggctggtggctcctaagctcttggaggaagtttatacagagcttaatctggatgttggagttatagtaaggcctaaatatctatcaatatgcaaggcggatcaaaggtactattacggtaagagagtcccagagatcattgaaagcaagttgcctatggctcttatccatgaggcggtgggcactgttgtaaaggacaatacaggcaaattcaatgtgggggacaatgttgtaatgattccaaacattcctcgtgcaagagacaatataataagcgagaactatattccgtcaagcaagttcagatccagcggatatgatggctttatggaagagtatgtgtctctcactgaagacaggcttgtaaagcttccagatgatttaaacatggaagttgcttcttttattgagcttatttcagtggctacacattcaatcaagcgtttcaagcagttttcccaccaaaagaaagacgtgctaggagtatggggggacggaagttttggatacattacttcccttgttcttaaggtgatgtttccagagagcaaggtctatgtctttggaatgcatagggaaaagcttcatatgtttacctttgtggatgaaacctttttggtggatgagattccagataatgttagtgtggatcatgcctttgaatgtgttggaaaggctagcgcaaacaatgcaatcaatcagataattgacataatcaatccagagggcaccattgctctacttggcgttagtgagtttaatgtatcaattgatactaggaccatattggaaaagggaattagggtattcggtaccaacagaagcgctagggaagactttgtttctgtagtcaatctcctcgaggaaaatcctaatatgattcactatcttgagagtcttattactgagatagttgaagtgaataccttaaatgatattaaaagggcttttgagtcagataaaaaccttagatttggaaaaactgtaataaaatgggagatttaa

SEQ ID NO: 816 - DNA, 3039 bp, Methanobrevibacter ruminantium
atgaaaaagaacaattttaataaaaagataactttcgtcgctaattacttttggactagcattaaggaaggttcaaaatccaattcttattttaattatgataattacctaaaaaaatatcctgatgtaaaggaatctggaatgaatccttttaaacactatctattgcatggaattgatgaagagcgcagtactaattttgatgaaaatattaattcatacagtttagttgaaaattccgatttatttgattatgaatattactgtgaaaaaaacaatctgaaatttgattcctatagtaaagcattaatgcattatcttgaaaagggatataagaaaggatacaacccaagtataaaatttaatgcagaagaatattatgaagttcgtcctgatgttaaaagggctgatgtaaaccctttagttcattatttaaagtatggaaaaattgaagtaacctcaatgactgaaaatttaaatcttaaagagtatcagctcgttaaaaattcaaatttatttgattataattattatatggaaaaaaatcatttggatttaagaaacgaaaccgaggcaatttatcattatttggaaataggttataaaaagggatataaccctagcaataagttcaatggtgaaatttattttaagaaaaatccggatattgaggaatctggctggaaccctttagttcattatttgaaatatggtcaaaaagaagagcgtactgataaatgtgataaaaacctgaaagaatattctttagttaaggaatcaggattatttgattatcaattttataaagataaatatgatttagatttaaattcatataagcgcggtttaattcattatttggaatttggttacaaaagaggatataaacctagcagaaattttgatggggaagaatacttaaaaagatatcctgaagttaaaaaagcaggatttaatcctttagttcattatttgaagtatggtgtgaatgaggaaagaataggattaagaagaataagctttaaaaatttcaacaagaactatgatgttgaagccattttagaaaatatagataatgatgttacaatcttattgaatgttgaagactcaaacaacttgaaagaatgtattgaaaacattaagagcaccactaaagactataagataattttaattcatgaaaatcttgatgatgaggatttggaatatataaaatccaataatgatatagaacttttaagaaggagccctcatgaatcattcatcaatgcattgaataatatattggacaatgccaaaaatgatatcatctttcttaaaaataacatcagaacttttgagaaatggattttcaaattaacagttgctgcatattcagatgatcgcattggatttgttagccctatttcaaattattctactgttagcctaataaatattgaagaagatgagaaatcaagcgaatttataagtaatatttcaaaaagagattatgaagaatctccgttacctaatgactcttgtgtctttataaaaaaggatgtctttaaggaattaaaatttgatgaaagttcaaacgaggaaaattggtttgctacttttatagaccgtggattagaaaagggatggaaatcaattttagatgattcaacatatgtttactatcagtttaatgaggtagaaccccaacaagcagatgaatatgattattcaactccctatgtattagaaaataggccttcagttaaatttattaattctgatgcatttaacaacagttttcaaaatattcatgagtatgctgatgataatcttgaagagaatattcaagaaaagacaaggaaaaatatcctatttgctatgcattatgggggaggagtggaatttacagtaaaagatattgttaatgcgataaaaaatgattatgaatgttatgttttaagggcatttaagaataaaatgaaattatataaagttttcaacgattattttatttctataaaagaatttaatattaaatatccttggactcctaaaatgattcacagtgatgaatataaacagatttatttttatatattgattaattataatatagacattttagaaatcgatcatttattattgcatacatttgacttgcaggagcttgcaaaaaaactggatattcctataatcctaacattgcatgatttttattatatttgtccttcatatttcctattggatgaaaataataaatattgcggtggttactgtggtgatcaacctagaaattgcagtaccagagtcacttggattgatttgcctgcaaatattgttgaatggaaaaatcaatggcaggaatatatgaaagaactatttggaatgtgtgattatattctcactgcaacagactttactaaggatatgttcttagaacattatgacagtttaaaaagtgatgatataacaattatagagcatggtcgtgatttaatacgttatgataataattatacagttcctaatatatatcaaccgattaaaatattaattcctggagttatagggcctcataaaggcttagattttattaaagaattgaaaggatttgatgacgacaatcgcttggaataccatttcattggacaagtggatgatgaattgaaatcaatgggcatatatcatggtccttatgaacgggaagatttcgctaagtgggtgtttaaaattaaaccatcattcattggaatattctctgtctgtgccgagacatattcccatacattgactgaatccatatgttctggggtccctgttttagcatctaatcttggtgctttaaaaactaggattgaatctcaagggggaggatggctggtaaatattgatgatgctgaagagacatatgaacaaattttagatatttccagtaaaaaagaggagtataaatttgtaacggaaaatctaaaggatattaggatttccagttcagaagaaatgggaagcaaatataaggaaatttatgataagctaaccaagaaagaagataaatga

SEQ ID NO: 817 - DNA, 1467 bp, Methanobrevibacter ruminantium
atgaatcaaaaaagagatgaattaaattctaaacaaaatataaacttggattcagaaaatgaaatttcctcatcagaaattaatcttaagaaaagagatcctcaaaataaatcagatttaatagctcagcaacgcatgaaagctaaaagggaattaattgaaagatataatatgtctgaaagtgaggctgaaagtactctcaaaagcatagaaaataaggtaatgcaaaagaaaaataaaaaaataactaatgaaaaagagatagaaattaattcaaataaagttagaatggatgataaaaattgttctttggagaatagcgctggtgtttcagaaaacaaggataaaaatgatgaagctataaaaatacaaagccaaaattctcaaattgaaggagaatctgaggaaattattccagagcatgttttagaaagacaaaatcctaataaaattgataatagtgattatgaaataaattctgtttccgatacactgcctgtaatagaggaaggggaatcaaagcctattcaaaatgccgaggatgaaatcgtaaagaaagagcttgttgattctgtttctgatgtggtgcctgttgtgggagagaaagaagaaaataatgaacctataattaagaaagacgattcatcagatgtagatgatgtcttgtcatcaataattccagaatatcatcagaaatcatcaattgaagtaaataatgtttcattaagttttaatattgaaaatgataagatagataatcttaaggaatatattattcgtaccctaaaaaggaccaaagagaaaaaaattaaatttcatgctttaaacaatatcacttttaaaatctataaaggtgaaaaagtagggattattggatataatggtgcaggaaaaagcacattgctaaatgttatcacaggtatttatgaacctgatgaaggaaatgtgaaaacatatggaaaaatttctccattattgtctttaggtgcaggttttgattataattattctggaagagaaaatatctacttaaatggagcagttttaggttatgataagaagtttttagaatcaaaatttgatgaaattgtggaattttcagaacttcaagattttattgatttgcctattaaaaactattcttcaggaatgcttgcaaaattagggttctctatagcaacaattgtcgaacctgatattttgattattgatgaggtgcttggagtaggagatgtgaactttcagaagaaaagtagtaataaaatcaaatctttaatggatgggggaacaactgttctgcttgtttcacattctattgttcagattagagagatatgtgacaaggctatatggattgataaaggggagctaagagagtttggcgaagttaatgaagtttgcgatcattaccttaaagatgcccagaatgccactaaaaatcaagtgaaagatattagatttaattaa

SEQ ID NO: 818 - DNA, 1224 bp, Methanobrevibacter ruminantium
atgaaaattacagttgcgggagtgggatatgtagggctttctattgctattctgcttgcccagaaacatgatgtaaccgcaattacaactactgaatcaaaggcagaaaaacttaaccaattcataagtcccatcagagatgatgagattgagaggttttttaaggagactcgtgatggaaaaaggaaattaaaccttcacacaactactgataaagaatctgcatataaaaatgcggatcttgtcattatagcagcaccgacaaactatgatgatgtcaaccatttttttgacacatcagctgttgaagatgccatagaatggactctcaaggtcaatccagatgttttgatggtcattaagtcaacaatacctgtgggatatagcgagtctgttcgtgaaaagtatggtgtcaaaaacatcatattctctccggaattcctccgtgagtcaaaggcactttatgatatgctccatccaagcagaataattgtgggatgcgatgacgaccaaaaagaagatgcacaaatgtttgtagaccttcttttggaaggtgtgagattggaagaaaagagatctgattctccaaagcaggatattcctattctaatagcacccttcacagaggttgaagcaagcaagcttttccaaaacacctatcttgcattaagggtaagctacttcaatgaacttgacacctttgcccagaccaaaggtcttaacacaaatataatcattgactgtgtgtgcatggacccaagaatcggaggacactataacaatccatcattcggatacggaggttattgtcttcctaaggatacaaaacaattattagcaaattgcaaggatgttccacaggccctaattgaggcaatagtcaattcaaatgctgtgcgaaaggaattcatcgccgaccagattatttcaaataatccaaaaacagttggcatatataggcttattatgaaaagcaacagcgataacttccgcgcatccgccatacaggatgttataaaaatgataaaagcagaaggaattaaaataatcatctatgaacctatattggatgatggaagtgagttccttaaatcagaagtggtaaatgatttagatatctttaaaagagaaagcgatatcatccttgcaaacagatttgaccaagatattctcggtgatgttgcagataaagtatatacaagagatatcttcggaagagattga

SEQ ID NO: 819 - DNA, 2682 bp, Methanobrevibacter ruminantium
atggagataagatataaaaatttattaaaagtttttactatttttcttgttttactcatcagttgcggatttgcctcagcagtcagtgatttagatgaaggtaattctgcaaatattgttgataatggtgatttatcattatctgacaatatgatgagtgaatctgcagataattgtaaaaatttggaaactattgaggagtctcatactttcagtgaaaaaaacactgttaaagacgtttcatatggactttcaacacctatagatggaaatacttttgaagatatccaaactgctattgataatgctgctgatggagatattattgaacttaatggtacttattttggaaacgggtctgatataaaaattacaaaagatttaacaatcagcggaaatcttgaaacaatattggatgctaaaaacaaatcaggtattttttatgttaactcaaataacgtaactttacaaaacttaaaattttataattcaatagttcctgaatatggaagtgcggttcattttttaagtaatggttctgtgattaattgtacttttataaataatactgctggtggagtttatggtactattgattacttttggtctactggaggtgtagtatatttggccaagggcaatggctctgtgattaattgtacttttataaataatactgctaatgcagatggcggtgcaatttattgtggagttgatggcgggtctgtgattaattgtacatttattaataatactgcaaaagagttagggggtgccatctatattggcggcggtcatgacggtggcgctcattattcaaatgtttatgattgctatgtagataattgcgtatttattaacaatactgctggtgaaggtgctgggatttattatggcggaggcggtttaatatttaattgtacttttattaataacactgctcgttttggagattcaattctagtaaataatatgtattatcctaacactgtgtctgatatgaaaactcttactattaaggaatgtgattttaagagtaataaagagggttggggatatgtagtagttaattataaagcatacaaaaacactatctgtggactttgtgaaattattgattcaaatttctctaatgaacaagcagaagattatataaatatttataatcaaggaaatatttatttgtctggaaacaagatttcatctaattacgctacaatatctaatgatttaatagcttatggtaataatgcaaatattacctcacaaacaagccttgtaattttggataatactactaaaagtgtagaaaaatattctccatttgatgtttatgcagttcttgtagatgatcaaggaaattatattcgtgatgaaaacattagtttatttattggttctaagaatgtaactggcgtatttgataatgtaaacttattcaaatatcatttaaatgatttaagttcattaaattatagaactcttgtttcaggcaattatgatggagcaaaagatttggttgttaaaacaggcgttttacagttagatgtagaggtcgatattgacttggattatgaggatgataatgttattataaaacttaaagattctgaaggaaatcctatttccggagagtctgtttcacttttaatagataataatactagctctgtgaaaactgactcaaatggtgaagctaaagttccagttaatgaaatatctatggtcaaggcaattttcactgatggttttggagttaatgtcagttcctatttagtggtaaaagcagttgaaaaggtaaaacttgttccaacttttgccaatgcaaaaatttcattagatgttgaagataattgcagtgctgttattgtcactttgaaagatttatccggcaaccctatcagttctgcaaaacttgatgcacttgttaatggtgctggcaaaactttaatcaccaacgcttcaggtcaggcaaaaattgatattgaaggtaacgctacagtggaagtgacttatattgatgcagagaatgctaatgcaacagtatcaagcagccttactgtaataaagaatgttgactcagttccggttattccaaataggacagccactaatatcatttgtaaagatatgaatacaactgcagtagccaaaccggatggaagaataggaaaatacttcgaggtcactttagttgatgtaaatggcaaggcattagctaataaatcagttaatataggattcaatggagcagtttataatcttacaacaaatgaaaccgggggcgcaaaacttcaaatcaaccttggatacgaaggcaaatacacctttgcaatagcattcctaggtgacgacaactatactggatcttttaaagtggcccttatttcagtaagtaaacacagtccaaaactttcagcacctgcaaaaacatataaggcaaatgcaaaaactaaaacaattaccgctacattcaaaacatcaaatggaaatgcaatcagcggcaagaaaataagtttcaacattaatggaaaaacttatagcggaactacaaactcaaaaggagtcgccagtgtgaagataagtttaaacaagaaaggaacttatagttgcactgccaaatatgcaggagatggaatgtataaagcaacaagcactaaattcaatgtaaaaatagtataa

SEQ ID NO: 820 - DNA, 3858 bp, Methanobrevibacter ruminantium
atggcagcttacaatagcggagcatatatccaagagactctagactcactaatcaatcaaagccttgactttaaggaaaacatccaagttattatcgtaaatgatgcaagcagtgacaatacagagtctgtatgccaagagtacatcaaaaactatcctaataacatcatactaatcaacaacagaatcaactgcggccctgcccatacaagaaatgtgggcctccattatgcagaaggggagataatcaactttttagacagtgatgactacatatcaaagaagacctttgaacgtgtagattccttctttgaagactttgttcatgtggacatggcatcaatcccaatcaagtttgtagggtccaagcgtggagaccatccattaaactataaatataagggcacaggggtcataaatctcctaaataatcctgatgccatacagctatcctctgcatcagcattcttcagaagcgacattcttaaagctagccttttcaatcattccaggtctcgctacgatggatctgtctctgttgtttacaatgacaacagtcctgtttcagattcaattcctatgatattcaatgaaaacctatcagtctctgaagatgctcttctaatcaatcagatgctccttagaaaccctcttcttggaatactctcaaactgcacttatttttataggaagaaagcaactgataacacttccctaatctctgattccgccaatcacaggtcttactttacatccagagtaaataactatatgataaggcttattaacgattcccttgacctttatggaaaggttccagaattcattcaatatgtggtaatgtatgaccttcaatggatcatggagataaggcaggtggatcacctattggacctagaagaccttactcacctttatgacaagctaatctccattctattctatattggagacaaggtgatattcaatcaaaggtccatcccatctatcctaaagtcacatatccttcttctcaagtatttcggatggggatatcttgatgataagacatttaattttaaacagattgataaaaagtattatgatgagcatggtaacctcataccatatattgaaaaagaccaactatctttcattattcaaaagttggagttaaataaaatatatcttgacatagttgatattaaaaatattaagtctaaaattaatttaaataataacaataatggcactccagatgatgataaaaaggatgatggaaagaatagtcatgatttctatctttcttctcaagatgatgaagacagacaggagctatatctctctggaatgattacaagctttttcaacagcgacttcgacatctatgctatcgtaagcgaaaaggacaagagcagctcccatattcttgaaaaggaaatcaaggtcaaaaagataagctatcctcagcgggacaacctttcccttaacttcaactatggatataaccaatgctttgaggttaggatacccttgagcgaaaagacaagtagaatttccttccgcatgggctttaagagcctgaatgaggtctgcaattccctaggcattgagactctcagcgaggattcatttgactatataaatcatcatgaccttgcattttccggagaccttcttatagactataatcacacttcacgcctatctcaggtgtccaactataagatatccaaggattatcttatcctggacaacggaaatcatatgatagttagaaaaagaagcctcctaactactataaagtatgaattggtcacctttgcctctatccttggtgaacgagaggagggctggagaaccggaatccttcttagggctctttactttattctttatcctttctatcgcaataagcgcatctggatatttatggatcttccatatactgccgatgacaacggtcttcaattgttcaagtctgttcggaatatggacaagcttaagttggaggactataataagcttttggacttggatgaaagccttctttcacgtgagaggcatccatacaaatacgaattgtttgaaggcaaggacataggtttggtagggcttataaaaaacgtatttagttctataaagaatgtattctctagggattctgatgatgatgaaaatggaaaggtcaagttcatcaaggggggctctttaggtttggatgataagtatgatgagcttgaggataatggagattattcagattacttgaatgagcactttggatttgccgatgtgaatgaggactatttggacaaccaggacattcaagtggaaggctctagctttgaggatgacattgagcatagctccaagttcagaaggaatgtctatggaaaggccggatttgttaagtcattcgatgccaaagtggatgcaaagtataatgattctctgaatagccttgagaataggtttgataagagagtcagcaatataaagacaagaacaagaaatgcagatgtcagggagaaagttggcttgtctagagatagggatgacaatttctccaagggatttagcccgattgactttatttatggctttgacttgtctaagttcctaagcgaaaacagctttgtatatcttgtgaattatatattgtatcgcatctctaagctgcttttaagacctagaaagatcaagaggattgacaatagaaaaatcaagaagtactttactttggagcagtctacaagccattttaataatgttcgccatatggaaaaccagtatattgcaagttccaatagggataagcttcgtaaattgcttgcccgtgaaaagcagagcaatgagtataatgctcttaaaaagataggtcctgtacttgcctataagtcattgaagcataggatctatgcattatatgctgaggtgattgtctcatctcatcctgataacaatcttatctatccattctatggtaatttcccgcatgtggcgggccttgttaaggctaagactgtgttccttcagcatggagttacaaaggatgatgtttcattctggctgaatcgctttgacaagaaccttgacatgatcgttactgtatctgatttggaaagggattcattcttcccacgttttgatggtgatggtgagtatattagttcttattatggctatgataaagagactgtccaagtacttggatttcctagattcgactatcttgagagtttagaggataaaaaagagatagtgatcatgccaacttggagaaggcagttgcataaccttaaaaaggaagagtttgtaaacaccaatttctttaggacattcaatgcccttataaatgataaggtattgttggattatttggattctcatggatataagcttgtatttaagccacatcctaacttaaataagtatattggtctttttgataaggattcaagggtcgaatttgacttgaatgacttgaattttgctgaaaacagtaaggatgggactgccaaatatggatctcgaagatatgcagatatattcaatcattcctctttgattgttacagacttttcttccgtttcctttgacttcgcctatcttaagaagcctatcatttattatcattatgataatgactatcactttgacagcgagaatggctactttaattatgagtctatgggctttggtccagtcataaaaagtcataaggagttggttatgagcattattggctctattgagtctggatgcacaatggatgagctttataagggtcgtgttgataagttctttaagtatcatgatagggacaattcaagacgtgtttataaggccatattggagatggataagtattattag

SEQ ID NO: 821 - DNA, 285 bp, Methanobrevibacter ruminantium
atggctggaactacaaaccttgtggatgcaatgcttgttcttgcattgggatttctcatctttgcagttatcggctggaacttacaaagcgttatattcagtgatatggaccctcaggagcgacaggccactatggagtcaattaatcaaatcactaatgtaactcaaggagaacagttaaacagtactccagacacatcaaaccagtctggagaaggttatgtagaacaaggtaaagtttataaggattcgaaaacgggtaatctgattatggttgaaacttaa

SEQ ID NO: 822 - DNA, 642 bp, Methanobrevibacter ruminantium
atgacaattcctggtggtgacttcttaaccactggacttaatttaatttcacaaagtcttttgataccggtagttatcatactattggtttttgttgtagttgtagtgatttcacttggagggcttatctatgaatacacttcaaggacaaaggtatctgtagatgacgtgtccaatctgattctggagatttccgattcagggtctgttgattccatgaagtctgcaatagcaaactctccgattcctaagcttcaaaaggacattctgcttaagatagcaagcacaggaaatatgagccctaatacaagagaggcatttgcccgtaagctcatcgagaatgaagaggggctaactgacaagtcccttgagataactgacataattacacgtatcggccctacacttggtttgatgggtactcttatcccattaggtacaggtcttgcagcacttggctctggagacgtcaatactttgtccgagtccttgattgttgcatttgatacaactgtagtgggtatcggttccggtgctttggcttatgttatttcaaagcttagaaataggtggtatgaggaatatctatctaatttagatgttttatctgatgctgtattggattttatggctaaacattag

SEQ ID NO: 823 - DNA, 882 bp, Methanobrevibacter ruminantium
atgaatcaaaaactatcaaattacttcaatatgggattgtcactatacctattgcttgatttaatccttataacattcacattagtttttaagatagaaaataatttatattatataataatagccatagacaccatattatgtgttattttaatatatgagttttataatagattcaaaaccgctgaaaataagattcacttcagcatcagaaactctacagaaatattagctggaatccctattgacctgattttccttccatttgctcctaatcttactgtttttttaaccattttcaatcttctcaagtttctaaagataatcggactctttttggaattctttgaaacaattgacgtattccttaaaaagacccatcttgatgagattttaggattggccattcttgtaatccttgtatcaacccttggaatatacctctttgatccaagcataaacagcatattcgacagcctatggtttgtcctatccacaatcacaactgtaggatatggagacgtgcttccaaattcatatattggaaaagtaatagggattttaatattgatattcggagtgctaatcttttcagcaataacaggagcaatgacctcctactttgcaagaaaggtattcgccacaaaggactttaacattacagaaaatgacgacaatatccggcttctaaaggaagacttaagcttcaacaagaaaaatctaaacaatgcaaatgaaaaaatagataaaatcaataatgatgttgaaaagcttaaaagagaattgaatgaaatgaaagaggaattaagagaatctagacaattaaataaggaacttaaagaagagattgttattttaaatgagaatttgaaaaataaatga

SEQ ID NO: 824 - DNA, 360 bp, Methanobrevibacter ruminantium
atgactatgaaaacagggagcgaattaaaattcaatgacgattatgaatatatgacctttgatcttgaccaggaatttctattgggggaattaggccaagatgaaataagggacaagatcataaccgctcaagagatattggataatcatttggccaatccttatgaggcaggccaagagattgaaattgagaatccctttgaaaagcctattctaagaaagtacatcaaggtaaatgaggtgactgaggacatgatagatataatatattatcaggtccgaaatcattatgaagtttataaatttgttactttgactgacccggctcataggggacgtattttaattcctaaagactga

SEQ ID NO: 825 - DNA, 474 bp, Methanobrevibacter ruminantium
atgcaatttgatgaattgatggaaaaaggagatcaagctagaaaggataggaattatgaagaggctttggattggtatcaaaaagcattgaaagaagataaaagacgtagcgaagcttggaatatgaaagcaagtacattaggtctcttaggtaggcctgatgaggctatcgaagcttttgacaaatccttggagcttgactttaataacgaacagacctggtttttaaaaggaatgaccttatttgctgtagacaggttcaatgaggctgattcctgctttgataaggctgtaaattcagacccacacaatccggtttattggaagtataagggaatggtattaagccagttaggtcacaatcatgacgccttggaatgtcttgacaatgcattggaattgaatcctgatgatgaggctattcttgtattcaggcatactgttgttgaagccatagaaaaagaagataattaa

SEQ ID NO: 826 - DNA, 1956 bp, Methanobrevibacter ruminantium
ttgaaagaattcaaactgaaatcaccatataagcctcttggagaccagccacaagctatcgaatcattatcaaacggaatcaaagagggattccacgaacagaccttgctaggagtgacaggctccggcaaaacttataccatggcaaacattatacaaaacgtacagaagccaactcttatcatatcacataacaagacccttgctgcacagctttatgaagaattcaaggtctttttcccagataatgcagttgaatactttgtcagctactacgactattaccagcctgaggcatatgtccctagaacagacactttcatcgacaaggaagcctcaataaacgaggacatagacataatgaggcattctgccacacagtctctcctatctcgtgacgatgtcatcgtagtaagcagcgtatcctgcatctacggaataggttcccctgaagactatggggagtttgcattctccataaatgtcggagacatctacgaccgtggagatatacttagaaagctgatctttatgcaatatgaaagaaatgacattgcatttgaaagaggtcagtttagggtaagaggagatgttatcgaaataaaccctgttcatggaactcccccaataagaatcgagctcttcggagatgaaatagatgcaataagcctcataaacccagtgactgggatgagagaggaaagcataaataggtatgtaatatttccagcaaagcactttgtagtaggtgcagacagaatggatcaagcccttaaggacatagaagcagagcttcaatcaaggctcaatgagctgaaccttgagggcaagtatcttgaagctcaaaggcttgagcaaaggacaagattcgatttagagatgcttcgggagatgggatactgtccaggaatcgaaaactattccatgcacctttcagggagaaactggggagacatgccttattcccttcttaaatacttcccagatgactatcttacaataatagacgagtcccacgtaaccgttccccagattaggggaatgtacaatggagacagagcaagaaaggaaacacttgtaaactatggattccgccttccatcagcaaaggaaaacaggccacttagatttgatgagtttgaagcaagccaaaaccaggtattatatgtttcagcaacaccagggccttatgagctatcaagaagcaagaatgtggtagaacagatcatccgtccaacagggcttgttgaccctaaaataacaataagaccagttaagggacaggttgaagacctcctaggagaagtaaggcgaaaggtggagcatgaccaaagaatacttgtaaccactttgacaaaaagaatggccgaagacctgaccgactattatgcaaagattggaatcaaggtaagataccttcattcagagattgataccctggaaagggttgaaataatagacgacctaagaaggggagagtttgatgtccttgtaggagtaaacctcctaagggaaggacttgacctgccagaggtaggccttgtagcgattctggatgcagataaggaaggatttttacgctctgagacatcccttattcagacaataggaagggctgcaagaaacgtagacggagaggtattgatgtatgttgatgagatgactgattcagtcaggaatgcagtggacattacaaacaagagaagaaagctgcagatggcatacaatgagaagtataatatcactccaaagaccacacaaagaacccttaaggagaagaagcttgccgacagagccccatcaagagatgacttaagaggcatgcctaaagatgaacttaagctattgattaaggaccttgaagcagaaatgagagaggctgctaataatcttgagttcgagaaggccgccagcttgagagatcagattgttgccttaaagagcattaaaaaatag

SEQ ID NO: 827 - DNA, 1917 bp, Methanobrevibacter ruminantium
atgaaatttaagaattcacatatcttactcgtttcattaatatccattttcctattgttgagcataagcgcagcttctgcagctgactctgatattgcagcggatgacagctcagtggatattgttgaaatagaagatataaatataaaagaaagccactatctctgtgatgatgcctctactggctcagaagatctaagtggtgatgaaaatacaagtgcatcaggcactgatgacgctacaggtggaaatgacactgatgctacaggtggagatgacactggaaatgctacaagtgtaaatggcactgaaaatgttactgatagcaatggtacaaatgccactaatggaacaaatgcaaccaataataccaagtatgacggtcctgtaaccaatgcaaccatcattcctgtaagcacttctgctgattatcaatatggaaacttcacattcaaggtagtggacaatgcaaccggagagcctttggcaaatcaaaagatatctgtaagcggagtatatttctttacatttaataacggatcatccatatccactacaaaggtattcactaccaacagcaacggtttgcttgtcattgcaaacaagaacttaaataagaaccttgacacacttggtatggtatataatttcaccgctcttgatgtgggcaaatacgaccttaccttcagcggaaatgacagcttaaagattgttgtcaacaataccctcccaatcactgtaaataaggtcaatgcagaaattaaggcaagcaacttcaaagatgaagttggaacaagtaaaaaatatacatttaagcttgtaaataagaatacaggtactgttatcaaattagccagcctcaagttccaaatcaagttaaacagttcaggatatacaacctataattcaacaaccaacctttcaggtcaagtgggatataacctgaaccttttggccggcacatatcctgttagaatcgtcaataatgattcaaatctaaaggctagcactgtaagccgcaatgttacattgactaaaaaggtaggtgtactctctgcaagcaacagaactatcctttacaactcagcacctactgcaataatcaaattgactgataagaaaacaggcaaggcagttgcaggagcagtcctcaaggtcagagtatacacaacaagcaaaaaatatagcgatttggcattttacactgacaataaaggacaagtcagcttcaaggcagcattaagcttaggcaagcacaagatgattatcagcaccttggacaataactacactgcaagcagcattaccagatatgtaaccttaaagaaaaccactggtaagataagcgctcctaaaatcagcgctacctataagtctggcaaattgtatacaattaccttaaagaatgctaaaaacggcaatgcaatgtatggatccacattgaacatcaggatctttgttacaagcaaaagctattacaaatacactggcatgactgacggaaacggtaaggtcaatatcaacaccagttccctaaagccaggtacttacaaggtttctgtatctagcggagattcaggattcactgcaaaggcagctacaggtcaaataaaaatcactaagatacctcttaagttgtccccaactgcatataaggaaaaatacaattccggcaaaaccttcaagatcaaggtaactaataagaataccaataagatcatttcaggcataaaggtaactgtaaaggtttacacttcagccaagaaatataagacatacactgtaaagaccactaataagggtattgcttatttgaaggttactcaaaagccaggaacttataagactgtagtaagtctttctaacgcttattactcagcaagtgcagtaacttccaagataactgtaacaaaatag

SEQ ID NO: 828 - DNA, 693 bp, Methanobrevibacter ruminantium
gtgtatagcgaaaccaaaatagcaattccaatatttcaaaagaaaaaggaagatgtgatatctgttgctcaagactgcatcataaaaggtgcagatattcttgaactacgaatagacggcatggaaaatcctaatccaaagctagtaagggagattattgaagagataaactttccaataattgcaacaaacagaacaacaagggaaggaggattcttcaagggcaccgataaggacaggatagccatattaagagaatgtgcagatgtggcagactttgttgacgttgaacttcagacaaaccgaaagcttattgaatccattacagaaactggagtaaaaacaatcatttcctatcataactttaagcagacccctgatttggactttttgattgacattgtaaatcaggaaaaagagcttggagacattgcaaagatagccgttatgccaaataacttagaagacactcttactgttctagcgattctatctcactttgatgacactgtagcgatttcaatgggagaattaggaagttatacaagggttattgcatctaaattcaatgcccctttcacatttgctgtggctaatgacactacagcccctggacagatagacattgatacaatgagggtcttgctaaatagtgacttgatcaatactgatgaatttgagaacaatgaataa

SEQ ID NO: 829 - DNA, 726 bp, Methanobrevibacter ruminantium
atgaaagttgtagctattggtgcggatatttcaaacaatgatgtaagcgtttccaagtcattggttgaaaatatagagaaggacattcctaaactcattgatttaggagctaaaagggcagcattgacaaatgtcacaggagatgatgtggtaatctctgccttttgtgaagatgatcttttagaaactgtcaatcgtggaattgcagacatactaagggcaaatgcagagagcttaggtgaccttgctggagtttcagatgaccctagcaaggcaggagagggactctcatatgccgaggcaagcttgaacgatgacggctatcaggatgcaattatcatggcctttgacacctatggtggagaaggctttgtaaaggatgttgcaaactctgcaattgaggctgcaagtggcatgaagtctgtaatcgacgtttcagatagaataggctcaagaacagacattccaggtgttggctatgtgtctgaaaatgatacagatgatcctgttgtggttgtttcagtaaaagacctagaacagatagctgtggtggctggagccatgattggcgcagcacttggatgcaagaacacctatcttgtaaagcggcataccccatgcaatgtgcttcctggaagtgtgcttgtatctgtaactgcattcatgaatggaaatatgattgacctatctataccattcgagaacaaaacaagaattttaggctaa

SEQ ID NO: 830 - DNA, 870 bp, Methanobrevibacter ruminantium
atgataattttagatgaaaatgtaaaatgtttagttcaaggaattactggaaaacaaggttcattccacactgaacagatgttaaaatacaatacaaaaatcgtagcaggagtaactccaggtaaaggcggacaagagattctaggagttcctgtttttgattccattgaggaagctaaggaaaatactgatgtgaatgcttcaattatctttgtgccagcgccatttgctaaggatgctgcctttgaatcaattgaccatttggatcttgtaattataattaccagagccacattccctatccatgacaccatggaaatcatggcttatgcaaaggctaagggagtgactgtcataggacctaacactccaggagtaatctctcctaaagtgggcaagcttggaatcatgccaacccatattttctcagaaggaactgttggtgtcatctctagaagcggtaccttgacctatgagattgcaagtcaattgagccgtgcagaaatcggacagagcacttgtgtaggaattggcggagaccctgttatcggtaccccttacattgaagtcttgcagatgtttgaagacgatcctgaaaccactgaaatagtcttaatcggtgagatcggaggatctgctgaagaggatgctgcagcatacattaaggaaaacattacaaagcctgtcgttgcatacattgcaggtatctctgcacctcctggaaagaggatgggtcacgcaggagctatcattgcaggtaattctggaactgctaaaagtaaaatggaagctttggaatctgctggtgtaaaggttgctcgcaagccttctgaaatcgtagaatacattaaggaaattcgtggagaataa

SEQ ID NO: 831 - DNA, 1203 bp, Methanobrevibacter ruminantium
atggacaaggaagaaatcattaataaactaatggctggtgaaatgaagctttatcagattgataaattcacagaaaatgctacagaggctttggatattagaagggaatttatagaaagacattccaattgtgagcttaatcagatagccaattacactttggatatggaaaaggcattttccaaaaacattgaaaaccctataggaaccgttcaagtacctattggagttgtcggcccattaaaaatcaatggggaacatgcagatgatgaattctttgttcctttagccacatctgaaggcgctttgcttgcttcagtcaataggggctgctctgctattacagcatctggaggagtcaatgcaagagtgattggagataagatgactagggctcctgttataaagacagattctgttgtagaggccgttaaggtaaaatcatggtttgagactaagtttgatgagctaaaatccattgcagagtccaccacaagccatggaaagctggtgaagatagatcctatcataatcgttggaaactatgtctatcctagattcgtatactctacaggagacagcatgggaatgaatatggttacaatagctacagaaaaggttctctctaagttatatgatgatttgggagttcatgcgattgcattaagcggaaatctttgtgtggataagaagcctgctgcaatcaaccttgttgaaggaaggggaaagactgtagttgcagacatattgattccagaggaaatagtaaaatccaagcttaagacaactgcaaaggcaatggaagaggtaaacattgcaaagaacctgattggatctgctgcagcaggaagcatggctttcaatgcacactttgctaatatgattggtgcaatattcttggcaactggtcaggatgaggcccatgttgtggaaggttcccttggaataacaacagcagaggacagggatggagacttgtattttgctgtaagcatgccggacttacctattgcaacaattggcggtggaacaaggcttgaaacagcaagcgaaggattaagcattattgattgtttaggttcaggcaaggtcaataagtttgcagagattgttatttcaactgttcttgcaggtgaattatctttagttggagctttagcagctggacatttggctaaagcacatcaagaactaggcagatag

SEQ ID NO: 832 - DNA, 405 bp, Methanobrevibacter ruminantium
atgtctgataaggagtatattgattttaaaaaggaatttaaagactttgctcaagatttggaaaatagcaagcctatttttgatgatgaagatttgtcctttgatgattttgataatctcataggcaatattggagaaaataatctttcagatgattctattgacagatatggttcaataaatgatgatttagataaattggatagtctttttggaagcgattgtccggaaatcactcttgaaacagagaacatgctaatgaatttaagcattaaaaaggattattcaaagattaaagacttcaatttaagaaagaaagagttttttaaggatttaaaggatttcattgatgaatttgaatcaactgaagaatcagatgaattgatgaagttttatgatgattag

SEQ ID NO: 833 - DNA, 156 bp, Methanobrevibacter ruminantium
atgtgtagttcaggaggcccaatggctgacctttcaatgaaaaaattgaaaacaaaaaaatacaaatgtcttgattgtggaaatgaatttaaaggattaggcagaaaggtaatctgtccttcatgccaaagcgacaatgttgaattaagagaatag

SEQ ID NO: 834 - DNA, 405 bp, Methanobrevibacter ruminantium
atggtaggaatagctaaggctggagaggataagatgctttttataggaactccagacaatgatgagattgttcagtatcttgaaaaggatgatcttattgcagtttcctcattcaatcttggcaagaagtatgaaaaggggataaggtctctcatttatcttacccgcgatatcgaatctccgataatcgttcttccaaagaaccatcccgcttcaaagcgacttaagatggtcttatcagttggtgaaaacgttaggttggattgtggaataattcctggaacccatccagagcaggatatattatgctcctgtgacagtttatctggattgaatattgtgaaatccgccgatggtgttataatagagggaaatgttcctgattataagattgagcctttttga

SEQ ID NO: 835 - DNA, 390 bp, Methanobrevibacter ruminantium
atggaagaaaacgaaatttctcctttctttacaattaaaaagataagagaaggagactccattcaattggatcaaaaatacattaaggtcagatcaaatacagacaaggtaattgcaattcactataaggcacctatagaaagaacaattgaacttgaaatgttctttgaagattataatcctattgaaaggttaaattacaatattggcgataccggttgggtaggtgcaaatttcagaggtctcatcgatggaaaggacaagtccttgccagttgattatgattataagatattgctattggaagaatataaatgtttaagcaaggtagagcttaaacatgtaaaaagaagttctaaatttaggcctaactatactatagctaaataa

SEQ ID NO: 836 - DNA, 519 bp, Methanobrevibacter ruminantium
atgaaagtcactgtttttcatgcaaacgaatgcgataagaagaaatgcacagcctttaagatggaaaagcaaggaaagtgcagaatagtctataagattcatcagattcctcgtggtgcagttgtattgaatccatttagcgaaaaagcagtatcctttgaagatagggggcttgtagaggataagggagttgtaggacttgactgctcctggaataaggtgtcaaagtctgctagtttcttctccttgtcaaagtatcacagatcccttcctttccttattgctgcaaatccggttaatttcggcaagccatgcatattgtcaacaaatgaggcgatagctgccacattctatataactggattcaaggaagaggctaatcatattatggatggatttaaatggggccattcatttattgaactaaattatgacttgcttgaggcttatagctctgtaaaaacaagtgctgaagttgtggagatacagaatgagttcttggctgctcatgagaaatga

SEQ ID NO: 837 - DNA, 162 bp, Methanobrevibacter ruminantium
atggaggatgttgaaatggcaagatttgaagaagcagaaaacagaatgttcaatgtaaaaatctgtttaaaatgtaacgcacgtaatcctgctggagctaccacctgtagaaaatgtggttacaaaggtttaagattcaaagctaaagaacctagaggatag

SEQ ID NO: 838 - DNA, 189 bp, Methanobrevibacter ruminantium
atgctatttttattgtttaactacgtttttttatatgctattcttataattgctaatctctctttttctattgatttatccactaactctttttctatttataatcactatcttatttttttcaatatcccattattccttttaaaaaaaatcaccctgttaaaggtttttttaaatattttaaaatag

SEQ ID NO: 839 - DNA, 750 bp, Methanobrevibacter ruminantium
atggaaaatgttgagcaacatcttaaagaaattttaaagactcgcaaaattcatttaactttaatagatcctgatgaacaaagcccagatgaagctgtcaatatagctaaagaggctattgcaggaggcagtgacggcattatggtagggggctccactgtagacactgctgctcttgacggaacctgtaaagccttatctgaaaatatagacaatccgattatactcttccctggaaacatcaatggagcaagcaagtatgcagatgcaatattcttcatgagctatctcaattcaaacaatccttactggattattggagctcaagcattagctgcacctgcagtgaataagacaggaatagaaaagattccaatgggatatgttgttgcagagcctggcggaactgtgggctgggttggagatgcaaagcttattccaagaaacaagccaaagattccagctatctatgctatggcagctgaaaacttaggaatgaggtttttctatattgaagcaggatctggtgcagatcagcctattcctcctgaaatggttgcatatacaaaaagggcaaccagcgacatagttcttgttgtgggagggggaatccgtgacggcatagcagcttatacagcagctaaggccggtgcagacattgttgttacaggaactgttgtagaagaaacttcagatgttaaaggtaaaatccaagaaatagtcgcaggagttcgcaaagcttctgaatag

SEQ ID NO: 840 - DNA, 1086 bp, Methanobrevibacter ruminantium
atgttaaattcattatatactgaagccatcaataagaaaggccaactgaaagagcctcttgaagagcttaatgaaagcaagatagatttggagtcaaaatggaatgatacgcctatcatcccctctaaatcaaatcatataatagctgcaggtgacggaagctataacaagaagaaatacctgaacttcaatttctatgcagttgcagcggaatcattgatttataatcccactaaggaggagaataagctatcctctatagagtctgttgaattggacataatgccacaccaatccttcttggaagaccgattgagaaacatgatgagcatatttgaaatcaagacagcaatcaagacctttagggaatatgaaatcgattattatttagatgacggctcaatattgggagatcttattaggccaattcctcttgagaccatctcctttgaaaagaaacaggaaattattgattctgcctatctaaagattaaaaaaggctatgaaaatatggactctgacatatcatcattgaattataaggaagagtttaaggaattctttgatgatgaggagattgatgagcatgacttaattaggcttttagagaacttagagaacttgatagcattgaaatatcttttggaaaacagaaagaagattattgcaatatcaaagacctcatcaagcaatgagcttttctatgctaacattccagatatggcaattctagaccgattcacaagaaaggaaggcttttctaaagcctattataggaaggtttcatataaagtcaagcatgactttccaatagagaatgagtttttccgcaatcttggctttacaacagtctttgcacgtctaaaggactataagaacatcataaagatagagtttccttattatattgatgatgatgaggaaataaagaatatcctctcaatattaaaggataattccacagaaggctatccatatcttctaaagaaggcacataaggatgttgtaatttcaaatcagaatatgacaagtctgtctaatgtaataggatttttagacaagtctggaagggaaatgttggattag

SEQ ID NO: 841 - DNA, 1509 bp, Methanobrevibacter ruminantium
atgattggaagatgcataggggaaacatccctaattgaactgagctttatttctaaagagatgccccaagtcggcgagtatgtcagcatagagtatgatggaaaggtcattttgggaatgatcgaatcaatggttagaggcagcgtttcattgaatgatgacatatacgaccctgacaccatagaaaagatacgtgagatagagggagatgacttttacataaagggaaaggtgacaatccttggagatataaatgacaatcttaggcttccacggactccagcacctcctggaactcctatctatagggcttcatcagagattctaaaggacatttttcaaatggacaattcacttaagctaggtcacctgataagtaatgaagaagttgaaattggagttaacataaatagtatggtttcccgacacttggcaattcttgcaatgaccggagcaggtaagtccaatacagtttctgtaatcattgacggccttcttgagtataatggctgcatgcttatctttgacatgcattcagagtatgtggatgcagagtttacaaatggcgaggttaatgtaatagatccaatcatcaatcctcagcatatggaattcaacgaaataaagaaattggcaaacattccttcaaatgctccccttcaggagagatacttcagaagggcctttaatgaagctagaaagaaagttcaggaaggtgttgccaaaccaacagatttcattgaaattctagaggatgtccttgtgagcatgcatgaaagcgagcagtatgaatctgccgataagaaaaagatattggatgtaatgaataaaattgaagacttgaaggtaaagtatgataaattattaaacaccaatgtgggagatatcctaaagcaattgaagcctggaatggcaaatgtcttggatttaggacaagtagatgagaatactgctgaagtattggttgcacatgtcttaagaaggtcccttagaagcagaaaggcttatgtaaaaaataaggataagtctgccttatcctatccaatattcttcatagttgaagaggcccatattttggctcctcaaaacaggaatccaaattccaaatattggattaccagaatagctagagaagggcgtaaattcggtcttggactttgtttggtaagccaatctcctaaatctgttgatgcagagacattatcacaagcaaataatatgataatcctcagattggttgagccaaaggatcaaaggcatgttcagacagctagtgaaaacctcagtgaggaccttgttcagcagctgccttccttaaacattggggaagctttggttttaggtcttatgacaaaggttccaacccttgttaagataaatgagtttaaaggaagacaaagaggaggagacttggatatcattgagcaatgggcttctcaaaagaaagagaaaaaggaaactttgcaaatagaattaaccagattcaatgacttaagcggaggatattag

SEQ ID NO: 842 - DNA, 1392 bp, Methanobrevibacter ruminantium
atgcgttttgcacatatatcagacagtcatttaggctgtagacaattcggcctattggaacgtgaaaaggacttttatgaagtcttcaataggaccatagataagataatagaagaggatgtggattttgtaattcatagcggagacttatttgacagtaaccgtccatctacagaggcattgctcacttttcaacaagcattgttaagattaaacgaagcaaagatacctgtttatgcaattgctggaaatcatgattccatattaagaaaaggatctttgcctccacaagtcctattcaaggacattggacttaatataatcagtccggaacatcctgttcatcagttaggtgctgttttaatctgtggagttccatttgcaaccagttcacagaagaatgcattggttgagaattataatatattatcaaaagttgcagacaccgcagttaaatccatcttggtttcacaccaaggaattagcaaatggatgcctgaggatagctatgaaattgatttggatgatttgccaaagaattttgactactatgcaatgggtcaccttcataatttctatgtagaggactatggaaaaggcaaattggtttatccgggctctatggaaataaaccgtacaagcgaattgaatgataattttaaggaatttggaaagggtttctgtatagttgatttaagtgaggacattccaactgttgaaagggtcaccatcgatctcgcaaggaaattttacaatgaaattattgagtatgacaaattggatgaaaggctttctgtaattgaggaagaacttaaaacattggaagttaaaccaatagttgatataacagttcgtggcggtgattttgaaagcgctgatgtctatgaaaagattaatgaaaaaattggtaatgatgttttaagtttcagacctacattcaagccagataatgttttaataggagaaaatcaacttgatggggataaaacattggatcctaagacattattaaagcagacagttgataagaaatttgcccgagaggaagtcactaaattgtctgttgatttattggatactttatctgaaaaaaggatgggggaagccaaatatatctctgatgaattttatgatgaatattattatcataaggatgaaaatgaagtcagttccgaatcagagtatggcggttctgaattaaatgttaatgaacataatgatgatggtacttctcacttagagtcttctgcttatgattcagtttcagacaattcatccagtttagatgactatttaaataagaacttagattctaaagaagaagtatccgataaggaaaaatcaaaggaaaatcaagtcaagaccaaagaagtaagtcttgataacttttaa

SEQ ID NO: 843 - DNA, 2799 bp, Methanobrevibacter ruminantium
atgatatttaaacatcttcaattaaagaacttcaaatcacatgcagacactgaattggatttggatcttggcataagtctaatcgttggtgaaaacggtgcaggaaagtcatcaatatttgaagccatatcctttgcattgtttaagaattacacaaccaacaacatcaccgatttggttagaactaacaagaatttggatgaaaagatagaaatgtcagttaagctaaccttcctttgtgagggaaatgaatatatggtggaaaggggaggcatattatctccatcaaagaccaaatcaaagcctaatttcaagtcaatatcaaatctgtttaaaataagcaatggacgagaggatatcattgcatctggaaacaaggaagtggacaggcaaatagaagagctcttaaacatgaactcctcaacatttctaaatgcaatctatatccgtcagggagagatatctgccttgatagatgacactccagcaaaccgtaagaaattgattaccaagctcttgagaattgaggaattggaaactgcatacaataacattccaagcattattgaagagtataaaacaagaaaggcagtattggaaagcaatattcgtccggaatccgaacttaattttgagttgaagaaggctaaggaagaccattttaacttagatgaccagataaaaaaatcaaaagaggaatttgaaggcctcaaggtcgaacttgaaaatataaaagaggaaaaggaaaaattggacaaggaaaaatctgattttgaatctcttaaattaaagcatgctcatgaagaggaaaatctgagtgctctaaacaaaggcaaggaagagctcttcactaaactaaatgagatcacaagaaatgaaacagagatgggcattcttaagccattctgcgagaaacttcctatttataaagaattcaaagagtcctttttagctttaaataagttaaaagaagatgaagagaatcataaaaagaccttaagtcagattgaagaatataagactgtcattaaagatgagcaagaaaatcatgagaaatacattgctttagaaggtgaaataaaggtcttaaacaataagaaaatagagatgtcctctgagattaaaaatctgaatgaattggaatctcgcaaagacaccctgactcaagaggtcagtctaaacaatcaaaaattagagacattctttaacagttctaaatctgttctctcacaatttgatcttgaagaggaaatcagccctataaaaaccaatgatgacttcaataaattggaaagtattgtagaagaccttagaactaatcttagaacttcaattgacaatacaagcactgaaatagataatttaaagaaggaatcaatcagtctaaagcaggaaataaaatcattggatgagccattggctgatattaaaaaggttgaaaacaaatgccctgtctgccaatctgaaattagtgaagataagaagaatgaacttatcaatgggtatgaggccacaatatctggcaatacaaagaggataaatgaaattaatgggtttctccttaaattaaatgaggataaatccttgaatgagtctaaattaaagagccttgattcaattaaaaacgatatttatgctaataagcatattgtagatgaccttgacaagtccaataagactcttgaaacattggatgctaaaatcaaagagcttcaagggaaaaaggaggagcttgaaagtttagataaaatgatagaatccaaaaatggagaattcattgaacttgaagcccataataagaaatatctggaagcaagcactcttcttaagtctttccctgatgaaactaaagtcaaggatgacttatatgcaatatatggcaagatcaagactgaggatgaaaagcttaaaacatatatcagttcagattcagagctttctttaaatattaccttggaagagcttgatgagtcaattgaaaaactatccgaaaaggataagagatataatatcttattaggttcagttaaagataagaaagagtatgaagataaatatgagaataaaaagaaagaaatcgaatcaaaaactcaagagattgaggagattaaaaagcagatagaatcttccagctatgatgaggaatattataatcatgtaaatatcttgcttgaaaggttaaacaataaattcacttattattctcaggacattgctgttaaggagactaatcttgccaattttgaaactgtaatcaagaatattgaagagatcattcaacagaacagagaatataaggaagagtatattgcagttaccgaatattataatctccttgaggactttagaaaactatacagcaaggacggaattcaaagggatcttaaatcacaatccagaccgttgattcagaagaataccaaggatttctttgataagttcagcttcaagtattcagatttaatcttggatgatgactataacatttctatttttggccctgagggtgaggcgaatatagatatggtcagtggtggtgaaaagattgctatagctcttgctttaagattgggaattactcaagccatgtctaagggtaatattgaaacaattcttttggatgagcctacaattcatttggatagcttccgcagacaggagctgatcaatgtattgaggagcatgtctataattcctcaaatgattatagtcactcacgatacagagcttgagactgctgccgatactctgatttcagttgaaaaagaagagggaatttctaaaattgaaaatagttaa

SEQ ID NO: 844 - DNA, 426 bp, Methanobrevibacter ruminantium
atgtttgaagaagatgaaaaagtaaataaaatatttaatcttataatcacacaaggaattgactctgaaaatgaatataaaatctttacagaaagattatactcaaagccagacttcttatggaccgaatcctttgcaagagactatgcaccatttggagaacagttcttttctaaagtagacattatcgttttattgtctggtctttacaatgacaataaggaactatttgataccttgattaaaaaatcagaagaatttgatattcctttgcttttagtgcgcccttatggtatggaaatagttccagaagagcttgaagaaaaggttaaaagcgttgtaggatggaatgcaaattgcattatagatgatataaaaagcataataatgggtgattatgactttgatgatgattttgacatttaa

SEQ ID NO: 845 - DNA, 1074 bp, Methanobrevibacter ruminantium
atgacatctcgaagagcagaacatgagagataccttaaaagcatcctatcaaactcattatcttcaggacatccatctaaagaggccatagaaaggtataggaaatcatccccaacttactataataagctaaagcttggacttatgaacaaatacaaggactgggacctcttggacatagaaggaagttcagttattgaaaacatctatggagagaccttaaggattaggcgaagggaaaagctagactttcacctagaggataagaaagatgagataaagaatgagctttcctcaaatttgaagttaattccaggtatcggctatcaaaccgaatccagactgaaggaaaataactaccatacaatctatgaccttcttcaacatgacaaatactcccataaggcccaaaaggcattgaatcggatagaaaggaactgttttgtatctgatttcaagcttttaaaggaatcatccaaatatcctatggatcactcccagccgattgacaagaacagaacccttaaggcattaagctcccttgatccgtttaaccttaaatttatggatatagaaactttagggctttcaaatgtccctatcatccttattggaattgctgagataaaaggcaaatggattgaatccaaccaatatctcctaagggacattgaggaggagcctgcagtgatagaggcttacctttcccatctggatgaggcaagcgttcatgtaacctataatggagcaagctttgatataccatatatcaagaatagggcacattattatagaatggactataatcttgaccagatacactacgaccttatatatccggctcgcaatctatggaaagatgtattacctaactgcaaactaaccacaattgaagaaaatctgtttggcataaaaagggaagatgatgtccctggagcgtttattccagactattatcaaagctatttaaaagaaaataatattggtccattgattccaataattgagcacaatcgtatggatatagtatctttagccagttttttaatgaaaatttatgaagaatccttttga

SEQ ID NO: 846 - DNA, 309 bp, Methanobrevibacter ruminantium
atggaattaactgctgaaaagagaaaagaactgcaagagaaagtcacaacagacattaatgcaatcctagaaaagcatgaacttccttataggatggatggaatttcagtaatgaaaacatcaaaaggaaccagttttttaggaaacattagagttcatgatccttataaggtaaaagatgttagaaaagaggttgaagactattttgaaagctatggaaacgttactatcacttcaagggatgtagtgccttgctgtgaattgccttatacatatataactttccatattgattattttaacgaataa

SEQ ID NO: 847 - DNA, 2757 bp, Methanobrevibacter ruminantium
atgtctaccgaaagcaaagataagcagatgggcaaaatcgatcaattcaaaaacgacattcgttttagaagaaagatcgaatatgtggaaaccattccagggaaagatgcaagctataagaaggtagatgtattaaacaaaagaattctccaatatcttgaggataagaagataaagctctacagacatcaggcattggctattgaaaaaacaagagaagataagaacatcataataaccacccctacagcaagcggaaagacattggccttcaacctgccagtcttagaggaacttattagcgataatgatgcatgtgcattatatatttaccctgcaaaggccttatcctacgaccaattgaaggtcctaaggaactttgaggatgagatgggccttgatctaaacccaaacccttacgatggggacactccaaaggctaaaagatataaaatcagacaggagtctcgcatcatcttgaccaacccataccagattcatcatatattggcttggcaccaccaatgggagcgattctactcaaacctaaagtatatcatcatcgatgaggcccattattataagggaatcttcggttccaatgtggcgtttcttatcaggagacttaaaaggattgcaaagttttacggctctgaacctaaattcatattgtcctcagcaacccttgcaaacccattggaacttgcagagaagcttacaggagagagttttgaactcattgacgaggactcctcccctagcggagagaaggattttgtattgtacaatccatataagtcaatcaaaaaggattccaaggaccaatttgacatggatgagtattcacgctctgtccatatggaaacagagcgcatattcctgtatctgattttaaaggacatacagacattatgctttacctcatccagaaagattgcagagctcattgcactatggacaaaacgtgatatggaaaaggtcaaaaagcgaaacgtcgaaaagattgcagcctatcgggcaggttacttggcagaggacagaaggcagatagaggacggattgaagtccagagactatttgggagtcacctccacaaatgcccttgaattgggaataaacattggaagccttgatgctgttataatatccggatttccaggatccatgatttccacctggcaacagggaggaagatccggccgtacaaatcagaagtcccttgtcattttggttgcattcgagaatcagctggaccagtactttatgaaaaacccggaattcttctttgacaagcctcatgagaatgtggttattgacctaaacaatgaaaagctacttaaaaaccatatcatctgcgctgctaacgagcttccacttacattagaggaagcaaaagaggaattcaatgttacagaagacttccttgacaatatagtcagaaacagggatttaagaaaaagcagaggattctacatctatccatatgatgacagcccatcctttaacttttctttagaccagatttcaaatgagatatttacagtgatgaatggaagaactgtgatagagcatatggaaaagtccaatatgtacagggaagcccacgagggagctgtgctgataaaccaaggacagacctatattgtaaataaggttgatctagacagccatttcatctttgtcaaaaagaaggatgtggaagcccatacaatagcattgaaaagaacaaacatcaagattaccaaaaagattaaaaagcataggataggagagtttacagtccatttcggtgaacttgaagtagaggaagactattttaagtataagctgatgcaatattcaaaggttattggagaatatataatcgatctgcctccacttaagttcaacactaaaggaatttggtttactatcccagatagcgttaaggacaagcttgaagaaatctacaaggatgaaactgaagtctttgcaggaggccttcatggaacagagcatgctatgattggactcttcccccttcatgtgatgtgcgacaggtttgatataggtggactttcaaccaattaccatgaggacacacaggaagcgactatattcatctatgacggatatgagggaggaataggaatctgtgaaaaggcgattgacctaatcaccgaacttacaaaatcaactagaaacctgattaagaattgcgaatgcaaggacggatgtccttcttgcatttattcaccaaaatgcggcaatgataataagccacttcataagaaggccacggaatatattttagattatatgtgggatgagatgaataagctaagcccagaggaccttgctaaattagaggaagaaagaattaatactgaaaacagtgattatgataatctaaatggacattctgatgttgaagttgaatatgataaaaaaccaaataatgctgaaattgaaatagatgatgaaagagaagcggataatgctgaaattgagatagaagatgatgaagcccaagaggaatatgaaaaggcattggaagagtttaataaggaaaactattcaattgcaaaagacattctaactgatataatcataaattatgacaatcaatctgcagatgcttattatctcattggtaagatattgtttattcaaggagatagtatgggagcattgtcctttgttaaaaaggcattgtctattgagcctgctcatgaattggctaatgaattttactttgagttgaagaatagttattaa

SEQ ID NO: 848 - DNA, 1608 bp, Methanobrevibacter ruminantium
gtgataagttacgaagaatttgaaaagctggttgtagagatattagaaagggatatctcttccaattcagaccaaaaggccgctatatctgctgataagtcacaatccttatttattgtagcaggtccaggctctggaaagactacagttatggttttaaagatacttaaatttatttttgtagatgatgtccagccaaaggagatacttgcaactacatttactaaaaaggctgcttcagaactattatcccgtatattaagctggggagataagcttaagaaaaaaatccctgtttttattatggataaggtaatgaatggggaaatggcagatggctctgttgtagataaggttagaaaaatcgatttcaatcaaatcaatgtaggaacaatagacagcatagcagatgagctcttaagggtccatagggatgcaggtacaagccagcctattctgattgaggattttgttgcaaattcagttatgattaatgaatgtcttttaaagaatgatatgtatttgcatgagtccttgcaggagtatttggctgagataacaggaaaggaatctcaaattgaccaaaagcctaaggttaaaaaccttacagccatggcagatatcctccttagcattaaggagcatatatattacaatatggttgacattaatgatatactggctgatacaaaggataatgaaaggggaaagaaaatagcattgaatcttattatggaatatgaaaaaacccttagaagtcagaatatctttgattttgccatgttagagactgaatttttaaacagattgagttcaggtaaattggatagctttttagatgatgttaaagtgattttagttgacgaatatcaggacaccaatctccttcaggaaagcatttactttaggattgcagaatctgccattaaaaatggcggtaacattactgttgtaggagatgacgaccaatctttatacagatttagaggagcaagcgttgacttgtttaccaatttcattgaaagagtttctagaattggcatagaagcgaaagagataaatcttaagacaaattacagatcaactgaaaacatcattgacttatgcaatgactttgttgaattggatgatgagtatcaggatgctcgtgtaaaggaaaagcctaaaatcgtttttcctaatcttgattcttctgaagatacttcagaaaatgaatctccagaagacctacctaatgaggatgaaatagaaacccaaaagattcctgttttaggcatgttccgttcatctgaagaaaagcttgcaatggatttgactaactttttagatgaactaaacagaaaaggaaaagtaaagagaaaagtaaagagagtcttaaacaaggacatcaataaaaaactaaattcagacagtgaagatgccttggaaagctataagaagtctggctttgagcttgctcaaagcgaaggggaaatcataatagagcttgatgaggagacaggttccatagatgatgttgcatttttaacatattcccccctaaggggaagtccacttcataaacttctcgcaaaattccccatttttattcttaaaaaaaccgcttag

SEQ ID NO: 849 - DNA, 1410 bp, Methanobrevibacter ruminantium
atgaaactatcaacacgttctaaagagtatattattccagaatatagtctaactggagacttattgtcctttctcacttgcaatttgcaatatcgctatcagaataagggaaatcttcctccttccatgcctattcaattgtggtttggtgaatttattcatggagtcatggaagaggcttatttaaaatggaataactttagtgatgaagaaaagaaggatttcaaatgggattgggaaagagatataaagcctatagaggatataatcacaaaaagacttaaggtaaaaggccttaatcctccaatcaattatactgaaaattatggtcctaaggaaaacatgtacagtgccagagtggacagatcaataaagatttggggacctcatctctttccattgatagaggatgctgaagttttgataaagggcattcgagatatgcctaaggacaatgaaggacattcaaggtctgagtattattctataaatggggtgatagatgtattaagctcagtcaagttagatgagatatattcaatagagaatgattttaatggtgataatgaaaaatcaaaaaatacattcaaacaaacaactttagatagtttctttgttattgattcatgtgacattgataatgttagagataaatcctctaagaaatcaggaaataaaattttagaatatttggctaataatgaagagtttaaaactattctggaaaatttagaagatgatgaatatgaaataattatagattataagggtatgagaaggcctagcgctccaaataaaaatgatattgataaaaataatattcatttgttaaatgaggattctaatgatgaaaactcattggaagattataaaacttggattcagcatgaatggcaaattgtaacttatgcttggctaagatccatgcaggaagatgctaaaccagttatctgtggaattattttctatctgaatgaattggttccttctactgaggatttgttattgataagggaagatttagaaaacaataaaacggacattcctaggcaatccattcctaaggactgggaaatattaaagaattgggatgaaaatggtccgaaggcgattcacgatgacttgtctaaaaaatttaagatggaccggtcaattaggataataaatataaaggaagatttaatagatgattctctattggaatttgatgaagttgtaaatcagatagaaagctctatgattagggaattaaatggttctaagattaaggaagcttggaatgcaaatgctgaacagagaacatgcaatgcttgtgatttcagtacattttgtaataaaaaagatttagaagaaaatactaatgagaattcaaatgaagaagataataaacctgttttttcagttccttaa

SEQ ID NO: 850 - DNA, 681 bp, Methanobrevibacter ruminantium
atggattatgatattaatgaaaatgctaattattctaaaatatttattgatgagctaaagcttagcagattgcctgttgcagttaaattcatcaacgatgaaagtgaagttccagaaggtattgaaaagattgacgaatcattaagacactgtgaaatgattacaaaagcagctaaaggcgaatcattctattcaactgctgaagagcaaagatgtgctggcggagcttctgcaatgggattaatcgatcttcctcctaagattgcaagcggtgaattatactataatttaggcagatttgaatctattgaaactgctaaaagcgttcttgacaatatttatagaaaggatgaaagaagctttggcattgtatatgcgccattggaaaaagctaatttcgctcctgatgtagttgtagtcattgcaaatcctaaaaacggaatgagaatcactcaagctattgtctacaatagcggtgaaatgttcaatgcaaaattcgctggaattcagtcattatgtgcagatgcagttagcggaccttatgttagcggcaagcctaatgcaactttagcctgtagcggttcaagagcatatgctggcatagaagatgaagaaattgcttatggtatgcacagagacaatataaaaccaatcattgaagcatttgcaaatatgaaataa

SEQ ID NO: 851 - DNA, 741 bp, Methanobrevibacter ruminantium
atgagcaatttgaaaattatttcatggaatgtaaatggcataaggactaggataaaaaataaggacatcaatcctgttttagagaaagagcctgatattattttattccaagagactaaagctagctatgagcaaatggataagaaattcttaaataagaatccctatgattattatttcttaaaaggtgaaagcgctaggactggcggactagcaagctttaccaatattgtacctaaaataatcaaaagattctttattaaatctcaagatgcattccatagggcatgtgtattggattttgaagactttacattaattcatatttatgcacctgctggaactggtaaaaaagctaattttaatcaaaaattagattatttcaacagtctattaaaatatgtagaaaagaataaggacaagaatttgattattgcaggtgactttaatattgctcataatgatatagacatatccaacaaggacactaaagttagcttcaccgatgaagaaagatctgttttagataaacttgaatcatttggatttgtagatgccttaagattattcaatgaagaagaatctttttcatactggaaaaataaggaagaaaacgatggtgcacgtttagattatttctttgtttctgaatctcttaaggataaggttaaatcttcttctatattagttgatgttgaaggttctaaacatcttcctattgaacttgaaattgagatttaa

SEQ ID NO: 852 - DNA, 657 bp, Methanobrevibacter ruminantium
atgctaagtgtttcagcagtcataactgcagcaggaaaaaattctagaatgagacaagatcaagagaaaaggaatcttccgttgcagaataagcttacactcccctttaaatcaaaaactgttatagaaacaacaattgataatgtattgaatacaaagggtatagaagaatgtgcaattgtattaggtcattatagcagcgaaatattacctttaattaaggatattgatgatgaaagaataaagatagtcatgaataatcctattgatgtaggattatctgtctctttattaaatggattaaataatataaattcagacatcgccctttgtgtaactgcagatcaaccaactgtcagttcaactacttttaataatattttagattctattttaaattcttccaatcctaataagaccatttctgttttaagacgtttggatattggtaaattagacactgctaaaggattagggatgccttttgctgcaagcagatgtgaattaattgattatattaaagacaaggatgacaatttaaatccaatattaagagaaatctttgcagatggctttgaattttatggagttgaagagaatcatcctgatgagttaattaatataaattattattcagattatgaaagcttgttatga

SEQ ID NO: 853 - DNA, 1230 bp, Methanobrevibacter ruminantium
atgccaagattattcaaaaaaacatcttttaagatttttattgcattaattgtaataataattttactaatacctatctccatggcaatgacaagtcaccataatactcaaaacatggctgaaatttccaaatatgagaatggatccactgtcttcaatggagataacataattgacaaaaacaaaataaacaagtaccctatagtttcagatataggtgcattgactgatcaaatcttaagaggagacattgcagatgcattcttctcaatatccacaggagtggtacctacccctgcatctgaacttgtaaccggaaacattactaaatccggcgagattcaaggaatcaaaggtcctgcttatatcgatattgaaaaagaccagatcaacattgttgaacctggaaactttttatatggattcaataccccatacacacaagcggtgattgttgaaggtggtattgacatcattaacaacaagacaaatgaaaccataaaacacattaatgccaatgacataactaatgacactcttccaggagacatggtaagtgaagagacaataaaatattggtataatacatcacaagttggttccaaatacaatatagaattctgtattgacggtcttaacgataaccgttcatacattactccaactgagcttaaagagaaattccctgaagcttataactattcaatcaaataccctggaggctctccagtaattctttataaagacaatgtaaatagcactgttgtaagcagcacctatacatacttaggttcacaccctcaatataacgatgcaaacagagaatataatgccagacaattcgttacagcatggaatggaactgtaattcctgcaaatacctctggatgtggaagggaaggagtttatttcagtgctgttaaagaagcaaatgcacagtctggaatggctacacacggtgtatgtcctccagcaagagctttaagaaatgctgtattagctttaggattcagtttgcctgtaggtatggattatggtgaagatgctgtactctttggatacagtccttcaactggaatcagagttaccaacactcttgactatcctatacaaatcaatatgtggactgaaggtgccggtactggaatggcaatatatgcagatgtagttgaatatattccaaataatgtaaccactaccaacagtacagaaacaggaactactatttag

SEQ ID NO: 854 - DNA, 1332 bp, Methanobrevibacter ruminantium
atgaaggctgctataataggtttaggcgtagaagggaaaaaagcattgaattccctattaaaacataattgggatgtttatgcaagtgacttgaatgtcaatatcaaaatggacaatctgcctataagccttgcccaagtgaatgtatctccatctaaggataaaatcactttccaaaaggataatctaaccattgatttaggatttaacaatcaggaaatcatcaattccgctgatgcagttgtattaagccctagcatttggggaagcagaattgcagagcattataaaaactctggaaaactcctatgtgacgttaagaccaagcatagggatatctttacaattggagtaaccggaaccaatggaaagacaaccactgtgtccatgattaaggaaatcctagaaaatgccggcaaaaatgttttagtcggaggaaatggtggaggaggctttgaaggctattatgaccttatcctagaagcagatgaggaagaatatgatgtcttgcttattgaagtttgtgatatgactgtcggattctgcagatattgctttgactttgacattatagccctaacaaatatgggaaatgatcatatggacgttcacggttcaatggaaggatataaagattccctaaaggagtttttcaaagataaaacaatatttttaaataagaaccccgagtttccagagagctttaaggaagaatttattggcatttctaaaaataccatagaatacggcgaaacagattatgaaattgatcttttcggcagattcaatagattgaatgcaggattaagccaatcattatccgaatacataaatgaaaatgtttttgagatagatgaggaaatcattaaaacaagcctagaaaactttaaacctgtaaaaggaagattagagcttcttaagctaaatgactgcacaatctatataggaaaatccgacaattcagatgcgattaaggtcattcttgatgaagttgacttcactgcaatcttcattggaactccaaggcataatgagaatcatagattggacatcttaaatgaagttgttaatgcaaatcccgatgcaatcattctattccctggacttgaggataccctagatcaggcaatctacagattaggcctgctgaattatgatggaagaatcgaaatagccaataatctggatgagatagttgcatttgttgcagaattctcacatgaccctgctatatttataggaggaaacggtcaagagaccattattaaaatacaggatagattaagagaaattgctgattcgataaatgaaagtgattatgagtgcgattaa

SEQ ID NO: 855 - DNA, 1104 bp, Methanobrevibacter ruminantium
atgaaaggtgaaatgatgacatctgatgaaaaaattaaattagtagaagaactctgtatgactccaggtatctctgggtttgaagaaaagattgcagagattattaaaagagaattaaaagatgtagcagataaaattgaagtagacaagatgggaaatctaatcgctactaaaaaaggttcttctaaaaaaggaccaaccgtaatgttggcatcccatatggatgaaattggtttgatggtaagctatatcgacgataatggttaccttaagtttgcaaccattggcggaatcaacgatcaaatgcttatgaaccaaacagttgttatccattccaaaaatggtgatgtgactggagttatcggttctaagccacctcatgtaaccaagcctgaagagaaaaagaaagttgttccatatgatgaaatgtttattgatattggagcaaaggataaggagcaagctgaagagatggtttccattggagatccaattacatttaaaacatggtttgaagcatttccaaataatttagtaatgtgtaaggcattggataaccgtttaggctgttatgtcatgatggaagtcttaaaaagagtggattccaaagctacagtatatggtgttggaacaacccaagaggaagttggcttgaaaggtgcaaaagtaacttcatataagttaaacccagatatggcatttgctcttgacgttaccttatccggagatcaccctggaataaaacctgaagaggctcctgttgttataggaaaaggacctgctgtaatcttaatcgatgcaagcggcagaggaataattactcctaaatacattagagagcttttgattaacactggagaaaaagaagaaattccataccagcttgaagtaagtagtggtggtacaactgatggtacagcaattcaccttaccaaagaaggaattcctaccggtgtattatctgttccaaccaggtatattcacacaactgttagcgtagcaagtatggatgatgttgaaaatacaattcaattgattgtagctgctataaacagtttagaaataaattttaaatacattttcagtattttaaatactttttaa

SEQ ID NO: 856 - DNA, 1161 bp, Methanobrevibacter ruminantium
atgtttggagtaaagaaaatgaaatacaaatctaaatttggttttggctgtatgagattgcccctaaaggatgaaaacaatccacagtcaattgaccaagaatactttaatgagatggttgatacctatatggaaaaaggatttaactattttgacacatcctatgcatatcataatggaatgagcgagattgcaattaaaaaagcccttgttgaaagatatcctcgcgaatcattccttatctgtgataagatgcctacttgggcccttacaagtgaagaagacaatgagaaatttgtaaatactatgcttgaaaggcttggaatcgactattttgatgtcttttttgtacataatattaatattccatggctagaactggctgaggaacataatacatttgaatatgtaaagaatatgaaagaaaagggcatagcaaagaagattggaatcagtttccatgagaattccgatttgttagaaaagttccttaataaatatgctaaagacattgacattgtgcaattggagcttaactatttggattgggaagatccagctatcgaagcccataaatgctacgatttatgtgtagagcatggccttgatgtctatgtgatggaaccattaaagggaggagtgattgtaaaccaacctgaagaaataaataatgatttcaaggagcttagtcaagacgcttcaatagcaagctttgcaatgagattctgtgcatcccttgaacatgtgaaaatagttttaagtgggatgagcaaaatggaagacttaatcgataatatcaatacctttgaaaacttcaaaccattaagcgaagaggaatttgacttcttgcttaaagaagcagataaattaagagaaaatcttgcagtgccatgcagcgaatgcggatactgtcttaaggcatgcccgttagagattccaattcctgagtactttagattatacaatcaccataaagttcagaaagaatcaaatatctatagattgtattttgataagttagctgatgagaaggttccagcaagcgactgcacacagtgtgaaacctgcatagattattgcactcaaaaaataaacattccaaaagaattagaaaaattgtgtgagcatttccaagagggttttagtccttatggtaattaa

SEQ ID NO: 857 - DNA, 7899 bp, Methanobrevibacter ruminantium
atgaaatttagaacaccatcaaagaaagacaccaataaggatattgagaaggagtttaaaaacttaagaaaagagctcttggatctaaccttaagaaaccctcttcttaactttaaggctagaaaccgaaatctcagtattatcaatcaatctcctataaacatctataggacccttgttttagagaataaaaagatgttctttcaagcaaataagaaagaaactaaaaagtcaaaggcccatgcattcatagatgaggctaaggagtttctatcacaggaaagcgataagaccttaaaggcagacttatcacctagtgaacttcaaaaaagactcttttatatagatcagcaatctaagacaatggtacaggagcaaggttacaatatcctatacattgcaatcggatttatcgaatggattgacaataagaagccaagacaaaagaatttagcacctctcattcttattccagttgaaatggaacgtaaaaaagttggaaactctttttcattatcttggacaggtgaagacttacagaacaatatttctattcaagcaaagctaagggaaatcggcatagaattgcctaagtttgaacagacttcctatgtggaaggggttaaccactatctggaaaatgtaaggcaggcaatcaggccatttccaaaatgggatgtaaaatatgacatagcattaggattcttctcattcaccaagtttgtaatgtataatgacttgaatccggaaagttgggatgagaacatcgacttgacaaaaaatgagcttattcaagcaatcttcaacccaagcaagaatgtatatgaagatacctttgaagaggatgatgtagatgaaaagctccattataagacaatgtatcaggttttggatgcagattcctcccagattgcagctattgaaaatgtaaaggccggacataaccttgttgtagaaggtcctcctggaaccggaaagtcacaaaccattgtaaacttgatagctgagcttattgcagaggggaaaaccgttctttttgtaagtgaaaagatggctgcacttgaagtggtaaaaagcagattggatagcgtaggccttggcaagtttgtattggagcttcattcacataagacaagacgaaagaaattccttaaaaaccttcaaaaagccactaatgttcgctcaacaagggatttaaagttagatcaaacattaagaaagcttgaaaacctacgtgaccagttagatcaatatgcagagataattcaccgtcctatggcaaatgtcaagctcagcccatttgaactctatggtatgaaggagtcttcagaggattatttctcccgccaaaataggttattgcctttggttaggtttgacaatccagaagatatcaccatgaaggatctggatgatataatcatatcattggaaaacctatcagagctctattcaacaatatcaaaaaacaatccttggagctattgcaatccgaaaagcttgcttccagcagatttaagggaaatagaacagctgataatggataccctcgaggcactcactgactttagatatgagatggacataataaatgaggtctatggaatcaaggttccaaataccctgcaggaatatgaagattcaatcactgcattaagcctattaaatagcgagacagttaaccttattgacagctccatcctattgaatagggagtggtatagcaatcctgaacaggcacaaattctaatcaagctattggcttcatatcagcaatcatctaacctctttgataagtttacagattatcttctcattgctgatttggatacattgattcaagacttgaataaggacttgaataagaaatttaggctcttcggcggaaattcccataaggatgagctaagcagattatataagggccctgttcctagtgaaaaggaagccttaaatgaccttattaaggtacgtaaagaaattaaagttagacaaagctataatgataatgaaaaacttggaatcagatactttggagatttatggggcaagaatgccaatgttcaagagcttaaggaagtttcaatctggatgagaaagttcacacatcttttatctaatggcacattcaatgaaaataccgttaagatgctttctaatgaaatattccacccttcaatagatgatggaatcgatgaatatattgaaaaaggcaacagattctatgaaagccttaagaaactggaatccaaactcaatccgagaagcaagattatatttaagaaggaaagcgaagatgttccatttgacaagtgggaaattcaacttaacaaatggaaaggacaattgtcaagcctccacttatggtcacagtattccaataccaaaagggcatgcatgaacactcatgcttctattttcatcaagacagttgaaaagagaaatatcaaaaaggacgatgtaaagccactggtattaggtaattttgcagacagtctcttgaatattgtatttagtgaaaatgagatattggcaggattcattggagaattgcatgaaaaccgcattgctgactttaaggatttagatcgaaagatcatcaatctaaaccgaaaaagaatattcaataaactgaatagccaaatccctaagattttcggtggagcaaacgaccctgaagcaaagatcttagctggagaattcactagaaaaagcggacacttgccagttagaacccttcttgaaaaggctggaggaacaatcaaaaaaatcaagccagtctttatgatgagtccattgtcaattgcacagtacctcgaccctacaaatcctaaattgcaatttgatgttgtcattttcgacgaggcaagtcaggttaagcccgaggatgcattaggtgcattcatgagaggaaagactgctgtagttatgggagacactcaacaattgcctcctacaagtttctttgatcagatgacagacagcgaagggggagaggaagtggcaaccgctttggatatggaaagcattcttcacttatgcaaaatgtcattccctgtcaagatgcttaaatggcactacagaagccgccatgagtctttaatcaatatttccaatagggaattctatgataatgagctcttggtctatccttcaccttgccataatgaccctgaactaggacttaaattccattataatccaaatacagcatatcatagaggagaaggctctgctaacccattggaagcaaaggatgttgtaaaggaaatattcagacactttgaaaagtatggcgataagaagagcttaggtgttggaacattctctgttgctcaaaagaatgccatattagaggaattggagattgaaagaaagagccatcctgaatttgaaccactattttctgataagagagaggaaaggttcttcgtaaagaaccttgaaacaattcaaggggatgaaagggatgtcattctaataagcgtaggatatggatatgatacagaaggtaagatgtccttaaacttcggtcctctaaaccaagacggtggagaaagacgtttgaatgtgcttattacaagggcaagggaaaaatgtgttgttttcaccaatttcagagcccatgacattcatctaacagcaaaccctccatttggggttaagtctctacaaagctttttggagtatgctgaaaacctttcacaaaatcagttcattgaccaagaagaggatgaggaggctccatttgaggatgcaatctataatttcctagcagataacggatatcgggtcgataagagaatcggttgtgcaggatttagagtggatcttgctataattgatgaggagaatccgggaaaatacctcctgggaatccagtgtgacggccataattatgcttcaagcaaggtagcaagagacagagacagactaagagagcaagtattaaacggattaggatggaaaatctatcatatttggtcaacagactggtatagaaacagagacctagccagagctagactcttggagcatattgagaatacaataatcactacaaaggttaatgacttgaagtcaaagattcatgatgctgaatcaatgcagataaatccagtcactactgttgttattgataagaaaaataaggagaaagattctgatgatgattcagacagtgataaaactgataaaaataaagaaagccttattaataattatttaaaagatttagaagatgaatttggagacaatagtgataaaaaggacaataataatgaagatgatgattctaataatgatgatggaggattagtcattgattcaactgatgattctattgacaatccagatgatggaggattagtcattgattcaactgatgattctattgacaatccagatgatgaagggttagttattgattcagataccaatttaggtagtgaagagtttgatattggttctgattctgttttagatgatgattctgatgatgaagagtttggtgttgattctgattctgatttggatgaagaagaaatcattgaagattcagaaattaaattaagcgacactcttaatactgatttaaaagatgaagacatttatgaacctgaaattgaattagatgacaattctgattctgatttggatgaagaagaaatcatttatgaaagggaaattcaattaaaagagggttctgatttagatacagaagatgaaattattattgaagaaaataataacaatggttctgatattgatttagattcagatgatgtaactgtatttgaattaagtgatgaggattctagttctgattcagatgatgtgactgtatttgaattaagtgatgatgattctagttctgattcagatgatgaagaattagataatgattccaatattgatttggaagatgaagaatcagatgataatttcactcttgatttggaggatcaatcaaataatctgatgccaaaaagcactattgataaatctgagtttttaaaagatttatatggtgaagatgatgatttaagttcaactattgacgaagaaccgaaaatacttaatgataataatgaagttattaataaatcttttgattcaaaggataaaaagagttctaaaaatattagcaaatctgagcttaaaaatcaagaaaaagctaaatctaaaactaaatctaaaactaaatctaaagctaaacctaaaaatagaaatcaagagattaaaaatattgaaaacggcaaaattaaaaatgatgattctaaaaaagagcagaataaaccaaaatctaaaaataggtctatactaaatagattaaagaatattggtggaggtttgggtttatcaagatcagaagaatctgaaggtaaagaatttattaaggctgaagataaaaaatcaaaagaatttgtatccgatgccaaaaagtcaataaaaagaaaagacagaaaggcaaaagataaggattccaatgataaaaaagaaataaataaaaaacttaataaagagcaaaatataaaaaataataaagataatattgttgaatcagataaaaaacaagaggaaattaaagaagaaattcaaaaacctgttcctaaatctaaaccaaataatacaaaagagttaattaatcaaaataacaaaaccattgaagaattagaagaatatattaataatagttcaaataattctgatttagaatttgatggtgcttctgatattgatttagaaaaagaaattatttcagaagacaaaactaaattagacgtagaatcagatattcaaatggatgatgaatatgtgatagttgatgattctgaattggaagacgaatttgagtttatagaagaattagatgatgattctgaattggaagacgaatttgagtttatagaagaattagatgatgattctgaattggaagatgaagaatttgaatttattgatgatttagatgatgattttggttcagaagatgaatatgaactagttgatgattctgaattggaagacgaatttgaattaattgacgatttagaagaaaaatccaacaattatgataatgaagatattaatcttaaagaagatagtgaatatttagaaaaagaagagtctgaggatattatgagacaaaaggaaagtgtttcaaaaagaaaggttgagcatgaaatcattgatgattctctagatgttattgttcctataagtgctgaaagaagagcagatgaatataataattattctgaagatgctaatgttattattccaattcaagatgaagaggaatttgaagaggaatattataataatgattctcaagttgattctgaagagggaattgatgaattggaagaattaatctctgaaaacattaattattcagatgatgatgctagagaagaattcttaacaaataaagagtctaatcaagaaagtgaagaagattcttactattacagcgcagtaggaattgaaaattcacttaaaaagaatgctgttcaatatccaaaatcaagcaataggaataaaaaaggcattgtaggtgctgtatctagcttaaaagatgaaatgctttatatcaatgcttcaattaaagaaatagaaaacccaactgaaagagaaaaaatctatgtgatagacccttcagaagaggaatactataatcagccagatgattctatttactataatgattcccttagtgaaaataaggaaagatatgctaaatcaaaacaatatgaagatgaagttgaagtcatttctccggtatcagattctgatgagggagaaacaggccatattcaatctgattatattgaaagaaaagctgaagacagttctaaatctagttctgaatccttatttagtcctaaaaaacatgaatatttggataaaattaaggaatatgctgctgaatctgaatatgaagaggcagctgaaaaccctacaataagtccagttcatactgaaattgaagaaagtgttgaatcttctgtaattagcccggttcatactgaatatgttgaaactgttgaatcttctgctatcagccctgtccaacaggaatatgacaaaacagaggaaccttcaaccataagtgctgaagatcaagaaacagagtttattgatgatattcttttagaagaagatgaattatcaaatattcaagatactgatgactctgctttagctgaagaagaaccggaatctatagaaatagatgatgatgaatttgaaagcattatcactgatgtggatcaagattatcaagaacttgaaaaagagagaataaaggaagctaatgtattaagtgcagtagataataccagattaactcctaccggcaaattagaagattatatcgtggcatataaggaaattgatgatgtcattatcaaaagtgccacagaaatatatgatgatgagaagaaagtggctactgcagttatggacattgtaagtgcagaaggccctattcatgtagatatggttatacgccggattagggaaagctgcaatctctctagagcaggcactaaatttaaggaagctatatttaaggcaattgaccgcaatgaatctcatatgaatcttataagagaagaggatttcttatttatagattatgaccaaattgcagttagaaaaagagataaacctaatatagaccttatttctgatttggaaatagaaaatgctatagatttggtattaagctttgaaaaatcattaaaggttaaggaattagctagaatcgtttctagaaccttaggttttaaatccacttctaagaaaacttcagctaagattttagaagtcattgatgttatgatcggcaaagagattttagtaaatgttaatgataaaatagaatttagataa

SEQ ID NO: 858 - DNA, 288 bp, Methanobrevibacter ruminantium
atgtcaatcactcttatccatactcgaaggagattagcccataagaaaacatataaatctcctaatgaacgtaaaaagaaaactctagctaggctatctcataaagagagagctcaaagaaacagagacaagaaaagagctagattagataggcaaaaaaataaaaataagcctaaaagtcgcaaacctaaaaaatctaaaatgccttataggtttaaatattatcaatttcaggattataaatttaactcagagttagatcagctagaaaagattgattctgattaa

SEQ ID NO: 859 - DNA, 180 bp, Methanobrevibacter ruminantium
atgttttacagtacaataatgaaaattgattcaattgacagattaagagatattagagatgcattattagtagaacaaggaattaatcctacaagaaacggagaacaggcaattcgtgtagttgttgatagaattgatgagatccaatctactttagataaaaaaatagaaaaattataa

SEQ ID NO: 860 - DNA, 1896 bp, Methanobrevibacter ruminantium
atgggattatttggtttcttaaaaaaggataagaaggaaaaatcaaataaaaaatttgatgaagaatctaataaggatttagatgaagctatagaagaatcaactgatatgattaaaaaagattctgattctagtaaagataaatcagaatcagatgattctaaatctaaagagtctaaggattctaaagaaaaagaatctaaatctaaagagcctaatgattctaaatctaaaaaatcaaaaaataaagaatcaaaggattctaaagaaaaagaacctaaaaagtccaaatccagactatttagacgttctaaaaagtctgaagatagcatcgacttcgattccataaagcacttaagcaaagaggatatgcaagaggctaaggaaaaacgtctaaaaaaggattctagaaccaaagaagagaaactcaaggatgaaacctttaggcaaatagcaatgaaccatagcaatagaaataaccgtcttgcagcagttatggaaataaagtcccaagatatattggaggatgtatgccttgaccataaggacagatttgttagaaccattgcagcttcacgaatcacagatccgaatatcctagaagagatagcctataatgccaaatacacagatgttcgccaaatcgcctttgatcagttaggccaagttgaaaatgtatttgcagagatagcaaaatatgataaaaaaggtaaaaaccgctttgcagcaataaatgaaattgatgatgaacttatattaatggatattgtcatcaatgccaaagataaaaaggtaaggataaaggcacttgaaaagataaataatgctgaaatattggctgaaattctaaaaaacaccaatgataaaaagataaccaacctaatcgttgaaaaggaaagctttgataatgaggaagtcctctctagaatagcagaggatgaaagctatgacaaattcattagaagcgaagcaataaagaaattaaatccagataatgaaataataagggagatagcaatcaatgattcaaatgaacatgtccgattgatagctattgagaaattagaggatgaagatgatcttaatgaaatagccttaaattcagaatactcatcatctcgtttgcaagctgttaaaaaaatcaacaaccaagagatattaagtcagattgccttaaatgatgaggataagtttgttagaatggaaactttaagcaagatagatgatgaaaaaatactatttgaagtgtataataaagattcagatgaattcgttagaagcgaagcaatcaaatacatcaattctcctcttaatttagcagacattgcaataaatgatgacaatttaatagtatctaaaaatgctttaaataaaatcttcagtctttatgaggaaggtgattttgaagaggatctggatgaattgcttggaaaaatagcaattaaatcaaataaagatgagatatctgaattgtcaatcaaatccattgaaaaagaggatgttctagagcatattgtaaacgaatctaaaaacactaatactttattgcttgcagttgacaagattaaatctgaagacatattaaagaatatctcagagtcaaatgaaaattccaaaatccgagtcaagtccgttagcaagattaaagacaaggacaatttagaagatattgctttaaacggcaattataatgatgcaagagttgaagccatagtaaatgttcataatcaggagatattgtctaacttggccttaaatgatgaagattccaaggtaagggaagctgcttgtaggaatcttaatggattgaatactttaaaagaggttttagcaaaagacacagatgaatacgttcgtaaaattgctaaaaagagatatgatttgattagtaaataa

SEQ ID NO: 861 - DNA, 2907 bp, Methanobrevibacter ruminantium
atgatgagttcagaaagaaaaaacatcatattaaagggtggaagagaacataaccttcaaaatattgatgtatccattccacgtgatcaattcatagtagtaaccggattaagtggctccggcaaatctacacttgcttttgataccatttatgctgaaggacagcgtagatatgtagaatcattatctgcttatgcaagacaatttttaggacagatgaaaaagcctgaagtggattatatagaaggtctctcacctgcaatatccatagaccaaaagactacaaaagtaaatccaagatcaactgtaggaacaattactgaaatatacgactacttacgtttattatatgcaagaataggaattccacactgtccaaactgtggaaaggaagtctctcatcaaaccataggtcaaataaccgaatccataatagaagaaggggaaggattaaagattcatgtgctagctccagtcattaaagaccgtaagggggagcataaggacatattggaagacttcagaaaaaacggatttgtcagagcccgaatagacggtgaaatccgtgggcttgatgaggaaattgagcttgcaaagaccttccgccatagcatagatttggttgttgaccgccttgtaataagggaaggaacagacttccaaagaaggttgtcagattctgtagaaacagcttgtaattttgcagaaggcatagtgactgtcatgtttaatggaagggatagtgaaggaaatgaaaccgagtacgaaaaaacatattctgaagactttgcatgtaccgactgtggcataagttttcaagaattgacacctaggatgttttcattcaatgctccgcagggagcatgtcctgaatgtaatggtattggaacaaagatggaaatgaatccagacctaatcgttcccaataaaaatctttcattgaatgaaggagccatagttccttggtcaaagtcaaataagaaggaaaactactattaccaaatgttacaggctgtagctgaacatttcaactttagcatggacacacctttcaaggacttaagcgaagagcatcagcatatattattatatggctcaaatgaaaaggtggcatttgcctttaaaagaagaaacagatcatatagggtgaatcgtaaatttgaaggtgttatcacaagaatggaaagactgtaccttgaaaccaaatctaattataaccgcaaatacatctctaaattcatgagtgacttaaaatgtccagtctgtggaggaaagaggcttcgccctgaagtattggctgtaactgtaggggacaaatcaatcatagacgtatgtgatttatcaatcaaggaaagctataggttcttccaggaactggagcttacagaaaggcagatgtatattggaaaagagattctaaaagagattaaggcccgattgaagtttttagttgatgtgggattggattacattacaatgtcaagatcctctggaacattatccggaggggaagcccaaaggattcgcctcgctacacagataggctcaggtctggttggggttctatatatcctagatgagccaagcataggccttcaccagagggacaatgtaaagcttattgaaaccttaaagcacctaagagacataggaaataccctgattgttgtggagcacgatgaagaaaccatattatctgcagactatgtcattgacataggcccaggagctggtgagcatggaggaaagatcattgcagaaggcagtcctgaagagattatggaatcagaagagtccattacaggaaaatacctatctcgaagggaattcataccaatcagagaggacagacgtagcggaaacggcaatttcctcaccatcaaaggtgcaagggaaaacaacctaaaggatattgatgttgagattccattgggactattcacttgtattacaggagtcagcggctctggaaaaagcagcctgataaatcaggtattgtataagggcctttctacaaagataaataagaaatacatgcatcctggaaagcatgattccattgaaggcattgaaaacattgataagatcattagaattgaccaaacacctataggcagaactccacgttccaatcctgcaacttatgtaggggtattcactcctataagggagctttttgctgaaactcctgaagccaaggcaagaggatacaaacctggaagattcagtttcaatgtaaagggaggaagatgcgagtcctgtttcggtgatggaatcatacagattgagatgcatttcctatctgacgtttatgttccttgtgaagtctgtaaaggaaagagatataatgaagaaaccttggatatccgatttaaaggcaaaaacatctatgaagtattagaaatgactgttgaagaagctttagagttctttgagaatattccaagagtggcaagaaagttgcagacattatatgatgtaggattaggatatataaagcttggacagcctgcaaccacattgtcaggtggtgaagcacaaagggtaaaattagctaaggagctttccaagacaagcacaggccaaacattatatattttggatgagcctactacaggtcttcactttgacgacattaagaaattattgaatgttttagacagattgactgatgcaggcaattctgttgttgttattgaacacaaccttgacgttattaaaacagcggattatattattgatttaggtcctgaaggtggagatggcggcggtgaagtcattgcaactggaacacctgaagagattgctgaatctggaacatatactggtgatttcttaaaagtagttttaaatgagaatagaactgctcttgcaaagcagttagttgaagaaaatagtgctaaatag

SEQ ID NO: 862 - DNA, 1593 bp, Methanobrevibacter ruminantium
atgttatgggtagataaataccggccaaagacttttaaggaagttgtcggtaacaacaaacaaaagaaggtcatagaggactggcttcaatcatggcaggatggaaatccgcaaaagcccttattattgataggacctgctggaaccggaaagaccactatagcacatatcatagccaatgagttcagcgaatacatagagttgaatgcaagtgacaagcgttctcaggatgtccttatgagcacaataggagaatcagccactaccaaatccctatttggtgaaaacaagaaactgattataatggatgaggtggatggtatccacggaaccaatgacagaggcggaaccagcgctttaaataagatcattaaaaacagcaaacagcctattgtaatgatggcaaatgatttctatagcaataagttaactacaatcaagaagaatgcacaagtcatcaagatggacaagatcagggcacctacaatcaataagttccttcgtgatgttgtccttaaaaatgaaggaatcgaagtggaccctgatgtgcttatgaagctttcaaaacgctccagcggagacttgcgttctgcaatcaataccttgcaggcattggttgaaaacggaggggaattgacagaagaaacccttgatacaaccggccagaaggacaatacagctacagtaatagacactgttacaagagtcctaaaaagcacaaatgcaatcaatgtaaaaaggtccctaagggaaaacaacgaagatcctacattggttatggaatatattgcagaaaacattccaagggaatatgaagataacaaggaaatcaaggatgcctatgaaatgataagcaaggcagacctattctttggaagggccagaagcagtagaaactatggctattggagatatgcttcagactttatgggtccaggtgttgccttatccaaaaagcagacctataaaaaattcactagggtaacaggccctatggcatttacattgatgggcagaacccgtggacaaagggcattaagggataggattgcagctaaaatggaagagaaaatgcatgtttcattacaggtcgcctataccattttcccatactttgaaataatgtttgaagatgacgtaaccgcttggcagatatcagactttttagaacttgaagaggatgaaattaaaagattcagaaagaaaaagatacctaaaaaggtcataactgctatggaaaaagtcaaagcggaaatgagagaagaagaaaaagaagagtggcgtaacagcattaaaaaaggtatattcgccaatgttccatctgaagcagatttagcagacaataatcttaataagaacttgattgatgaggattatattgaagatataacaattaaggaagatttaaataatatttcagatgatgaattggatgaaatagcaaatgaattttccttaaagccttccaaatcaagattggataaaggaaaaaatgatgctgataatgaggagaaaaaagataaagatgaagataaaaaggaaaagacagaggaaaaactagaaaaaggtcagactactttatttagtttttaa

SEQ ID NO: 863 - DNA, 945 bp, Methanobrevibacter ruminantium
atgttaggaccttgggtagaaaagtatagaccgcaaactttagacgacattgtaggacaaaagcatatcgtagaaagcctaaagaaatacgtagatcaaggaagcatgccaaacttaatgtttacaggtcctgcaggtgtaggtaagaccacttcagcacttgcacttgtaaaggcaatcttaggggactattggagacaaaacttcttagagcttaacgcatctgatgcaaggggaatcgaaacagtaagaacaaacattaagaatttctgtcgattgaaacctgtaggggctccatttagaatcatcttcttagacgaagtggacaatatgacaaaggacgctcagcatgcgttaagacgtgaaatggaaatgtataccaagacctgctcattcatactttcctgtaactattcttcaaaaatcattgacccaattcaatccagatgtgcaatattccgctttgcaccaataaaggctgaagagattgcagacagattaaaatacattgcagaggctgaaggatgcgaatacgaagaaaaggccatagaaaccatagtcctattcggcgaaggggatatgcgtaagtctgtaaatatgcttcagtctgcagcctccactggaaacataaccgaagaccatgtttatgaggttgtaactaaggcaagacctcaagagattaaggaaatggtcgatgcggccttaagaggcaagttcatggaatcccgtaatattttaagggatgttatgattcttcagggcacaagcggagaggatatggtaaaccagatctatcaggatgttgcaggcagagtcatggatggaaagatgagcggtgaagtctatatggaattgattggggcaattgcagacactgactttagaatcagggaaggagcaaacccaagaatccaattggaagctttacttgctaagtttttataa

SEQ ID NO: 864 - DNA, 1482 bp, Methanobrevibacter ruminantium
atgatatgtccaaaatgtaatacagtaaacgatgataatgaaaaattttgtaaaaattgtggtttgcagctgaatacaactagaatatgtcctaattgtaacactgcaaataagccaaattccaaattttgtcataagtgtggtactaccttaagccctgtagatacatttaaaaaaggaattatagaagaaaatacaagcaattctttctttagtacatacaagatacctataatctgcgctttagttattttactggctatcggcgctgttacaggagtggctattttcggtggtgacggcaataatgggatcaattcaataatccctttggcaaatgacacatatgacgatacaaacttaaataattatggcgtaaatcatgacaatgtaagccaaactcaaagtgataactttacagaaaaccagactgacaacctaacagacaatcagactgtcaatcagactgttgaaaataaaacaaaaactgcaactgttcaaaatcagacagacaataataaaacaagcaataacgatacaaataaaacaaaagtctattctgaaaagactaacactacaaacagttcagcaaaagtcaacactgaaaagacaaatgcaactaacagttcagctaagacatatactgaaaagactaacactacaaacagttcagacaaagtctacagtgaaaagacaaattcaacaaacaatagtaaagtttacactgaaaagaccaataaaaccagtgatgataataaaaagaacgatacttcaattgatttgaaaactgatgataacctaacttcaattgacagtaagataaataatacagatgatgataataattctgtgattgtaatagataataagcaaaatgattctgatttaaatgattctgatgacttaaacaagaatggcttaaacgattcagatgatttaaacaagaatgatgacttaaatgattctgatgacttaaacaataattcagattcaggaaaagatacagacaatacattaaatgacacaactgatgataataaaggagatgatactatttctgacacaatagaaatgacagatgttccaaatcttgctcaagaagctgcaaataataattaccgcttctcttctataagttataaaggaaatgtatttacacaagcacaatgcattgacattttcagtgaatatatattgaatgtcaacaatggcgtattctctccaattaagattaattctgtcagttctgcatctagtccatctggagaagaccaaagtcagtctatttcccaatctgactatatcagcattgcaaacagagtccactcatggattgacagcaataatcaagttcctaattatgttggagtgagcgtaaaaggtcaagcggatctttctccaaataagatgcttgaattgttcggccaagttgtcttaaactatgcagttacaggagacatgccacaatctgttgatatctaa

SEQ ID NO: 865 - DNA, 474 bp, Methanobrevibacter ruminantium
atgaaatcaattgtttttaatatagactgtctgttgaattttttaaaggtaagaagatctgatttgttggaaaggaagtttaaaagaattataatctctaataaggtttataataatttatccaatccaagcatatcacaatacataagggacgacttaaatacacttattgataagaaatttattaaaatagaggaaatcaacttaaacacggctgttttcgagctttattatgaaattatcaataattatgataatgaaatattaggcgaaagcgaagcttcctccattgcacttgcagtcaagaataaaaagacacttgctttcaataatccaaaatcaattgagttttatctggaaaagtatgatataaaatgcattggcactaaagacattttaaatgatcttttagacaaaaaaattatatcaacagatgaattctatggcatactcaatgaattaaatcagtattaa

SEQ ID NO: 866 - DNA, 777 bp, Methanobrevibacter ruminantium
atgagagatagaataaaactaaattcatttgctgtcgaattgagaagagattgggagttgaacccatacagtccaatagacctattctctattgtattatccaaattacccgatttaacaatcattttttatccaatgtctgaaaatacaagcggcatgtgcataaaaaatattaatcttttcaatgaaaaggaattagaagaagaatgtgattccgatgacatggttgtatgcataaattcaaacatgtctaagggaaggcaaagattcaccttagcacatgaattataccatcttttatttgaagaggataaggaggacataattatctgtgaagattcaaataaggatgactctgaaatagaagctaatatatttgcttcttatttaataatgccttatgaggggttagagcgttattataaaacaaataatattggcaaatggaccttggaggataccattcgtgcagaacagttcttccagatgagccaccatgcaacgttatttagattaaaagaacaggaattcattacaaaagaagaatgcataaattttaggaaagtttttataggttatgaagccagaatcaatggattcagcgatgatctatatgttcaatccgaggaatctaaaaagtactattcattaggtaaatatattcgatcggttgaaaaagccttctcgaataagagaatatctagtggaaaaagagatgaattgcttttagatgctttcaggagtgatttaactttcaatttcaatgatggcttataa

SEQ ID NO: 867 - DNA, 342 bp, Methanobrevibacter ruminantium
atgaaaaaaataggacaacgtttacaaggattaagagaatcaaaaggattgtctcaatctgacttggctaactatttaggtatttcacagccactcctatcccagatagaagctggaaacagaaacctgaacctgtcattgctggataagctttgtgcattatacggatgcaccgattcctatattctttgtaaagatgacgaatataatgcagtaaacttttcctttagatcaaagaatgctgcaagggaagatttggattgcatttcttcagtacataagattgtcttgaacatgcgttttttaaacgaaatagacgaagatgatgagtctgaagaataa

SEQ ID NO: 868 - DNA, 735 bp, Methanobrevibacter ruminantium
atggcagttcctgaaataaatgaattatttttaccattgcttaagacaataaaagataaggatgaatataaggtaaaggacattacagatgaggttattgaaataatagaaatctctgaagaggataaaaacattaccttgcctaatggtgaaacattgatagaatctagaatcagcacagctaatacatacctaagaaaggctgatctaattgaatcaaacagattcctttactataatattactgatgaaggattgaaagtccttgaggaaaatccagatgaattgaaagaagaggatcttatggaaaactctgcttttaaagagttaaaggatgtttatactcatgatgatgtaactgaagagattccaaatccacaggacgctttaaaggcttctctacaaaagcaaatggaagatgtcagagcggaaatctccaatgatgtaattaaagagaatgaggttaaatacttcaggcctaaaaaccaaaaggaaaatgatgaaatctatgaaatcagaagccgcagggccaatctaaaagatgataaggataaatccaaaagaaaatgccatgacaagcatcatggacacaaacaccatcataaacataagtatattgtctataaggaattctctcctgcagatgaattgttaaagtatgcagaactctttgagagaggttatttaactaaagaagagtttgataagaaaaaagaagaattattgaaattataa

SEQ ID NO: 869 - DNA, 1200 bp, Methanobrevibacter ruminantium
atgagttcaaaagtagatttagaaaaggcaagagaatacaataaagtaaagaagtatgaagagtccttatcatgctaccaatcttacttagaatctggtgaagaactacctgaaatagataaggaaagatatgcatgggacatatactttgcaagagtcaagaatgcaagcacaatagctgaattggaggaatatgtcaaggaactgaccaaatatgcaaagcaaaagaactcttcccgtagggaaaagccttgctcctataccatttccatacttaagctaatgaaattctattcagacaatatcacatttaacaacaatgcatataagcttatagcatgggctgataagttaaatcccgattacttaagcaataatcaggctaaaagggatgacactcataaatacaattcaaacaaggaaaactggtatctccagataaccaaagggctctttgaaattaaaaaatacgatgatgtgataaggctatccaatgaggccttggaaaagattccagaatttaataatttcaatgactattggttcaaatacaaaatagccaagtcctataaggaattaggagaatacgataagtccttagaatatttggatgaaatcgttaaggttaaaaacgattggttcatctatcatgaaatagctaaaaactattatttaaaagaagaccttgattcctctgccaaatgggctgctagagctgcattatctccagacggcaaggtagaaagcaaattgaaattgtatctattgattggagacattttaaaggccaaaggctatgaagatgaatatatcatgcataagtacttggtctatgtaatacgcaatgccaaggactggacccaagaggaaggctgggatgaggaattggcttcatatgagttggatcttgataatactgactacaaatcaatccataaggaactgtctgccctttggctcagcttaaaattcataggccaggaaagacaatatggtaagataactaaggtctttgaaaacaacaatggatttataaaatccggaaacaagtcttatttctttaatgcccgtgaattccaggatgataaaagctttatctatgaaggaacagaagtgtctttctttttagagaaggcttataataggaagaaagatgaagtggttgataatgctgtgaatatttactgtgaagagttttaa

SEQ ID NO: 870 - DNA, 1197 bp, Methanobrevibacter ruminantium
ttgaaattttataacgatactgacatatttgtctttttaaatgaagaatatgctgattttgaaggaaatgaaatcgaatcaatcgaatctaatattgaagatgattttgattatctattcaatttttacgaggaaaaagaagaggattataatcatttagttgacttttatgatgaaaatctggagtcttttgaatttgattcattaatcaaggattatgaggattacatgaatcaaatagattcatttatcgatgataatcaatatagagaagataatatagaatcctttatagaagattatgaggatgaaggggaaatatttgatttgatcattgcaaaatatgaacaggaaagacaagaagaattggattactatgcagatgagtataaaaaccagataagtcccgatgatgtggaagagaaatactatgaccatattgaatctttagatgagatgcattataataactatgaagagtccatagaatcaaaatttgaggcctaccagtcaagtccaatcaataatcacatcgattatggcaacatgcatgaggtagataacttttcagactatttggattataaggacatggacactatcgattttgctttaagccaagccgattcctataatgagattgaccgctctccagaatgggatattataaatagtgatggtcctgaatacgatgaaccctttttcatagaggattttgatgattgcgacaatatagttgtggattatttggaaaacattcttccattagatgcagagcttgaaacattaattgaagatgacccatatgactctttagagaatcttattagctttgatgaggagatcaattcaaacattgaaggagagattgattttctaatttcaaataagctagaggaaatggaaaggtatgaatatgaggtagattcatatctggaatctcttttagaggataagaaagccattaataattcaatagaagcttatttagacagggaagaatacagagagtatgatgaatattatcagttcaatgacttggaacttgaagagatagaaaaccagggcatagattttgatgacttgaataatctagatggaacagctaatatctatttcaatagagacgaggaagatgaagagccatttgacttaaatgaggatatttattatggtgattatcagtacgatgagtaa

SEQ ID NO: 871 - DNA, 4641 bp, Methanobrevibacter ruminantium
atggaaactatagcagaaaaccagaatacagaatttgaactaaatgaataccaagaggaagctgtcacatactatggcgaaaagcctctcttgattgaagcaggtccaggttcaggtaaaaccagagttattaccgaaagggtaaggtacctggtagaagaaaaggaaatggacccagaatcattcttaataattactttttctaataaggcagctcgtgagcttaaagaaagattaatggactattttgatgtggatataatcaatcaaatgcagatatccactgtacactctttttgttataaactattaatcgaaaacactaacattacctataaaatccttgatgatgattatggaacaaaaaagaacatgttcatatataagaatagagaacgacttgggtttaaaagagagtctacattaactagaggaaaggtaaaggatgtagtggctgcttttgacaaatattctacttttgatgtggatacagaaaaactggtagaatggataaaggagaatgaaccagtttcccaagattatattgattttgtaaacgaagaatatagaaaaaccggcaagtttccaagaaagaagatagatcttgataaaaagaaaaagaatctgaaaactgctactgattatcatgcctatgcagattcctggtataatgcattgcaccttcaagtggcaaaggcatatccaatctataaaaaacttttagatgagcacaattatcttgattttaacatccttcaggtaaaggctcttgaatacttaaaggaaaacccagaaacccaatatacaaacattcttgttgatgagtttcaagatacagaccctgtacagattgaaatatttgaaatattaatgaaaaatgctttaaatcccatagaaaaaagtaaagatgatgctgaagaagattgtccccctattagtgaattagaactagatgaagcggaaatctctgataagaaaataacatcctcatttactgctgtaggagatatggaccaaagtatatatggatttagaggggctttggaaaattactttgaatattttgataataaatattgctgtaaaaaagttggattaaacgtcaattaccgctctactaatgagattattgagttcagtgaacaatacataaagatgcaaaggggtaaaaaatctagaaagaatttaagagaggcccgtaaagagtcaagaaacatctactatatagaaaacgaagaaagggaaatggaagcggcaagcattgccaaaatcatcaaaggacttaaggatgaggaaaagattaaaaactacaatgatgttgccgtcttgcttagatctgtcctcacttcctctaaagacataatcaacgtattcaatgatgagaacattccatttcaggtaaagggattgcaggaccttgaaaacaaggatgagataaaatccatcttaactctattgcatttcataattgaagacgataaccctcaagaaactccaataatcacattctgggaagctgactggcttaacctaagggcatttacaaatgcagactttaagcagacctttataaaattatcctctgaaacagaggaaatattgattgaaaagcaaaaggaatttgaagaaaatgtctttaattatgctaaattaatttataatgacatcacagggaatagatttacaaaaagaagctataagggagttttagagcttgaagatgaagttcttgatgctgtttttaaggaatatcctaaacctgtattaacaaataaaacccttagagaatatggaattactaatgaagatgatttagaattcttcaatcaattgaatgagcttaaatttgaaatattcggtgatgataaggactttgatgaaaggcctaccatattgaatgtctattataggatccttgagatatgcggtttcttaagtgaagactatatatttgaccctaaaaacaagcaagctttggattatattgggctttttacccaaatcatctacgaatatgaaaacatcatatccaacagagacataagaggcctttactggttcttaaactctaatatcaagaattacagctatgacattgaaaatgaaaatggcgtaaacataatgaccattcataagtccaagggattggagtttccagttgtcattcttgcaggcttgaacgactcatctttcccaagggaatatgaagacctaagagaaaccaaatataagaatggaagcgctgtattctacactccaagggaatgcctaagatataaaagccttgataaggatgatgtcacactccattatgaggaagaggaaaggaatatctatgtggctatgaccagggctcaggaccttcttattttatctaaaaactttaaaaatcctaaaaagaccacttattccaagaccttggaaaaggaaatcaaagcaatcgagctaaaggaaaagataagtagtattaaggatgagcttgatgagctgatgaaaaaagaggatgttaatgatttatccttccttcttaagagcttgaatgatgagttaaaagatataagggcagaacttaaggaattgaagcctcttattaaagatcataaaaagattaaggttctaaataagcaattgaaagaactttccattgaaataaaatggaagataaaagacttaaaatacgaagataagattatggatgatcttattgacttattcaatcttgatgaggatagtggattaacaagggatgatttaaagaatatgttcttgaatgactttgacattggtgaaaataatgaggattctgatgaatctgagaatagttttgaggatataatcaatgattcaactattgataaagaattagataacgataatacatccatagattcattaagtagtaataataaacctatagaagactactttgaagataaagaagcattatcagacatattagtccgtactgaaaatgaaattgcaggattaggtgaggatatagaaaaatcactaaagagaaccaaaaagctcttatctaagcttaaggagcttcaagatgatgacttaaatgattcaatgtctgaaattcacttcaaatataagatggaaatccaatcaatcattgaaggggccattgaaagcaatgaagatgattccctcagcaagaatcaaattgccttaaatgcattgtactgcatgctccagtcaatcgagtctgaaataatggaaaacaaagaaaccatggaatcaaataaggagatcttaaagcgagaaaaagagttgaacaataaaaaatcatacttggattataaaatcaagctaattaaagacactgaagaattcgacaagaaatatgacatgggatatagtataagcagttatgaggaatacaagataaaagaggacttggatgaactcagcaaagtgcttatggatgattcagtcaactccattggagatttggcactcttaagagaaaaggttctggaagctggaagtccaaagctttgtgaggacttcataatcaattgggaattgattgaatctctatttaatgatgacaaatttgccaaactggaacttctctttaagataatggaatctgaagagattgataatattaggcatatgtcaatcctaaatgacagaacagagctcaaggagaaaaccaaactcttcttcatgttattctactataagaaccaagagattgaatataaggagaaattatccttcatcaataagaaaaaggaccatcttggcaatttaatcaatgcatatgatggaattataaagattgaacctaccgaaatcgacaaggtaatagatgaaaggaagattccaaatgttattgtaatagaggatgacaagaagctaaccttaagctacagttccattcagacctatgaatcctgtcctttccagtatcatttagcctacaactataagttcaagatttcagatagggaagcaattactgaaggaaatatcaatcacaattccttagaggaaataaataagacaatcattgaaagaaaggatgaaaaagaaggagaattagttggagaaatagacaatgaacttctcatttcaagagatgaaatcattaaaatcgtcaagagaatctatatggaaagccctaatatagaccgtgacgaaactcctatagactatgttctatcaaatatctttgaatattgggacaattatggcagaagatttgatatcattggctctgaatatcaatttgacatcaatagagaggactattttgttttaatcggttccattgacttattatataaaacagataatggaattgttatcttagactataagacaactgaaaacatctctaaaaaagctcaagagaaatataaaaagcaattatatacttatgctttagctttaaaggatgatccaatgtataatgatgcagttgttgataagctgcagatatatgcaatcaaatctcttgaaatgcttgactttgagctaaatgaagaagagagggatgaaagagaagagaagattagggaaattgcatctaacattaggaatgaggaattccattcaaaaggttatgacgagttctctgaatgttcattctgcagatatagttttatttgtgaaaacaattaa

SEQ ID NO: 872 - DNA, 1209 bp, Methanobrevibacter ruminantium
atgaaatatgttattgttatagaagatggtgctagtgattatcctatagaagagatagatggaaaaactccacttaaggtagcagaaaagcctgcattggatagaatagctagagaaggacgtacaggccttattcaaaatgtgccagaaagccttcctccaggctctgatgtggctaacatgagcatattcggctatgatccattgctatactacacaggcagaggaccattggaagctgcaagcatgggagttgaaaccaaagatggagatgtggtcttccgctgcaatacaatcacagaacgtgacggccttatggcaagctcaaatgcaggacatatatcctctgaggaagctgcagaacttatggagtacttaaatgaatacttcaatgacaagtatcctggctttaaaggcaagttctatcctggagtaagctacagacacttatttgtatacaatgataaggaaaatgcagaaaagctagctaaattggacatggttcctccacatgactttgttggagagacaatcgctgataagatagagtttgattcctttgcagatgaagttaagtcaataatgctggaatcaaaggaagccctagaaaaccatccggtaaaccttaagagaattgaagaaggaaaagagccttccaatatggtttggttctggggtcaaggaacaatgcctgcaatgccaagcatgaaagaagtttatggcctaaagggagctgtaataactggcgttgacctaattaaaggattaggcgtatgttcaggatgcactaacctagatgttccaggagcaactgcattctttgatactgattataatgccaaaggagaatatgcaattgatgccttaaaggataatgacattgtatttgttcatatagaagcacctgatgaggcaggccatgctaaaaacctagaggaaaaggtcagaggcattgaaaatattgataaacatatattagcccctctacttgaggcacttccagaatatggtgactttaagatagctgttttgccggatcatcctactccaatagatgttggaacccacacaagagatatggtccctattgccatctattcaactgtagatgagccagatgatgtccaagtctatgatgaggacagtgttaaagagggttctcttggtgaattgacagggtgtaatctcttaaaattgctattggaataa

SEQ ID NO: 873 - DNA, 486 bp, Methanobrevibacter ruminantium
atgagaatgaacttaattcttgaaatattggatgttcctggacaattggtttccatattaggccctattggtgagcttggagctaatctggtaaccattgtacacaaaagagagataagaactgaagaaggcaaagtgcctgttcaaatagctcttgaaggagaaagggaaaaccttcaagcagttgttgataaatttaaggagatgggagtaaaccttatagaagtggatgatacaatcaagaaggaaaagctaagcactatcctttacggacatatcatagacactgacttaagagacaccgtcgataagatcaacgctgtggaaggacttgtcgtaagtgatttacaattaaaattagatggcgaactcaaatcaactgcactgcttacaatcgagcttgatttaggaaaaagggaaatagcctatgataaggttatggaaattgctaaagagaaggactttttagtgattgatgaggtctaa

SEQ ID NO: 874 - DNA, 216 bp, Methanobrevibacter ruminantium
atggcaattgaaaaagatgcagaaaaaatattagaagaattttcaaaaaccttggatcaagttccagaattggaaggaacttattatattacagataaccttaatcttaatcgtgaagatgaatctgaagaaaaggacgctagtaaaattgtcagaaatgctagaactgacaaagatggtaatgttattgtaaaaagagcagattggactggttaa

SEQ ID NO: 875 - DNA, 1812 bp, Methanobrevibacter ruminantium
atgtgcggctgtataggtctggtaggaaattttaataaagaattactattttctatgatggaatctactaaacataggggaatggattcaagcggatattatttatacaataagggttcatctgaatcactctatgaaaataatttcattttagataatagaaaatctttcaatgaatcatctatggaagataatgattccaatcaatgttctacaataggccttggacataatctattgtccatatttaatctaatcaatgaaaaaagagaaataacagacaatatcaatgaaaacagacagccgatcatattggataatcttgtattcatattcaatggagagatatataatttcaataagcttgaaagctttctaaaggaaaacaatgaaaattatgtaaagtccaaaagtgacagtcaactattggctaatttgattcaatattattataaagagacaaattcaggcaatcaggaaaatcctcttttagaatctgtaaaagaagtcgtaggtcaattggatggagactatgcgtttgcaatatatgataaggataatgatgatttggccatatcaagagattccattggagtaaagcctttattttatgctgtaactgataatctgaaaggatttgcatctgaaaggaaagcactttggaaggctggatttgaagatagtgacataaaggatttaaagccaggatccattctatacaactttgaagaaattgatttagatgatgatttgataaatgaaatcataaatactgactttaaattgcttaaatcttcatttgatgactataaatcctatttggacactaaagatacctatgatgtttataaagagctcttggctgatgatatatatgaggcagttgaaaagcgtgttgaaaacatagtagatataggccttatattctctggaggagttgacagtactattttagcggtcattctaaagagcattgcagaaaaaaggcaaaagcaaattgattcagttaataataaatcttcagatttggataacgtgtttttaaatggtttgggggaaactagcaatccatcaaataattcactagaaaatagcaaatcatcaaatgacttttcagaaaatgttaagccattaaacataaggctatatgcagtaggacttgaaaactcacaggatatcgaattcagcaaaagggttgccaaagatttagatttagacttaaagacaataattatagatgaagatacaatcagaaagagcgttccagatgtgctgactgccatagaagacccaaacatcatgaagcttggcgttggaatgaccatataccttgcaactaaggcaatccatgaagataatataaaggtagctctatctggacagggtgcagatgagctctttggtggatataacagatatctgaaacattttgataatcacactctatttgatgcatattttgacttggatgaagagatatatcatgacattgcaaacatatatcacgtcaatcttgaaagggatgatgcagttgcaatggccaatggggtagaactaagggttccgtttttagataaggatgtaattagccttgcattggatattccagggaaattcaagataaaagatggtgatgaccttcttagaaagcatatattaagggacttggctaaggacattggagtggctgaatatattgcagacagacctaagaaggctgctcaatacggctctggcataaataagattctaaaaaagaaagttttgagaagctttaacattgaagagtttgtagaatccttaaaacattag

SEQ ID NO: 876 - DNA, 267 bp, Methanobrevibacter ruminantium
atggcaaagaaaaatatataccttgcaatgattctttcttttttcattccaggtttaggtttagcgtatgacggtgtagttaaaaagttcctaggatattttattctgggattgatttttattggactatggttttacttcggtatgcctctagatgctgagataagcaatacaggtttctgttgttacttggcatatattatcgtttggatctttggtttatatgatactttaagaaccacaatcgatataaataggggagaataa

SEQ ID NO: 877 - DNA, 1137 bp, Methanobrevibacter ruminantium
atggctgaatttagtcttgatgtagaagaaattaaagaagaagttgaaaaaagtttccaagaagaggaaaaaacaattcctaatgacaaaatcaagaagcaagctgagcaaaacgctatcgctatctttgaagcagactttgatgatgcagcccaaagggaaggaatcatcaagcctttagacgactttggtataaatgccattaaccgttcctctgctaaaaacagtcttttaagcacacgctttaaagagatgtccaaaggaggatcagaagctgacaatgtaggtgacaagttagctgacttaaaccgtcaggtcaaggctttagacccaagcaaagtggacttcaccagaacaggattcctcggaaaccttttccatccggtgagaaaatactttgacagatacgaaaaggctgaagtcgttattggaaacatcatcgaatccctagataacagtagcaaggtcttgcagaatgacaatacaaccctcttatccgaggaaacttatcttagggaattgaccaaaaagctcatgaccgacattgagcttgcaaaggaaatggacgaatccattgaggttcaaatcagaaacgctgaaatccaaggggttgaccaatacaagattgactttgtaagggaagaggttttattccctctcagacaaagaataatggacatgcaacagatgattgttgttaaccagcaaggtatcgtttccttgaatgtagtcagaagaaacaacaaggagcttatccgcggtatctcccgtgctaaaaacgtaactgtaaccgctcttagaaccggtgtaatggttgcaagcgcattgtacaatcaaaagattgcaatggataagatcaaggtcctaaatgaaaccactgaagacgttatcgaatccacttcaaagatcttaagggagcaaggaagtcaaatccaaaagacagcttctgaaaccatgatctctcctgaagtattgaagacttcattcaatgaggcattagctgcaattgaagatgtaagcaattacaaacagcaagctcttccaaaaatgcaagagaccattattgcatttaatgaaatggctcaggaaggtcaaaaggtcattgataaaattgaaatcggaaacaatacccaataa

SEQ ID NO: 878 - DNA, 453 bp, Methanobrevibacter ruminantium
atgactgaagagataaaaaagaagataaaggacatgaactttgagggagactttcaaagtcttgacttatataaggaagccttgtttgatttgaatcagcaattcttctcaaaaaaggcaaaactaagcaatttgattgaagaaaactatcaatatacaaattataactatgacaggctcttgaatattgttttccatctggaaaagatgttcaatgaggaatataagtcaatcctatcaataatacagctctcatataagaacaatgtggtgatagatcagctactgcagaagaagtttaaatcattgatatcaataattgataagacagattccttatatgatgatttggttcttaatttatccctttcggattcaaatgaaaatcaaagaaacatatctgttctagaaagcatggattctcttatagattctgttaaatactacaaataa

SEQ ID NO: 879 - DNA, 510 bp, Methanobrevibacter ruminantium
atgaaacgatataatcattgtatttattgtggctataaattacatagcgatgatgttttctgtcccaattgcggggtcaagatcggctatgtggacgatcagtccgtttcccttcccttaagcaaatacaaagagcaggtattagagctaagggatgaatatgaaaagaaggaaaaggaagtgctgagtcttgtagaaaaacgtttcgcaccgccacaattgacttatcatagatttataggggaaattgataattgcagggtattgttcttcagggaagctgaatcaatacttgacattatcaatctggtaaccgaacttagtccaaagatagaaactgaaatcaagaaaaagatagaccttctaaagaaaatcatagatcagatgaatgacctgatcaatgaattgattataaatatgggggataaggaagaatctgaaaatgaagttaaaatcgttttggatgatatgaaaaatctgattgattctgtaaaggattatgacttttag

SEQ ID NO: 880 - DNA, 1287 bp, Methanobrevibacter ruminantium
atgactaaaaagtatggagatagaaccttagaagtgcatgcaggtcaggaagaggcagatccttttaccggcgcaagggctgcgcctatctatcagacaagctcatatgtatttgaaagcgctgaatatgcagcaaacatatttgcccttaaggagcctggaaacatctatacaagacttaacaaccctaccaatgaagtctttgaaaagagggttgcagcaatcgaaggaggcgtgggagcactatcccaagcaagcggaatggcagcaatcacccttgcaatactaaacatcgctcaatgcggagatgagatagtttccggaaacaacctttacggaggaacattcaacctatttaaaaataccttaagcaagtttggaataaaggtaaactttgtagattcccaagacaccaaggcctttgaggatgcgattaatgagaatacaaaggcactttactgcgaatcaatcggaaaccctaagctggatgttccggactttgaagttctagcggacattgcacacaggcatggaattcctttgatggtggacaatacctctgcaataggcatggtaaagccaatagagcatggagcagacattgtagtccattcagctacaaagatcattggaggacacggaacttcccttggaggaacaattgttggattcagggtaactttcgactgggaccaaacggcaagttccccagagtttacagagcctgatgacagctatcatggattgatttatactgaagcattcggcaatgcagcatacattacaaaggcacgtgttcagatgatgagagaccttggtacatgcataagcccatttaactcatttctacttcttcaaggacttgaaaccatgtcccttagggttaagcaacatacagagaatgcccttgaagttgcaaagttcttagacaatcatgagcttgtatcatgggtcaactatcctggccttgaagacaatccaaaccatgagattgctaaaaagtatttaggagacaaattcggctgcgttcttggatttggaataaaaggaggaatagaggaaggcaagaagtttattgaaagcgttgaactattatcccaccttgctaacatatgtgatgctaagacattggttgtgcatcctgcttccacaacacattccacattaagccctgaagagcaaatagcaaatggagtgactccagactttattaggatgtctgtgggaattgagaatgtggaagatatcattgctgatattgatcaggcgttaaaaaaaagcggttga

SEQ ID NO: 881 - DNA, 648 bp, Methanobrevibacter ruminantium
atgacagataatgaattgaaactggaaacaaagtgctatgatgcctgtgaatatggctacctttatggattgaataagaagatacctgatgaagactgggaaaaggtaaagccctatatgagaaaatggaaaagaatggactttgtagaaggcaatatcaaggtaacaggaaggcctgaaggatacaggtgcctggaggaagatgttgccaaggttgaagagatacttggaataacaaacactcttgcaaaaagaagggcaaatattgaagagaaaatgtctgaccctataaaaaaggttcagtttaaggaccaatgctataattggttgaatatgctatttaaaagcggaacacagccaaaacaagacctgtccagacttgcaatccattcaacaaagatctatgaccctgcagacagctttaaaaacggagcagaagatggctatggagagcttttcatctataccccacatggaatgtggtatgtaatcaataatggaagcgatgctgccaacaagtctttaaataatctagaaagcaagtttggaggggccattggatataggttgatgtatgctgatactgtagataccttaattagagtatatacagaggaaaatgagtatactgggccacaattatattag

SEQ ID NO: 882 - DNA, 2235 bp, Methanobrevibacter ruminantium
atggaagatgataatttagaattcaacgagctcttgaatgacctagagccacatatttttaattttattttagataatctctctgaagttccatccgatctatcaaaaaaggaacagatagaattcatcacatccaactacagccaggacacaatagatgacctgatagacgaatacaatacatttgaaatagaggcaacagaaactttagactctcttgaagatgatatctttggtctagttgcaatgggccttgacgttccagaggacgacaaggaggagcagattagctatataatcacaaattactccaaggataagatagaatacgccatatatgaagctgaattgaaaagggaaatcatagctgaactggaggaattggatgatgagtacttcaatctgattgtttgccacttcaacctatctgatgagattggggaaagggaaaccctcattaactgcatttttgataactattcaataagccaaatgaaaactgcaattgagatagcagataagaagatggtcttctataatgatatgcttggatttgatgatgacgtattttcattcatatgctttaactattcctctctagactataataacctcaaggctttggaaaataaagagagccgtaaggataaggcatattatcttatttcaaactactctccaactgagctacaccaaaaggccagtgaattttttgcaaagatagacctcttcaacagcctggactcattggatgaggtcttatttagaatccttataaagaacatgaatgcatacagcttctttttagaccgccttgacataatatataaccttatgatcaactattcagactatatcatttatattgaaatggacaaggcaagggaaagctttaagacctatgatgagcttagaaacctggaagacattaagctgctgttccttgcaaattatctcaatgctccagaggaaatgatagaaaactggataaaggtctctgattttgacaataatatcttcaaggactatgacgttaacccaaagaaccatataatcagcttttatatagatgatgaagaggaagaaaaagaggaagagcctaaagtaaaaagaaacaatctctttggtatcaattactttgacataaatccattggaattgtctccaaaggaagagattgcctattatatctataagaacaagtctgaggaagacataatagaagggcttaattcattccctaatgtgattgtggacagcgatggcaatcttgtagagggcatgaatgattccatatcaaattctaatcttaataatcctgctgatagtgatattaatgatatagatgattctgataataaagagagtgataatattagttctaatgatgattctactgtaaaagtaaatattgaaggagcagatgatggaaaatcagatgaagttgaagtaaaaatttcagatgatgaagattcagattctactgaaaatttagatgaatcagataaagattcaaattcttctgaagacttagaagaaacacaagcttcacaagcacctgaaaaagatagttcacgtcctgaagtatctaaagaagaatttacaaagatgctaaatgaattggatggggacgtattcaagattctaactaaaaagctagcaattgtagaaaacaataaggtatctatcatagaccatatcgtatctaactacaactactacgaaatagaagatagaatcaagcttatctcatttaaaaaggaccactatgttcgtttagatgccttggatgatgccacattcaacatattcttgaaagagttttcaactgttcctaattcattcaatcgctttgaaaagatagactatatcataaacaactattcctatggctatatagaatccagattggagatggttctagatgacattagagagataaaaagatcattagccgatgatgatgtcttctttgagatagccacatactttaaattgcctctccatgccactaaggaagagcagatcgatcaccttctaatcaattatgacttgattagagttcgaaaaagaatcgctttctatgagggcaagcttcacgtagaaggcttaattaggggcatagttgataaaaacaagatagaatgtccttattgtggtgctaagattagaaaagatgctaaatactgtaccaattgcggtgaaaagctaagcattaacattaatattgattaa

SEQ ID NO: 883 - DNA, 747 bp, Methanobrevibacter ruminantium
gtggacttaaaagacgtttattattcttcaaaaccctatactcaagaggaatttgaaagtatcataataaatgcttataaatatgtctgtgaggagattgaaaccaaaaataaacgttttcaggcatgtcatgattttgaaccatgttttatttgctggaacatcgaattggaagggaatgaatttacaaaatggatagaggaaaattctgatcttagagtaataaataaattcaatgcttcaatggatgttggggttctaggctcatttacagaagatactattaagctggaaaatggcattgatctatctaaaattccaagatgcaaaggaaaatgcgatagggaatatttctttaatgaggaatgcttctttgaaagaagaaggctaagagagaaaatagggtcaattgaagatatggaactaattaatccttcttcaatatttgaattcattgattataaagaagaattcattgatttaatcatagaaagcgttaatcttataaaaaatcattttccaaaggcaaaaatttatttaaaatataattgggatcatgaatattgggatttaacttcaatctgtggaaatatttatctaaaagacggaaataatgatgaaaactatagtatttataaatataaactctttccagactttgttaaattaagaaagtcctatggtgatttcaattattatatagaaatgatagatagcgatgaattggatgaacttttaaaaaattga

SEQ ID NO: 884 - DNA, 795 bp, Methanobrevibacter ruminantium
gtggatataaagactctccaaaaaagagccatatattatagcgaaagcaaatatacaagggatgaattcgaaagcataattatcggtgcattcagatatgtctgtgaagagattattcctaatctttccaactttactcgctgtggctttgatttgaattttgaaaggatttgctttgccaaaggagtcaatgggtatttaaataaatggattgaggaaaactctgatttaagaattctaagaagcactgaaatatcaatggatataggaaaccccttcagtccgaaatatgatacatataaacttcttgataatatagattatgcaaagatgcctgattgcaagttggaatgcccaaacaatgaggactatgaaaagatctggagaagaaagcattgctactgggaaagagaaaaggtcaaggaaagattaaactccattgaaggtttgatattggtaaatccaaatgaaatctacaggtttgtacttaagaaggacaatttcattgactatattgaaagcactatggatttgattagaaagcattttccaatggctgtagttattttgcagtttagtccagaccctgaatgcgaaacctatgacattctttcagctgtaatatatgatgccgatggagactatgactattcttttttagtccagaatgaggaatttacagaggaaaactgggccttgattgattattacgatatacatgaccttatccttaaattaacaaaaagtgatgaatattataaaagtttgattgaaaagaatttagaaagcgaatag

SEQ ID NO: 885 - DNA, 447 bp, Methanobrevibacter ruminantium
atgtataaattaaagaattttttaaaaggacattttgcaaaaagcaaagtcgaagacttgaattttcactgtaagatcaatgagaattttcttttgataaatccaaatgaaatctatgattttataggtgaaaataatagtttaatagaattaattaacattagtttcacattaataaaaaaatattttccagattcaaccatatatttggaatttaatcaagaccctgaatatgagggattgaattcaatctttgccaatatttatgatggtacaaattcctatgattgtaatatggatttatttgaagatttatcccttgaatttagagaattaaaaaagcaatatgggaaaatggattattttttagatatggtgtctgttgatgagccttttagaaataggctaaatgataaatttgatgggtttttaaagatagtaagatga

SEQ ID NO: 886 - DNA, 360 bp, Methanobrevibacter ruminantium
atgagctttgattgggaaagatttatagatgtggctgaacatttaagaaactattccaatagggaagagtatcaaaggacagcagttggtcgttattattatacttgttttttaatagcaagagacatctattatgatatggccaaagtgcctgagggaacatttgtatctcatgaatctgtaataacattttttgaaaagtcaaaaaaggatattgagaaagatttgggcactaaattgagaaatttaagaagaagacgtaataatgcggattatgataaggaattccgttttgctgatttaaatgacatcaaaaaaagatataaggacattattactttgcttgacaaattgaaataa

SEQ ID NO: 887 - DNA, 432 bp, Methanobrevibacter ruminantium
atgaataacaaaactagaatggtggttggtaggcactcaaaaagaacaggtcctgagatggatcaaattgtagaaaagtactacttctttgaagaaggctttgctgggctaatgatgctctttgaagaggactggtttgtggataagcttttagagttgaaggatcttgtccttgagcactatgatgatgtggtattctacttcttcaatcttaccctaaaaagcgatcttgaaagctgctgctttttggtgacagtcattgtgaagaaggatgatggccatgagatgtccaagtcccatatacgctctctgatttccgataggatcaatgatggctcaaagcttccctttatgataaatcttgttgaagtgagcgatcctctggaatttaagagatatacgcagggggaaataggacctcataaagactga

SEQ ID NO: 888 - DNA, 402 bp, Methanobrevibacter ruminantium
atgcaagtggcaatagctaaaaaggaaaatggagaaatattggaattggatgatataagctaccaatttgtcttatggctaaacgaaaacaacctaacccaacttgatccaatatatgcaaagtccgttctaaagactacagttggagagttcagcaagcttaccagccagcatgagtttgaaggtgaggatgagatgcttgttcctcagctcaactactttgtagagctttcaacatgggcttcctggaaggatggcaagcttatggatgaggatgaggaaataacaatatcctttgagatatgtgatgtggtcttcaatagggagactatgaaagaggaataccatccgattgaaatgacttatatgaagtctttcatagagtcttttttagaaaaataa

SEQ ID NO: 889 - DNA, 1836 bp, Methanobrevibacter ruminantium
atgacactaacagcagaacagcaaagaattgcagatgatatgtgcagagagcttgcaccaatcacattcatacaaggaaaggcgggaagcggaaagacccacctcatcaatgagctcatcaatctattggagatagatgagatattgtgccctacaaatcttgcaaagcagttatatgggcgcaatgcaagaacaatacattccttcttttttcatgagtttgataaaattgaagaaggctatcagaaccctaaggcttatgatggggttcgaaatgactatttcctcagaaacatagcctttacaaagataatagtaattgatgaagtttccatggtcagatccgaccttatggagatgatacataagattctatcaactgctcttaagaacgacagtccctttggtggaataaagatgatacttgttggagacatgttccaactgcctccgattgtagaatccgaggaaacctatgaatatctgaaaaatgaatatggcgggctgtacttctttgacagccatgtaattcgtaataatctttcccaaatcaagttctatgagctgaacgagtcagtgcgacataaggatgactccgattgggtaaatatgttagatatgttacgtgaagtgcctaagtttgaaagggtccttcctattttagaaaagatcaacacccgtgtcgtttctcccgatgagattccagagaatatcactgcaataactccttccaatgctgaagcaaacagaatcaacagaaggcagttggataagatttccggagaggaattctcttcaagagctcatttcagaattaaggagctggattcaaaggattatttggaattttattacagcgaagaccctatgaaaatagacatgcaaaaatattatccaattgaagttccttccagattcgaagccttcttaagatataagataggggctcgtgtcatgttaaccggatctgttatgggcggaggtaaaaatggagatttcggcactatagtggatagggagataatcagggattatgatgatagcataacagaaatcattaaagtgaaattggaaaagaataatcaggtagtctctgtaactcttgacgctttcagcgctgtggattataagtatgaaatggaatatgatcctacatcccatagcttaagacgtaagacaccttatattcagcgtgttaaacaatacccattaaagctaggctatgcattcaccatacataagtcacagggccaaagctttcctgaaatggttttggacttgaaaagcaatatttttgcttcaggacagttatatgttgccttaagtcgtgtgaagaaattggagggcttgtatctgacaaagcctatcgcttttagtgatattattatagatgaaaggataattcaattcttggattcattaaggaatagagaatttgatgttccagaggatggctcttcaattggctctcaagaagtattaatctctaaaaagactcctttaaatgatttgtttgaggactttttgcatgagacagaaagccaagctgaaaatgaggtgaataggacaatccataggctggttgattatgcctatgccctatatcaggtagatgaatatgatatgattttacttgagataaaaaagatagctcaaattatttctaaccaattcctcattccacaagaggatatggagtttattgaaaaagttaagactatgtctgatgataaaatagatgaatctatctgtacttcagtactgttcaatctttatgatgtctataaaagggtacatgatgatcccaaccctatagtagtggataagattcattaa

SEQ ID NO: 890 - DNA, 1701 bp, Methanobrevibacter ruminantium
atgctaataaacattaaaattaaaaatttcagatcactcaaggactttgaaatgaacttcaatccaggcctaaatgtaataataggagagaacgatgcaggcaagacatccttaatagactctctaaaaatactatttgggctgaagaagatagatataaatgactataacgaagtgggctgtccaataacaatagctcttgatgagtcaaacttccattactgccttgaatcaaggatagtggaggacactgtggtaaacacattctatctcaagcccaccgaagataaaataaatgaaatgaagacccgcctaaacgggatggatgaactgaaggaagccgaggcaagaaagatgcttaaggagtactgctccatcttcgacatcagctatcgctccaacagtattatggaaaacctcaagtcaaagatacttgaatcaatggaatctgatgaatacaccaaggttaaaagctttagctatccaataagcttcttgggaagccgcgaatttgaaaacatagactcattctttgaaaacactttcttcaaggagctgaaggaggagatatggaacatacatattggggataagaccctcaaccagcatatagatgactatatagaagagttcaaaaacgaacagctttccaatcaggatgcagaggagctcaatgcccaacttaaggaattcatgcccgatttcaaggagataaaccctatagtcaatccaagcgccaagcttagcctggacgttgatgtcgaaatcctcaacagctcagggcagaggataatgatagagaagatgggagacggaaccaaccgccgtacaaccatggccatcttcaagcataagaaggacaaaaaggaccttgtatatgtatttgatgaaatagaaacacaccttcacataaaggcccaattggacattctcaaactattgaaggaccttacaaaagagaataagcagataataataaccacacactccccattcctcataaaccaagtaaaccttaacgagatacatctcatgagcattgacaaggagacaggctctaaggtatctacccttaacagcagcgaagaaagtcaagtcgcattgagcaatttgggaataaacaatatagatctcttctttacaaacaaattgcttattgttgaaggggaaagcgaacagaactttatacctataatgtatgaaaagatctatggctatcctataagccagaatttcataaagatagtcaaggcagatggcataagggacatacctaatttcatacgtgtaatcaagaagtccttttcaaagacagacatatttgtcctcatggacaatgatgcagatgagcttaccgaggaaaggatagagaagatggttgaaggtgacctgatacatagggacaatatttttgaaataggagatgtggagtttgaagacaccttcagcgatgatatattaaggcaggccctaagccagtacatgtcagatacccttggatatgctgttgaggcaagcatgagggacattcaaaatgcaagacattcagataagttttcaaaggttttaggagaggcctttaataggaggacatataaaaactttaaaaagccattgtttgcacagtatctggctatgtttgcagagaaagaggacatagatgagaagataattaaattgtttgaattgattagcgattaa

SEQ ID NO: 891 - DNA, 726 bp, Methanobrevibacter ruminantium
atgtatttggaaatgaatgaattggcttgtgcttgcagaagacaatggaaaatagatgtaaatgaatccattgacatattctcacttgccataaataaaataaagaacttgacaatagtatttaaagtaatggataatgacataagcggagcctgtctaagattggataaggaaaacataatatttgtaaactcaagacacagtaaaggaagacaggcctttacaatagcacatgcattgtatcacttgaaatatgatgaaaacaatttcaatatatgtggaatagacagtgatgatgaaacagagcaaaaggcagatctttttgcatcatgtcttttaatgcctcatggagctttagaaacctataaattaaataataatattcaaaaatgggatttggattcaataattgatgctgagcaatacttccagatatcacatcaagcattgctctggagactaagacacttcttgaatgaaataacctatgaacagtatagggcatttaaggaagatattaatcgtaatgcatccattagaggttatgattcaagcttatacgctccatatttaaataaggactatttaaccattggaaattacatccaattaacagaaaaagcatttgaaaatgaattaatttcgctaggaaaaaaggaggaattattattggatgcttttcgtgaagacattgtatataatttaaatgaagaaatcattctatga

SEQ ID NO: 892 - DNA, 348 bp, Methanobrevibacter ruminantium
atggggtttaaaaatatggtagaaacagtaggtgatagattaaaaagaataagattagaacatgatttcactcaaaaccaaatagcagaatatcttggatttaaacaaggacaaatagctaaattagaaagtaataaaagaatattaaggagtgattctataatcaaactatctaatctttatagatgctctccagaatatataatattaggtattggagagtattccaaaactaatatggcattcagatcaaacaataaaaatctatcattggacgatattgcagagatgaacaggataatcaataatttggaattcctatcaagaattacagacaaacaggagtaa

SEQ ID NO: 893 - DNA, 1122 bp, Methanobrevibacter ruminantium
atgattattcaagaaattttctatgattgtgaaaaatttttaacaattgttcataatggcatggataatgatattaaaaaacgagttatccaaaaatcaatagatgtttcaagacatgaaatcctattaaaagagcgttatattgaaaaatatcaattggaaaatgataattatgaattttttattaaaggatttctagattgtgaaaatgagaaaaacccttatacgaactattcaacatattttaagcaatatgtttatcctaataaaaatgatgaaattgataatttatcatttaaagattttaaaaaagtatatgattttatttatgaatatacaaattttaaatttacaaaattaaatattaataacattttcctattttttcctacggatattttagtgaaaagcattaaatctgaaacaacatcttacttaattatcaaaagttctgagaatattagtaacatttcagtaaaattcaaactaaatgatattataaaagaatcaattaatttaactgagattcctaatgataataaaatcaaatcaagggaaaattggaataattatgaaatagaaatatttgataaagataaaattatctataaatcccatacttatgtaattatgtccataaattttaatatgggaataactacaaagataaaaaagattaaattaaataaatttgataaaatggtaaattcttcaaacttaaaaaccgaaaaattcacaatttcagaggaaaatggattaattaatatttctaattatttacttgaagaatctaaaaatagaaatgaacttaatgatgtgacaaaaacagaatgtatttttttaagaaagaatgaacgggaaaaagcttatgaaatcttagaaaaattagtgaaaaacgatggagaattatttatttttgatccctattttttaaaacaaagcgaaggaaaagatgtgttaaaagatttgctgaatactattttaactcataatgatttagttaatattatcttttcaaaagatattggagaatcttttgagaactttaaaaatagtttaactgttgatgaaaaacttttttttaagaatataggagggtccgccaaaaagctatttttttaa

SEQ ID NO: 894 - DNA, 1497 bp, Methanobrevibacter ruminantium; identical to SEQ ID NO: 85

SEQ ID NO: 895 - DNA, 1143 bp, Methanobrevibacter ruminantium
atgaatttttatgatttaaacaaaattagaataaaaattgctgaagatgaaattgatattaaagaaaatgattttttatacgaactgtatgatttagataattttgattctttatttgatgaattggatatattaattaataaaattgaatatcatcaatttgaatttacattaatttggtatgttggatttttcaatataattaagtatgaagatattgggaatttaccaaatattagtaaattaaagtcatataattatttaaaaggagggttaataaaatattttagagggcattttcatttaactaattatacaatggaaataaaaccttatagaaactattattcatttatagaacattatgttttaagaccatttcaatatagggcaataactaaattgttaaattggatttatatttatgataagaaattcttttttgaattacactattttgataaaagtaattttcatttcttaagattatttaaactgcatgaaatcaaaaattttgaattagaagagaaatatattgattttaactgtgaagacgaattaaaaaattacatactttttaattacattattacggaatatattcatagtgtagataaaaatttgcctaaggatataaaaacaaaaattgaatccgattttaaattaattgaaaaaatagaagttaatatacttataaaaattatattagactatattagattcgatgaaacaaaaaaaataccttgttattttttagaaactatagaagaaaatgaagaaactttctttacaatatttgaatcgttagaaatttataatattaatgaattaaattcactagttaacccattgaaagaaattcatattaatcaggacagattatttcaacaaatgataacaaaattagaaaagttattaacagaagaaatcattactattgataattatgaatgggaacattttttaaatattattcctgaaaaatatgttctaatgataaatggtcttcttcgaaaaacaattggggatttaacttttatttcagaactcgatagagaaataagaagtaaaagatatttctcagaaaaaaataaagaaaaaaaattaaaagaattaatagacattgcaaaaaatataaattaa

SEQ ID NO: 896 - DNA, 1371 bp, Methanobrevibacter ruminantium
atgcaaacatgtagttattgtggaaataaaattagaaataaagcaaaatattgtgataattgtaattcttacctgaaattaaataatttagaaattcaatttgatccaaaaaaatatgaaaaaattagattactagaaaaagctattaaagaagcttctaatctgatagaagaagataattatggtaatttaagtgcaaaaactcaaattcaaataatttatgatacaatttattcttatttagttgaaactacaaattttttgaaagtattaaagaaatatgatttaaatgaaaaatattttgtttatcattctttagagtttattaatcgagttagcaaatatcctaatggaattatatcaaatgaatttctttttgaaataaaccggattttttcagacttaaaaaataaaaataataataatactagaaaatatttattttatacaaatattaataatagagaatatattgaaaacactcttttagaaattttagaatattttgattttaaagttttttcttatgatgattttaagttccctccggaatttccagaaaattttaaaactaaattcaaatcaaaatatttaattttagagtataattcagctgagaatcatatatcaaataaagaagaaaaagcattaaatcaattgtatttattatttggatatttaacttttattcatcgatttggtagattaaatgaaaaatggcatgttaatagattcacattaaatcatcaaatctcagatttaaatgcttcggcaatgattgagttagataagaataataattttttagatatacatgaatctttagatatcttaaggacagaaattaaactagacaaaagtgatttgattaaattcaccaatattccgtttaaaacaaatttatatgaatcaattaaaaatgatgtaaaaaatgaagtagtattacataatatagaagaatatttacgattgtattatattgcttcaactaaatccgatttggaaaattcatttattaaattttggacacttgctgaaaagattttaaaagcaacttttgggcaaatgaatgatgagtctatggttagatatatgaaaaaaattttaaaatattttggttttgcaaattatatccaagatagaataccttttttaagaattaaaaggaataggcttgttcatgaaattaaagatgaaataacaattaatgataggaatataattaaattagttgtagattatttaattttatttttattgaattggagtggtgaattgaataataatgaagaatataaatttattttagacaattttaataaaactgatcttaacagaagagttgaattattaagtattttgaatgaataa

SEQ ID NO: 897 - DNA, 2712 bp, Methanobrevibacter ruminantium
atggtactaagtcaaagtgaaatgagaagaagggctgaaaaatttattgaaacttataaggaagtgtctgatgaaagaagttattctcaaatgttctggagagacttctttgatatttttggaataagcttaaatgatgtcgctgtttttgaacaagctgtaaaaaaatttgatggaacacaaggttttattgattgcttttggaaaggaaaacttgtaattgaacataaatcagagggaaaaaatttaaacagcgcatttcaacaggcattaggttatctggatacattatcttcattggaaaaacctcgatatataattgtttctgattttaaaagaattcgtttaatcgacttgtttgaagacaaaaagacagaaatatcattgtttgatttgaaagacaacattcagatgttcaactttatttatttagatggtgtgaaacatcatgaaaaacaagaagaactgaatattgaagctgctgaactaatgggcaaattgcatgactctctcaaggagtcaggatacgttggtcatgaactggaactccttttaattagattgcttttctgcgtttatgcagaggatactgggatttttaacacttatcaattctttgattatattggtgatgaagaagatccaattagtgttggaccgaaaattcaacaattattcagaatcttaaatcagcccgaatctcaaagacagactaatttgccggaggagttggctaattttccatatgtgaacggtaaactctttgaagaacctattgtccctccatactttgattatgaaatgtacaatcaattaaaggaaatctgtaaattcgattggagcactatatctccagctatttttggctctatattccagtcaataatgaatgaagatgagagacgacaattaggagctcattatacaagtgaatcaaacattttgaaggtaataaattctttatttatgaatgatttatgggaggagtttagaaaagctaaaaagaattctaaaaaattagaacagttaagagataagatgggaaaattaaaattctttgaccctgcctgtggttgtgggaactttttaattatagcttacagagaattaagattattggaatatgaaatcttaaatattttacataatataaaaagtgaacgagatactcaagtcctattcgattccaaggagttaagtaacattaaaattgaaaatttttatggaattgaaattgaagagtttccttccttgattgctaaagttgctatgtggttcattgagcaccagatggatttaaaatatgaacaattaaacatacataaaagcaatttaccattaatatcttccgccaatattattcaaggaaatgctttaaaaatagattggacacaatttttacagcctactaatgaagtatttgttttaggaaatcctccttttgttggttcaagagaacaaactaaagaacagaaaaaggaaatgaaagaagtatttaaaggtgttaaaaggaatggtttgcttgattatgtttctgcatggtatcttaaagcagcacaatacatccaaaatacaaatataaaagtttgctttgtttctactaatagtatttgccaaggagatcaagtaggaatattgtgggaagttttgatgaaaaaatatgatatccatattaattttgctcaccaatactttaaatggagtaatgaagctcgaaatgctgccaaagtatatgttgtaattattggtttttctactgttgacatatctccaaaacatatttatacttatgaaacacttgattctaaaccagatttagaaatagctactcaaattaatcaatatttaattgattcagaaatagtttttattaaatctaggaataaccctatttcaaatgtttcaaatattatgaaaaaagggagtaaagcgtatgattatgggaatttgactctaagtttagaagagaaaaatgagttattagatgaatttccagaaatggaaaaatggataaaaacatttttaaatgctcgtgattttttaaaaagcactgaaagatattgcttatggtttgctgatataaccccttgtgaacttcaacaattgcctgcaccaattaagttaagaataaataatgttaaagaaaaaagggaaaatagtagtgattcaggtataaataatattgttaatgttccatggttatttgaaaataatcagcctaaaaatgattttttagccattcctgttgttagtggtgaaaaaagagattacattcctatgaaatttttatctaaagaaatcattgtaacaaatgcaatatatacttttgagtctgccactttattggattttgcatttttaacttctaaaatgcacatggcttggatgaagtatgtttgtggacggctaaaaggagattatagatattctaagaaaatagtttataataatttccctttccctaatgaattatctgaaaaggataaaaataatatcattaaaaaagctcaaaagattttagatattcgtgatgaatataaaaacgaatctttagaagttttatatggagaatatatgcctaactcattacaaaaagcacatatcgaattagataaagctattgataaagcgtatagttctaaaaaatttaaagatgataatgataggatgaaattcctattcaatctttatcttgaatacacttcagattaa

SEQ ID NO: 898 - DNA, 918 bp, Methanobrevibacter ruminantium
atgagtaaattttatgaagctaaatcaattttaaaaaatttggaagtgcctgataaacaacaatcagatatatgcgtatatacatttttatctttgctgtctgtttcagaagatacaaagtgggaagattcaactaatgaatggatcagaattcatgatgtcatccaattcataaagaataattatggtgtggtatatgcagaaaacagtagagaaactattagaaagacagcaatgcacccttttagagatgcagcttttattgaagacaatggtgtgcctactaactctccaagatacaaatataggataactgatgaattattggaagttgttattagttataatacttctaactggggttctgctttaagttcatttaaggaaaatcatgaaaccctaattgaaatttattcctccaagaaagagatgaggaaaatgcctgtaaagattaatggacaagatttgaccttttcaccaggaaaacacaatatacttcaaatattaatcattaaagagtttgctccaagatttgctcctaattcagaatgtctgtatgttggggatacaactaaaaaagatttgataaagaacactgaaaaattgcaggaattagggtttgagatcagtttgcatgataaaatgcctgatgtcgtattgtattcagaagagaatgattggatttactttgttgaagctgtaacaagtgtaggtcctatgagtcaaaagagagtgaatgagattgaaaagatgactgaagaagttgaatcagggaaaatttttgtgactgcttttttagatatgaaggattttaaaaagttctctgaagagattgcttgggaaactgagatatgggtagctagttttcctgatcatatgattcatatgaatggagataaattcttaggtccaaggtaa

SEQ ID NO: 899 - DNA, 1473 bp, Methanobrevibacter ruminantium
gtgttaaattatgtatcaaacgaaactaattcatttcttaattcaatttctaaagaagaaaggaaaaaaataggccaattctttacagatgttgatgtagcaaagtttatggcccaattatatgttcctactaaaaaacatttagatattttagatcctggagcaggatctggcatactctctgctgccattatctcacaattagaaaatactgatgttgattcaataaatttaactttatatgaaaatgattctcgcatcttgcctttacttcagaataatttaaaattcatctcagaaaacacatcaataaatttaaaatatgaaatcattgaagaaaattatatacttaacaattcattcagcattgaatctcaagagttttgcaaaaaagagtatgattttgttattgccaatccaccttattttaaaatatcaagaaaagcaccagaagctcaattgatggaatcaatatgttatggagcgcccaatatctatttcctattcatggcaatgtctttacatcacttatcaaaagattcagaaatggtattcattgttcctagaagttggacttcaggagcatactttaaaaaatttagagaatatctcttaagtgctggaaaaattaatcaagtccatctttttgtcagtagagataatgttttcaataagcagaatgtattgcaggaaacaataattattcatgtaataaaatctaaaaagcctttggaatctataaagatttcttcatcatccaataatgattttagtgatattgatgaatttgaagtcccttatgatttagcaatttccaatgatgaaaatcattttgtttatctgcctaccaataagggggaggtaaaagttttaaatgatgttcataaatttgatagttcttttttaacagaagaaatcaaattacgtactggactaactgtagattttagaaataagagctatttggaagaaaaaccaaataaagataatgttcctttaatttatcctttccattttaacaaaaatttcattacttttcctgtcgaacatgataaaaaacaatatgttaatatggcaaaaaagggtttaattcaagaaaacaaagattatctgtttcttaaacggtttacttcaaaggaagaaaaaagaagattgcaaccagcaatttatcttaaagaagattttccaaactatgattatatatcaactgaaaataaaattaatttcattgagtccactaatgatgatgatttgtcaaaagagcagatttatggcttatttgttattttcaattcaacaatgtatgataaatattataggattttaaatggaagcacacaagtcaatgctaatgaaatcaattcattgaatattccttctagaactagtttagaaaatttaggaagaattttaattaataaaaatgattattctgtagaatcttgtgatgaaatattggagagtattttatga

SEQ ID NO: 900 - DNA, 2328 bp, Methanobrevibacter ruminantium
gtgatagataggattgatatagggacagttttaggtaatgaattcattgtcattgataaatacggtggagaaggaaaatcaggatttggcactgtctttattgtatatgatgatgatttgaaaaaagctttagcactgaaaacattacaagataaatatcttaatgatgaagaaactataggagattttaagaaagagtctttaatttggacagaactgaaacatccaaatattgttgaagcattgggattagatattattgatggtagattatttattataatggaacctatttttagttttatgggtaaacaatcattagatgattacttttttgaaggtctgtcagattataaaattttagattgggctatccaattttgttatgctatggaatatatggaggaacagggtattaaatatcatggggatataaagccccaaaatattttagtttgggataatgagattaagattactgattttggcttaacaagttttattaatgaatctaaaatttttaaaaataagaatgtaggaaattattatatttcaaatggaaaactttgtggaactaatgcttatatggctccagaatcttttgaggggataaataatatttcaacagatatctatagttttggaatagttctttatcagatgataaataagggtaatttgccttttgaagcagaaaacaattttgataatgaatgggaagaattgcataaaaaagctgaaatcccttattttgatcatatattatatgatgtagttctgaagtgtttatcaaaaaatccaaaagatagatatgattcttttaaagatttaaaaagagaattaatttcaatatttaaagaaacttttgatgaagaaccatatgttccaaaagaaaaagattttgaaaaagattctaattactattattttaaaggaaattctcttgcaaatgttggcgatattgaaaattttatttcaaattatgataaagctatagaacttaatcctaattcctctgatattaggataaattatgcaataaatttgataaaatatgggtactatgatgaagctttaaatcatttaaatctagctaaaaagatatttgatgaaaataataaaaattttgttagtttagatagattatattttaattttggacatgcataccaatcaaaaggttatttaaataaagcaattgaaaattatgaaaatgctattgaaattaatgagaattatttagaatcatatgttaatttaggaaatatttataaagaattagaattatatgaaaaagcattagaaaaatatcaattagctttagatattaatcctaattttttcatggctttgattaatatgggtgaagcttatagttttttaggcaattatgaagattctgagaattgtttttataaagcaaaatatcaaaatatcaatgaggatttatattctttatggggagagagtttaagacgattaaatagggaaccttatgcattaacaaaattttttgaaattctgaaaatcaatgatgagtctatgtatgcttattataatataacaatttcttatttaattttagataatttggatcaagcaaaagaatattttggaaaagctttagatttatttggagataatattacatataaacttgatttatctaaacaattttttaagtatggttttcaagaggaatctttagaaattttagatgaaattatagaaactagtgaggataataataaattttttgctttatttcaaaaatttaatatttttaaagattctgatgtgaagtattcaacttcaattttagatgaaattatttattcttctgcagatgatgaattgaaatctgaggcatattgtgataaagcattatttttaaaggattatgaagattttgatttaattttagaatattttaatgaaggtttgagtttaaatccatataatattagaatttattatttaaaaggctgtttttgtcatgaaaatgaagagtatgaattggccatgcaaacatttgaagaaggcttgtttatagataaatataataaagaacttttgtatgaaaaatcaagattgcatttactttttggggaatgtgaaaaatgtataggctgttgtgaaaaatatttggaaatcggttatccatcggcagaaatttacttatctaaagcattaggatttatggggttagaggattataatgaatctttgaattttttagaattagcgcaatctttagttattgatgaagaaacaaaagagatgattttagttactaaagtaactatagaaaattttttagaaagataa

SEQ ID NO: 901 - DNA, 1377 bp, Methanobrevibacter ruminantium
atgtatcaagttagtgaaaaagaaagttctgtttataaatacaaagctcttggaacttcaaacgatagggaaatcaaatcaaaggatgtcaatgaccattataaagtcacagaatacaatattgatttgatttataatgaaatcaaggaattcattcattactatttattttcaggtgaaatcagcactgatttcactataaaagtccaagatttattcgaaatggatgatgatgacttaagaaccttgaagacagtgcatttcttactgagcgatgaagtccgagacttaattcagattttaccataccttcttagaaatctttcccattctactcaaaaggaaaaagaggaatttaatggaattgttagaggaagaatagattggaatgcaactttaaagacaaggtatgccaaaggattcaatgaccctagcctttttgtttgctctcctccatccaagttctatgatcttgaagaaaatcagctattgaagtttgtattaaggaagataatcagcttgaagaacaattatctcgattttgtggattttataagaaacgatgaagagaatccttttgatatagaaagcttgtctgatgaaagagattggtatgagattgttggaaacaattacaagatggcaaagaaaacattgaaaaaggtctattttgatgacatttcagatgttaggataattaaggcaaagcatattagaaaagcatttaaaaacaggaatgttctttatcatagggtagcaagagcatatatcctttatgaagacctattcattaatgaagatattgaattattgaaggaattggtagagcatagattgattaaagctaccaatccaaataaactgtatgagatttatatattctattcattggttagagcacttcctagtcctgaattaagattattgcatagtggaaatgattattctacctttgatgtgcttgaagacggaaccaaagtgacagttcactatcaataccttccaaagcctcttcaagaggtttcagagtatgcagagattttaagaaattataatattcaatgggcatatagggctccggatattattttagagtttgaaaaagagggcaaaatcacttacaggatagttgaagttaaaaacagtagtagcgctaattatgtaagggatagcgtttataaggtcatgggatattataaagactttgagaggattttgtataatgaggaggctacttttactgaaaactgccctattgttcttgttacttggggtggaataagaataaaggataattatgatccatttaaggatagccttattgttcttaataggaacgagtttttagatagtttggaaaaattgataaatttataa

SEQ ID NO: 902 - DNA, 2859 bp, Methanobrevibacter ruminantium
atgcccaatatagaaaaatatgcttatatattagatgattttaaggaaatcttagatatttatccaatcgagtctaaaaagccatataaaaacaatgaatttgcagctaagatgagaaatgatatagccgatgatttcaacaagtttattcttgatatggtttccaataaggagaaataccattcaaaaatctctcctggaatgatggattggtctaaaaaaccatgggctggattttaccataaggatgttaccaatactttcaaatttggtttttacttgatttacttgtttgagggagacggttccggttttacattgtcccttggccagggtgtcgacgatgctgaaaagaaattggtgaagagatccgaatacctgaattatatgattacagaaaatgaattgaaaatacctgatggttttaagcatgaagccaatgttggggaatcaatcattcgaaaattctataaaaaggaagaattggatctggaagagttttgcaatgatttggagaaaatgataaaaatatacgaatctttaattccccattacaatgaattaagagcaggtgaagagccttccagaaaggatgtgcgtccaaagaattccggaagcaaagtctggagaatttctccaggaggctcagatatttatgatgaagcttgggaagagttcaagcaggaatcatatattggcgtaggcttttatcatggagaaattgattattccacatttaaaaacaaatggtccttggacagatatttagataaggatggtgtcaaagacccttcaaaggctatgctttggaaattcgtcaattgggttgaaaagggagatattatcgtagcgaataagggaaagagcaaattagcaggcattggagtagtcactggcgatttcattcctttgacaaagaataaaaacaggaacaaattcggattggacaatatttaccctgttaaatggatttacacccctgacgatttggaaatttctaaaaacttctttgcaagacataccttggttgaatggcaaggggataaatggaatcagcttttgtgcgttttggcaagaaacgatgaagtccttaaagagagaattttgaagaagatatatgatgaatcatataagcttttgtttgaaagagaagattatcatcatatggaaggctataaaacagaatccaaagagataaatgatgtttggaatgatttattgttaaaatacgaaaatgatgaggatattgttgatgatgtatgggatagacttgtcaatcgcaagatgaaggttcatggagacggaagtaagaatatcaaggcctccattaagggaaaattaaagataagcgatgaagacttaagcaaaactgccattttattatttgaaacattgaaaggattgataggaaatagggatgaagcagatcaaaagagaataatcaaggaattcaatgacagcggatatagcaagggattcaaatcaggcagattcagttcaattctttattatctggacgattattattatgtaatcaatcaaaaaaccattgatactgttaaactcctgtctctaattctaggggatgaaatcctcttgtcaaatgaattggatcgctatataagcaacaatgcaaagtataaagagttcatacataatttaaggaacgcttattattatgataaatatgatgtatttgaatttagggcatttgatgccatttgtcattatctatgctccactccaccaatctactttgctacaaataaagctgaaaaaattccaatagaattctatgtggataccgatgagattttagagggcatagatgaaagcgagtttgatgagatggatttggatgacgaggagattgaggaaatcactgaagtctatattgaagagacaaaatatgaacttttaaacatcaatcctccattattggaatccaagcttcaatcatttgccattgctgaaactacagtaaatcaattgtgcgcatcacttaatgccggcaaaaacataatacttgacggaactccaggaactggtaaaacagaacttgcaatcaagtttgcaactgcagcaagcgacaataacttcattgacggttacattttgactacggcaacttccgattggtccacttttgatacgattggagggctgatgcctaatgaaaagggagaactctttttctatcccggcaaatttctggatgcaattgcagaaaacaaatggctgataattgacgaaatcaacagggccgacatagacaaggcattcggtcaattgtttaccgttctttcaaagcaggatgtggagttgccatacaaggaaaacggcaagccaatcaaaatcaagctatgggatgaaaactattccaagcatgataaagagaaatccacatattacatcggaaacaactggagaataattggaacaatgaatgtggatgataaggacagtctttttgacctttcttatgcattcatgagaagattcatgtttattgaagtggacttgccagaggagacccaatataaacgactcattaaaatgtggtccaatgatctctctgaagaatatactaacaatctcctaagggtttatgacgtaataaaattcagaaaattaggccctgctatattcaaggacatgactgaatacatcaaattcagggatgaaataagcgacgacagcacagatttaattcttgcagaagccatcagttcttatatagttcctcaattcgaaggacttaatagaaataaggttgaacaaatcagaaaacttatgggagacattggtctgtcccaatatttggatgaggaattgaaggaattgattcctaaattttag

SEQ ID NO: 903 - DNA, 141 bp, Methanobrevibacter ruminantium
atggaagatgaacttttaaaaaaatactttaatgaacttagaaaggaagcaaacaatgaagactttataaacgaattggaagggtctatagaaaccatttcaagggaagaaattgtggaactgattaaaaaacattattag

SEQ ID NO: 904 - DNA, 354 bp, Methanobrevibacter ruminantium
atgggtcaaaaattcaacatcaaagagttagagattagatcattcagaggaatcaaggatttgaaatatgattttgaaggaaagtccttagtgctatgtggccctaacggatgtggaaaaagttcaattacacaggcattcgaatacctcttcacaggccaagtcgcttccctaaagggaattcagggagtaaagcatgacgaatcacttatccataaaggggattcaaaggaagacctattggttaaagccaagataggaggccaatacattgaaagatcattcaatgaagaattcaatccagggcgattgaaggatatctatgaagactcaagaatggctcttttttattga

SEQ ID NO: 905 - DNA, 1890 bp, Methanobrevibacter ruminantium
ttgaataggaaaaagcttttatctttcattgaatcaaagcctagagaaagatacaatcaaatcacaggactcatctcctatgaaaaatatgatgaaatagagacaaagcttcgacaggcatccaaagacattaatgatgaaataaaaattctaaacaaaaggaatgatgaaaaaatcagtgaactgacccaattttatagctgcgaatctgatgacctatatgaaaagattaatgcttctctaaaaaagaataatttaaagcaaattgatgaaaatactaatttaacccaatacattgatgaaaacaagcttagcaaaccacataaactattaaacaaaaacattgaagaactaaatcatgattatttaagactattggataattatgaaaatatcaccttgacagaactgaaaacaaccaattcattagtttcattgcttgaaaaatccagggaataccttttattggaaaatccagataaatgtcccatttgtcaaaaatacattgacagcgaagaaatcataaatgatttaagtccaaaaatcgataaaatcaatgaaaacttgaagttgtttaaagattggaaaaatgactgcaacattataataaagcaattatcagatttagattatgaaataaaggatttcaatggtgaaaatcacaattcattggactatgatttgaacgatttgatagaatcattaaatgacttgtcaaatttcgataaaggactatctgaaatggacagggaaatattgggctctctaaataaagatatcatttccataaaaggtaaaatgcaagcaaatacagatgagataaacaggaatttagaccatctacaaattcttaagaatattagggaaaatgaaaaatatttggaaaagattcaaaagcaatatgatgtttccaaaaaatctcatgaattgtttaaaaagatcaaagaagaagagcttgccaatatcttaaagcaaatagaagaatataccattgaattctacaattatatacactacgatgaagacataaacagccctaaaatgaaaatcaaaggttccaatagcttgactttggccctattctttgaagatgacgagtcagagccaaggtcattttcaagcgaagggcatattgataccttaggattatgtctctttttggcatttgtaaaggaattcaataaatatgatttcatcattttagacgatatcatctctaccgttgacttggaacataaggaacaggtaattaaccttctgtttgaatactttggaaactataaattcattataaccacccataacaagctatggtttgagcaattggcaaggcttgccgattactatcaacaaggcagattccaatttgttgaaattactgactgggacagggaaataggaccgtcactgtcacgtaaaaaagatgaaaaagaaaggattgaacagtacataaatgacaatgacacctttgcagcaggcaatgcaatcagacgccagctggaatatgaattggataaaatctgcaaggtaaatgaaatacctctgcctcttaaaaagcattatactgtaggggactactacactccaacaaagaaatttgctaaggaaatgtttaaggacactgatgttgaagaatattacaaaaatgtattcaaagaactggatttgtctttatacaaagcaaatctcacatcccataacaatgaaatgaactatgacttgaacatcaatgaaattaaaaaattaagggatgccgtttatggtttggaaacagcattcaagtgcaagaatcattctggaaactatgtattgaagtttgatatggacaaatgtctaggactttgcagccataaacggtgcatagacttctttacatttaatagaatttga

SEQ ID NO: 906 - DNA, 1005 bp, Methanobrevibacter ruminantium
atgaaattagttgtagacggatttggcaaatcagttgctaaaagggacaatcaaattgtgattaaggaaaacggaaaagagataaactattatttggcaaaggatataagccaaatactattaactggcaagggatcaattacctttgatgcattgaccctgcttgctgaaaatgatgtggactgcgtatcaatcaattggaaaggccatgtggattacagactctcagctccagataggaaaaacgcaattgtcaaaaaggaacagtactttgcacttacagactcaagaagcggctatttggctaaggcttttgtaagagcaaagattgaaaatcaaaaggcagtgcttggaacccttgcaaaaagcagggaagagaaagattatattattgaacaaagagaaaaggtttcagaacatattggtaaaatagaaaaattatctaatatcaattcagataatattagaaataatatactgggaattgaagggcaagcgtcacatgaatattggtcagcttttgctagtgttcttgatgagaaatgggaattttttggcagaagtggcagaggtgctaaagatccggttaattcattgttaaattatggttatgcagtaatagaaagtgagatttggaagtcaatatatttggcaggccttgatccatattgtggttttctacattcagagcgctatggaagggctagtttggtttatgatcttattgaagaatttagacagcagatagttgataagacagtgctctcaatagttaataggaatcagattacaccagatgactttgaagaagatggcaattatattaagattcatgagagggctagacgacttttgattgcaaaaatattggataaattaaatagcaagataatgtttcatagtaagaatattagttattcagatattattttatatcaaggcaagcttatggctgattatttaacaaatggcgtaccatatgaagggttttctcttagatggtga

SEQ ID NO: 907 - DNA, 126 bp, Methanobrevibacter ruminantium
atgatagagagatatataatttctggagatgatgaaatatcctattgcagtcagtgcagaaactatgaaacttgtgatggggatgactgcgatccctactttgatgatgatttatatgatttgtga

SEQ ID NO: 908 - DNA, 279 bp, Methanobrevibacter ruminantium
atgttagtttttgtaatgtatgatatagttgatactccaacacgtacaagcttggttaaaaaattaaagcattatggcttgcatagaattcagaaatccatattctgtgggtttttatctattgatgagagattgaatcttgcaagcgagtttgattttttcatgtcttcagagagggatagtataatccttatcccaacatgtgaatcctgtgttgattccatattgattgagggcaatctggacttgcctaagaaatccctttatgagttcttatag

SEQ ID NO: 909 - DNA, 765 bp, Methanobrevibacter ruminantium
atgtgggttaaacgaatttattatgtttcattaataagatttaaaattttaaaaaaacgtttgataaaatcacttttatttaggtgcactatgaaaataaatacatgtcatttagttttaaagactaataagaaagtcaagcagaatccttcaaagttcaggggatatataggaagggaatttgacaagtatcctattctccataatcattatggaaataataaattcctatactcttatcctcttgttcagtatcaaatcatagatgggcagccatctattctagggattgaagagggtgcagacatattggttgacatatcctctaaaattaaagcgcttaagatgggagacagctattatagggtggaggatcattacttatattataaggagtatgatgttagggccactaggaaatatcatcaatataagttcttaagcccttggctggcattgaatactaaaaattatcaatcctttaagaatattaaggattggaaagaaaaaaagagctttttgaataatattatggttggaaatattctttccatgtcaaagggattaggtataatagttaacaaaaggctgcatgtcagctctcttttggatgatgagatagccgaatataaaaatgttcagatgaatgctttcacaggagagtttaaggttaacttcaatattcctgacttctttggatttggtaaaggtgtaagccaaggatttggtacggtaattaaggtcacagaccaagaagaagactaa

SEQ ID NO: 910 - DNA, 1368 bp, Methanobrevibacter ruminantium
atgtctaaaaaagagcaaattttaattttaagtttaggaggttctccagaacctctcatttattccattaaagaattcaagccagataaagtagtcttcttatgttctcctcagacacttaaggaatgcgatggcattcttgaagagactgctttcaatgaggaaaatgtggaaatatacgagatacctgatgctgaaagcttggatgattcattttccacttcaaagaaggtcttatccaaatttgcagatgatggctttgaggttcgtgtggatttcactggaggaacaaagcctatggtttcaggtcttgtccttgcagtaatcgaagggaattattctaatttcaaattcagctatgtgggccaaaaggacagccagagcagaaccaaaaatggtgtcggcgtagttaaggatggctctgaaattacaaagatgcagataaatccatataagaaatatgcaataaccgaatttaagagaggaaagaacttctttaacacatatcagtttgaagcggccttggaaaatttccaaagcgccaaatccagattcattaagggaactgagcaaagaaggatatctgaaatctatgaaaggattgtcatactttatcaaaaatgggacctatttgaagataaggtttcaaaaaacacagatttatttaaatatctgggctttataataaatgatattgaaaaggatgaattcatattaaatgaatttgaaaatatagacttctttatccaaatgaagagaaattatgaatttttgagtttcaaaattaggggagtttcatatgatagcgaagacccttccataaagggccatttaaagttcagaatttcctattacctttcagatttattcaataatgcctaccgaagaatcgaagagggcaagtatgatgatgctgttgccagattgtataggatcaatgagctgattgcacaggttcagcttacccaaaagggcctgattgacgatgaccaattgcagactcaaaaggagtttaaggtaaatatctcaagcacaaaatccaaagcacatgcaagggacaactatgatgaaatattagatttcattgattataactccagccttaaggaaaagaacaaaggttattttggcattgcaaatgataagagctatgagcttttagacttgtttggcattaagcaaagccctaagttcgataagttgaattccaaattaaaggaaagaaatggctctattctagctcatggcctaaagccgatgaataagaaaaaggcagaagagttatatgataagacacttgattatgctaaggactatttctcatttttagatgaggatatggatttggctaagtttccaaagttttaa

SEQ ID NO: 911 - DNA, 1203 bp, Methanobrevibacter ruminantium
atgatggttagattgcaattggaaacaatttctccagtttatattggaaacactggaaacgagtattcccgttctgaatttgcttttgctaaatttagcggcaagaagaaattagtcagattaaatttagatttggtggctaaagaactgtatcaaagggatgaaaaactctttaaggaatttctaaaggttctttcagatacaaaatcctttaaaaatattaaaaccaaaaaagataatagtcaatttaataaaaatgagaggattgcaattaaggggatgcaaaaattcttgtatgatacaattaggccttatgataaagatttatttaagaaaattttatcaagttgctcatcttataaagtttctctgcagtatgctccagaatccattaaagagaaaaatggcaaaaaggtttcagttacaagaaaaggggaaagcactgccgatattggtctaattaaggagaatttaaaaacaaataatgagccatatatctcaggttcttcaattaaaggtgcagttagaaatgccttattatattctagattaaatttatctagcaaatctaatcgtgatgtagctagagagattaataataagaataatagggatattaagaatattatgacatatgttcaattttcagacacttttaatacaatcgaagagccaagcctttatggggtcgaatcaattgggacaaaaaggaacactttttcattctttgaaacaattgataggggcaatgtttttgaatttgaatatcgcaatactttcaattctaaggtgcataatcctagaatgttaaataacttcgatttatctgttgaatcaatatttaagcatatttatgaattttctaatgatatattggatgaggaaatacgttttattgaagatacagttaactttgattatgtgtattccgatgttgactctggaaagttatataaatatttcgatgatttgaaggataaaaatactgaagagtctccattgttgagattaggtcaaggcagtggagctttaggtgtcagtcaattattggaagttaaaaattccaggtctccaacggaattcaccacttttagaaaattcaatcgtttaggtcataaaaatcattatgatttccctaaaacaagaaaattgatagtaaatagctttgaacctttaggatgggttaagttaagtaaaatttaa

SEQ ID NO: 912 - DNA, 996 bp, Methanobrevibacter ruminantium
atgtatgtttgtgataaaatgaaaatagtttatttaaaacctaaatcaacttttccttttttatcttcagatagcattttcggagcattaacctatgggatggcagaattatttccagaaaaacttgattcatttatagaaagctttaagaataaaaatgacattccatttttaatttcatcagcttttccattcattaaaaatgaaaacaattattttagattctatccaaagccaattacaaaattccaatctaaagacatgaaattatctaaaaaattcaaaaaaattaaatttattgaagaggatattttcttggaattggtttcaggcaatatttcaaatgatgggatctttgataattttaaagatgatttattccttgtgaatgaatttaatgaatctttcttagtaaaaaaagaaaattcagaaattatcgatggaagtttattttcaaaggaaatctctccccacaatgttatagatagggtaaagaataattccataaatatcttttattcagaggattataggttcagagaaaataaaggcttgtttttcttagtggactttaaggactcttcatttgaagaaattttcatttcccttttgagatttttaagagataagggttttggccatgacatttcctctggaaaaggacaatttgattttgaaatagatgattttgataagtttgataatttaaataaaagccaatatttcctatcattgtctcgtttcattccagatgagaaggatatttcttttattgaggaattatctgatgatgatgctctttatgaaattggagataagagatctcgggattcatttggtttgagaaagaaaacaaggttctttaaggaaggttctgttttcccggattacactgtcaaatatgatgttaattgcggttgtttggttgaaacttctgataggtcaattgaatatggatattcctttaatataccatataacgtggaggaattatga

SEQ ID NO: 913 - DNA, 768 bp, Methanobrevibacter ruminantium
atggaaaatttagaatttcaaggaaatgttataattaaaggaaaaatcgtttgtgatactggtttgcatattggcgaatccaatgaaactttagaaattggcggaatagacaatatggtcatgagggataagaaatccaatttgccatatatcccaggttcttctttaaaaggtaagctcagacaccaaatggaattgttcaataaggattctgtaagatatattcttgacaatccaaaaggaagaaatagggaatatgctccttgcaactgtggaaaatgttctgtttgcaagatatttggttttaccaatgatgaggatggaacttatgtaggccctactagaataatcgttagggatgcatttccagatgatgaaacaaaggaattttgggaaagttcagaaggcgtatccagaggagcagaattaaagacagaaaatgttattgatagagtaaaatcaactgcaatgcaccctagacctactgaaagaattccaaaggattcaaaatttgattttgaaattgtatttggaatatatcatgatgatgataaggaaaactttaaggaaattttcactgcattgaaattgcttgaaaataattatttaggtggaaatggttctagaggatatggtaaaatccattttgaggatttatcctatttgattagaaacaggtctttctatactgataatgctgaagaaaaggtaattgaacttggcgttttgtctaatttagaagatgaaaatttaaaaatcgaattataa

SEQ ID NO: 914 - DNA, 432 bp, Methanobrevibacter ruminantium
atgccaaatgatttgaaagatgttgaaaacaaaattaaaggtttgaaaagcttaaaatattatgaaattgaagagtttgtcaaatttgatggtgatgcagataagattactaaacaattacgaaatgatgacattaagacttcccaattaagaaagttttttgctgcagttaaggaaatcgaaatgtatgtaaaagataaaagagtttgggatgacaaggcaaaagtggatttctacttgctgatgcctaaattagcttatgctaaaggaagaaaagtcattagtgaaagattttttaatttaatgaaaattactatggaaaaagttggttctggaaataaagaagatactttagatgatttcttaagatttgtgcaatttttagaagctattgttgcattctttaaagttaacaatccaggatctttataa

SEQ ID NO: 915 - DNA, 2658 bp, Methanobrevibacter ruminantium
atggatagaaaaaatttagaatttgcttccttacttcatgatattggaaaattttcttaccgtgcggaaaataatttttcatctgaatacaaaaatcttgataaagatgattttggttatcatggtgcacattctaaatggtctgctagctttattaagcattattggaattcagatattactaatttagcattatatcatcataatcctaaatctggtataaatgaagaaataggtttaattattcaaaaagcagaccatcattcttctggtgagcgcatagattctattaaaaatgatccatttaaaactccattgctttctatcttttcagatattttaattaagcctgaaaaaaataagaaatgcgatgagttatatgttccattggaagaatttgatttgaatagaaagtggaaaaattctattccaacttccatcgataatgctaaaaagggtcataattcattgaaaaagtgttattctgctttatgggagaaatttgaaagtgaagtgaagcatttagaaaatacggatgattttaatactattttggctttgttaaaaaaatacacttcttgtatgccctctgcaacatgggggtctaaacctgacatatctttgtatgaccattcaaagacaactgcagccattgcagtgtgcagatatctgtttaatgaagaaacagagttgaaacacacttcatcaactcaagaagtttattcagttatcagcggagatatttcagggattcagaattttatctttaaaatttcttcacctcaaaaggctcaaagtgcaatgagtaaacgtttaaggggaagatcattgtatctgactttattgacagatgcgattgcaaataagatagttcaagatttagacctgactcaagcaaatattttattctgtggcggaggaagattcacaattcttgctccaaatactgaaaaggctaaaaaatctttaaatgaaatacaaaaggaaataaatgcctttttcatagaaaagtttaatgcagaattatatttggctattgcaagtgaagaatgcagtggaaatggacttgaaaacttcagtgatattacatccattttatcatataagattgcacaggataaaaagcataaatttattgacaatctggatgatttatttgattttgaagaagatttggatggaaaatctacttgtgccgtttgcggaaatctcttcaaaccaaaagatgaggaggataagttttgtgatgactgtgaagaacatataaaactgggttcaaaagtaactaatgcaagttatatgattaagtgtttctttaatgaagagtttaaaaatatttatgataaaaataaatttaaaaaagtctctttctatgaaaagcctttaaacatagcttatatttttactagcaataccagtaagaagtctgttgacaagacttttaaagaaataaaagatattctttctgaatatgatgaatttgtcgatagatttgaaataataaagttaaatgacactgatttcttggaaattgaaaataaatttagtttagaggaattagataaaatctcatttagttttagtttcttaggaaatactattccaaaatatcataacagaaatccattatactttgaacatttagcccaaatcagtaaaggggcaaataaattaggtgttctaaagatggatgtagatgatttgggaatgatatttggcgaaggatttaatcatgcctttaaagattcagatgagtctataagcagcatttccagaatttccacactaagctctcaattggatctattcttctcagggtttattaataagattgcatcagaattctgtgtttatgatgatggaatcaaggaatatttcaaaaatgacccttctttctttgaattaaactttaaagaggtagaattgaaacttcaaaatgatgatggctctaaaaatgaagatgaatccatcattgtttataaagaaaagtatggaatggaacttgacgacgaaatcaaggaatccataaaggagtatagtattccaactattcatataaattactctggaggggatgatttattagtgttaggtccatatgatgatatcattgaattttcacaagaattaagaacaagattcaagcaatggacttgcaataatgattccattaatttatccggtggaattaacattgtctcttcaaaattccctataggcaaagctgtgattatggctgaaaattatcttgaggcttcaaaatcctgcggtaaagataagcttacagtatttaatgaagttgttccttgggatgctaaaggctctaaatttaaagatttcaatcaattacatgaatttggcctaaaattagaggaatataattctcaaaataaactatcaaaaagcatagtttattccatgttatatttatggaaagataattttgaagagcattcaggaatatttttcaatgaagaaaaatgggaaaaggagaattttgcgaaatgcaataacaatagatttgttcctaaatttgcttataggttaagaggtatgaatcaaaatagtaaagaatatgatgttgttttaaaagaaggtattaaatatatgccttggattaaaatacctgtttcatgggttagtttaagaatgaggtga

SEQ ID NO: 916 - DNA, 4698 bp, Methanobrevibacter ruminantium
atgtcaattgatttaaataaaaaccaaaaaagggctgcctattacaatggagacaagtacttggtcatagaagcaggtccaggcgctgggaaaacacgtgttttaatagaaagaatcaagtttctcataaatgaagagaaggtagagccttcaagccttttagttattacattcacacgcaaagctgcagaagagcttaaagaacgtttatataaggatattgatgaatctgtagtaagcatgatgcaaatatcaaccatacatgctttttgcagagtgattctctcagagattggggaatacaatactcgtgtcttgggagatagcgttaacgaaaaacagaaaatgtttttaaacaaatataagaaagacttaggctttgttaatgagtgtcacatccgccagaatgaaatatttaacctaatagataaatatggcgaatacgccacctttaaggtagatagtaaaaaattggttgactatatagaaaggaatactaaaattgaccctgaatatatagattttgtaaatgaatatatgaaggagaatgatggaagatatccttttgatgaggtaatggctaatgatgcctataagaaatcccgtacaaatgcattgtatctgcaaatagcaaagtcatatcctaaatatctggagcttttggatgaaaagggattcagcgattttgatcagatgcaaatcaaaaccttaaactatttgaaaaccaatccaaacaccatctacaagaatgttttggttgacgagtttcaggatacagatcctgtccaaatgaagatatttgaaattctaatgaaaaatgcagattcctttactgttgtgggagatatagaccaaagcatatatggattccggggagccaataagaattattttgaatatctatacaataattatgacgatagggtctacaaggtgaacttaaatgtaaactaccgttcagcaaatcaaatcattgacataagcgaggatttcatcaagtctcaaagggctgagggagcaaagcaggacaaggctcttggcgcacgggatttggatagaaacacttattttcttgtaaatgaaaacagcgaaagcgaagcaaaggccatttttgaaatgattcgatatctccatgacagcgggaagattgaaaattataatgagattgctatcttatcccgttccataaggtttagcaacactgcccaagacctaatccaattatttattgataacaacatcccttatcatgtcaggggggttccagatctctttgaccggcctgaaataaggtcagtgatcacattgattcaccatcttatagaggatacaaatccccataaccataaatttgacctgtgggaattggaatggctaaatcttaaggcatatactggagaaagcttcaatcaggttttatttaacctatctgatgaaactaaaaatatcttaaatagtatacaagaagaatttgaagagaatgtcttaaaggaagaaaaaagagcttatttaaaagttacaggcaagaagtctcataaatatgtctttaaaagagtctttgaaagggatgagaaggttttaattgaattatttaaaaacattgaaaggcctatcctaagcaatgagaatctgattagatacggggtaaaaaataagcaggatttggagttctttagaagattgaatgacttgaaagcttacttcaacagtgaagagtatatggactccgaagacactattttggatatctatatgaaattgctgacagatgtctgcaattatttgactgaagatttcattaatgaccctattaatagggatgagcttaaaaatctggcaatcctaagcaacactttccataattatgagttgattgtagacaataagaatttgaagggagcatactatttcttaagatataacatagctggctacagcacagataatgatgaatccgaaggggttcagcttatgacagtccataagtctaaaggattggaatttcctgtagtcattttactgtcattgaatcataagaagttcccaagccaatataaggatgaatatgataggttttacactccaaactcctgtttggaatataagaattacgattccaaggaagaggaaattcaagactatctagaggaagaggatagaatagtctatgtggctatgacaagggctcaggatattttagttctatctaatctaatcaaggaaactcctgaattagaagggttaaaagcagaattgaatgacaatctttctcaaattgaaaagatagaaataatcaaggacattcctaaagggcatattaagattcatgacttgatcaataggaatctctcaagctgcaagtttttggaagatgactttagccagcttccaaagacggtttgtgaaaagcctcaagttaaaaaggaggatttccttaatttaagcttttattcccttgagaattatgttgcctgtcctttcaagtataaactgatgcatgacattaatttcagcgaatccacaatggaattcaataagctaagaggcttgtttgtacataatttgcttgaaacgatcaacaatagaatcaggtccaacggaaacagatatattggagatgatgaggtcttggctatctttgaaaggtttcaagactccttccgctttgaaaacttaagattgtcaaagaaggaatatgatattataaaaaatgatgttctttattattacaatacctttggaaaggatttcaatatattaaacacagagctttcatttagcattaaaaaggaatattatggattgtcaggcattattgacctaatctataagaccaaagatggaaagatgggcattttggattataagaacactgaacgcatatcaaggcattatgttcaaaattatattaagcaggtctatacctatatgattgcattaaaggatagttttgaaatcgatgagcttcggatatatgcaataaaagcaagaaagatgatatctgttgatataaatcagaagtcccttgatattcttttagaagagcttgataatgtttcattgaatattaaaaaagaagtattcgaatgtaattttggagagggctgcttaaaatgcagtttctcaaagatatgcgttaaggcaaataatgatgacgtttctgtttttgactttaataatgaggacactttatcttttagaaataagttctatcagaacttgccagattatgaaataattgatttaaaagacagatattggaaagatattgattttgattcagatgatgaaactaagtttgatgttgatattagtgcagatgatttagcttcaatctctgctaaagagggtgtttctgtatctgctaatgaaggtattcctatatctgcaagagagggtgtttctgtatctgctaatgaaggtattcctatatctgctaaagagggtgtttctgtatctgataaggataatgatttgtctgtatctgctaatcaaattaaaaatttaaataattcatctgatgataaacatcttggtgcggatttcaaatctaaaaaagattcatttaaatcagaaatgaaatctcctagttctaaaaaagattcatctaaatccaaaaagaaatcttataaatctaaggaatcctctaaatcttcaaaagaaccatttattagttcttattcaaaatatttggatttaaagtccattcctaaaaaatataagaatttccttaaaaatgattattccaaggacattgatctttttgaatatgatgatgatttgtctcttgaagagaacattttaagaaaatatatcctaaagaaaaaaggattgaaattgcttaaaaaagaactatatgatgaatctgaagattattataaaaaattaatacacaattcctattttaaagaagattactatccatataagcaattaatgaaagtctatcataagactaaaaaatatgataaagaagctgatattataagagatttcttcaaatcaagcgtttatgccaataaatatcaattcttatatttcaaatataagaataggaaattgcctaaaagagctagaataaagcataatgaactaaaagatttaattaaaaattatgtaaatctattaaaagattctgatttatctaataattctattcctaatgctgatagattgaaaaaagataagaacagactaaaaatcctatcagatgaagaggaattctataatcataaaaggtcctattataccaatattgccgatggattatatgaagaaaagctcaatcaggaagcttttgacttatatgctatggcaatttataagtacaaagaaaagagtttcagatattatcaaagattggctagtatttataggcgcactaataattataaacatgagttgctggttattatggaatattttaataaaagcaataagatccatagaacaaaaagcagcgacaaatggtttaagcaacgtttatattccactaaacaactaattggggatgagaatgcaattaggcagattgaaaatattgtttgcaaaaaaggatacaatctaaaagcagattatgctttaaattatttaaatcatgatttggatgaatattactgtttgaaaaatttagataaggaattaaattatattatttcaagcaatgaggacatttttacacttcataaaaagaaataa

SEQ ID NO: 917 - DNA, 1197 bp, Methanobrevibacter ruminantium
atgaatgaaaccacttcaaatgaactaatacatgcacgcagactttatatgaaaaagaatatgaaagaagcagaaactaattttttaaaagttttcaatacaaatagagagctctttaatgatttggatgaaatttattttatccgtgcaatacaagaatcccatattgataactgccaatctataggtgatttaaggcactatgctgattttgtagtagaaaactttaatcaagaggattgctccaatagaaattttgaagatccatatgctgattttattttaaatcttagcactgttctaatcaaggaagaatactatttggatgcaattaaatacctgataagattagatgagtctttcctatctgatgtttcaagacataattccaatggctattatagattctcccatcatgagaaatatctttcaaatatggttaaggcattgattggcataggaaaatatgatgctgctttgcaatattccattagattaatcaatgaccttccagacactgccagtgaagctaagtattggattaaatggagcatagctaaaatatataatctgactggagattatgaactttcaattgaatatatcaatgaattattgcttaaaaggagtgaaaactatttctataaacttttagcagataactatctaaaattagatgattatgataatgcattagtcagtggggtccattatattattttaaaaaaggatatcaaatcctgtgtaaattattacacagaactcggatatatcttaagccaattgggtcttactgaggaatccaataaacattattatctcagctacgctatcaaaaaatcctatggcaatttcattccagattatttggaagagaaaatcagagatttaggctttgatttggaaaataccaattataataagatagctaatgagcttaaacctttctggagagaatgtttatacagaaataaaaagcagtttacaggaaccataagtgccataaaacaagaaaggggatttggttttattaagccagatgatggaggaaaaaaccaattcttcctattcaaggactttaaggatgatcatgattatatttggaataatatgagggtttcatattatcttggggatagcattgattattctaaaaataaggagtccactagggcagttaatgttgaattaatttag

SEQ ID NO: 918 - DNA, 1695 bp, Methanobrevibacter ruminantium
atgtctagtcaacttgaggaattaaaaaaagaattccaaatagccgaatacaatctcgactttgatagactccacaccctatgtgacaagatacttgaacatgatcctaatctaatcgaatacaagcaatacattgcaattagctacttcctctctgaggactatgaaaactgcataaaggaatacagcatctaccttgaccgccgtgagaaggatgctgatgacgcgtacatacttgccatgagccatcttcatctcaacaacgaatctgaggccatgtcgattatcgaaggctttgatgagatagactctcttgagctaaagctcaaggcatatcatgatataaaacactactacaaggccatcaaggccggtaacgagcttcttgatattgacagctccaatgatgaagccttgcaaaccatgtcggaaatatatgacgagcttaacaataccgagatgtcgcttttctatgaatgggagctatgcaagctgaagcctgcatttaagggcttccatctcatgaggctctatgagcttggaaggtatgaagaggtcatagagatatttgaaaggaatcctgatgactttaaatgcgaccttctccactacccattcaacttcttgataggatcttcatattgtgaaatcggcaagcatatggatgcattgaagtatctatacaggtccaaccagctccatgagtgccgtgatacaggacttcagatagcccgtaactattatatactgaaggattatgagatggcatataagattctaaagggggttgctgttaaggagggtctattggactatgatgattctctctcggacgatgagctattgaatgataattctcttctcctattggatgaagatggtttagaagatgattctttactcctatccgataatgagactttaaatgatgattctttacttttatccgaggataagactttaaataatgattccttattcttaagagaagataagacattagaacaaataatggataagtactgcaagggggcacctgaagagaaagctgatgaaaagacttgcaatgaagaagaaaaagaaacagaagtcctaagcgatatacagattcttgaccagatgctgcttgagcttgatattgatgaaagccattatacccaagtggaagaagagccaagctatttcaaggaaactgatgaggattcaatcgacggcgacgaggatattgacatagtggatgcaaacatactgagaatgatgtctgaggtctgtctctaccttaaaagatatgatgagtgcatcatgatagcaaacagactcttaagcgtctcagaccgatatgacgagattgtgaatgtgataagcgcatactaccttgagatggaagacgagtggaaggctgatgaatggtaccttctccttcctatagagcttgcattcaataagccatttgtctataccattgcccgcaacctctctctcatcggtgagagcgaccgtgccctgaaaatctatagcaccatagagaagctgattgacgaaagcccatatctcctatatgaaagggccggcctctataagaggataggggagaaggagcttgccatgaaggaccttgataagtataatgaaattgccctgaaatatctatatgagaatggggaaccggaagttaagtatgaggatctggaatag

SEQ ID NO: 919 - DNA, 1290 bp, Methanobrevibacter ruminantium
atgaaaagaaaagaagtagtactattcatgaccgttggaaccgggatcaatccagactccaacgaggcgggatacaagaagctggccaagaagctctactcaaccttaaacaagatatatccaaactatgtaatcttctttgcatctaacgtatccaagcacacaataaaatacatagacgcgctatttgagcttgacggcgacgagttcaatgagggggaggattatgagatagttgaacttaacaacattgacgacttcaactactgctttgagtcctttgaagcaaagatatgggaatacgactatctcaatgagaaaaaataccagataatcatggactatacctcagggacaaagaccatgtcagctgcaatggcatgctgcggaatgctctacagccgtgaccttatctctgtcggaggggaccgctccaagggagaggtatcagcaggaacagagataataaactaccagaacctctataagatatatgacaagagggccataatgaggataaggtacaacttcaacacaaacagattccagccatgccttgacgtattgaactatatagttgacatgaacatccacaaggactccctagtggacctctgtaagggatactttgcatgggacaccatggacttctcccatgcatatgagcatctaaagagcatagaccttaactatatggagtttgcagagataaaaaacgagcttaagaagaaccttaatgccttgggaataatagtaaactcaaagtcccagaaccttaagaactgctatatacttgcatgcatcataaacaatgcaataaggagagctgaggaatataagtttgacgacgcaattgcaaggctatacaggtcatttgagctcattgcacagataaggcttgagaaatacaatctcatgagttctgatattgatatagatcttctcaaggaaaagggattaaggcaagagtttatagatgagcttgagaatatgagggaagacggtaagattaggataggacttataaaggactatcatcttttaaatgagctggatgatgagctaggcaagtactttatggagaatgagtctaagataaaggaccttacattcaagaggaacaattccattttggcccacggattggactcacagtccaaggaagactttgacaagtttttagagcttgtgataggattggccaaaaagcttgataaggacatgaacaagttcctggaagagaccaggtttgcaaagttcgacttaaagttggatattaataatgcctga

SEQ ID NO: 920 - DNA, 339 bp, Methanobrevibacter ruminantium
atgtataaaataattaatgaagacggcagtttagttagaggatatccttcagatgcattatatgatcttttaactgataaagaaaaggaacatatccaattattcaaaaatgaaattgaaaagataacagaaaaagaagggcttggaaaaataactgtttcagtaagttatgatgaacctataattgaaaaagcattccaaatacaagataaaaatggatatagctttgatgagtttcaagagatattggataaaattagattgcatatggcagatttctgtaagaataacaaagagttatgcgaatttaaaaaattctcttatattatttctgcttaa

SEQ ID NO: 921 - DNA, 270 bp, Methanobrevibacter ruminantium
atgatggttagtgataaggatttagcaaaaaataataatgtaaagggctctagaatcaatgtgacacctcttatggcagcatatttcttaggatatatgctttctgaaaagggtgagaagatctctgatgagaaaatcgaagatctttataagggggcatgcttcagcatgggaatcgatcctgttgaagacatctctgaattatttaatgaattgttcagcccaaaaaagaaaacaaaagaagatttagaaaatagtttttattgctaa

SEQ ID NO: 922 - DNA, 1407 bp, Methanobrevibacter ruminantium
atgatccatttaggtgcaatcatgtcaaatatcgttgatagaataggtatggaaaaatcagtcatactccttgctgcagttgtatcctttgtcactgcattccttgcaaacatctctgtagctttgcccttaatagcaagggagcttgcaatgagcaatatcattcaaaattgggtagccacaatctaccttcttccaattgccatgctttccatccctttaggaaagcttacaagcaagcatggcctaaacaagtcattgcttgcaggaataatccttacaataataggagtaatcatagcctgcttttcaatcaacagtgaacttctacttctatcaagggtaatccaaggaatcggaaccgctttaatcaatgtcgcttcaatggcattaatcgtttcagcagttaacccagaaacccggggacaggcattgggactgaacattgctggagtctatataggactctcatcagcccctgtaatcggaggccttgtcatctaccaccttggctggcagagcatattctatataatgctaatcccactaatattctcagcctacctgtcatggtcactcaaggatgaatggacaatgtatgacggtccaatagacataactggatctatcatattttcaataggtattcttctagtaatctatggattcaccatagtaaacacatggcttggcatagttctattgataattggtttactattattaattgcctttgcttattttgaacttagggtcaataatcctgtctttgatgtgagactctttaagaattctaggttctcctcttcaaatattgcatccttgattagttatactgcaacttttgtaatcacatacatcttaacttatcattttcagtatattatgggctttgactctaaattttcaggcatgttattaatagtaacacctgtcatgatggcaattctagcacccctatcaggcaggctatcagataggatagatcctcaaaagcttgcagcaataggcatgggttttgtaacagtggcactaacaatcctatgcttcctaaacgaatcaaccccattatatatgattctactcgcaatgtttctccagggaataggatatggattgttctcttcacctaatacaaatgcgatcatgagctctgttccaaaggaagagacttcttccgcttcagcatcccttgcagcagttagggtgattggacagacactaagccttggaatgcttactgtgatatttgcatacatcatgggaaatgtggcaattgtgcctgaatattatccattgcttatggaaagctctagattgtcttgcattatctctgcagtattgtgtgtgattgctgttgttgcatcattagttggactgcgctctgatgatgagtatgagacttaa

SEQ ID NO: 923 - DNA, 750 bp, Methanobrevibacter ruminantium
atgaactcaaaacaaaaagccctaatggtccttgccttaagcataatcctactcagttcaattgcagcagcatctgcagaggattattctttaaccaatgccaaaatagatatggtaatccaggatgacggattagtctttgtggatgaggcaatcacctaccatttttataagaccatgaatggcgtctataggtacattccaatcaataactttaacatggaagattttgctgtagacgttgatggcgcatattatgaactggagggtaatgatgacgactctcaaatagaggctaaggtctatctctataaggataaggataaaaccgaaaagatcgaccctggtacagatgttacagtccattataagtactacatgagcgatctccttgatgtaaagggagacaatgcagtattgaactattatctattgggagaagattgggaggttgacttagaggagattgaagcaaacgtccatttccctgaaaagaaggagcttgattacgagcttgttccaagcggcagtgctgaaggcaagtggtctggagacacattgaccattactggagagaatattaatgctggagatggtcttgcattaatcgttgaaatcccattagatgagttcgcttcaggcttttcaaatgctgtccacaatgacactgatgatgatgatgacatagataatgatatcgataatgataaggatgatttaaaggacttgacaaaggctaagcagatttaa

SEQ ID NO: 924 - DNA, 489 bp, Methanobrevibacter ruminantium
atgaaactcaaatattttgccgtatgtctttttgtcttgatattggctgcaggcatttcagctgcttatgcaactgatgtggattttgaaggcggccacagcttcaccatgccagacggctatgagattgttgaaggacaaaacactaccgaagacattatcatggaaaagaatggggacaataggattgttttccaatactggatagatgaatatgaggaccttaaaaacattgaagaaaactataattttggagacatcattaaagcagtaatggaagatgcagtaataggaaatgaagaaaactacacctttgaagactatgatgtaactcaaattgactataaagtacaaggcattcaatgttactcctatatccttgataatggtaaggaaggttatgtcattcaccatatagctaaagaagacttaaaagacttaaatgacccagataacgtcattggagatcttgttaaaagtattaaatag

SEQ ID NO: 925 - DNA, 213 bp, Methanobrevibacter ruminantium
atgacttataactgttgtttaaagacttcaagggaatatactgaagaaggattattgaatctcattgctgagacatttgatacagacgtttcaggtttgaaggttgaaaacatcgactcctatgaagatgatagaggtgagaacttcataattacctgttccaaggaagagggaaatatgaagacaataaaagtgtttcatgcttatggctag

SEQ ID NO: 926 - DNA, 210 bp, Methanobrevibacter ruminantium
atgaaagatatggaatatccgaatgaagaagctaaagaaaagtttgaagagataatgttaagaagattaaggctattatatggcatagatgtgtctgaaatggaaatcattaatatttctttaggagagtctagtgtagagcctaccattagaattgtattaattgattccactgaggaagattgtattagagtatttgaaattgcttaa

SEQ ID NO: 927 - DNA, 1473 bp, Methanobrevibacter ruminantium
atgaagcaacattctgtaggtagagttgaaactaagacatttgccatcaatgataaattaaaattaagttcaggaaagactctagaaaatgtggaacttgcttatgaaacctacggggaattaaatactgcaaagaccaacgccattcttgtatgtcacgcactcactggggacgcccatgctgcaggctggcataagaacgctacaaagcctggctggtgggagatagtgataggccctggaaaggcattggatactgacaagtattttgtaatctgctccaatgttttaggtggatgtaagggttctaccggtcctgcatcaatcaatccaaaaaccaatgaggaatatgcgcttgactttccaatcattacaatagaggatatggttcatgctcaaaagaagctgattgaacatttgggaatagaaaagctccatgctgtagttggaggttcaatgggtggaatgcaagccttgcaatggacagtctcatatcctaatatgatgaaaaaggcaagcataatcgccacaacagctaggtcttcccctcagcagattgcctttaatgaggtaggaaggcagtccatcatttcagatccgttctggaacaatggacagtactatggaaagaacagaactcctcgttctggtttggctgtagcccgtatgattggccacatcacatatcttagtgatgaatcaatgtatatcaagtttggaagggaattgcaggataaggatcagctaagctatgactttacccttgatttccaggtggaaagctatcttcaccaccaaggggaaagttttgtaaagcgttttgacgctaattcatatttatacattacaaaggcggttgattactttgatctgtctgttgatggctcattgcctgacggattgaagaatgtaaaggccaagttccagattatagctgtagattctgattggctatatcctgtagaccagtctaaggacttgcttacagcccttcagacccttggggttgaagtgagctataatgaagtaaaatcagattacggacatgacgcattccttttggaaaacggtcagatgaacttccttttaaacaatttcctctctgagaatgtggttgacgaccttatgaaaactgatgttccaaccattgacatcaattccacaataaaggatgctgctaacataatgtttgacaatcaggtcactcaccttcctgtagtggatgagaatgataagctgcttggaatagtcactgcatgggacttatccaagtccattgcaaaggactgcaagcttttagaggatgttatgactaaggatgtcagatattgtaagtctactgactctattgaatacatttcaagacagatgaagaagtttgacatttcctgcttgcctgtggtcaatgatgacctatgccttgagggaattattacaactgatcagattagtcatttgatttcatcttattag

SEQ ID NO: 928 - DNA, 201 bp, Methanobrevibacter ruminantium
atgacacatttgactattacagaataccgagaaatggtaaaggatataattgaatttaaaaatgaaaatggtaagatgcctgattttgcaagcgtaaacaatcaggaaatctctcatgagaattattccgccatgataaacgatgttaataactatattctacagcatggcagaagccctgaatttgttcaaattaaatga

SEQ ID NO: 929 - DNA, 1494 bp, Methanobrevibacter ruminantium
ttgagtttttcagacaaaatttataatgcaaaacctggttatacttatgatgattttttattggttccaaatgcttcctggattgaagcgaaggatgtagacactaaaataaaccttacaaaggatatcaaacttaacattcctattatgagtgctgcaatggataccgtaactgaagctgatttggctatcgcacttgctcaagagggtggaatcggtgtaattcaccgtaacatcaatcaagaggctcaagtcgctgaagtcagaaaggtaaaaagcgctgaagacatcactgtacgtgatgttgtaaccatcagtcctgactcctctatcgaaacagtccaagacattatggaaaacgaatcagtcagcggtcttcctgtaatggaaggggacaggattgtaggaatcatctccaaaagggatgtaaggccattcctaaaaaacgattccaaaagattggttaaggaaatcatgacttccgatgttgtcacaatcaaggaaaacatctctcaagaggaagctttagatatcgcctatgaaaataaggttgaaagattgcctgtcgttaatgaggatggcgctttagtaggtattctaaccattaaagacatattaaatcaagatcagcatcctaacgctgcagtagataagaacggaaaataccttgttgcagctgcctgcggtccatttgaccttgacagggctatggcattggatgaggcaggagcagacatcatttcaatcgactgtgctcacgcacataacatgaatgtggtcaagtttgctgaaaccattaaggacaatatcgatgcagacttatgtatgggtaacattgcaactaaagaggctgctgaagacttgattgcacatggtgcagacggccttaaggtaggtatcggtccaggttcaatctgtaccacccgtattgtagctggaatcggcgttccgcagctcactgcaattgcagatgttgcagatgttgcaggagaagcaggcattccagtcattgcagacggaggtctcagatactccggtgacattgcaaaggctatcggtgcaggtgcagatgttgtaatgctcggtaacttgcttgcaggtactttagaggctccaggtgatgtagtaaccatgaatggaagaaagttcaaacaataccgtggaatgggttccatgggagcgatgactggaggttccggaggtggagctgacagatacttccaagaattggaaaaaggatctcacatgaaacattccaagctagtccctgaaggtgttgaaggtgtagttccatataagggaactgtagctgaagttgtcttccaattggttggaggattaaagtcttccatgggctactgtggagctaaggacattcaaaccatgaaagaagttgctagattcgttagaattaccacaagcggtattaaggaatctcacccacatgacttcttaatcactaatgaaagtcctaattatccaactttagactaa

SEQ ID NO: 930 - DNA, 720 bp, Methanobrevibacter ruminantium
ttgcttttattaattagtcctataaatcatgaagaagctgttgaatctattgaaggtggagcagacattgttgatgttaaaaatcctaaagaaggttccttaggagctaatttcccttgggtaattaaggatatcagagagcttaccccaaaggatatgcttgtaagcgcaactttaggagatgttccatacaagcctggaaccgtttctcttgctgcaatgggagctttagtctctggtgcagattatattaaagtcggattatatggtccaagcaactatgaagaaggcgtagaagtaatgaaaggtgtagttaaggctgtaaaagacactaatcctgatgctacagttgttgcttccggctatgcagatgctcatagagttggagctgtaagtccttgggacattcctaaggtggcaaaggattcaggagcagacattgccatgttagatacagctgtcaaggatggacatactttatttgattatctagacattgacgattgtagaaaattcacagaagaagctcatagctatggattgaaagttgccttagcaggatctgttaaaaaagaccaattaaagccattatatgatgttggctgtgatgtagttggtgttagaggggctgcttgtgttggcggagacagaaacactggccatattgatagaactgctgtagctgaattaaaagagcttgtacaatcatttgaagaatag

SEQ ID NO: 931 - DNA, 7251 bp, Methanobrevibacter ruminantium
gtgaaattaaaattaatatatttaatttgtatgatttgctgtgttttattaacattttcaactgttagtgcaattgatatggatggaaatctaactgcttcagttaatcatttagatggctcccattcagatcagtctgcatttatttcacagtctgaatcttcgaaaacaaatttaaatgcaaataataatttaagagtttctagtggagattatgattgtgtagaaactatgaatgaattgtctaatttagattcaaaggattctaaagataataacttatccaaggataaaacatctttaaaatctgatctaaattctattgattcagatgagtattctcttaaatctagtcttagttctattaattctagtaagaaatcttcttatgaagatggagataatgaatatgagaacttggaggattctttagattcaaagaataaaaattctttaagttccaatgctctaggagcaggcacaagtacatttggcgatttgcaaaccatgataaacaatgcccaagagggttcaacaatcaatcttgatggaaagacatttatcggaaacggctcatttataaccataaagaaggccatcaccataaacggtggctctgctacaaacttggcacgattcgatgcaagaaacttatcatatatatttaagataagcgcatccaacgtccatataaagaactgttatttctcatacagtaccaactgttccgtatatttctttggaaatggatcctcaatagataattgccatttcgactacaattataagcacctgtgggttgctgtaaacatcaagtacttctcacttacaaactgcaatttcacaaatggaaagacagatatgggaagtaccgcatatgtggtagcagacaatgccactgtgaaaaactgcaatttcatcaacaatgaagcaagcggaaccgaacaatgttacggtgctgcattgcagataggggcttcatcctcaggcataaatgaaggatatgtggtaaattgcaccttcataaacaatagggttatcaccacccatagctattcccatgcaggagcgctatgcttccgtccgggaatcaaggtctataattccactttcatcaacaattactgcaataggatgggaggtgccacaacccttcacagcgatggggagataatgaactgcacattcatcaacaacagcgcaggggaatatggcggagcaatctcaacagggcttatggctgataatatcagcgtaaacattacaggatgtacttttataaataactatgcccctatgggcggagcgattctgataaaaggaaataatgtaaaggtaactaattctacatttaaagaaaacaaggcaagagaaaatgacggtggagcagtttacattctaggtaacgatgctttgatattgaattccacattccagagcaattatgcaaagaatgtgggagcagggattctaatcaacggttcatatgtgactgtcttgaattccagcttcgcaagaaacaatgcaagctatggtgctggaatctatgttataggttcaaatgcaaatcttttcagctcaaacttcactaaccacaatgtcaagaacggctctgtctatataaagggtataggcgcttatgtttataactgtaattttgcaagcaacactggagaaaacggagctgcattatatattgaaggctcaaacacaacattgattttaagcaatttcacaaataacaatgttacaaaggacggaggggcaatctatgttgtaggctcaaatgccaagctaatggcttcaaatttcctatacaacaatgcgattccaagcgaatcagacattaaaagcggccttggaggcgctgtatacattaagggaaacagcaatacaatcgattcctcaagcttcaagtacaatacagcacgtaacggatctgcaatatataccgacggaaaaaacatgaacctttcaaatgacaattttgacaggaatcaggcatggtcatatgtattggattctgtgataaaaccaagcagcagttattttaacagaagcgatattttaattaatttaactttgataggtggcaataatattgctaatgcaatttataatactgcttcagtgaatgatatttacttttataatgtaagctatatatcctcaaagggtaaaaaagtaactacttcaaatgaaatacatccggtaaatggtgcatcaaacagccaaaacggtgcattgctataccaggatgaccgtgaagacaatcaattggtaaatgttattgtgtataaggatcctaatagcaaatctacttccttatctgcaataaacaaaaacgacataatcctaaacaagacattcacaacaggaattcttggaaacgtgtccttgaatctcagctcatctgtgggcaaggcaatagctccaggaaactatcttctatatgcaaagcacactgaagatgactattacaaggaaatagatgaggacaatcagtttgagattctccctcttgtggatgtggctgtagacattgtctccagcaaggatatagtggaatataacagaacaaacaagttcacagtcaaggttataaacaatggtccaaacaatgctacagacgttcaggtaagtgctgtgcttcctaaaggactgatactcgtttcttcaagtccatctgttggcacttacaattctagcactggaatctggaccattggcaacttaaatagcggagttaaccagaccttagccataaacacaagggctaacactacaggtgcagtaaattatccggttagcgtatcctcctatgaaaaggacacaaacgaagctaacaataaggataaccaatcaataaagatacctgaatgtgacttgctcattgacattgcctcatctaatcacagccctaaatatagcgatattgtaaactggacagtcaccgttaaaaacaacggtccggatgatgcaagcaaagttgtagtttccttaggcaatctctctggaaacgaattgatatatcaaaagtccacaaatgccaatttcaatataagcactcagacattggagctttccaaattggctagtggatcaaacgtaagctttgtaataactaccaaggtaaacgcttccaataagaagattacagtaaattcctcagtaagctcagatacatttgaatataacctaaacaacaatcaggacaacgattatgtcaatgtggccccattatgtgatgttggaataactgtaaaggtctctaacaggactgcaaacagaaatgaccttgtcaaatggacaataacagttaaaaactacggtcctgataaggcaagcaatgtaaatgttgcactcagtgacctagcaagcttaggattaggccttgttaacaagtcagacgccaattacgcttcaaacgaatggaatgtaggggaccttaacaaggatgcctctaaggaattggtgattagcactaaggtaaacactgaaaataagaacattgtccttaagggaactgtaaatacaagcacttatgagacaaataaggctaataatcttgcaaatgacacattatctgtcaatccttattgtgatgtcttgattgaagtgactgcatcagataacagtgctaacaagaatgatgtcattacttggactgtcaatgttaaaaacaacggcccaaatcaggctaaggatgttaaggtctcattgaccaatatggaaaaattaggcttaatagtccaaaacaggtcattcacctttaaggatattgccgtattggagaattccacattcaacttcaacaagtcaagcaatatatggtccatcggaagcatggcctccggagacatctcaagcatgactgtaaagaccaaggtcaactgttcagataaggtcttatcagttgagggaaatgtatcaacaagcacttatgagcttaataaagccaataaccatgatgatgacctcttgactgtagaggaattatgtgatttggctgttgaagtgaacgcttcaaagaagactgcaaataagggcgatattgtaaactggacaataaaaataaaaaacaatggtccggacaccgcttctgatgtcttcttgacagtatctgatttggaatctttaggaatggtctttgtaaattcatcaagcaaagattttgacagcgaatcattcgcttgggagattggagagcttgcaagcggaaagggactgactctcatattggccactcaagtggacacctctgatgagaccataatggttgaagctgatgtggatacaagcacatatgaattgaacaaggcaaacaatgctgataatgattcattaaatgtcaatccatgctgtgatattgtcatagacatatcagtctctgattctcctgtaaacaaggaagatattgtcaattggactattgtggtaactaatgatggtcctgacgatgcaaaggctgttgtggtcaatctaactgacttggaacctttagccctaatcataatgaatgtttccgagagttcttatgataatggccaatggacaataggcgatttgcctgatggagaaagtcaaagccttattattacaacaaaggcaaactgttccaatgacactataaaacttgatggaattgtcgatacaagcacctttgagctagataagagcaataaccataatgatgatattttagagattgatcctttatgtgacttatcaattgaaatatcagtatctgattctcctgtaaacaatggggacattgtaaattggactattgtagttgccaatgacggcccagatggtgccagcgatgtgattgtcagtttatctgatttggaatcattgaacttggaaatattaaacgtttcagaggataatttcaatcctgaaacttatgaatggataataggtgatttagataataatgaaaatgctagcttaataatttccgcaaaagtaaatacttcagacgatatattggatgttgagtctacagttgacagcaagacttttgaattgaataaggataataactatgacaatgaaagccttattgtaaatcctttatgcgatcttatcatagatatatctgtgtccgattctccagttaatacagaagatcttgtcgattggacaataacagtaactaatgacggtccagatatggctgaaaacgttaaagtctatttgaatgacttagatgctttaaacttaattttagttaatgcttccgaggattcatttgatggggacgcctatcaatggatcattggcaatctggacaatggcgatgctgttgaattgctcattacaacaagggttaacgcttccaataagacaatagaagttgaatcagctgttttaagcgacacctttgaattgaataaggaaaataactatgataatgatacagtcacagtaaatcctttatgcgatttgattgtagttgttgatgtgtcaaattcaacaataaataaggatgaggtagtcaattggacaataactgtcactaatgatggccctgacactgcagagaatgtaatcttagacttaagcgaccttgaggatttaggattgatagtcttgaatgtatctgatgattcctataatccagaatccggtaaatggattataggggatttggctccaggagagactgttgatttaatagtcacaactcaagcaaatgtgtccaatgcatctttgcctgtagaggccatagtacaaggcgatacttatgagcttaataaggacaacaaccatgacgataagctattggatgtcaatcctttatgcgatttggtaattgagataactgtatccaacagctctgtaaacaagggaggcactgttgaatggaccatagttgtttataatgacggtccagatgatgcatctgatgttatagtcactttagatgacttgaagaccttaggactaatcctttccaatgtgacttatggaacaacaagcatggacatctcatatgacggttctagattgtttgttaaggacatttcttcagaagattctgaaaattctgattccatagatgaaagtgatagttcatcccctaatatgcttaaagcaagctctaaattagatggtgttggttctgatttagataatggggaattaaaatcactcaaatctggctcttatttaagtgatgattcatctaatgattcagataaagcttcaaacacattcgatgaagaaactaacttatggtacattggagatttagccaaaggaaacagtatttctttgaaattattgacagaggttaataggtcaaatgataatataactcttccttcaaatgtggatacaagcacttatgaagtcgttaaatccaataactttgacagcgctattgtagaagttcttccattagctgataatggagataatgaatctgtaaatagttctgattctaatggtgataatcctttagatggtgatggaaacagtacatctgatggttctaatcctgatggtgataattcttcagatggtgatggaaacagtacatctgatggttctgatcctaatggtggaaatggtgatgaacctttagatggtgatggaaacaatagttctaatggttctggtaatcctgatggttctgattctaatggtgataatcctttagatggtgatggaaacagtacatctgacggttccgataattccgatggtgataataagtctggtgataattccggaaatcctgatggttctgattctaatggtgataatcctttagatggtgatggaaacagtacatctgacggttctggtaatcctgatggttctggttcttctgatggtgataattctggcaattctgatgctggtgaaaagtctgatgatggttccagtgatactgatggctctggaaataccgatggcaatggctctttggatgaagatggcgataatgactcaggcagcggttctggtaattatggcagtgacctttatgatatgtacccttgggatgattatatggataataaaaccaatgacggatccaataaaaacaaccagggggataataattcccatgcaggcaaaaaggtcaaaaatccaactaaaaagaaccttagcaatcacgtccaagctaaacaacaaaaaggagttccaatgaaaaatactggacatccattggcattattggttttaaccatttttgctttgtttacattaagctatagaaaatttaaattttag

SEQ ID NO: 932 - DNA, 1230 bp, Methanobrevibacter ruminantium
atgaaagaagaagaaatagaatcaatgagaaaaatattctcccagcttaaagacaaaatcgaacctctttcacagtctcctgcaatacaagctcttcaaaagagggtcatggaaattagaaaagaagccataaaaaacaacagtcagcttttagaaacagttcaaaatagctttaaggaaaacgacatcgactgctttttagcaagcaatgatatagaggctcaaaaaatcattttagacctaatcaatgaagagatagaatctaaccccaatatagacagcaatgatgtatacatatgcaaatccaaatccaacacccttagggagataggatttctggaacttatggaagaaaacaactacaatgtcattgaaacagatttgggagaccgcatacttcaattgaaaaaggaagataacgatccggtccatcccacaggacctgcatcacaccttacagtatcagacattgcagatatcgtcaaccaatcaatggacttgaatctaaatcctgttccaaaggaaataatggaagccgttaggtctgatgtattgaatctcatgcataagtcttatattggcataagcggctcaaactcaatagctgcagaggacggtgcaattctgatggttcacaatgaaggaaacatcagctttgtccaatcaaagaagctccatataattgtagctggaatagataagctggtcccacatcttgaggattcagtttcaattgcaaagctggagactgcatatgccacaggaaagcctttaacctcttatatgaatatagtttcaggcccttcaaagacagcagacattgaaaagaagcttttaaagaatatgtatggtgctgaaagggttgctgttatccttcttgacaatggaaggtcaaaggcaattgatgaatgcctatggtgcattggctgcggcaattgcattgtaagctgtccggtatacaatataattggaaacaaatttggctattccagttatttgggaggaagaggaattgccttaagccgatatcttaaggataatgaggtaagcgttgattctggattgtatatgtgcaccttatgtggaatgtgcactgaaaactgtccggttctcactccaacttatgaaatcattgaaaacttacgttgcgatagccaaaaagaaggcctctttcgcaatcagcacaaatctattagggacaatattaaaaataagggttctccttattaa

SEQ ID NO: 933 - DNA, 759 bp, Methanobrevibacter ruminantium
atgttattatattttagaggatgtactgcacgagagaagttagattcaataagtgaagccactcaaagcttattaaaactctttaacattgaatatgaaatcttagacaacgaacagtgctgtgggtctgttttgcttagaactggctttaaggaagatggaatcgaacagatgaataaaacctactcagacattaaaggaaagaccattttaacttcctgtgcaggatgctataaaactcttaaggaagattataagacttatctggatgcagatttagaagtaattcatatttcccaacttttaaatgaattgattaatgaaaatagcatcaataagttagataaagacttattaatcacttatcatgatccttgtcacttaggaagacatgcgggggaatatgaagctccacgttcagttattaagactttttccaatctgactgaaatgaagaatattaaagaaaagtcaagatgctgtggctctggaggtggagttaagtctgcttatggcgatttgtctaattccatagccaaattaagaattgcagaagcaaatgaaactggtgcagacttattggtttcagcatgtccattctgcaaattaaatctaagtcaaaactctgatgatttggaagttttagacctgtctgaatttgttttaaaaatgcttaaagaaagtgatttggacttatccaatttaaaaatgcttgaagaagataatttggagttatctaaaaataagaagatggaataa

SEQ ID NO: 934 - DNA, 459 bp, Methanobrevibacter ruminantium
atgagaataggaattgcagatactacttttgctcgttatgatatgggtgctgcagcaatagatgagttaaagaagaacgcttcagaccttaagattattcgcaggactgttcctggggtaaaggaccttccagtagctagcaaaaagcttattgaagaggaaggctgtgagatagtcatggctttaggaatgccagggcctatggaaaaggataagatgtgtgctcatgaggcttctacaggacttatacgtgctcagcttatgacaaacacccatatattagaagtatttgttcatgaggatgaggaggaagatcctaaggaacttaagaaattggcagataacagggcacgtgaacatgcacaaaaccttattaagatgatgttccatcctagacttatggaaaaggaagcaggaaagggaatgagagaaggaaaagaggatgttggtccattatag

SEQ ID NO: 935 - DNA, 1191 bp, Methanobrevibacter ruminantium
atgcctaaagaagagattgataaaatcaaaaggaatctgagcggaaatcctgatttggatagggattatctggtttcccaactggaatattacaagggccatgaatattcctatgagataatcaaagagatctcccatttgattttacagtccttggatttttaccttattgaagatataggctctaaaaagactatggcaagccgcattcttgatgaagtgatgcaatatattgaaactcgtgataagaggactgccaaggaaaagcttgataaatatatggagtcatttgtagacaaatacgaaaacaaagaggaccataaggaaagtgatttcaattcaaaccggtccattcgtgaaattcaatatataagatatagggaaaacaaattggcagacagtcccaaatcctttagggtaagtcctaaaaaggataggcaagtgaattggagaaaggatgtcaagataaagaaaatggaaagcaattcaattgaagaaatccatgaaaaggaatatcatagcttcttaaatcctcttgaggagatattgttctatcattacattggactaaagaaggaattggcatatataccattcaacgagcctctatttgacttgtactatctttatggaaccttgctttttgaatctgatgaatatggaaagtcagaggaatatctcttgaaggcattgagaatcaatcccgtatcctcaaagacaatcctagccctagcagacatctataagtcaaagacaagaacatataataggtttttcctatataatgtggatgcattgaagtttgcatacagaaatgaggatatagcaagagcctatagaaactttggcttcttttatgttgaggaaaatcaattggatgttgcagctgcattctatgacttcagcttaaactatgactataataagcatgtagttaaagagcttgaatatctaaagtcaaggggagtggacacccaaatagaaacagaggaagcggtaggaatcattgaatcaaagaacattcaagttggagtcaatgactttgttttagatgccttgaagtttatatgctttgatttggatagtagaaagcacactagccaagccttatacttctataggattttatatgacttgactaaggacaatcaagtcttaggaagaataaatgctctttcgaataagatttag

SEQ ID NO: 936 - DNA, 762 bp, Methanobrevibacter ruminantium
gtggaaaagggagagatggtctctcttttaggaagaaacggcgcagggaaatcaactttatttttgcatttcaacggcattcaccagccaaagtcaggtgaaatctatatagatggagaaaaattatcctatggcaaggaagagcttatgctcgctcgtcagaaggttggaatcgttttccaaaaccctgacaatcaattgttcgcccctactgtagaggaggatgttgccttcggccctatgaatctaggccttcctattgaagaggttgaaaagagggttaaggattcccttgaaaaggttggaatgggaggatttgagaagaaatctccacaccatctaagcggaggacagaagaaaagaatagccattgcaggaattttggctatggaacctgagataatgattctggatgagcctacttcaggtcttgacccaaagggagcttcccatattcttaaattgctatactcattgaatgaagaggggatgaccattgtcatttcaacccacgatgtaggtcttgtaccggtatattcatctaagatatttctaatcagcgatggggagattataaagtcaggcactcctaaagaggtattttcagatgttgaaacaatcagaaaagctgatttaagacttccaagggtaactcaccttgctgagatattggaaaagaacaatgatatagatttcggcggagagtatcctttgacaatcggcgaggcccgtcagaaaatcctagatctgcttggaaaataa

SEQ ID NO: 937 - DNA, 1104 bp, Methanobrevibacter ruminantium
atgacaaatgatgataagacccaagaattcaaactcatttcaaaaacaattgatggcgatgagatatttctcaatcatgattcaattgtagtgaaatttgcaggcaaaaggaatgccatagtcacttcttggttaaatggaggttatagcgaagatctctctgctgtattcaatcatcagctgtcacaggagaacattgacgaatatggtgatggtggcatattgggctttttggagatgctatcctacgatttctataataaacttgacttgaagggcaataagttaagcggtttggtcacttcagctcaaatagatgagtattcaattgctgtagagagatataaggacattgaggttctagccattacaacagctggagttcgcgttaatgcggtctcagcaggggatgtcgcttcctattatgaattgaacggagaatatgattttgatttggaaaatgaagatccaaatcctaataagcctggaacaatcaataacatcatcctaatcaattgcaggcttgatgaaagctcccttcttttagctgaaatgatagctgtagaggctaaggcagtggctctaagggaccttatgacttcaagcaattattctagcgagatagcaaccggaacaggcacagacggcatagcaatatgctcaaatctccaaagcgataactttattgagaatgtgagcaagcatgcaaagattggtgaattgattgcaaatgcagtcatccgctcaataaaggaggctttggctaatctgcaatggctcactccatcatatcagctgaatgcacttgtaaggctagacagatttaagatgaatctggatgagttctatgacaaaagcttgaatctggatgagatggagaaaaaggaatttataatgtccttaattaaggtctcaaaaaacccagagcttgttggatatgtttcattaatcattcatatcatagatcagtataggattggattattggataaaaagcctgccttaaaggttttaaattctattttgaatagcaatttcaaccgaaaggaatggaattccatgaaactgcttttggaatacgtcattgaaaagcagatagaataa

SEQ ID NO: 938 - DNA, 1938 bp, Methanobrevibacter ruminantium
atggcgttaatcgaatttaagaatttcagcttttcatatctaaattcagacggaacagaatccctagaaaagtccttagacaatatcagcctaaatattaactttggcgattttgttcttctatgcggaccttcaggatgcggaaagactactcttctaaccaatcttaaaaaggagctgatgccaaacggaagacgtgaaggaagcataaaatacaatggaactgaaatcgcccagcttgatgatttcacttcagcatgcgatataggatatcttttccagaacccagacagccagatagtgacagacactgtaattcaggagattgcattccctcttgaaaacatagggcttccgacagaggagattcgaaacagaataagcgagattgttgccttctttggaataaatgacattctccataagaatgtaaacgagctctctggaggacagaagcagcttatcaacctatgttcccttcttgtcttaaggccaaaggttcttcttcttgacgagcctatgtctcagcttgacccgatcgcttcatatgagttcctttcaataataagaagactcaatgaggagttttcaataacagtcataatgagcgagcataaggcagacagcatatttccattcatagacaatgcagtcttcctaaaggatggaaagatagagttcaatgacaatgcccatgacatctgtgaggaagtaattaatgatgatatatttgaaaactaccttcctgcagtaacaaagatctataatggccttagccaaaactaccttgaaaatgaggaatatataagcgaatatgaagagttcactaaattgaatactcctttaagcattcgtgagggtagacgttatcttaatataattagtgatgagttaattaaaataaatgaagatgtacaaaaaaataataattttgaaaatgattatgcatatgattcattagaaaaagataattctaatcaaaattccacttcaagcaaaaaagaacatgattattatcaaaagtccagtttgaccacaaaaaaatacaattccaataagttaggccttagggataggcttccattctctaatgataagaacacattaattagaatgaatggaatatactttgcatatgagaagaataatcttatactaaagaatgtggactttaaattgaacaagggagatttccttagccttgtaggtggaaatggagtaggaaaatcaaccttccttcagatattggtaggaatattaaagccgataaagggcaaggtaaggtatagtaagaatctgaagatagcatatgttcatcagaatcctatgattcacttctccaaggacacagttaaggaagagttccttgaatcaatattaagctcaaatgcattcagcgcaagcgaattcaatatggaaacctatgatggtcttttaaagctgaatggaaatgagtttttagagtcagacctattgaacaatctaaagtttaaaaatatagactatagatttaaagagcttattggattctttgacattgaaaatctcttggataagcatccttatgactgcagtggaggagagcaggaaaagatagtaatcgtcaaggcattgattcaaaatacagacgttctggtattggatgagcctacaaaaggtttggatcctatatcaagcaaaaacttggcatatatacttaattcattggtggacaatggattgacaattgtaatgacaagccatgacttggatttcgttgcaaacaattgcaagagatgtctgatgctatttgataaggacattcaaatagatgacgaccctaaggtgatatttgcagagaataacttctatactacctttgtaaataggatggtcaaggattatattccgcaagctgttacattggatgatgtaaaggagatttgggatttaaagtga

SEQ ID NO: 939 - DNA, 1005 bp, Methanobrevibacter ruminantium
atggttctcttggctttcatttttagcgatccttattttgtattgagttttttagctttgattcttattcttatcgctcttcagggagtctccagcgagctaaagaacataatgaaatttttcatacccttaagcgtactgattataattctaaatcccctcctgaatcggacaggggcacataggatatatcttttcaacggattcttcatcacctatgaggcaattgcatatgggatattgatgtcattggcacttctcattgtaattctggttttctcatcatataataggtcagtttcctatcaggagatgctttatatcttttctaaaaagcttccaatcatctcaatgataattgtaatggcattaaggttcattccactaatcaattcaagggccattgaggttcaaaagctgaataatctgaaggccaatggggtagaatcagatgaagaggatgatttaaatgatgattctcttgaagacaatctttctgaggaaaataatctttcagatgaaaataattcaaaagaagattcagactctctcgatttagagcaattcgactcaaacatatcaagcctggacatcggttccgattcaagggtcttcaagaagataaagtcctctaaaaggttccaatccattgcaaaggaggcaaaggtccttggaaagatcatgggaataacagtctcatggtcccttgaagagtccatgtttacagccaagtcaatgaaagcccgtggatacaactccaatgagcgaacaagctatctttcatacaagttcggacttgcagacatcatattccttgcaataatcatagtcacagtatcaataatagtgataggccttatacaaggatatggcatgataaacatttatccttcaatagacttctcattcagcgatttaccatttaacatttattattttgcatttatagtatttttattacctttaatctatctagaaattaaggagagattcctatggcgttaa

SEQ ID NO: 940 - DNA, 1848 bp, Methanobrevibacter ruminantium
atgtcaactaaagtacactcaccagatgaactgcctcaaaagcctggaatatacataatgaaagacataaatgaggagatcatctatgtaggcaagtcaaagtctctaagaaaccgagtaaagtcttattttcaaaagaaccttgacagccctaagacaaaggtgctgatgagccatttcaacagccttgaatacatagtcacaaacaccgaaaaggaagccctcattctagaggcaaacctaatcaagaagcatcgcccgagatacaatatacgccttaaggatgacaagagatacccttacgtaaagataacagacgaggactttccaaagattgtcatcacccgcacaatatcaaagaccggaacatattacggcccatttacagatgttacagctgttcgccaaaccgtcaagtttctaaagcagctatttagaatcagaacctgcaaaagaatggacggcccatgcttaaacagtcaaatagacctatgctatgcaccttgtgacggccagatctcaaaggaagagtataaggagcatataaaaaagattgatctttttttccaaggcaaatataataagataatcaaggaccttgaaattgagatgaaacaggcagctgaaaggcaggaatatgaaaaggctgcagtgattagggaccagataagctcaatcgatgaggttatgaaaaagcagttcgttgaatttgaaaacgacttggatcaagatatcatagcaatcgcatacacaatccataatgcagttgcagttgttatgaacatccgaaacggaaagatcatgggcaaggacgactttacaatggacggttcagagaataccacttcagatgaggttatctctgccttcatcaagcagtactatggaataaacagacacattccaaaggaagttctacttgaagaggatataccagataaggagcttattgaagaatggctaagcgacttaagaggaaataaggtatccttaaaagtgcctcaaaagggaaataagcttaggttagtgcgaatggcaggaaagaatgcagagataatcaagaaccaaaggcaaaagatggaaaattcaatgatggaacttaagagatatctcaatcttaaaaagcttccaagagtcatagagggctatgacatatcaaacatttcaggaaagcttgcagtaggttccaaggtttcattcctcgacggaaagccaaacaagaagcaatataagaaattcaagatgaatactccaggacctaatgactttgcaatgatgaaggaactcttggaaagaagacttaaaccccttaaggaacattacgaaaaggtcagaatcaatgaggagcataccaaacataatgaagcggaaacagaaaagatagagcccttaaaattaggggaagagccaaacctaatagttattgacggaggaaagggacagttgggaatggctgttgatgttctaaaggaatataatcttacccacataccgataataggacttgcaaaggagtttgaagagatttacattcctaacagcagctttccaatcatcattcctcaggacaatgaggctctccatctgctgcagcaggtaagggatgaatcccataggtttgcagtgacatatcacagaaaattaaggtctaagaaaatagaggagtctccacttgatgagatagagggaatcggtaaaaagagaaaattagagttattaaggcatttcggtgactttgacagcattaaaaaggcaagtgttgaagagctgaagggcgttgatgggatgaatgagaaagtggctttgaatgtttataattattttcatgagggtgaaaaggagcaatag

SEQ ID NO: 941 - DNA, 543 bp, Methanobrevibacter ruminantium
atgaaagttataggtgtaacaggtttaccaggttctgggaaaagcattctttttgatactgctgaagaaaaaggagctctagtagtttgcatgggcgatcttgtacgtgaaaaggctgcagaaagaggagaagacagcggtaccactgccagaaaattaagggaagaatttggccaatatatagtggctgaactgacaattgaaagaattaaggaaattttagaaaaagataaagatgcaaagatcattttagttgatggaatcagaagcccttatgaaatagagctctttaaggaaagctttgataatttcatttcagtttccatttatgccagccctcaaacaagatttgaaaggcttgtccttagaaacagggaagacgatcctgaagtctatgaggacttccttgtaagggacaatagagaaataggatttggaattgctgaagttgtggcaactgcggactatatgcttaacaatgaatgctctttagaggaattcaagcaatccgttgctgattttattgaaaaggaaatggattaa

SEQ ID NO: 942 - DNA, 747 bp, Methanobrevibacter ruminantium
atgataccaaaaactcatccacgttacgaatcattattattaagagataaagtcaaaaacgcatttaaggaaggctatttagcagattctggaatgattgctcacggaaggggagagacattcgactatcttataggcgagagaaccacagaacctgctagaaaggcatgtgaagctgctgttgcatacatattgcttgcagaaaatccggtattgtcagttaatggaaacactactgcacttgccatagatgaaataatcgagcttgcaaaggcaacagactctaagatagaaataaatctcttttacagaactccagaacgtgttgaaataattgaaagaatgtttaaggaaaggggctgggaagatattcttggcggaaacgatgaaaagcttgaatatattgacaatctcaacagcccaagggctacagcaagcaaggaaggtagctacattgctgatgtgatgcttgttcctcttgaagatggtgacagggctgaagttctagttcaaaatggcaagaagataatttgcatagatttaaatcctctatcaaggacttctaagatgtctacagtctctattgtggataatattgtaagggcagttccattgatgacaagcatggctcttgactttaaagagaaaggcaaggacaaggataaggaatttttagaaaacataattaagaatttctccaatgagcagaaccttaaggattccttggctgagattaaattaaaataa

SEQ ID NO: 943 - DNA, 579 bp, Methanobrevibacter ruminantium
atgaaacgatttattgctattgatgggcttgacggttctggaaaggacactcaagcaagaaagatcaaggaaaagtatgagcaggaaggaactgtggtaattcgttctcatccaacatctgacaatttctttggccgccattcaaaatccgcattagagaaaaagggaaagcttaataagatcattgcaaccctttgctatggcgcagatgcaataaggtctgtaattaaatattatggaaaatacgatactgttatctttgtaagatatacattggctgtttcctatttaagcaaagccatatctgttcctgtttataaattggtttgtgtattgcttcctatctccgaatacttcttttatttggatgtctctccaaaggagctggttagacgggtcaagtcaagaaatgaaaaggaagagatgtttgaaaactatgatgcctttgtaaaggtgagaaaaatggcagagcctgtattgtacaattggaatgttattccagcagatgactctccagatgaaatattttcgagaatagaagcaatcttggatgaattagataagaaacttttagaataa

SEQ ID NO: 944 - DNA, 528 bp, Methanobrevibacter ruminantium
atggatgaaaaaatagaaaatcccgaacttaaagcaataatggcaatcgaccctgaagagatggatgaagaccagctaaacaagtttgttgaagcgtttatggaagcgacactaattgttccagcagaaatggaaacagatattgacattgaaggcatgagcgatgaggaaatagccttgaatgaagagattgaaataaccataatcaagcttgaggacgatgagggacatgaattcattccagcatacacagatgatgaggaagttgaaaagcttgattttgatgtctatggattaatttttaaaacagaagacttagctaaccttttatatgaaagcgaagacgaacttgaagcggttgtattaaatccattcactgaatattctgctgaaattcctttggattccctttttgagctctttgatttagaggaatgtgatgatcctaactgtgataatccacaccaccaccatcatgaccatgaacacaatcacgagcatcatcatgaccatgaacacgagcattaa

SEQ ID NO: 945 - DNA, 567 bp, Methanobrevibacter ruminantium
atgaaaagctccataactaaagaagactatttaagaatctatgaaatgacagatgatgttttcacacttgattttgactgtggaaagctctgcaacaatatctgctgcaccatcgaaaaggaagccaaggatgatgagtatcttgagatggtattgtatctcttgcctggcgaagaggaactcttttttgaaaaccaatggtttgagatgtattatgaaacaacagatgaatatgaataccctgattcatggaaagggaaggtatattatgtaaagtgctccgatccaccatattgcgataggaaaagaaggcctatccaatgcaggtcatttccggtaagcccacatcttgataaggacaacaagctccatcttatctatgatgaggatgacttcagctatgactgtccaatagtcagccaaaagatggaattaagcgacaatttcaaggaaaagatattaaagatgtggagcatcttaatagaggatgaactgatcttcgatttaataaagatggagtcagtacaacgagaaaataatgaaaaagagtatgattttgttttttaa

SEQ ID NO: 946 - DNA, 600 bp, Methanobrevibacter ruminantium
atgaataaaaaaagatttaaattattattaactatttttatagcatttgcactcattaacacttgttttattttaaatgataatctctcagcagcagacaatgctccaaagggatatagcaactactatattcgtggggtctgcttcaatgtccctgactcatataaactggtggatgagggatgggatgatgtaaataggctaagctacgctcattttaaaaagggaaacaatttccttaatatcagcttggataagcattccacaaagtttaacaagaaccttttggatggattcagttcctttacaataaatggaatcaatctgaataagaaaaccatatctcatgtaactggattctatgcaaagaagaatggcgtaaagcattttgtctttgcaacagaggatgattttgtatatattgcagcaaaagggccaaagcttaaagatgtcttatcatcaaccaatcaaagggattataagccttatcatgatagtgaatatgactttgatgatgatgcctattatgaatcagacgtttatgatgactcttttgatgattcctttgatgatggcgcttattatggctatgattggtag

SEQ ID NO: 947 - DNA, 684 bp, Methanobrevibacter ruminantium
atgaaatcagcagttttattttcaggtggaaaagacagtgcaatggccttaaactatgccataaacaatggagatgatgttagatatcttctttcaatgaaatcccagaatgatgagtcatatatgtttcatgttccaaacattcatatgactgatttgatctcacaggctgttgaaattcctcttatggaagtggagacagatggagtaaaggaagaagagcttaaagacttaagaagaggattcatacaactaaaggaagagggaattgaagcaatttatactggagcacttttttcaacctatcaaaagtcaagaatagaaaacttagctgatgaaactggaataaaggccatttcaccatattggcataaggatccaaaggaatatatggaacttgtattggaaacaggctttaaggtaatcataagcggtgtctttgcagaaggacttgatgagaagtggctaggccgtttgatagatgctcaagccctccaagagcttgagaaaatcagtgaaaagacatatcttaatcttgcatttgaagggggagaggctgaaacccttgtgattgacgggcctatatttaaaaagagaattgagatagtggatgccgagacagactggcatttggataatggtacatataatgtcattgaggcaagattggtagaaaaagaataa

SEQ ID NO: 948 - DNA, 582 bp, Methanobrevibacter ruminantium
atgtttgataaatcaatagctaaaaaatcttctttgccttttaaatcaataaacaataacagtttatttaagtttatatcaattaataaatgtttatttaagtttatatcaatcaacaataaaggtttatttaagtttatatcaatagacaataaaggacaactctcactagaatacatactaagcgctatgatggtcattctactaataacactcctttctgttcctatcctctcactaacaattgattattcaaatgatgtcataaactctataagcacaaagaatgaactgtcaaaaataactgattctattgatttctgctactatagcggaaagggttctaaaaaggtggtcttgcttgatttcaatcaagatttttctgttcgatttaccaacaatggccaaaaggggattgcatatgctgatttggaattgtcagataataaccacaaagagatatctagcgaatatgattatataggtctaaatacaaatattcagttttcaaagggtttcaataagattttagttgaatgggatgaggataccggactaatcaggctctctaagttaaattaa

SEQ ID NO: 949 - DNA, 909 bp, Methanobrevibacter ruminantium
atgaatatctatattttattttggaatatctttaacaacattgacttttatctgatgtctggcttcattatggtattctttacactcttattggctaactattatgatctgaagtatgggattattccaaataagttaagtgttttccttatgacatttgggattctaataaatgtattgattttaattgtccttaataatcgattgtacgcaatattttatgtatcttatttaattataatttttattatctcatttgtcctatggaaaatatccttttggggaggtggagacctgaagctattctgttcaatagggttttcacttccctttatagatattctgaatcatttctatactggcagcatcttaaatagcttttcattcaatagccagataattctttatcctaagatcttttcaatactgataaattcaatcttattgtcatttccggttattctattactgcttgtttataagttgcttagggaaaacaagctgaacttgatattatttgctttttccaatatgaaattgctcataaaggaactgtcaacaaagacagtatttataaatgacctgaaggagggaatgattgtagaggattattatttcaatagcttggagctatttaacttgatggaagagctgactggaaatgaagagtgctacaatctaaaagcaagtcaatttaaagagaattcttatgtccttaagtcatcttcaatggcaggtctgacaagggatgacattaaactaatcaattttgcatatatggaaactttaataaactttcccaattttaaaatcaaaatgggagttccttttgttccctctttgactgtaggatatttggtattcttggctttcggtgatttggtgtttttaatttcaacaataatctaa

SEQ ID NO: 950 - DNA, 216 bp, Methanobrevibacter ruminantium
atgatggcatcaattttacgaaatcaggtcaatttcacattttcatacaactttcatatgatggcatcaattttacgaaatcaggtcaatttcacattttcatacaactttcacacgatgaaatcaatttactatcttgaagtaaattttacgaaatcaagtaaattttacgaaatgacatcaattttacgagatgacatcaattttacattctaa

SEQ ID NO: 951 - DNA, 600 bp, Methanobrevibacter ruminantium
atgaatgatttagataataatcttgcaaacgctaaaggcattggtaaaaccattgctacaaaggttccgatgaatgttcatgatgaattagttcatttggtggactgtggtgcttatttaagcatttcagacttcttaagggaagcgattcgtgaacaattgaagaattataaaattgctgacatgaggaaaattaattatcaggacgctaaaagagaggtaataagctacttcaaaaagtataaggtctgttttttagatgagatagcaattaatttagaattggaatttgaattggtcaatacaatcttgaacgaccttgttatggaagaaaggattaagatgatctctaaagccgatcaggtcttcaaggattatttggaggaaaacgaccttgatgaaagtcaacatttttccaataagggaaacaactttatcaagttcaagggaaaacgcataattgttgaatcaagttccaaagacgttgatttcattagcttaaggcctagtccaaagaataagtctgtcttgaaaagccatggtatggttttaaacaatgggactgtcattctatccgaatgctatatctttttaaaatag

SEQ ID NO: 952 - DNA, 1677 bp, Methanobrevibacter ruminantium
atggatttttacaaagattcaagattttttcaaaattttaaggagtggatttatctgacaaaatatattataataactggtggagtagttagttctattggaaaaggaattacttctgcatctattggccgtattttacgttcgtatggcttaaaggttgcagctattaagattgacccatatttgaattgggattcaggtactttaaacccatatcagcatggggaagtgttcgtcacttatgatggaatggagactgacctggacttaggtcattatgaaaggttcctggatgtagagcttcctggaatatcaaacattaccacagggaaagtctatcaatcagttattactaaagagagaaacggcgatttcttaggcgcttgtgttcagattatccctcatatcaccaatgagattaaggaaatggttcgtgagatatctgccaaggacgattatgatgttgttttggtagagcttggcggaactgtaggggacattgaaagccagccattccttgaggctttaagacagcttagaaatgaggaaggctctgaaaatgtaatgtttgtacatgtgactttcgttccttacttgaatgcagctggcgaattcaagacaaagcctacccaacactcttcaaaagagcttagaagcatgggtatcaaccctaacatgattgtcttaagaagccaagaacctattgacgatgacttgaaaagaaagatcgctcacttctgtgacgttgatgtcaaagctgtcgtaaacactcctgatgctcaatcaatctatgaggttcctttggtattggatagggaaaatgccggacaatacatttcagatagaataaatcttggaatcgattttgaaaatgataaaaatactcttaacgaatgggaagaaatcgtaaactcccttaaaatacaagatccggttgttaccatcggaatcgttggaaaatatgttgaattggaagacgcttatattagtataagagaatcactccatcatgcagctgccaaaatcggcgctaagatgaatattgaatatttaagttctgatgttgatgtggaagatgttgatgaattgaaggcattcaaggaggagctttcaaagcttgacggaatccttatccctggaggatttggagaccgtggagttgaaggaaagttccaggctgttgattatgcaattgaaaatgatgttcctatcttcggtatctgtttaggtatgcaatgtatggttattcagtttgcaagaagaattggaatggaaggtgctaacagcagtgaattcaacacagaaacaccatatcctgttattgatatgatggaagagcaaaagaaaatcaagaagatgggcggaaccatgcgtttaggtgcttatgactgtaaattgattgatggcaccagaactatggaagcttatggagaagagaacattcaggaaagacataggcataggtttgaatataataatgaatatagggatgttcttactgagaatggtcttgtcattgcaggaacaactccagataatttcttggtagagattgttgagttgcctgatcatccatggtttattggatgtcagttccatccagaatttaaatccagaccaaataatgcacatccattgtttgcttcttttgtacaagcagcttttgataataaatag

SEQ ID NO: 953 - DNA, 381 bp, Methanobrevibacter ruminantium
atggatacaaaaactattactgcagaattgaatgaggagcaatataagaaatatcaaataatgcaagagaataatttgagtgtaggtgaagccatagatctgattttcaatcttagggaagagtttgaacttcaagctaatgattatcttgaagagaggcttgctgagctaaatgataaaaaagaaagtttatctaaggaaatgtcttcaatagatgatgaattgaatgttcttaaaaaaattgtagattctcctatggacttcaagcaaaaaagagacatcattgaaaaggaatatgcaagttttgatgagacttatgatattaaggttataagagctaagcatcaagtaagttgggtaactgatttctttaaattctaa

SEQ ID NO: 954 - DNA, 453 bp, Methanobrevibacter ruminantium
ttgaataaagataattcttcattaaataaaaataatcttaatttagaaaaggaaaattcaagtcttgaaaaaatacttaagccagaatctaaattaaattccagtttggatttggtttctaatatgatttcagatttggattctgatatagaatcaagattaaattctgatttggagtccagttcaagttcattctctgatttatatagaaattacctcatcgaagacaatgaaatctatttggaaatgtccatttcaaaagatgaattcttcaaaatgatgaaatttttatatgttttgattgactcatatagattagaattaaataatatagaagttttagatacaggtgatggattattaaatatctgctcaagcattttaatggaagatgagtcaaacattaaaataattgaagcatttttaataaataatgactttggaaatgattga

SEQ ID NO: 955 - DNA, 744 bp, Methanobrevibacter ruminantium
atgttattgaaaataattgaaaacaaaaagataaaggcaaatcaaaaggaatttgataggtttttagaaaggttccataacaataaaaagacattcacagtagactgtgaccatatcaatctggactatttcaattcagaatcatatgttacaatcagacatagaaagccaaataaggagtccatatattatacaagcttttttaaggaaagggatgaagtcacttacttatttggccttgcccgtgaaaatgtggtttgcacatcctcttatatggatatgggtgctcagataagacctaccttagttgcagtattgaatctggaggattcctctaaatcaactattgtatttgctgaagacagcgaagaatataacaatgtcattctgcttagaatagactgcagtcagctaaacaatgatgaattgactgtcttaaagaataagaataagataaccaagcttaaagatggaaagggctttatcaatttcggagccattggtgatttcaccacattgaaaaacatccgaaacttcatttccaatgtgacttttgaatatgacaatggcctttatgcaaaaataataaatgtatctattccaataaacaatagtttttcaaaacctgattcggatgttctaaaggacagattctataattttgataagctggattctgatctggtggtcattgatcctaatgaagatgatgattccaataaaagaattctgaagataaattaa

SEQ ID NO: 956 - DNA, 4689 bp, Methanobrevibacter ruminantium
atgaaaaaccatagttttatgtttttagactcagattttcaggatatctctaatttttgcatgaggatggaaaagaatatagttgaaggcgacggcgtagatgcagttatctgggcaggaaagatagcagaacgtgttacacactatattacaaaattcgtgggtattgatttaaacgaattggaccaaaataaaaaactcaataccttatactctaaaggaatcatacctgaagataaatacaataaattggattccatacgtcaatatagaaacattgcaactcatcatgaattaagggatgagatgaacatagcaaagaaaactcataaagacgtttttaatatattgtcatggttttatgggacatataagggtgatgaggcatattacaaactcaaatatcctggagtcacctatcgccatgatgaaagctttttaaatcaacttaaggaaaacataaacaacaatgtaaaaaccatagataataataaggccaccacagcaatcaaatcagccaacgatcacatatatcagcatgatgttgactataacgtacacagctacttcaaccaaaacaatgttgaattcaatccggaattaaatgcatacactgcatttttcatttttgatgacaagaaagtaaccataggccatttcaagacaagggaagttgcagtgagaaagggatatagattcgttctaaacgaggactttaggatgtttcaatactttaacggatgcctgcttcctgaaaggttggaagatggaagctattccgattccaagggaatagatttcgatatggaagaaaagctatggaaagcaagctttgacgataaggatttgggatacttcatatctgaaaattcagccataatcgcaagaaaggaatatatagacaccttgccattacctgagagcaaaaacggctcctattcagattataaggaaatctcatttgacttgaaccataagctatggtacattaagaaggaaggaaagatactggactattatgatagcgaaagggaggcaatacataacctttcaaatgtctataggctcgatatagacttagaggacttaggcatagtccaggacaagaacgattcaagatggaagatattctataagaacaagtatgtaaccacttgcgacactaaggaagaagccatcaaaaagcgattaagccatatttccagctttgcaccaccaaagagaaacaaggatggggagtattcaatccataagggaatatactatgacgataagaaccttatttgggtattgacaatcaagggagagacattaggattctttgacagtgaagaggacgccttcaattataagaaggaattcctaaaatccaaaggatttgatgtaagcgaccttatattccaccaagaggaattatttgatgacagctttgactttaaggtaaggcttaacagcgaagaaaacgccgtagattacgataaggacaatgacgaatgggtcatttactttaggggaaacgagataggaaggaaagcctctgaagatgaggcaagaaagttccgtagggcatatcttaaggaaatgccttatcctccaagaaagtccaatggtaattattcattcattgatggaatagattatgacatcaacagccatttatggttggcaaagaatggtgaggagctgatcggacattttgactccgaggaagatgcattctatggattgaaggaagctcttgttaaggaaggctttgatgtaagagatatgcactttatcaattcagacattaaaagcaatgatgaaaatgacggtaacttgtctaatatagtcaatccaagcaaggattatctaataaaggacaattccactaaggattatcttagtgatggttctgtttctaatgaagattcttcagcagaagcatctaatcaaaaagatggctctgataaattaataagcttttatgatgtatttagaacaaatacaggcaattatattttaagcgattctgaagaaagtttaagcgattctgaagaaagtttaagtgattctgtagaaagtttaagtgattctgtagaaagcataaataaacctgtagaaagtgctgatgaagattttaaaaacaacagtgaaagcattgctaatgacagcgcttttgaaaccgacaatggaaggggagttatcgatcaggagtttttagcagatggagacaagcaattcaatatgggtgcaataatccaagaggacaattcaaagaatataaatgagtataagaaaagttccttttatggaattgccaatcaaaatcaggacgataggctttcagatgatttatcaattccatatttggaatcagaggataattacgaatatatggaagacctcaatttagagcagcttaatttggatgagaacaatggattcctaaacatatctgaaaaccttttcaaaagctctaatcgtaaggaactaaaggaaataaaattgaactcatacgactccaataacttcagaagggaaatggttctctcctataacgattcctatttatgcgtatcccttcagggcatggtaaataaggatgagttaaaggacatcatatttttagacattttggacaatatggtcaaattgaactattccaaggtggatgaagagtatttcagcatcttcatcaatgtgcagtataagttaagcacaattgatttagtaacattgataaatcttttgtctgatttaggttgggaatttgacttattggataaattggccatttccaatgatataaatctaaattcactagtccaatccaagataggaaaaatcagagacaaaaggaaagcccattcaaatgaattgattaaaagttctcataatgaagattcattaatctccaagtctaagattaatgattctatagtttccaatgaatctgattccaataaaggaagctctaaatttaaggaaaacttatctctttatgataaattttcactaagctctaatgatgcagaagattcagatgctcaaaaggctaaagataaatctttaaagtcaaaagactatttggatgcaaatcctatttccaaaagaaaaagctatccaaagcaggaatcaatatcctctaaaaataagaaatctaattccaaatcagaaaaggcaattatccgtggcggagttagagtcagtctagaggaagcccatgagatagataatgctgaggaaaacaaggtaataaaatccaagatcattgataagaagccagaaatggttaaagactttaaaacaacttctttagatagtcttttagaggcaaatagaattaaggaagaagaaagacttaactctacttcagatgatattggtgatgatttgtctattgaagataattctgacacatttaaagatgatttaaattctaatggtctggaaactttagaaaacggattaaatcttattaaagagggtttaaattctgctgaaaatgatttggattatgctgaagatgttttaaattctgaagaagatgatttggattctgctgaagatgttttaaatcctgaagaagatgatttaggttctgttgaagatgttttaaatcctgaagaagatgatttaggttctgttgaagatgttttaaatcctgaagaagataactatgtttctgaatctagtttaaatgatgattttgatagtttggattattcagactccttagaagactcaactgattccagttttgattatggtgatgtattgggtgaagataactcaaattccaattccattgaagacattttcaatgatgaagatgatttggattctgaaggcttattggatgaggattctgatgatgttgacttcttagaaaaggtttcatctgatctgtcttcaactaacttgtttgatgaatctgcagatttaagcgctaacgacttattcgatggctataatgattctagctctagcgatttgtttgatgatgaatctgaaactagttttgaagatgaattggacaatataggttcttcaaatcaagaagatttgtcaaccgaatcaaatgattcagattctaatttggaagaaataggatctcttaaagaaactgcagaacagactgaatcagaatcagattccactgcttcaaaggtatctaaacctaaagtaaagaaagctaaaaagcctaaaaaggttccagcagatgcatttgatgaaaagtatgcaaattccactgaaatcgaatatgatgaggaaagcgataagtggcttgcattccttggaggagatttaatcaggtcatttaacactccaaaggaagcttacattgaacgtaagaagctattaagaagaaaagtcaaaaggcctaaacgtggtatgaatggaagatattccgaatttgaaggaatagacttcaatacacaagagggcttatggacaagttcagtaaatgatattattgtctgttactcaataactgaaaaagaggctcataaaaaaagaaccatgttcgttgatttgattttagataagtttgatgtctcagaagaggaatttaccgaagatctcttagaagaaattaaaagcactaatttagaagatttatttgctgatttatcagatgaagatttgaatgactcttctaatttaagtcttaaggaggttaaaaaagaattaaataagttttaa

SEQ ID NO: 957 - DNA, 300 bp, Methanobrevibacter ruminantium
atggaagaaataagaaaggaactaatcaagtttcaaatggaaagagactggaaaaggtatcatactccagagaatttagccaaatcaatatctatagaagctgctgaactcttggagcactttcaatggcaaaaggaatatgataaggatgaagtggtagatgaattggcagatgtctttaactactgctttctaatggcggatgcattggatgttgacgttaaggaaatagtcttcaataagatgaaaaagaatgccataaaatatcctcctaaggtcagttcagatgatcttaagtag

SEQ ID NO: 958 - DNA, 774 bp, Methanobrevibacter ruminantium
atggatgactttctatcaaattttgttttaaaggaagaagaaacaagtctctcagactccaaaaaggatgtattaaagtttctaaagcaaatcggagtggacactcgttttgtaagcttctttgaaaaagacaatgaaaaaaggatatatatagagaatcttcgattttcaaggttttccagaaagagaacatctattttcaataatgaatatccagatattgaagttgtccgatcttccctttttcaaaagatatgtttaagggcttcaaagaccttgtcaaactccctggaccctaaggatagagtcatcattccaaaaatggacaatgaatataacgagcttttatttattgttttagagtcttattcaagaaaatatggcataatctttattgaatatgatgaaaatgaaaatatcaatttaaaagactttaatgccattgtctctccattaaacctaaatcaggaagtaaatcatatcttaaatgacatatttgatggaaagggaatagaatgggataggaaattcgatttgtcttctctttatggctttaatgcttcagatatcaaagacaagaaaatcatatttccatttatcaatgtgcctcaagagtggatttatgactttttaggcatagaaaaggaatatgtaattgattatgataatgatgacattggagactcctttatgggatttttaagcgaaataaatcctcagtttaaggaaaatgtattggcagcctctagctttttagagacacatcaaaaatag

SEQ ID NO: 959 - DNA, 897 bp, Methanobrevibacter ruminantium
atggtagatggaaaaacaaagatattaggagttataggagaccctatagaacatacattctcaccggctatgcagaatgccggacttgaagctttaaatttaaattacatttatcttccatttcatgtcaaatcagataatttaaatagtgccatagaaggggcaaaaacccttggaataaggggattgaatgtaacaattccccataagagagaagttataacatgtctggatgaagtggatcctattgcaaatatgataggtgctgtaaatacaatcaaatttgattatgatgaaaatgagggcatatcaaccaaaggatacaatacagatgcctatggctgcttaagggccattgaagagaaagcatcagtcaaagataaaaaaataacaatagtaggtgctggaggagcctcaagggcaattgcctttcagatggcaagttcagacattggggaattatccatattgaatcgtaatttcaataaggcagaatcccttgcaaatgatataaaaagtaatttaaagcaattaaacgataatttcaatttaaatatcaatgcttatgatatggacagcctaaaaagagagatacaggaatcagagattttaatagacacaactcctattggaatgtatccgaacattaatgacaagccaatagcaagtgcagatatgatgcatgatgacttgattgtaaatgacattgtctacactcctatggagacctctttgattaaggaggctaaaaaggccaatgctgaagtggtttatggctataagatgctattgtatcagggcattcgcagctttgaaatatggctaggagaagaagcccctgtaaaagaaatggaaaatgctctattgaaagtttttaggcatttaaatggtttttaa

SEQ ID NO: 960 - DNA, 540 bp, Methanobrevibacter ruminantium
atgaatctatgtatgacgactttaagaatgtcattagcggagaagagacagcatctaagcaagctctttttagaggtcttaaaggaacattcaggaaccatttctgtatatgaccttatgagcgttacagctgagcttagggaagataccaaatatgtccaggacaaatatagggaagagacaaatgctgtctatgtaaaatacttcttaggccgtataaagaacatacgtgatgataataatcagtatgatggcagcatagacaaggatgacttcattgaatcagttgctaccttaaagtcatatcaggaaggtgaatcaaaaacatcaaagaccaagtttcctttaatatatgcaatagtctccttatacacaacttatattcttgaagagcctattcatcctgttggaactccgtttccaggctcacttaaggtcactcagaaaaatggagtcttttattgtccggttaaggaagcaaatcttgaatctccaaatgctgtctgcaagatgtgcatagcagaacagttggagttttag

SEQ ID NO: 961 - DNA, 4620 bp, Methanobrevibacter ruminantium
gtgagtaaaacgaataaaaagaaattatttttatctattctaattattttaagcgtattgatatctttatcaagcgtttcagctataaatacaaatgattcatctattcaagataatggagatttatccattcaagactcaattgatgaaatttcccaatttgatgaatcagaacaattaaataaaatcaataaggattcaccagaatccaattttaatcaagaattatctaatgattctaaagacatatctgcagattccaatcaagacctaatgggatttgagaattatgatttcaaatacaatacaaagagctcttattcaaatgccctaaaggactcaaatgtcataaatgttacaggaagcacatttcaagatattcaagatgctatagatagggcaaatgatggggacatcctttatctcaagtcatacaaattccatgggaatgggaccgccatcagcatcaataagccccttacaatcataggtagctatgaagccaataacaaaagccattatttagatgcatacttaaagtccagaatattatatatagattcagacgatgtcacattaatcaatattcactttgactatgggggaaatattgacaataatggcaatggaggggccatatatttggatggaacaaactgcgcaattgtaaattgctcctttaaggggaatcatgcttggctggggggagccattttccaatcaaacaattccaatgacctttatgtgggtggctgcaaatttgtagagaacaatgcccaaattggggcgggaattaccacatgcggattcaattgccttgtttcaaattgcagctttgaaaacaatagcgccgttaccgccggtgcaataatgacagacactcagaagaatggggatatgactttcttccgcttggaaaattccactttcataaataacaatgccacagggggaggcggggccatcaattttgacggctactaccaaagcgtctataattgcaagttcatagataactatgccaaaaattctgggggcgccatctatggcagtttaaaaccatttgacgtttccctatgccaattctataataactatgctaataccggaggtgccatcagaggcactgcaaactataatgtttcggactgccgattcataaataactcagctcatcatgctggcgctgtattccttcattcctatagtaatgtcatagatagttattttgaaaataactatgccgaagcgaatggaggagccatctgtactgattccaacacagtgggagttattattaaaggctccactttaataggaaataatgcaactacaggcagtgccattatgatggtttcaagtagaagcattatagaaaactgtaatttttcaggcaatatcggcaaaagcgaaggcgccatttattcaatccatgactgtaacatctcccattgcatcttcgacagcaatcaggcagaaaagggaggggccttctatatttataggggcaacaacagcaatattgacaactgccgcttcataaacaactctgccaattcttcaggaggggccatatattggtatgtcaataagggtaagatttcaaactcttattttgaggaaaatcaggctcgatatggatctgcaatttattgctcaaatgtagaggcggattcaggatttataatcacagattgtgattttataaataatcatcctaaagaggatggatctaatacaaaggggggagcgatatatttatatgatcaattaaaatgtatcatagttgcaaattccacttttgagtataactatgcctctagaggaggagccatctatgttgagggagatgtaaatcttattgcaaattcaaccttcaagtataataaggcagatattttttcattatctgcttataatgataatgccaatcttatagtcacattaaggggctatgagaattatatgaatgccatctatgccgagaaaactgtcgattttcacaatgtcacctattgggatggggaatttgtcaccggcgactatcctataaaaagaaatctggaagctggaataaacatcatccttgactgcaggggtaatggacatagcttaaatgtcactaagatgaccaatagcatgggagaggttatatttgatgagatgaggaccttgccaagcggaacttatgcatatcaggtctccgttccagataacagctattacactgccaaaaagcttaagcctgacatattcaatgtcccatatctttgtgaaaacattcttggcattgatgtggcggatatctcttatgaccagtatcctgttgtaaatataaccgccaattatacaggtaactacacagtctatattgcaaattcaagctatgatgtcacattcacagaccaggatgttgaaaggggaagggtattgggatataatatcacaatcaccgatgaggatgtagtaaaaggagaaaagctaatagtaattccacatctttttgacataaaggatggctatggggcttatgttcaattgagggcaatcgatcaggagaatgttgagcttgtctatattcaaaacaggacatccttcaatgtctataaggcagcttcagcccttgaagctgagggggcagttgctgtaaatggaagcgatatagaattgaattatatggctcaaaacggcactgtaactatagaaagcattaaaaaggacggatctcttttagaaaatggaacagactataatttcacagtaaatgatgataagataatcatcacaggattggatgcaggccattatattgctaatctgaccttgattgtcgacgattatcataacagctcctctatagatgtttcaattgatgttcttatcaaaaccagcatcgatgtggcagattctatttccattgccgaaacagagagctctctaataaatgcaacactatctccagaggaagcaggtttattgaattaccaaagtgataatgaaactgtggcggtcattgataatgatggaagaataactggaattttaaaaggaaatgcaactatatttgttagttatgctggaaatgaggattattctccttccaatgccactgtaaagataaacgtttatcctttggttgatttgaaaataaacaaaactgcaaatgtatctaaggcttttgtagataacatgattaagtttacagtctctgtggtcaatgatggtccttccaatgctagcggagtttatgtggatgagacattaagctccatccttgatcttatttccaattcctcaacaaagggaagctatgatggaaataaatggttggttggcaatttgaataatggtgaaagtgcaagcctaacaatagttgccaaaatcaacagagctggaataataagcaatgatgtgactgtcaaggccaatgaagccgattccaatcagtccaataataattgttcaatctccattgaaggattaatgattgaaactgtattgacagttccaaatgtgacttcaagctataatatggataagaattttacaatcagcttaaaagatataaacggaaacccaattggagatgcaaatataactgttgacttaaatggcaaaaagagttatataacagattcaaatggacaaatcaagctttcaactacaggattggctgtagatacacatgttttgaatgtcacatttgcaggcaattacaagtacaacggttcaagctcttcaagcaagatagttattatcaaggattcaagcaaattaaatgcaacagacattattagcacttataatgatgatgattatcttattgtaagcttaactaactctcagaacaatcctattgcaggagcaaatgtatttgttgatttggctggaaaaagaaattacactacagattccaatggccaaatcaaagtgtctcttaagaatctaattccagacaactacaatgcaagcattgcatttggaggaaatgaaaactatacagaatccagcacaagtgcaatggtgacagttaaaagggcaaagacatcatttaactacacagatatgaatacagttgcattcgattcaaaattagagggaagagttggagaatactttaaattcaaattgctggataataatggaaagccaatagccggaagacaggtattcataggtttcaatggagtcaaatacaatagaacaaccaacgaaacaggtgaggcacagcttcagataaaccttaagtatgccaaccattacacatttgcaatagcattccttggagatgactgctatagcggatcattcaatgttgcgctgattagtgtaactgaacagactcctgttctaactacaagtcctaagacctataagtcaagcgctaagacaaaggtcttgactgctacacttaaatcctcaagggaaagtgcccttccaggcaaaaaggtcactttcactattaatggaaaggtatattctgcaaatactaatgaggatggtatagctactgtaaaggtcagcctaagcaagaaaggaacctatagctttacagttcagtttggaggagacagcacatataagaagattactaaaagctcaaaacttactataaaatag

SEQ ID NO: 962 - DNA, 5061 bp, Methanobrevibacter ruminantium
atggataaaaaggtgagtaaaacgaataaaaagaaattattattatctattctaatccttttcagcatattggtatctttatcaagcgtttcagctgcaagtgatttaattcaagactatgaagatttaactattcaaaattcatatgatgatttaatcattcaagactcttttaatgaagatttaattcaagattcttctaatacagagttaaaaactcaagattcatctattgacaatctaaaagagactataaatcaaacagaatcaatagatgacacattaactaatcaagatttatcaagtctccaagactcttcaaaggagaatataaaggattccaatttaaaaagctcaagactgggaaaatccataaccgttaagggaaatacatttcaatccattcaatcagcgattgatggtgcagaagctggagacactattattctaagcgaaaatatgtttaagggagataattattatggccttggagaacaaatttatattaataagtcccttaccataatgggcagttctcaattcggcagccaatatataattttaaatgcactacatagttcccgtattttcaatatcactgcagataatgttacaataagcaatattcaatttaccaatggctacgtagtaggtgaacccggaggagctatttactggtttggaaacaatgggaaaattataaattcttacttctcattaaattgcgccaattcctctatggaatgggatattgaaggaggtgcaatttactttgggttgaaattcaaaaatcaatatattgaaaattgtttattcaaatataattctgcatatgatggcggagcattatatacctgttcgcaaaataccacaatctcaaaatgtacttttgacagtaattttggtatttcgaataatgctggtggcatggccaatggtgcagctctcagttttagtgctaaagatgtttatgtaattgattccactttcttaaataatgatgctccagaaggatggggtggtgcagtatatatctataaacatgggtatgaaccttatttctttaattgttcctttaaaaataattctgcagcttttggaggtgcaatatgttggttaactgatggagggacatttttaaattgtacttttgagaataatcatgcaaccggcggtgacgctattccccatggtggtgctatctataaaatagggcgcaatggaggcaatattataaattccactttcacaagaaattatgcaactacaggcagtgccatttatctaaacgcttatttaaacatagacaattgtactttcacggataatcaggctgatagtgaaggtgccatttacataataactgataatgttacgatacgcaactgtttatttgacaaaaattatgcatataattacggcgcggccattttttcttgggaccatgacaatatcaaagtggaaaattccagatttattgaaaatcatgctcgcaatgaaggtggcgccatctatttcctcggaaagaattgtcagatatatggctgcctatttgagggcaatagggtaagcaatttttactctttcggtggtgccgtctttatggaaattagtggtgaggatacttccattctagattgtagctttaaaaataactctgctctttataagggcggagccctatacatttcttatggctcttcggaaaagattgcaattataaattcaagttttgaggataattcagcaagtaatggtggtgcaattcaggcggattggaatttaagccttattgcaaattcaagttttgaggataattcagcaagttatggaggtgcaatacaggtgtttgggagtgtagaccttattgcaaattcaagctttgaggataattcagcaagttatggaggtgcaatacatgtgtttaggagtataggccttattgcaaattccacctttaagaataattatgcaaacagtttagagattaaccaatccaaagagtcatatggaagagtatttacttttaagggcaaggaaaattatattaatgctatctatactgaagattacagtttgaactttgagaatgtgacctattgggacggttcatttgtcaccagcggcagccctataaagagtgactgtgaagcaggcataaaaatcagaatagttcttcgccaaggcgtttcggcaggtcctgttgttttaaatattacaaaaataactaatatcaagggggaagttgtttttaatgagtataatggtctttctccaggaatctattattatgaggcatatcatcctaaagacagctattattcagagtcagagaagttaagcggcatgatcactgtccctaaaaaagccactgacaacacccttgctatttctctagatgattcaatctatggggaagacctaaaggttaatgtaaatactgacgtctctggagaatacaggatctatattgcaaattcaaattatgatgcaatattcaccgatgacgatgtcgcaaagggcaatgtattggcctatgatattacagtaaatgagaatgagctcaagggaaataaatggacaatcctaaaaaattctttgaatgttaagaacggatatggagcatacattcagtttgcagaccttgaagacggcgaaaattacataaatattcataataggacttcattcaatgtctataaggcagaatccagcatagatgcaaatgaaacaattgccattgagggggatggcgctgaggtaaactacacaattgaaaacggaactgcaagcatagacaacattagaaggggctctgccatattggaggaaggcactgattataattttacagtcactccagataagataataatcactggattggatatgggcaattatactgtaaaattaaaaaccattgttgattccaactataacccttcaacaaaagaagtctttatttgcatcctaggtcgaacagccattgacgttcaagagtcagtggcaattgaaaaggataagagctatcttttaagtccaaccctaattcctgaagatgcagggactctacgttacatcagcaatgatgaaagcatagtgaaggttgactctaaaggcaatctcactgcaatatctgagggaaacacaaccattatggttctatttgatggaaacgatatttatgccccttcaaatgctacagtgaaggtctctgtctattcaggaagcatgccaacatcaatcaaagtcaataagtcatttgaattgtatatggatgaatccattgatatgggtgcagttctagacccggcaaatgcaggaaacttgacttataaaagcagcaatgaaaagatagtgaaggttgacaattatggaaagataactggacttggccaaggaaaagcaaatataactgttagcttcagtggaaatgagaagtttttagccagcaatgctacagctttggttacagtttatccgttagtggatttaaaaattgctaaaagtgcaaatgtatctggtgaagtctatattggtgataagatcaaatttgtcatcactgtttcaaacaatggcccttccaatgcaactggagtatatgtaaatgaagcattaaactctaatcttgttttggcttccaattctacaacaaaaggcaattatgatggaagcaagtggactattggcaatctaaataaaggagaaacagttaacctaacaattattgcaaatgtaaaatctgttggtaacattgataataaggtaattgcaaattccacagaaagggattccaattatacaaacaatattgcaagcataagcacaattaaagcactccctattgttgatttgagtattaatgtgacttctaataaaaaatcacttaatgtgggagatacattcacttatacaattaatcttattaatttaggtccttcaaaggctacaaatattattgtagatgaattattaagtcagtttattgagcttgtcaatgtcaatctaagcattggaaactatgataattccacttctgtatggtctgttgatcaattagatccgaatagtccagttagcttaaatttaactgttaaggcaataagagcaggcaaaattgaaaatagtgtaactgcatattccaatgaaaaggattcaaatgaatccaataataatttcacattatctattaattgtgttaaaataaatactcaattgactgcaaataatataactacaagctataatcttaataaagatttgataattggattaaatgacagcaaaggcaatccattaagtggatttatagtgtctgttgacttaaatggcaagaagaattatacaactgattcaaatggtcaaataaagattccaactaagtctttaattccagacacttataatgcaacaataagattcgaaggaaatgagaaatattactcctctcatgcaagtgcaatcatagttgttaaaagggcaagcacatcattaaactatacaaatatgaatacagttgccttcgattcaaatatagagggaagagttggagaatatttccaattccaattattggataatgatggaaagccaatagcaggaaaacaggtattcataggtttcaatggagtaaaatacaatagaacaaccaaccaaacaggtgaggcaaggcttcagatcaacctaaagtacgccaaccattacacctttgcaatcgcattcctcggagataacaactatagcggtgatttccaagtagcactgatcaatgtgactgaacagactcctgttctaactacaagtcctaaaacctataaatcaactgcaaagacaaaggccttgactgccactcttaaatcatcaagaggacaagcccttgcaggcaaaaaaatcactttcacccttaatggaaaggtttatagcggaaataccaattctgatggcattgcaactgtaaatgtaagcttaagcaagaaaggaacctatagctttacagcccagtatggaggagacagcacatataagaaggtgactaaaagttcaaaactaacaataaaatag

SEQ ID NO: 963 - DNA, 1302 bp, Methanobrevibacter ruminantium
atggaatttgaaagaccaagaggaacaagagacttcctctttgaggaaatgagagaaagaaagatggctgaagacactttaagaaatgtctttgaaaattacggattcggcgaagtgcagacacctctttttgaagacttaaaattattcactacaaaatccggagaggagattgtagatcaattatacaacttcaaggacaagggagatagggatttggcccttaggccagagataaccgcccctattgcaaggctatacttaaatgagcttcaaaagacctcaaagccaatcaagatttactattatggaagctgcttcagatatgaaaggccccaaaagggcagattcagacaattctggcaattcggatgcgaattgattggagcaaagactcctgaaggtgaggctgaagtcattgcaatgtgcaacaatgcaatcgaagagcttggaataactacagcagaattcaatgtaaaccacctcggaatcataagagggctctttgcccactttgacattgacacagccacccaaagggagataatggttgttatcgataagggagacaaggacctattaaaggactcccttgttggagaaaacccaatcataaaggacaagccagagcttaatgaagtgctgttcaaacttatggacatggtaggggattcatcaatcataaaagacatagaagagcttgtcgctccatacgaagaaacccaagaggcattggaagagtttaaagagcttgtaaaaaccttagaaagcttccaggtattcaactacaaattgaaccttggcgtcgccagaggccttgactactatacaggaatcgtatttgaggtatatgtggaaggacttggcgcacagaagcaggtctgcggcggaggaacctacaatctagtcaagctattcggaggagaggatgttgtttccacaggatttgcattaggatttgacagactgatgaatgcaatagaagagcttaatggcaaagttgaattggaaccaatagttaacacttatgttgctgcaatctccgactcaacaagacacaatgctttcagcattgcacaagaccttagaaaggccaacattccaactgaagtggacctatccagaaagaaattcaagaagatcttggcttatgcaaataagatagatgtaaaatacacagttcttgtaggagaacgtgacctagaggaaggaaaggttacaattaaggacatgttaactggagagcaggaattggtagccattgatgaagtggttgactacattaaaggcaaattatattaa

SEQ ID NO: 964 - DNA, 414 bp, Methanobrevibacter ruminantium
atggaattaaacttcagacttaatatgggtggagaagaccttgtaattgcagttgcacaagactacgaaacaaatgatgtgctcatggtagctttcatgaacaaggaagctgtagaacaaacattaaagaccaaaaaggctcactactactccacatcaagacagaaacaatggctaaaaggagaaagctctggaaatgttcagactgttaaggaaatgtatattgactgcgatgcagatgcaatcattatgaaagtcgaccaaatcggtgcagcatgccatgaaggatacaggtcttgcttctttagacaattggacattgataaggagaatattgacttagacagtcttacagatgaggatataagcataatctcagaaagactctttgatccaaaagagatgtatggataa

SEQ ID NO: 965 - DNA, 2163 bp, Methanobrevibacter ruminantium
atggattttaacgattatgactatgatagcgaatacaacaatgatgaagaagaatacaatgatgaaattaaaagaattgtgccagatacaagcgcaataattgaaggaaatgtagaaaagataataaaggaaaagggattgaactaccccgaaataataattccagaagctgtcattgccgaacttgaacatcaggccaacaaccaaaggccaacaggactaagaggtttggaaaacctaaagaaactacaggaaatggcagagattggagagctgtcaattagaataaccggcagaaggccaacaaagtttgaaaaggacaatgcaaagcttggagagatagacggacttataagagatgttgcaaaggacgaattggcactactcattacaagcgacaagatccaagccaagacagcagaggcacagggaatcccagtcatatattatgctcaagagtataaaggctcaatcgacttgaagatagcaaaattctttgatgaagagaccatgagcgtccatttaaaggaaaacgttccacctatggctaaaaaaggtaagcctggccatatcaagcttgtaaagcttgcagatgaaaagttcacctttaagcagcttgaattcatagctgaagagatattggaaaaggaaaggtatgaccctaagacctatcttgaagtggacaggcagggagcgattgttgttcagtcaagagaccttaggatatcaattgcaaggcctccatttgcagaggcacttgagataactgcagtaaggccagtagcagaagtgtcccttgatgaatatcacctatccagccagcttatagacagacttaccaacagcgcaagaggaatactcatttcaggttctccaggagcaggtaaaagtacatttgcccaggcaatagccaaattctatgacgaggacttgaataaggtagtaaagaccatggaatctccaagagaccttcaggtggcagatacaatcacccaatatgcccctcttgagggggatatggaaaagacagcagacatacttcttcttgtaaggccagactttactatctatgatgagcttaggaaaaaccatgacttcagcatatttgcagacatgaggcttgcaggagttggaatgatcggtgtagtccatgcgacaaagcctattgatgcaatatcaagaatagcaaacagggttgaccttggtacaattccttcaattgtagatacaacaatctatatagaaaacggtgagatatctgcaatatatgaaaacaagcttacagtgaaggttccaactggaatggaagagcgagaccttgcaaggcctgtaattgaggtcagggactttgagacaggaacccttgtaaacgagatctacacctacggtgagcagaccatagttatggacataggaatggttgaagagtctaaaaaggcaaaggataaggaggaaaagacccctgtacaaataatagccgagcgagaaatcctaaggaccatgaaaagaatagtccctaaggctgcaatggaagtgagcatggaaaatgacagaagggtaaatatctatatgagtgaaaagtacattcctaaagtcattggaaagggcggaaaaagaattgcagagcttgaagaggacattggtataagcatgaacattgaacctcttgacaaggctccagacagcttcagcgaaagattatccaaaagatccaagaaaaagaagtctaaaaaggagaaaaagaaaaaatccaaaaaatcaggattgaaggaatacaatggagtagaggatggagaattgtctgaagatggtttgaaggactataataaggataattattttgacttcaccgatgataatgaagattattatgaggattatgaagattatgatgattctgacatattggaagatgattatgaagagcttttctatgacacctttgaagtattcccaaaagttagaaagagccgtgttgaattgccaataggcaagaagtatgtaggaaaatcctttgacatattcattgaagatgagttcctgttcaatgcaaccgtaagcaaaaagggaaatgtcaaggtacataggaagttaaagtcctatggaaagatagtctctgcattagatgcgggagatagaatcattgctaaggttagaaaatag

SEQ ID NO: 966 - DNA, 768 bp, Methanobrevibacter ruminantium
atgaaattaggagcttcaatatttcctagaaagataattccaatagaaaaatccttagattattttgaatcaaacagatacatcgaatatatggaaatatttcacgactatccaaatagggacattgatgttgaaaaggacttgattgacaagtttaactcatatgatttaaagtacacagttcatgccccctttatagaagtgaatcctgcttctgtaaaccctgctcttgcaaaggcatctgtagatgagataaaaagatctgttgaccttgcaaatcttctggactctgacattgtcgtaatccatccaggaagagccatatttacaaatgatatggaatatatggcctctgtctatagaatagctgaagaaaacctaaaggttataggagaatatgccaaggacaatggagtgatgacatgcatcgaaaaccttccaagactaaggggattcatgtatcaggacattaatcaattgaatgagactctagagagaacaggtcttccaatgacccttgacatcggccatgcatacactgcaggctttgatgttgatgatgtctcatttgattgcataagccatatccacatccatgacaatgacggcatccgtgactcacatcttcctttaggggaaggaatcattgactttaaaagattctttgaaatctttgacaaatatgatggaatctataattttgaattaggctcaaaggaatatatagaaaagagcatagactatttgaaaggcttgaaattgatttaa

SEQ ID NO: 967 - DNA, 774 bp, Methanobrevibacter ruminantium
atgaaaataggagcttcaatgttagcaacagaagataagacaatgaaagaatccttagactacttcgatagcaacaaatacatcgaatatgtagaaatattgcatgactatccatatagagaattgaatgacgataaggagcttattgatttaatcaactcatatgacttaaaatatacaattcactctccattcattgacttgaatatcgcttcccttaactcagcgcttgcaaagctctctgttgaagagataaaaagatcaatagaccttgcaaatatgatagacagcgatatcgttgtagcccatcctggctttgtatcatttaatggaagaggcaaggaagatataatttatgaaataggaagagaagggctagtggaaattggagattatgccaaggacaatggcgtcaatgcctgcatcgaaaaccttccaaagattgaagggttcatgtatcaggatgtgaaccaacttaatgatacacttgttgaacttgagcttccaatgacattggatattggtcatgcacacactgcaggcttcagtcctgatgagatttactttgactctgttaaacacattcatgtccatgataatcctggtgatgatgatacacaccttgcattaggtgatgggacttttgatgtaaatggcttctttgatgtttttactaagaatgggtatgacggcatatatatgttagagttaaatcatatcgatttcattcaaaaaactttggactatatgaaaaatctaggattgatagactaa

SEQ ID NO: 968 - DNA, 1302 bp, Methanobrevibacter ruminantium
atgtggaatgaagaaatagaaaccatgcctagagaagacatttacgaacttcaattgaagaagctgcaaagcactgtaaaaagagcatttgacaagataccatattacaataaaaagtatagtgaagctaatgttttccctgaggacatagagactttagaggatattgaaaagttgccattccttaccaaagatgatttaagagcatgttatccatttggaatgtttgcagttgataaaaaggaaatcatagaagtacactcctcctctggaactacaggaaagcctgtagtaagcggatacacccaaaatgacatagacaactggggagagattgtagcaagaggacttaccatgatgggccttgacagtgacgacatcatccaaaacacccacggatacggcttgtttaccggaggattcggcgttcactatggagcccacagattaggggcaaccatcattcctatctcaaccggacagacaagaagacaggttgaaatcatggcagatttcggcaccacttgccttattttcactccatcctatggaatctatcttggagaggtagcaaaggaggaaggaatagactttgacaagctaggacttaaggcaatcggatttggagctgaaatgtggactgctgagatgagagatagaatcgaagagacattcaagaccaaggcatataacatctacgggctaaccgaacttatgggtccgggagtaggtatagaatgttctgctcaaaacggattgcacattgctgaagatttcttctatccggaaatcatcaatcctaaaaccggagagaccttagctgaaggcaaacatggagaattggtattgaccaatcttgaaagggaaagcatgcctataataagatttagaacaaaggaccttacagcacttcactatgacacctgcaaatgcggaaggacacttgcaagaatggaaagaatcaccggaaggtcagatgacatgatcaaggtcaaaggagttgccatcttcccatcacaaatcgaaaaggcccttcttaaggtcagcaatattgagcctcactatcaaatcatagtcacaaggccagacattatggatgaaattgaaattaaggtggaagcttctgcatccctattttcagatgacatcaaagagatgatggctgtaaaacgaaagattggagaatatattcaaaatgagactggaattgcagttaatgttagtttagtagctcctaagagcattccaagaagtacaaaaggtaaaatacaaagagttattgacaaacgtaacttacactag

SEQ ID NO: 969 - DNA, 435 bp, Methanobrevibacter ruminantium
atgtataaaataacacaattatccatatttttagaaaacagaagagggaaactttacaatacattgaatttgcttgctaaaaatgacatcaacatcagagcattgtttttagcagacactaccgaattcggcattttaaggcttgttgttcaagaccctataaaggctaaagacattcttgaagaaaacgaccatatagttaaaatgactccaatcattggagcagagcttgatgacactccaggtggactttcaactgtcttgaaaattatcaaggacgaagagattgatcttgaatatctttatgctttcactcatgagaaaactgaaaaggccattcttcttttgcaagcagatgatttagacaatttgattggtattttaactgcttataaggtgcctttagtacctgcagaagaagtttataatttataa

SEQ ID NO: 970 - DNA, 951 bp, Methanobrevibacter ruminantium
atggtaaaagtatgtattattggagttacaggagttataggtaaaaatgtagcttttaaattggcaagagcagacactgtagacgaaatagtgttctttacaagggaaaaaagcctatcaaaagcaaaaggagagatatatgacatgtatgatgcattggctgcagaggatattgactgcaagctcactccaacttcagattataaggatatggctggctctcaaattatccttataacagcaggggctccaagaaaagagggaatggaaagaagcgacttggcacatacaaatgcacagattgtctataactatgcaaagcagatagcaatccatgctccagattcaatcattctaattgcaacaaatcctgtggatgttatgactgcagtggctcttgaagcctctggatttaataagaaaagagtcatcggccttggaaaccacttggattcattaagattaaagacatattttgcaagacgcctggacataaacagcagtgaggttcatacaagggttgttggcgaacatggtgaaaggatggttcctcttttaagctctacaacaatagggggtattcctctaaagtactttatcaaggatgtgaaactagaccttccagatattgtgaagacccttagaaatgctggaaacactatcatttcaaagaaaggggcaaccgagtatggccctgcctatgcaatatcaaacttgattaccacaatcattacaaacatccataagatacttactgtaagcatgtatcttgaaggagagatagcagatgttgaaggagtctgcttaggtgttccggttgtattatctaaaaaaggagctgccatgattgttcctattcatatgaatgactatgaggtaaataagtttcaaatagctgcaaatcatgtcagggaacttactaatgaagttcttgaaagattagaaaaatag

SEQ ID NO: 971 - DNA, 2505 bp, Methanobrevibacter ruminantium
atgtataaagatgcaattttagtcaggggagctaaagtacacaatctaaagaacatagatgtggacattcctcttggaaagatagtggctatagctggagtctctggaagcggaaagtcttccctagcccttggagttctgtatgcagaaggatccagaagataccttgaggccctatccacatatacaagacgaaggatcacccaatctgaaaaggccaatgtggaatctgtccaatatgttccggcagctcttgcattgcatcagagacctaatgttccaaatataagaagcacctttgggacttcaacagagcttttaaattccttaaggctgctatactctcgctgtggcagctatatatgtccaaatggacatatcctcaagccttcattgaatgttgcaagggagattgagcttgaatgtgatgtctgtggcgagagattctatggtcttggagctgaggaatatgccttcaattcagatggggcatgtcccaattgtagcggaactggaatagaacgtgtcattgacgattccacacttgttccaaatgaaaacaagaccttggaggaaggtgcagttgaatcatggaacatgtttggaataaactggatgtatcatgtggctggagagcttggagtgagggtggatgttccctttaaagatttaagcgataaggaaaaggaaatcgtttataagggaccctctgtaaagagatacattaacattccatctaagaacggaaagctatttgagttgaatgcagaatacagaaatgcccatagggcagttgaagaggcattgaagaatgccaagactgaaaaggggcttactagaataaacaaatatctaaagataagggagtgcagccagtgccatggcacaaggcttaataaaagagcaaattcaactcttttaggtggaataaacattagccaagcctgtcagatgactctagaagatatcgtcaaatggattcctaatgtcataaacaatctgccaaaggaaatgcaagatatggcaaataacattgcagaggagtttatggacaatgccaagatattgcttgacttggggctcagctatatctcacttgataggccaagcaataccctttccactggagagcttcagagggtgcagcttgccagaacccttagaaaccctacaacaggggttctatatgttttggatgagccttcaataggtcttcaccctgcaaatgtggaaggcctgataaaagtcatgaacaggctgatagaggatggaaatagcataatacttgtagatcatgacgttaggatattaaggatagcagactatctgattgagttaggtccttcagcaggttcaaatgggggaaagataattgctgaaggcacaatagatgaaataaataaaaataaagaatcattgatttcaggattcctctcaaatgaggaaaagattataattaggaaaaagtcagataagaactccatattcaaaaacggatccattgacatttcaacttgccaaatccacaatgtaaagcctatggatattagttttcctaaaggaaagctcactgtagtaagcggagtttcaggaagcggcaagaccacattgctccttgaatcattgtatccagcagttaaatcattgataaatgatgaaaatatccctaacaatataaaatccatcgatgcaaagaatattaataaaatagaacttatcgatagcgttccaataggaaagaatgtgagaagcacagtatcaacctatagtggagtattggatgacttgagaaagatatttgccaaattggactcctctattgaaaggaatctgaaggcatctgacttttcatataatacaggcagcctgagatgtccatcctgcaacggcacaggaacaatctctatggatgtccagttcctccctgatgtggagataacttgccctgactgcaatggccttagatattcagatgaagctggtgaaataatgttaggtcatctttccatttcagatataatggcattgacaatagatgaggccattgatgaactgtccaatattgaagatgagagtatagatcctcttttaaaaagagcgataaataaattggctaaactgtccaatttaggccttggataccttacaatcggagagtcaacaccaagtctttcaggtggggaagctcaaaggttaaagcttgcatctgaaataggcaaatcccaaaggaattcaatattcatctttgatgagccttccataggtcttcatccattggatgtgaaggtattgcttaatgtattccagacattaatagatgacggagcaacaatcatagtaatagagcatgaccttgatataattgcaaatgccgattatataattgatattggaatagatgacaagcatatgggtggagagatacttgcaaagggaactttagaagatattcttaattctaaggatagtctgactgctaattatttaaatgagattaatttatag

SEQ ID NO: 972 - DNA, 498 bp, Methanobrevibacter ruminantium
atggtaaatgaaaaaatggaagcagcattaaatgcacaattaaacgcagaagtttactctggatacttatatttatctatggcagcttactttgaagatgttgatttagcaggatttgctaactggatgagagttcaagcagcagaagaattggaacacggaatgaaattctatgactatctcattagaagaggagcaagcgttacccttactgctattgacgctccacaaaccgaatgggaatctccattagcagcatttgaacatgttttagaacatgaaaaaatggttactggtttaatcaacgatttagtggacttagctattgaagaaaaagaccatgctaccaacaacttcttacaatggtttgttgaagaacaagttgaagaagaagaaaacgctatggaaaacttagctaaactcaaattagctggcgacgacaactctttattatacaaactcaatgaagagtttgcaggtcgtggagctgcagaatag

SEQ ID NO: 973 - DNA, 156 bp, Methanobrevibacter ruminantium
atggtttttgtatgtgacatttgtggatatgaatacaatccagaagctggcgacccagataatggaattgaaccaggaactgcatttgcagacttaccagatgattggacttgtccattatgtggtgcagaaaaagcagatttcgtagaagaataa

SEQ ID NO: 974 - DNA, 159 bp, Methanobrevibacter ruminantium
atggctcaacacagatgtactatttgcggatatgtatacgacagtgaaactggtgaagaaagaagagatcttgctgctggaaccgaatgggaagatgtacctgacgatttcacctgcccattatgcggtgcagtcaaaaccatgttcagagctcaatag

SEQ ID NO: 975 - DNA, 618 bp, Methanobrevibacter ruminantium
atgatttctttgaagacaatagtaatcaatgcaggtcctaaaaaaagaggcttcaatgcagagatggcaaagtctgctttaaggggcgcccaatctgttggtgctgaagtggaattcatagacttatatcgtctgaagtttacaggctgcttgagctgtctcatttgcatgagagatgattttgaaagctgcaaatgcttccttagggatgatctttcacctttgattgaccggatattggatgcagattgccttttgatagctgccccaatcttcttttcaaatccctcaagccattatatggcccttttggagcgattgatattctgcatagtttcaaacaagggagaaaatcttttcaagggaaaggtcaatgtaggccttatctatacattccattatgataagggctattttgaagagtctgtccgccctcatttcaagcattcagaggacatcttaaagatgctcaatggagaagtggaaatctactcagcagaatatgattccaagaaaacctattccacaagctttgatggcgaaattagttcggaagatgaatgtttcactctcaatttagaaaaaacctatgaaatcggtgctaaattaagcaattaa

SEQ ID NO: 976 - DNA, 411 bp, Methanobrevibacter ruminantium
atgtttaaaaatattttagtggctagtgatggctcaaaatgtggagacaaggcagttgatatagctattgatttggcttcaaagtatgatgcaagggtagctgccctttatatcatggattttggccttgatttgtcctatgatgatatggatgatgcaggaggggctgtattggatgatatcacagcaaaaggtaaagagaaggatgttgttgtggttgagcacattataacagcagatcctattcaagatatggaaaccatgataagaaagataaaccctgatatagctatctttggagctttcggcaagtccacagacaaagaggacaaaataagatatgataagataggcagagttgccttgaatgcattaaaggtggctaaagttccggtccttctagtaaaataa

SEQ ID NO: 977 - DNA, 1722 bp, Methanobrevibacter ruminantium
atgataagtattaaaaacctttctaaatcatataaattagaaaatggagaagaacttcctgccttaaaaaacattaatctggaagttgaggatggagaaatcctaggaatcataggaaccagcggatctggaaagaccacacttttaagaatattaagaggggttgaaaaatttgatgaaggtgaattcaccataggaagatacaccattaagccggattcctcccaattttattataatcaagtcaagaaggaaactgcaatccaccttcaaaggtcatttggtatttggcctgaaagcgtgctggacaatgttgttcgaaaattatacggtgccaaatacggagatgagtctggaactgactttgaaatagctcatgaccaatttgacaaggaagctatggaaatcatagagcttgtaggccttgagcataaggctgatcatttggcatctgtcttaagcggaggagaaaagcaaagacttatcatggctcgtcaattggctaaaaagcctgcagtaatgctattggatgaacctgccacaatggcatgtccaaagacaaagcaggaaatattggatgcaatcaagaaaatcaatgatgaacttggaataaccgtaattctcgtatcacaccttccggaaatccataagttcctagcagacagggtagtccttatggaagacggtgagatagtcaaagacggagatgtcaacgaagtggtggatgagttccttaaggacattgaggaacctgttgacatagacatcgaatccactgacgaaaccataattaaagcaatagatattgacaaaaggttctatttgcttaagggcaaaaacgttctccatatgaaagacgtcaaccttgaagtaaataggggaaatgtgctatctctagttggcccaagcggtgcaggtaagactgttttgcttaggatgctaggaggtcttgactatcctgatagtggagatgttctcttcaagcttgtaaataaggaagatggagaagaagaaatcagatgggtaaacattgaaaatgcaagccttgacaggatggaaatcagaagaaaccttggatttatgcatcaggaatttgcattgatgtattacgccacaatacaaagtcaattggctgtcaagctaggatacaaaagatgggatatggtagaggaagccaaaaagagagctaaggaaaatggccttccagatatcttgcttgatgcattgtatcaattgacagaccttccggaaagggaggctaaggcacgtcttgaacagattggtcttgacccaactatattggatgaattattccctaaattcccagaaactcaaatcaaggaagaggttaaggacttgtttgaagcccttgacttgccgctcgatatccttccaagaaggtcatatgaattgtcaggcggtcaaaaggtaagggccatgcttgcattggttcttgtttcaaagccagatattctcttgcttgacgaaccgtttggagaccttgaccctaagacattgagaatagttgcaaactcacttaagagaatctgcaaagagtttggaacaacccttgtgatggtttcacataatacagacttcattaaggagctaagcaatagggcagtgttcattgaccaaggtcacctaaaggacgatagcgaagatgttgataagcttgtagatgacttcattggattctgtaaggctgattacttgatgtaa

SEQ ID NO: 978 - DNA, 1056 bp, Methanobrevibacter ruminantium
atgggaatgaagaatctaattttatccaagagcgatcaattcaatcattacaaagataaggcaaatcaattgaaaaaggaaaataaggaattaaagctaaaaaatgaggaattggagtttaaaaacaatgagcttagtcctgaacttgaagagggaattagcctaatcattcctagctataagggagaaaatcatattcagcctcttttagagtccttggaaaagcaaacaatttcaaaagacctttttgaagtaatcttcatcgtcaatggagaaatggattccacaatagacatattaactgattttgcaaaatcaaatcctgacatgaacataataattagctatacaagcgaagggggagtgtccaatgcaagaaacattggaattcggattgcaaaaagggaatatataggatttcttgatgatgacgacttcatcagcgataattatctaaaagccctttatgaccatatagctccaaatagggttgtgctctctaatttcatcgacatcgatgaggaaactggagaagagatagggtctcgccttgtcccatattccatgaacagggaaggcatattcaatgatgttgttgtaaaactgactaacctttccatcataacaactgcaaagataattccagcattagccgttaagggaactgacttcaatccaaatctcaacaatggagttgacgtttcctattatgcaaggctatatccaaagaatcattttgaattttattttgtaagcaaggaagaaggagctgtctattatagaataaggcgaagcggttccatttcaagacaggaaacttcctatcaattcaatgtactggaccgattgaaggtcatcgatgacattaatgaaagctataaacaagttgataaaagcgatgaactctatgtccacttcctaaagatactctttgatgctcaaacatacttcattggattgtatttggatgaatatcctcaagatcgtgaaaaggtcattgaagaagtgagaaagcataattttgaatacttttcatatgaaaaactagaaggataa

SEQ ID NO: 979 - DNA, 642 bp, Methanobrevibacter ruminantium
atgtcatttagtttagaaagcattggaataaaggctggaggaagatatgagaccatctacaccaccatgaacaaggcaggtgaaatggacgctgctccaatcggattgaaatacattggagactacgatgttgctgcaaggatatttgaaggaagcaagaccttaaaaaacattcaagagacaggaatctttgtagtaaacattacaaatgacccttcagtctttgcaagatccctttatgacaatctgaaggaagaggaattcgttaaggatgatgacattgtttatttgaaaaatgcagatgcttacttcattgcccttgtaaaatccattgaagagatgaagccggaacatgaccatgtaaatgaaggggcaaagaattatatcataaaggcagagccattgaagataatcatcaataggcaaggagccaaggcactaaacagaggactatttgcattccttgagtcattagttgactatacaagagttgacatcatcgatgatgagaaaaaggaagaatataaaaagagatttattgaaaatgaaagagtcatccaaagagttgcagaggatgatgtaaaagagaatatggctattttaaaggaaaaaatgattgaaaaaggattggatttggaataa

SEQ ID NO: 980 - DNA, 1119 bp, Methanobrevibacter ruminantium
atgtataatgaaaatgtggcatcaaagactaagaaaatattagatagcgctcttgacgggcctatctcagttgaagatgggaattacctaatgaatctaaagggttcagagatttttccgcttttggctactgcagatgcgatacgtgaaaaggtggttggagataatgttacatttatcaacaattgcaatatcaactttacaaatatctgcaaggtccgctgcggattctgcgctttcggaaaggatgcagatgatcctgacgcttatcatctaagcgatgaggaaatattaaagaaggctgaaggtgcagtgaggactggagctcgcgaattcacattgatgggaggggtccttgaggatgcagacattgaatactatgagcatcttctcaagctcttgaagtctgaatatcctgatattgagattcatggattttccccaatgatgattaaggatgctgcattgaaaagtgaaatgcctatagaggaagcattcaagatactcaaaaaggcaggccttggaacattgcctggaactgcagctgaaatattgactgaccgttcaagagagattatatgccctaagaaggtcacaacacaggaatggatagacattattaagacagcccataatgcagggataactggctctgctacaatgatgtacggccatattgaaacaatggaagaaagggttgagcatttggacattcttagaaatatccaattggaaaccggcggcttcaatgagttcattccaatgacattcatgcatgaatactctcccatattccttgaaggacaggaaaacttaggagcaactggaactcaagaccttaagctttatgcagttagcagactcatgtttcatgacattattccaaacattcaagtctcttgggtaaagatgggattcagatttgcacaggtgtctcttttggctggtgcaaatgatttaggtggaactttaggtggagatgaattgtctgaagcatctggtgctccagatggtgttgatgcaagtataaaagacctaagtagacttgtaagagacttaggcagagtccctctagaaagaaactctgaatatactgaattttatcctattgaattataa

SEQ ID NO: 981 - DNA, 537 bp, Methanobrevibacter ruminantium
atgaaaagaaaaaaccgtggcttattaattggaagaatgcagcctgttcataatggacatattgaagttataaaggagactttagaggaagtcgatgagattataatcggaattggaagtgctcagttaagccatgagctaaaagatccattcactgcaggggaaagagttttgatgatgagaaatgccctaatagaggaagggattgacttgaataaaacatatataatccctatagaggacatcaaccgcaacaagctatgggtttctcaggttgagatggtcagccctcctttcaagaaggtctatagcggaaattcccttgttcaagtcctattttccgaagagggatatgaagtaatcgctcctgaattgtttgatagaaaagtcctttccggaactgaaattagaaaaagaatattgatggatgaggattggcaatcattggttcctaaggctacagttgaaattattgaagagataaatggtgtggatagaataaaacaccttaataaaaaggaaatcagtgaattataa

SEQ ID NO: 982 - DNA, 438 bp, Methanobrevibacter ruminantium
atggtaattaagattgttgaaaaagatgacgaatactttacaataggcgatttaatagaagagattaaaaagtccgacagagtggacgaagcaggagccatctacagttttgaaggaattgtaagaggagaagaagagaatttaaccgttgataagcttactttaacacttccagacaaggaaaaaggacttgaacagatagaatctatcgtagaaaccgctaaagtaaagcatggagtatttgaaataagcgttatccatttcattggagagttctatactggagatcagttattcctagttgttgttcttggacctcacagaggagaaaccttggaagcccttactgaagttgtggaaagagtcaagcatgagattgactttaaaaaagaggagctttccaatcaaggaactaaaatcataatggcaggaggataa

SEQ ID NO: 983 - DNA, 207 bp, Methanobrevibacter ruminantium
atggcaattagtgcaagaaatggtattaaaggtactgtagaaagtgtaaaattaggtaaagttatggcaagcatcaagattaaagtggaagatcctgctttaattactgcagtcattactaaagaatctgcagaagacttagacttagctgttggcgatgatgtaagtgctatcattaaatctactcaagttatggtagctaaatag

SEQ ID NO: 984 - DNA, 207 bp, Methanobrevibacter ruminantium
atggcaattagtgcaagaaacggattaaaaggaaaaattgaagatgtaaaattaggagaagtaatggcaagcatcaaaatcgcagtggatgaacctgctgtaatcactgctgttattactcgtgaatctgctgaagaattatctttagctgaaggtgatgaagtaagtgcagttattaaatctactgaaatcatggtagaaaaataa

SEQ ID NO: 985 - DNA, 207 bp, Methanobrevibacter ruminantium
atggcaattagtgcaagaaatggtattaaaggtactgtagaaagtgtaaaattaggtgaagtaatggctagcatcaagatcaaagttgaagaccctgctttaatcactgcagcaattaccgctgaatctgctgaagaattagaattagctgttggcgatgaagtaaaggctatcattaaatctactgaaatcatggtagcgaaatag

SEQ ID NO: 986 - DNA, 207 bp, Methanobrevibacter ruminantium
atggcgatcagtgcaagaaacggattaaaaggaaaaattgaagatgtgaaattaggtgcagtaatggctagcatcaaaattgcagttgacgaacctgctgtaattacagctgtcattactagagaatctgctgaagaattagctttagctgaaggtgacgaagtaagtgcagttattaagtccactgaaatcatggtggaaaaataa

SEQ ID NO: 987 - DNA, 207 bp, Methanobrevibacter ruminantium
atggtaattagtgcaagaaacggattaacaggaaaaatcgatagtataaaattaggagaagtaatggcaagtatcaaaatagcagtagatgaacctgctataattactgcaatcattactaaagaatctgcagaagacttaggtttagcagaaggtgacaaagttaaagcaattattaaatccactaatattatggtggaaaaataa

SEQ ID NO: 988 - DNA, 1224 bp, Methanobrevibacter ruminantium
atgtctgcaaataagaaattcatcagagacagtattcatggaaacctccccttaaattcatttgaacttgaaattttagactatcctcaattacagcgccttagaagagtgaagcaattaggattcatctatctaatctatccaggagcaaatcactccagatttgagcattcaatcggaaccatgcatcttgcaagcaagctggcagatcagcttgagcttaacgatgacgacaaggacttagttagaatagccggacttctccatgatgcaggacatggaccattctcccatgtatccgaagcagtgtttgatgttccccatgaggagctaactgcatttgttgtcaagaacacttcccttgcagataagctctctgaaaaattcaacacaagtgaaataatcgacatcatcaatggaaaaggtaaattgggaccgatcatctctggagagctggatatggatagaatggactatctaatcagagattcccactatacaggagtggcttatggagtgattgataccgaaagaatcatcagcaatctgaagctagaaagggaactgattttagacataaaaggggttcaagctgcagaagcagcacttgttgcaagatatcttatgtatccaagcgtatatcagcaccacaccacaagaattgtcaatgcaatgtttagaagatgcctaaggcatatgattcatcaggacattttaaatcctaaagagatgtacaaatatgacgatgcagacatgataagcatgtgcagaaactctgaaggattctcaagggacattatggagcgcattgacaacagaaggctcttgaaggttgcaaagtcaattccagtcaacagatttgagaacccagacaagatatttaaaataagcaaggaagagttgcttaaggccgaagaggaaatcagccaggacttcaatatagacagaaactatctcattatcaaccttccggaatatcctagatttgatgagatgaaaacctgggtgtcctttggagataaattatatcatttgaatgagatttcaagcattgtaggtgctttaagcagcgcaagattcaattccccagacatttgcctttatgtgcctaaggaagaccttgaaaagaccaaaagaatcaagctggaaaactatttggacttgcctgaagaagtgagaaggtatgatacaattcactttaaccagtccaaattgtttgattaa

SEQ ID NO: 989 - DNA, 555 bp, Methanobrevibacter ruminantium
atgattattatagcaattacaggtgcaagcggagtaatctatggagtggaactcttaaaagcacttaagcaacttaaaatagaaacaggactgcttataagcaatcctgccaagattgtaatcgaatatgaattggaagaatcagtagaagaaatcaaatcattagcagaccactattttgaatctgaagagatagactcctctgtaaacagcggatctttcaagtttgactctgctgtaatcataccatgttccatgaagacagtatcagcaatagccaacggctatgcatccaattccataactcgccttgcagatgttgcccttaaggaaagacgcacccttgttctggttccaagggaaactccattaagggatgtccaccttgaaaacatgcttaggatatctaaggaaggaggcataatccttcctgcaatgcctgccttctatcatgaccctaaagacataagcgacatgaccaatttcatagttggaaaagtcttggatgtcctaaagatagataatgatatgtttaaaagatgggagaaggaataa

SEQ ID NO: 990 - DNA, 564 bp, Methanobrevibacter ruminantium
atgataaaagattttgactttattaatacctgcgatatctccggattcattaaagaggaaattagagcaatagccctctataaatcagatgtgagtaaagaggacattgttttagacattaactgtggaattggagaaatatctacagaattttccaaattatccaaggaagtctattgcatagatgaagacaatacagcaatagagttttccaagacaaatattgaaaagcatggagatattgataaggtcaaattcataaatcaggaccctctttctgctataagaagcatcatcgactttgacattgccataataaaagcaaatgatgacaatattggtgagattatagaagagattcacaatagaatcaattcaaaaggcagaataataatcttgacaaacattcttgactttgctttaatgagtgtaaataagttagatgaattattatacaatccaacaattagtcagattgatgtatctaaaggacagcagttaaataaaggggtaaaattaatttcagacaatcctatgactatgatttatgttaaaaagagatag

SEQ ID NO: 991 - DNA, 699 bp, Methanobrevibacter ruminantium
atggatatattaaataagtttgacatagtgccaaatgatatggaactgtatgagacagcatttacacactcatcctatgcctccaagcatcatttgaacgattatgaaagattagaatttttaggtgactctgttttaaacatgctcacttctgaatttcttcaaaacatgcatcctgatttcggtgaaggcaaattgactaagcttagggctaattatgtctgtcagaatgcattgattgtttattcacatgagtttggattggacaaatgcgtgaaattgaatcttgaggacaatgcattaactgataatgaggtcatttcaatcacagctgatgtcttcgaatcctttttaggagccatctatctagaccaaggcatttctaagtgtaaggagttcctgacaataacagtatttccttatattgaaaatgagcagattttcttccatgactataagtcaactataaaagaatatggcgatgccatagataaggaaatcacttatgagctgattgaagagcatggcgctccccatgacaagacatttgtgatgaaaatattgatagatggcgttgatttcggccatggagtaggaaagagcaagaaggaagctgaacaagtcgctgcctgcaatgcaattaagactttaagattggatcatggccaggatgttgcgtatatgcgtttgtataaatag

SEQ ID NO: 992 - DNA, 459 bp, Methanobrevibacter ruminantium
atgctattgaattggtgtgaagagataacaaatatagacccttcaattaactttagagcaactggaggatggcttaaaaccgttactggtttagataaaagtgtcttgaatggctattcattagttggagagtttgttaaatcaggagattataaacatgaatattccgatggattgtatcttgattgcaacaaggaagggaaaaaatcaaagccaaaacaggactttagactctttagacttaaaaacggcaaactgactcttatcgatcaagtttatgacggcaaaaagaattgggcctgtgaattctgggaaagcgttagcgaagagctgaatcccaatttcagagaaagcgaagctgataagataatcagccttattttagataaaacaggtaaagacaaaaagcttttaagagaggttcaaagccaattggatttagtcatttctgaaatttga

SEQ ID NO: 993 - DNA, 513 bp, Methanobrevibacter ruminantium
atgacaaaaagcttaatcctatatttttcaagggctggagaaaactatacaagccaaggaataaaaaacattgaaattggaaatactgaggtcattgctaattatatcaaagagtttacagaagcggatatgtttaagatggagcctttaaacgactatcctgaagattatatgcaatgtactgaagtggctcaaaaagagctgaatgatgatgcaagacctgaactgaaggaatacattgaagacattagtgaatatgatatgatctatcttggttttcctaattggtggaacactatgcctatgcctgtctggactcaattggaaaagcttgatttcgatggaaaaaccataaagccatttgtcacccatgaaggcagtggattcggcaaatctgaaaaggatattaaaaacctatgtcctggagttaaattagctaaaggattatccatccgaggcagttcagttgaagattctaagaaaaaggtaaaacattgggttaaaaaaggttaa

SEQ ID NO: 994 - DNA, 186 bp, Methanobrevibacter ruminantium
gtgaaaggaactccatcaatgggtaaaaagaataaaaagacccatattagatgtagaagatgtggtaaaaactcataccacgtacgtaagaaagtttgtgcttcctgcggattcggaagatctagcagattaagaagttacagttggcaaaacaaaaaatccactactcgccaaagattagtgtag

SEQ ID NO: 995 - DNA, 234 bp, Methanobrevibacter ruminantium
atgagcggacaacaaaatgttcaaagaccacttgacgcattaggaaaagcagtaaactctccagttttaatcaaactcaaaggagaaagagaattcagaggcatcttaaaaagctttgacttacacatgaaccttgttcttgatgatgctgaagaattagaaaaaggagaagttttaagaagattaggtactgttctcattagaggagacaatattgtatatatttctccatag

SEQ ID NO: 996 - DNA, 705 bp, Methanobrevibacter ruminantium
atggtggaattaagagtaaatgctggaaatgtaaagaatcctaatgttcacaaaattggcataattgcccttggatctcatcttgaaaatcatggtcctgcgctgcctattgatacagatgctaagatagcttctcatattgcctttcaagcatctcttgaaagcggagctaagtttttaggagttatctatcctgctcatgagctaaaggaaataaaccatggcatacatgttagtttagaagatttaaccgatgaaatcgttaaggtattaaaatcagcaaagaaattcttaaggattagcagcgtaatcattgtaaatggtcatggtggaaatctgcctattgtaactactttatatgatattgaagagagaactggccttcttataacattaaacagcaagatcatagaatctgaaggacctcatggaggttctggcgaactctctatggctaaggctttaggaatcatagatgaaagtcaggttgaaaaccagaccaatcttgaggaatatggtgaagtgggcctttatatgtttggggaagctcgtagaaacgatcctaacattgaggaaggggctcttgacgttgaagagaatggcgtttatgtggatgatgtctatggacaggagcttttaaagctagccattaattctgttcttttggatgttgaaaaacagttggattctcattatggctattag

SEQ ID NO: 997 - DNA, 546 bp, Methanobrevibacter ruminantium
ttgattaaattaattaaaatcattgatttttttaatttaaatctactaaatggtttcaaggtgctgattttgaaaattaagaaaagatattttttaaagaagaagaaagtaaaggaaattaaaagcgaacttggagattacggatcatttataaataataaggacactcttgaaatgcttgaggcagaggattataactttattcttgtaaatggagagccttatattattataattaatgacaagccatatcctaccttaaaggctgccttaaatatggaattggacagcaaggttgttgttgtggatatgggtgcagtcagatttgtaacaaaaggggcagatataatgagtccgggaattgtggatgcagatgagtccatcgttccagatgacattgtcattatcgttgaagagactcataacaagcctttggctattggaatcagtcttataactgggcctgaaatggttgaaaacagtgaaggaaaggctattaagtcaattcattatgttggagatgccatttggaatcttgaggtctga

SEQ ID NO: 998 - DNA, 450 bp, Methanobrevibacter ruminantium
atggttaatgatgaaaaaagtttaagtcgtatgagtaaaacagattactaccttgcaattgcatttgcagtatcaaaaagaagcacatgcttaaagagacattatggtgctgtaatagtcaacaatgatgagataataagcactggatacaatggaaatccaaggggagaggaaaactgctgtgacagaggatcctgtaaaagaatggacgttccttctaattctggagactattctgactgcttttcagttcatgcagagcagaatgcaatgatcagcgcaagcagaaatgaaatgattggagcaaccatttatcttgctggtgaaatgtttaaggacgattcttggttcgaaatagaagatgcagaaccttgtccaatatgcttcaggatgattaagaactctggagttaaaaaaatagtaagtaagggagtagttattgatttataa

SEQ ID NO: 999 - DNA, 2424 bp, Methanobrevibacter ruminantium
atggaaggggaacaaaataacttaagaccttatattgaggatttctttagagatttgcaattatatgacgattacaagaatggtcatcactataaagaccttttagaaggaagcattattctttttttagaaaaggaaaacacatataccgcctatgaaatctatgaaaactttttcatgatctatcaaatcacagatgaggacaagtcccatgggcataagactgaaagcatagacatcagcgagtccaattcattattgaaactggtcaatgtaatgaaggactatgaagagaatacaggggatttgattgaaaagcagagggatcatttcatccattcagtaaacgtattcatccttggtttggccatttatgcaagcaatcataaatataggaatgcatttgaggcttatgtgacagacagtccatataagaaatactataagactgctgatggtgaattttccgcagaggagttcctataccgttggggaatagcttcccttttccatgatatcggctatcctgttgaaatcattggaaagcagttatccaaatttataaacgacagcagccaatcaatatctcaaaaatataaggtcaatacagctgtcaactttaagaatttcaatgaattgaattccatcataaagctagaccctaaattcccaataatctataggatggactatcctgaaaccaatttcattgatgtatacaagccaacaaaccttatggctcatcagatttttactgatttgtatgtggattctgatattagggccattgacgagtttgatgagttgaatgaatatctatataagttggttgtccatttggatggctttgtggattatatgacatcaaacaatttcattgaccacggcttcttttcatctatctttgtattgaactcctatggagccattatgcagaaacattatctcaatgatgatgaggaaaaattcgactattatataaataaatatgcttatttcttttatcctgtcttaaacagcgcaacttccatattgcttcataattattttagaggaaccttaaatgagaaggaaagcaagactgatgagtttaatctaggcaaattggaacctatgcaaaacccattagcttttcttttgattttctgtgacgaacttcaagaatggaaccgcaggccaattggactaaaggacaaggctaaaaaccatgtccatgatattaaaatcaatattaatgagaatcaggtcttagttgattatatcgttaaaaacagtgcattaggtcttaatttctctgaaaataaggaggaattaattaataatcttttggatgttacatcaatattctccaatggtttgaaagtaaacataactccttatttggatgagaagtatcctttagaggacatttcattatctgaagttgagactccaaggatattgctccgccatgttgaggagattgcacgtgcaagccataacagatataatgaaatcggaaaggcccatggcaatcctgatgagccttatgagtcattaagtcctaagaggaagctctccagcataagacagactaaggagtttcctatgaagctgaatctcattggatgtgagatggtctcagaaaatgatcctagagatgaatattcccttagcgatgatgagcttgatttccttgcagaaagggagcatgaggcttggtgcagagaaaaaaggaatgtaggttacatttcccatcatgatgcattcaaaagaggtcttatcgatgatgcagaatatgaccgactatgcagaacaaatgaggaaggctgcgagaccaataagcataataagatagaatctccagagagaaacctttatgttcattcaaatattattccttatgacgaactcaatcaatattctaagaataaggatagaaggccgtttgaagaccttccagataatttgaaattgattaagaacaatcctttaaagattgttgaaaacagatataagttgtttacagttgccatgcataatgaatatatggattatattgcaggcaagaaagaagttcctgagtttaaggacttgccatttgaattgcagcagataaattataagcaaacctatctcattgcaaaatacctaaatgaaatcggctatgaaattgttgaaaaggatgatgagagacctgctgtaactaagtttgagaacaataaggaaactggctatttggctggaagagagcataatgcttggtatttaagaaaattgaatgatggttgcactaatggtaagaataaggatggaacagacaatcctaggataaatccttgggatgaattggattacagtttgaaaaagcctaatatgaatacctttaagaaattgcctaaactttgtttgaaagctgatttgaagattattaaaaataaatag

SEQ ID NO: 1000 - DNA, 795 bp, Methanobrevibacter ruminantium
atgaatgataaacttatagaattgccaaattatggtcgcttgatggttgtaagcgatttgcatggtaatttaaatgactatgaaaagtatattgacctttgggattgccaagatcctgattttcatattgtctttcttggagacctaattcattccccttactttaatgataagtctgtagagctgttggatgatgtaatcgaaaaggataagaaatattccaattttcatgtattgctcggaaatcatgaatgggctcatattgttcatagggacatattcaaaaatggagaaaacattagggaggatttcgaatacttgatatcctataagaaaggtactatagagccagccattacagaatatatcagattctttaaatccatgcctttctttgtaaaaactgaaaatggccttttcttatcccatgcagggccttcaagaaaggtaaagtcaatcgaagactttaatggcatttttgatggagattatcataatcctattttagatgatttcttatggcttcgcccaaaaagaaacctttatggacgtagaaacatattgactgacagtaatttgtatgatgagggagacatcttcaatttcctaaatattgtgggagcaaactgcatggtggtaggtcatagtcctgtagatggctataagcagtatggaaatcaattgataatctcttccagctttcaaactgaggacaaggtttatttggatattgatttgtctaaagaaatcaaacacatgagggatttattggactgcattaggtattttgactga

SEQ ID NO: 1001 - DNA, 255 bp, Methanobrevibacter ruminantium
atggaagaaattattcaaaccttaaaagagattgaaaaggaaaataacattgaaatcctatatgccattgaatcaggatctcgcgcatggggattcagcaatgaggaatcagattacgacattagattcatatttaaaagaccgatcaaagactacatctccctaaaaaacaataaagatgccttagacattacaatcgacgattatgacatagtgggatgggacattaaaaaagactttaagcctccattataa

SEQ ID NO: 1002 - DNA, 444 bp, Methanobrevibacter ruminantium
atgggaaattgcgactttctaaatgaactgccagacttcgataaggatgttttaaagtaccattatgcaagcatagcatttaatgtatggaaagaagccttggatagagaagaaatggatagaaaatctactaaacgttatttatattgtattcgttgcatccttgcttggaaaagtgcagatttaggcaaagattcttcaataagcatttttgagctgatggaagacagtgagattaatgatgatttgaaaagtgatataaatacacttattgactattacaaatcattatgcaagaatgaattggatgaagagctgattgatcgcctaagcatttggatagatgatactgtgaaaaacatcaaggatcactatcctaaaaaagagaaaaaggacatgagtctttatgatgatgtcttatttaaagtcttggagattgaataa

SEQ ID NO: 1003 - DNA, 834 bp, Methanobrevibacter ruminantium
atgggatttaaagaagacaataaagacaaatacctagacccttttaaaagagtcactgttgatgtcggaagctcttttaataggataaacgtttcagcagatgtaattggaaacagaatccgcataactgtgccaaaggacaagagtggtaatttaactggaactattgtagagaatattgctttggaaaattccacttggatttttgagcctgttgccgatgagataatggaagatcgcatcgaccgtaagctctctcctagaaaatatatggatttatctaaatttgattttgaaaggggatttttgccaaaggaaatattggatgatttggtatatccaattaattacagaaaggattattctccatttgcaaagaaggtattggagcatccaaacgatgagattcgtaagattgcccttggatatatcgatgatgaggatgttttggcatccattattcttttcagcaaggataaggatctttccttatttgttctagaacatattaaggataagtctattctattagatattgtcagaaatgatttcaattactattatttcactggagcagtggatattttctatgatatggataaattgcctttaaagctctttgatttagatattcgtaaggctgctttagaaaggatagatgataaagagcttttatttgaccttgcctttgactgtgaggaatggtttaagcctattgatatgatcaaagacaataatcttttaagtaaaaaagagttggatagtctgaatttatatgctcaaaacagagagattcgtgaaatcattaaaagtaggttaaaaaatgagttatag

SEQ ID NO: 1004 - DNA, 1740 bp, Methanobrevibacter ruminantium
atgtgtggaatcgtaggatgcatacttaaagataagcaaaagtctgtagctcccattttacttgaatgtgtggaaaaccttgactatagaggatatgattcagttggaatagctacttttgacggcagcatccacgtaaaaaaggacaagggaaaaatccctgaagtggatgaaaagctagacttggccgacatgcctggaaactttggaatagctcatgtaagatggccatccactggaattgcaagcaaggagaacgcacatccccaattggatgaatccgacagcattgcagttgttcacaacggatcactgaaaaactatgacgaacttaagggagagcttatagcagatggattcaaattcaaatccacaacagacactgaagtgattcctcatctaatcagaaaatatatgaatgaagggcttgaccttgaacatgcatttagaaagaccatagaaaggcttgacggctcatatgcaattgcagtaatctcaaaagaagaaagcaataagattctagctacaagataccaatcaccattgaagattggaatatcagatgatgcctacttcatatcatcagacataccggcaatcataaactacaccagaaagatcattcttccagctgaaggggaaatggtcatattggatgaagatggagtccatgttcatgatgaggatggcaatgagattgaaaaggagattctagtgattccatggaccgctcaaatggcaagcaaaggagaccacccttactatatgattaaggaaatcctagagcagccagatgctgtggaattcactttaggtgaaagggagaatatccaaagaatcgttgatgaccttggagatattaaaaacatctgctttgtagcatgcggaacctcataccatgcatccttaactggaaaatatctgcttcaacatctggctaagataaaaacagatgtggttcttgcttctgagttcaagtacactgcagacacattagataaggacactttggttgttttcatttcacagtcaggagaaaccttagacagcatgaatgctttaagaattgcaaaggaaacttcaccaacccttgcaatcgtcaacaatataggctcttcaatgacagaggaagccaaatatacaataatcactcaagcaggccctgaaaagggagttgctgcaaccaaaacatatatagcacagcttactgcaatctatctgtttgcaggtcttttggcaaatgatgaaaaattgatcaatgaattgtataatgttccaggttacattagggaagtgttgaaaaaatcatctgaaatcgaggttctatctaaaagatacagctttgcagatgacttattctaccttggaagaggattctcttatcctattgccttagaaggtgcattgaaattaaaggaaatctctcttattcatgcagaaggctatgcatcaggagaattgaagcacggccctttagccttaatcaaccataagattccagtgattgtgattctacctccaggcagtgattatgaggacactatggtaaatctggaggaagttaaggcaagaaaggcaattatcctatcaatatgtgctgaaggagatgcgaaagcagaatgcaaatcaagagatgtctttacagtcaattcaaaagtcagtgagaccattgcacctcttgtctatacagttcctctccaattgttagcttattatgtgactttagaaaaagtagcatga

SEQ ID NO: 1005 - DNA, 3105 bp, Methanobrevibacter ruminantium
atgatagcaaacagccctaaagaaattaaatccagattaattgaaatctataatgaagaattattaaatcttaacatattcattaagaatagagatgaacttaaagggaataaggatttaagatatcttcttttagagagaatcaaggaggaatttgattatttggatgatgaggaactttttattcttttatcattttatcaaaccatcccttcattttatagaaaaacttttaataagattcttgaagcatctattgataaaaattatattgaaattcaagatgaattattgaaacttgttgaaatcattaaagaagaaatatcaaatatagatggggcaattgaagagcaaaatctaaagattgaggaaaaactcctaaagagtttatattctaaagacaatcaaaatggagaaaattcagatattaatcatttgaacgaaggaaaaagcttagatatcaataatctaactgatgaggaaatacttgaactatacaacattagcgatgaggaattttctcaattgcaggactattatgaatgggaaatatttgaaagtgattttctaaatgaagaaatcttagaggattatgatgaatctgcctttctggatatagcctataatcataaggatgcagaggttcgagggtttgctttaggcatggttttaaaaccatatgtttggcttgattttctatttaatgatccagatttatttgttcgaaagtctgctttattttatctttttaaagaaagatatttaaacgatattgaagacattgattatttgggcaaaattcctattgaaatagattttaatttggattatagcgacgcaatcgatgattttaaaatcgatgagtctctttttaataggcatgacaagatcatcattagtgaaatttcaattaaggatgatgatcttattgtaaagacagaccctaaaaactcatatgaacatgctgtaagcaagataagaagtcaagacgccttaaaggcaatcgcaaattatcataatcaatggtctgtacgctatattgctgtaaataagataacagacattgattatttatatgatattgcattaaatggttttaataaggatgcaaagcctagacatggaatattatattatcctggggagattagtgaaggagatgtattgaaatccctattaaatagacttttaagattgaagaacttatctgatgaagattcacaaagcttcctaaaggagcttttttataagtcaaaggatagcataataaaaagatattgcttatcaaagatagaagatgatgtatttttagtgaatttagcaaacactgaagcaaacccaagctttgcaagagtttgcttggatacgattaaggatgaggattacttgattctcctttccattgcaataataacaaaccctaggttcaaaggaaaaaatcaagatttatatgacgggctctgtgagggaggtattggggatgaagatagtttcataagggagtctcaatttgatgaaatagattatcacaatatccgggcctatgcctctaagattcttattgcattgcctagaaaaactctaaatgagactcttgaaagctttagtttaaaattagatattcccaatctaaaggaacatagagtttttaagcctataattaataaaaggattacagatattttaggagatcttgctaaaattgatgaaagtcctttagttcgctctattgcagttttaggtcttgaagataccaatgatttgatgtctattgctttagatgatgaggatgataaagtctcatttaatgctataaaaaagttaaatgatgataatttcattgaatattacttaaaagaaaccaataggaaagcatattatttagttgaaggaaatctagtaaaagaccaatcccttttaaagaaaattgcactaaatgattcatggggacctacacgcagtgaagctgtaagaaacatcaaagatgaggatttattgataggcattgcaaaaaatgaccctgaagcaattgttagaagggaggccgtactaaaaataaaaaatcagtctgctttgattgatattgcatatgaagatgaggatgatttagtaagggattttgcaatctcaaatattgatgatgaggatgttttggaggatttaatctataaaaatgaagattcaaatatattaagaacaatcttgtccaaattggataatgaggaaataattaaggactttgcttataatcatccaagagggattgtaaggaatgcagcaatctcaaatattgatgacaatcgtgttttggtggatattgcaaaaacagatgaagattggacggttcgacgaaatattattgctcgcctagttggaaagttcattaaaagcagtgttgatgtttatgaggataaatatttaaatcatttaaaaagaagggaatattataattctttgattaaaggagataatgagaagtttaaatctgaaaataaggtaaaatctagtgaaaatgagaaaaatgaatatgcagatgcaagttcaatagttctatatgaagatgatgaaccatacacacttcaagatcttttagttgacagggcacttaatgatgaatcagaaaaggttcgtgcatttgttgtttcttatattgatgatgaatatttcttattttacattgtaagcaatgataaaagcatcaaagttcaattatctgccattgatggaataaaaagaaatgagctattggccaaaatatttatcaaaagcaagaatcatcatgtatatagaaaagccatttcccggataagatatgaatatattcttttaaaattggtttgtttgaagaattattatggggagctttggcctaaaaggcaaatggctgaagctagaatggaagaattaggatttaagtctcctttaataaagaaagaggataatagaaaaaataaattcttcaggcctatatttgatataagggattatcaaagagatcttgaacttttagatcgtttggataaggaatataaaaatcgtagtaataattcagatgattctgatggttcttccgatgattttcaatttaaacgaattgttttttaa

SEQ ID NO: 1006 - DNA, 462 bp, Methanobrevibacter ruminantium
atgaaattaatgtttgtttgtactggaaacacttgtagaagtgttatggcagaatatttatttaaaaccatgattagtggagatatagaaatatcctccgcagggattatggcaaaagacggcagttccccttcattgaatactattgatgtctgcaaaaagcatggtttggatgtatctaatcataaggccactaatgttaagaggtcaaatatcaaggatatggatttggtattgactttagaggagtctcatagaaacaccttattgaatatgtatcctaatctttccatctatacaatcaaggaatttaatgatgttgattatgtttatgatatagaagacccttataatcaaagtttggaggtttatgaagccactttcaatgaaatcaaggagtctttagaaaagattgatccagataagcttttaagctatggctttaatgtagaaaaggattaa

SEQ ID NO: 1007 - DNA, 381 bp, Methanobrevibacter ruminantium
atgattatggacaatatgtggattgaagcattaaaaaacaaatatagatttgaattcaagggtctaatcaatgttgaagacttattcgatttaaagttagaggaccttgactacatctataagaatttaaaaagagacgaaaatgacttacaagttgattctctattagatgctaataaaaatcctttaaaaggagaattagactgcaagatcaatattgtaaaaagcattttccaaatgaaagtcgctgagattgaaaaagcaaaaattgctatggctaataaggctcaaaaggaaaagatcttagcaattattgaaaacaaacaagatcaagaattatctgaaaaatctattgaagaattaagaaaaaatctacgatga

SEQ ID NO: 1008 - DNA, 2013 bp, Methanobrevibacter ruminantium
atgcgtgacagattattcaatcattttaatgaaaatatggcaccaagaaaattatttattgtagaccgtgattgggaagaactatggaacatgtatctagacggatttccaagagaaatgaacccaatctatcgtgaaagaagagaactggattgtagtgcatgccgcagcttttttaaaagaatggcaaatgttgtagcacttgatgaagacactggtgattttatttcattatttgctggtgaaaccaatggagaaaaagaagtattccgtgctttagacgaatatgtcaaatccgcaaagattaaggacgtatttatgagcgacactcaaagggtaggaatcgaaagcaatcatgaaatgcttgatagcggaagcgtccatacttggtaccatttctatgtggatgtgccaagtgaatatgttggaaacttaagccagaaggcaatctatagaaataacagaattgtcctagaaaacagtacccaaagaatctctcaagatgctgtagacactgtattagagcttatcgcatctaacagcctatatcgtggagaccaatgggaagacgctttaaaaagttttaaggactacttaaaggaatatgaagcaaacgacatggatgaagatttattctactggattaaaagcattgagcttggatcattacttgttagaatcaaaaaccacagtattggagttcttttaatggacgtaacccaaggagtgccattagatgaagctgtctcaaactatgaaagaattgtagcacctaccaattatcaaagaccaaagccaatcttttctaaaagaatgctagaggacgcacaagagaagatcaatgaattaggttttggagagtcaatctacagacgctatgctaatatggcagacttaagcattaatgatgttctatttgcaaacagggattacaccagtgagattcaagacaatcagaatttctttgacaagctaaaagagctaactgttaacagggctcgtaactttgataaggttcaggagatctcactagaggactttgttgaaagcatccttcctactgctcttgaagttgaactatacctatcatatgacttaagcaataatttcatgtctttaatcgcaccggtcaatagggacgctccatcaatgtttaaatgggacaatcctttcagctgggcttataaaaacaacattgcagacagccttatgaaagagagagtaaaggctttaggtggagacgttgatgtagatttaagatttaccatccaatggaatgacaatgaatgggacaaaaacgatttagacgctcattgtaccactcctgaaggggaggaaatctacttcagccatatgagaagctcaaaaaccggaggatggctggatgttgatatcatcaaccctgaaaagaatgtacctgctgttgaaaacattcaatttaaagacagaaatcagatgattcctggagattacctattccgtgtccatcaatacacctaccgtggtggagatgacggatttaaggcagagattgaatttgacggaaggatctttaacttcatctatccaatgagactgtatcaaaatgaatatgtcgatgttgcaaaagtgagcttaggtgaggatggaaacttcactttaaatagctttttagacaatcaaaccgctagcgctaaagaatggaacttaaactacaacagattcgttccagtaagcctgatttgctacagccctaactactggggagacaatgctgtaggtaataagcatatcttctttatcctaaaggactgtttaaatgacggaagaccaaacccatggtttaacgaatacttagttagcgaattaagggaccatcgtaaggtaactgaagctttagcaactattgcaaaagtggaagagtctgatgagcagctaagcggtattggtttctcattcactcaaaagaataaggtcactttaaaggtcaaatctgaaaacattgaaagagtgtttaatgttgttattggatag

SEQ ID NO: 1009 - DNA, 1185 bp, Methanobrevibacter ruminantium
atgggaactttaccattaggaaacgataatgatttagatgattcacagttttacaatagagcagaagaaatttcatttatttctgagaatttagaattaactaaaaagggatccaccccaacaatactccttacaggcattagaggcgtaggaaaaactgcattgatgaaaaaattaaaaaaagatttccaaaaagatggatatatagttgtttatatggaattatctggaatgaataaatataaaaaagattccctagaccgcttttgttttatgaaattattctatgaatccattataaatgcatacaaggaatcaaatatcttatccataaatacgcaaatcttgaaatacataaaaacccgtaatttcaaaatagacaaaatatcatcatttgaaaaaattccaattccaatcatcacaacggaagaggactattccaaatttgcaggttttgtaatggatttgcctcaaatgatatatgatgattttaaagacgagataaatggagttttaatatttatggatgaatttcaaatcttaaaacaactcgatgaagatgtgaatgggttcttatggtacatcagaagcattattcaatcacaaaaaaacataggttatatattctcaggaagcatgagccttaaagatgatttgattgcagacattgcaggtcaaaaaggtgcctttggcgggagaatattgaattatgaaataaaaagattttcttatgaaacaacaaaaaactatttgaatgaaaaggcagattatcttaattttacagaagagggttttgaaagattttaccattgcaccaaaggcaatctatattatgtaaatagttttgcaagattgctccctccaaatatagaattaaatgaagaaaaggtaaactctgaatttgacaagtccctgccttatttggtaattcatttatcaagcgaatggtataaattaagcaatcaagaacaaagaatcgtcattgccctaatcgaaggaccattaaaaagaattgaaatagcaaataaattacaagtaactagcggtgcaattggcagttccttaaaaacactgcagaataaaatgttgattgaaatggataataataaatatcagatatatgattccattttcaaagcctggctaaaaaaggaatatagggaaaagggagattatcccttttaa

SEQ ID NO: 1010 - DNA, 2196 bp, Methanobrevibacter ruminantium
atgtcaagaagagacaaaatgattgcaaagataaaggaattgatgtacaagccagaatacatcagaaacataggaatatgtgcacatattgatcacggtaaaacaaccttatcagataacttgcttgcaggtgctggattgatctccgaggatttggctggagaggcacttggtatggacactaaaaaggacgaacaggaacgtggaattaccattgacgctgcaaacgcttctatggtacaggaatatgagggagaacaatacctcattaaccttattgacactccaggtcacgttgactttggaggggacgttacccgtgcaatgagggctgtagacggtgccgttgtagtggtatgtgctgtagacggtgttatgcctcagactgaaacagttcttaagcaggctttaagggaaaacgtaaagccagttctattcatcaacaaggtagacaggcttatcaatgaattgaaattaggtccagaagagctattgaagcaacttacaagcattatcgttgaagtcaatgcattaatcaagtcattggcccctaaggataagaaaaatgaatggatggtaaatgtagaggaaggaagtgtagctttcggttctgcattcaagaattgggctatcaacattccaaagatgcaggagacaaaatttacctttaaggacattatagattactgcaatgaaggcaaggaagacgaattgaagcagctcttgccattgactgaagtcctgttgaatatggtagttaaacacttgccttcacctaatgtggctcaagtctacagggttcctaagatttgggatggcgatattgagtctgaagttggccagaccatgataaagatgtctccagatggtcctttagccggaatgattaccaatgtggctgtagataagcatgcgggaatcgttgcaacatgcagaatctatggaggaaccttggagaagtctagcgaaatatatctggtaggttcccacggcaaggcaagagtccagcaggctggaatctttatgggtgctgaaaccatcgatacaggtaaggttccagttggaaacattgcttacttgacaggtgtaaagggagcaagcgcaggtgagaccatctgttctgcagattgtatcatcgatgagtttgagcctatcgaccacatttcagagcctgtagttactgtagctgtagaggctaaaaacaccaaggatcttcctaaattgattgaggtcttaagacaggtctctaaggaagaccctacaatcaaggtggaaatcaatgagaccactggagagcaattgatttcaggtatgggagagcttcacttggaagttgtaacaaacagaataattaatgacaagaaattggaaattcttgtttcagagcctatcatcgtatacaaggaaagcgtattaggtcattctccagtcattgaaggtaaatcacctaacaagcataacaggttctatattgacgttcagcctttagacaagcctctttatgatgccttgattgaaggagacttgaaggaaggcagaattaaaaccaaggaaactgctcaagacttcattgagcttggaatggataaggaagaggcaagaagggtatgggatgtctacaacaggtccatgtttatcaatatgaccagaggtatccaatacttggatgaagtaaaggagctattgcttgaaggttttgaagcagccttaaaggacggtcctttggcaaatgaggaagctgtaggattgaagttcatcctctcagacgctaagcttcacgaggatgcagttcacagaggtccggctcaagttcttcctgctatcaagaaagcgatttacgcttcaataatgtctgcaaacccatgtctattggagcctattcaaaaggttttcatttcagctccattagagtatatgggcaattgtaataaggacattcaaaacagaagaggtagaatcattggtcaggagacaaaaggagtcattgcagagatggactttgaagttcctattgcaaagatgttcggatttgcaggagacataagatctgcaacaggaggtaaaggtgacttctcaacagaaatgaaaggatttgaaaccttgccaatctatctccaggatgatattgtaagacaaatccgtacaagaaagggtctttcaccagagccttatggtccagaacactattctgcatag

SEQ ID NO: 1011 - DNA, 1986 bp, Methanobrevibacter ruminantium
atgactattcctgtaatgtatgatttggatgaggaacgtttaagagccttaaataaagatgaaaagaaggaagataggcttttttcaatcagccttctaaatcctttttatcctcttgactctttagtaactgatgaagaggaggatttagacattcgcatagctgctttagactgtcttgatctatttggagtcacattataccatattgatattgacagcgttccaaaggagcttgctttagctgttatagaaatgcttgacgatgggtctaagctaaaagaaatagctttaaaccataatgatattgattatcgtattaaagcattggaaaacaaacatctaactgatgaagatgccttaaaatacataattgaaaatgaatcagcccccaaattgcgctctcttgcagcttgtcacccttgcttaaatgacagcaaatttttagaaggccttgcattgaatgatgatgatgaagatgtccgtgccgctgcagtttctaactattctacaaagggtgtggatgttttaaagaaagtcattagtgatgatgaggatattgttcgcattcctgctttaaagaacttggtttttaaatataatcttttcaatccttccttaaataagaaatttaactttaaaaagaaatttcatgacatgtcttggcatatgattagctctatcgatgattatgtccctaaggaaatggataatgatgagggaataagggatctgattgactttgagctattggatcagatttatatttcttcagctaatgaatgctataatgaattgatagataagcttaaaatcttttttgaaaaggccctttaccattatgagattcataatccatttgatgagagtaaattagagaatgattcctataggaaaaaaatgtatgacaagctaaagcttgcagaaggtgaccaaaggagcttttatctctatcaaatggcatatgatggaggacatgcttatttgaacttttatttggactatctaaatggtttggattatgattcttatttgggagattctgatagttctaatgaagattcggatttaaaaaaactgtttaatgagtctaatgattcctactctttagataaggagattgaagagtcttacttcattgatttggcatatgccgattccaattgtgaaatggttagattggctattgaagcaatatctgacaattctgtattgtttgactttgcaaagaatggaaaaacaagtgatattcgaaaaactgcaatcaaaagattgactgattcagcatatctactagatttagctgtcaatcaaatcgataaggatattagggaagctaatttctatgatgatgattggatatgcgattatatctctgataattcaaatgattactttgatatctttaatacttatgacttttacagtcatgacctagagcattacgagcgtctatttgacaataggctggattccttttattatgaaaaggtagcttggaactattatagaaacaccatttcattttgtcttcttgaaaggatagacaactatctggatttggtttatgctataaaaaacactcgaagctttgttttaagggacttggtgatttataagattgaaaatccattgtttctaacagatattgcattaaatgcaatcgatgaacgcattcgctatactgcattcggcagaatagagtcaaaggcattcttaaagtatgtctatttgaacagcaatgattttagaataaaattattatatctttctaaaacaactgataatgctattctggaagaggccttcctaaatgaggaaaatgatgtattaaggaagtacgttttggataattccaattttaaaatcagtccaaaggtgattgagcactgtattaatgaagagtctgttatttccgattatgcagagaataagtttgcagagcagtttgttaattacaggctgatggataagaaatttttatag

SEQ ID NO: 1012 - DNA, 372 bp, Methanobrevibacter ruminantium
atgggatttataatgattattaataaactatttaatatgaatgaagataatgaaatttatttagtaattatacttgtattagctcctttaatcttttctatcattgattttacaagctgtttagtagatcatggagtaataacatggtttaactgctatacatttaagacatatatttgttttattccaatattgcttatttgttctattatagccaaagtgatttggagagagaaaagccttaaagatgtccttgagatagcatttgctcctttgtttttctggctaattgaaataggatttgcattgtttgtcagtttattcattggagtatttattgatatgattatagggatagaagctatggtttga

SEQ ID NO: 1013 - DNA, 477 bp, Methanobrevibacter ruminantium
atggctaattggtgtgaaaacaaattaacagtaaaaggaacaagtgaagaattagtaaaacttatagaagaacatgtaattgatggagaattgtcctataagacatttgcaacagaacatagattattcggtgaaaatcattttgaccttgatgagatcttaaatgaaagaataagcgaaatagtcttttggttttcaacaaaatggtcacctgtccctgcagagaaagtttgtgaagagataaatcagacttatcccacccttaaggcagaattatcattcttttcagcagaaagcggattttggggacaatatagcgactatggcggtgaggagtattatgaactaaaagaagaggatattgaaaaaacaagtgaggaattttttaaatttggacttgaagaaggctttttagaaaaaacagaaagtggaaaatacgccttcacccatgatgtccctacttttagattattatga

SEQ ID NO: 1014 - DNA, 4764 bp, Methanobrevibacter ruminantium
gtgagccttatggaatggaaatatgcaactatatttataagcagcagtttcatagacatgcatgcagaaagggactaccttatcaaaaaggtcttcccagagctagaggagtggtgcgaagagcacaagatacacttatcaaacattgacttaagatggggagttccagaagaaatctccaacaacaaaagcacaatcgaaaagtgcctaatcaatattgacgaaagccgtccattcttcttatgtttcctcgctcaaaggaggggatggattccagatttcgctgaagacatcagcgatgacactttcaaaagatatgaggagattgcagcctatagcggtctttcagccactgaaatggaaattgagcatgcattgctttcaccgttaaaagactttttaaatgatgacgatgagcttccagagaatctacgtacaagacattccctattcttcataagggacaagtcctcattggatgaaatcacagacgctcaaaagagggtatatacaaattacggtttggtagatgctgaacatggagagtttatccctggagaatatgacagcgaaggcaattgcataagggaacctaagataatagatgacttgtccttaaaaaccaaggaaatcatcgaagatgccgacaattcctctcaaaagattgttgatagaataatcaaaatgaaaggggactgtgatcttccagaggatgaaaagaaggttcacattgaaataacaaagtacactggggattggaacaggaacttgaagattccagaaattgaggctctcaccaataaggataaggacgatccagagaaaaaggtccgccgttacaatgactatgaatggatgggcaggctaagtaattttaaagaggttaaagaggattataaggatataagtctaatcaagaaatctgaaaatatagaatctaaaatcggcaggccacttaaggatgtcataatcgaacagatgaagagacagttggaattggaattcccagaaaactttaaggaggatgaggacctaaccgaagaggaaagaatcctccagaatgagttgaatcaacaggataactttgcatatcttaacagccaaggctatattccaatcaaaaaggacacagacatattaagcaaatacattgaagacgccgatgaaagcaggatatgtcttgtatcctctgaggcaggtttcggtaagactatgcttcttgcaaacttggccattcaacttgagaagaaatatacaaataaatatgatgagacaaggccaaaccaaaaggctatctataagagattctgtggagcttccaatttaagttcaaaggcattctctctatgggatacaatcattcaagaagcaggtttgacagaggatgatgatttcaagattccaaagaatttggatgagctaaagaaatccatagataagattcttgataaaatttcccagaagggagagtctgtaatcataatcgatgcagtcaatcagatgcctgacggcttagagatgctaaaatggctccctgcacctgaatcatctaatctaaagataataatatcatgtaaggaagataatgaagataaggaactatgcctcgaaagcttaaaattcataaaggatagaaatgcaatctgcccttactttgaggacggtcatgaggatgagcttggaggagaatataagaactatagctttgagcttaaggccttggaggattgtaagaacgaaaagactaagataatcaatgcatatcttaaaaactacttgaaggagctttctaataaggatattgaaaccatatgtagtttcgatgcatctaaaaaccctcttttcctaaaggtattgttggccgagcttagggtatttgcctcatttgaaaagctaagggatgagattcaagagtttattaaggatgagtttgcagatgaatctaaattgacttctgaagattcttctaatcattctgatgattctgaaggctctaaaaagcaatctcaaggttctccaaagacagcattcaaccatgttttggaaagattggagcatgacgaggaccttgttgaaggtgaagctcttgttcctttaatctttgcactgcttgcaaatgcaagggtgggattgtccagggatgaaatggcttccataataaaggccgcaaagcctgatttggatgatgaatacatcagagatacaataaaccttaacctaaggcaagtgaagccattcatggcaagaaaggaaggaagggacgacttcttctatgaaagcttcaaactagctgcacaagaaaggtatgctcctaaaaacattccaaagaatgagcgtttgaatgaatactttaaggataaggaagattctgataagttaatcaatgtcaatgccttgcttgcagattatttcttaaaagatgctttaggtcaagattcggcggattctaatgataaaaccctagacttaagtactatagatggtttcaactttaaaggggaaaatatccgctcatataatgagcttccataccatgcaaacgagtcaagagactttgacagattgaaagatatattgtcttcatactcattcattaaaaacaagatcaatctaagcgacatcaacaatcttattgttgattatcagttcaaggactttgaagatgcccaacatccattcataaaggatgaggaggaccattcaatagtcctgataggtcgggcattggaactctctgctcctatcctctctgatgataagtctgagcttcctgcccaattatatggaaggatggttgacttaagggatgatgaagtgataagtccacttatagatgaaattgaggctgattatgagatggtcttaaagccaaaatccaattccctttactctccaaagagctcaatcataaaaaggccaaaggtgaatggaacaaaatccacatcaagcattgaaataaccgatgataaattgcttatctctgcaaatgaggatggaacattaaacctctttgaccttgaaagcaatgacttggagattcttgaagagcctcatgattctaaggtaatcagaataataccaacagatgaaggccaaaatatgctgatggcatcaagcaatggccaaatcaataaatgggacataaacaatcgttcaatcttcaaggatgacgataacatttatccaaaaataaatgccaatatcacagacatctatctctctggaacatataataagatttatgcatcttcccatgagggaatattcacaatagacctggatacaaaagagctatgtgaagaaaaagagatagagcataagaaatataatcaaatccttgttccaagaagaaacgaggcaatccttgtctgtgacgagaaggaggttgacggctgggatgtctatgaaaagagaaaggcatataacaggcagcatcagcaaaatcctgcaggagaggaaagctccacccaattggattcatcagaggaaataaggtttatgggacttaataagagattccttaccttgatttctgaaaacggacagatgaagttctggaacacccttaaaaactctggcggtggagaaagcattgatgaggcacaggtatgcagccctcacgacaagttcgcccaagctatcacattagagaaggaggaccagataataaccatttcagatatgggagtgctaagggtctggaacattccaaggccaaggcagcctaagtttgaaatagctaaaatcgaaggctcagacattcctatggacattcagacaggtattaagtcacctacagctattgactatttcactgatggtgatgagagatgggtcattgtagctaatgagaacaatgacataagcgtaatcgacctgaataagaaagtggaagccaataaggaaactaaacatagtgagtctgtattgtcaataaaaatagatggaaatcatatgattacagcttcagataatggtgaaatatttgcttgggatttaaataaggaagaatgcattaataaatttgcaagtgaattcagagtcaattctatttcatatgatagggacaagtcacaattgctcttatcaggtgtaaagaaggagaaagacggcaataagatatataagatagctagccgtgacgctacagatatgtgggagcctattaaggtccaagatgatggaagcgattctaaaaagtccaaaaagcttattgacttaaatgctgatgatagggacaatcctaatcctgtcattgatattgctcaaatcagtgatggaatggtattcattgaagagaaaaagatttccatgcctgattatgaggcaggctttgataaaaaggctacaagcttagctactcaattcgactccaatctagcatttgtaggatttgaagacggaagcattagttcatatccaagagaaacagaatttgatgcaggaatcaattctccagttgttaaaattagagtaagtggcgatagattagtcgcaggatttaaggatggatctgttgtgatatttgacttaagcggtacaaaaacagcaagctttaaggctcatgataaggccataacaaatatctatcttgatgagtccagattaatcactatttcagaagacaagacattaaaattctggaagaatgatgagtgcacttatacttacttcttagacatatttgcaacatctgtcagtgttaatgatggcaaattgattcttggtgacactttaggtaatttaaggttctttgaattgtag

SEQ ID NO: 1015 - DNA, 2286 bp, Methanobrevibacter ruminantium
atgatgagacaaattagacgaaatacaattgattttgcaattgatctaggaacaagcgactctgtaatagcttgttttaacggtcaagagtctgagattataaaaaatcactctacaggtgaggaccatactccatctgctgtttatatagacagtttaggtgaaatccacgttggcaggattgcaaaggaagctgtcttaaaatgtccttctaatgccacaagtgaatttaagctcaatatgggctttccaattccatttttatttgaaagctcacagattaagatgtatccagagcaactgtctgcggaacttctaaaggatttaagaaaatccatctatcaccaaacaaaccaaaacattgaagagattgtgataacagttcctgccaattcaaatccccttaagacaaaggcaactaaagaggctgcagagctagctggattcaaatcagtttatcttattttagagcctgttgcagcagccatcgcctatggattaagggcaaaaaaagaggatactggtatttggatgatctatgatttagggggaggaacatttgatgtgtcccttgttaaggcaaatgggcaggagatagagaagcttgcaacaagcggtgaagacaatttaggtggaaagctctttgattggaagattgtagatgactatttcactccaaagatcattgatgacttgaatctgactgactttagaagggacaatcctaattatcttaaggtattttcaatacttaaaaatgaagctgagaaggctaaaatagctttatctggttctgataatgacattaaagattatgaactttctattgaaaagcttatcgaaataggggacaaatcatatgactttaattatatattaggcaaagaagatttaatgaatataatgaagccatttttaaaaatcacctttaatcattgctatgaggtattggaagaaagcaatctttctattgatgatgttgaaaagatcattcttgttggaggttccacattaagctcaattttaagggacagcctaaaagatgaattcgataggccattggaatatggaattaatcctttgactgtcgttgcacaaggtgcttccatttatgctggaaccatagaaaaacaatttattgaatgtgaaaatcacagatttgctttaattttggattatgaaaagataggttttaaggataatattgatattaacggaaaggtctttgcattggacgagaaatattcatttttggattattcaattgagattacaggctccaatggagaaatcatttatattgaggactctaaaactggaaatcctactgaaaggattgatttagatatagatggcaatttcagacttaatctgaatgtaaaagatagctataatgagtttttaatcaatatctatgacggcaatggggatcttgttgaacttgatgaaaattctccaaattcaattcattataagaaagccttaaatccaggttatcctattttatcttcctcaatcagtctttatcttgatgaggattcttcattgatattaaagaattcagaggacttgattgatcttgacacagaaaatgactttataattgaatattctaaaaggttcaactcttcctatcctattgcatctaagggggatataatcccaatgagcagaaaagagattctacacaccagtaaaataatcaaaaaaggagatggtgacagcttcattaaattttcattctattttggagagcttattctagccaattataataccttattgggacagatagtcatcacaggcaatgatattattgatgatttgcctaaggatagcgagatagaattgaatataaatataaacgagtctaatatgattgattttgaagtatttattccttatttaaggcaaagctttaataattcatttagcttcaataattacaataattataatggttttattgataattatgataatttaaagagcaagcatgatgagattataaaaaaatacaataaaattagggattttgctcgtgatgaagataaaaaagagctttttttaaaaaatggcatttatcaaagcatagagagagtctatgagaatattgaagagatagaggaaaaggagataattgattatcttgatatattggttgatatggctaggtatgataagatagctgtttatccatctttagagtatttgaactatttggatgatgttttagatgaatgcaagttctttttgaccattgcagatgtggagctttctatttaa

SEQ ID NO: 1016 - DNA, 1659 bp, Methanobrevibacter ruminantium
gtggttctcttgaattataatcaaacaaaagacatgatagaagattatttccatggccaatatgaggtcttaaagtttttaggggaaggatcattcgctcaagttttcctcgtaaagcaaaacttcctaaacgataaaagagccatgaaaataatcaaagaaccactttcaaataccaaaaatatcgaccatatctttcacgaagtgcaaatagcaagccaactccaccatgagaatatattggatatatatgatgccggacttatcggagatattgcatactttgttttggagtatgtttccggcggagaccttgaggactataggacttcatatcttaaggccaacaggccaattccaatccatatttccttggatataatcaagcaaatccttatggggctaggcacccttcactcttcaaatcctatcatcatccatagggacctaaagacaaagaatatccttatgaattatggtgatgaaaggctgattgttaagatatccgattttggctttgcaagggagctcagttcaaatgcagatgattttgaggtaggtggaaccaagccatatatggctcctgaatgctttaatggagtgttttcaacaagaagcgatgtatatgctgttggagttatattctatcttcttctagcaggtgaatttccttataggctttctgattatgtcattggtgatatagttgatggaaagccatggaagattgatttgaagcctcctagccattttaatcaaaacgttcctaagtttgttgacaagcttgtattgaaggcattggatgtcaatccaaacaaaaggcatattgatgcaaaggactttgaaaatgatttggataaggcaattgaaaaatttaaggaatattcttattataaggagtatttgaatgagcttaaaggacttgaagaactggatgaattagataatttaggaaaattgggagaattaggtgaatttggcgaattaaaggaattggaagaatcttctaggattgctgaattaaaggaatcttctaaattaggggaatctaataaggattctaaagaccaagaccatatcctaaatgacaatattctagaggcattcagattggctaaaacagaggatggattggatgaggcaagttccattcttgaaaaggaagtcttgaaggattatgaaattagaaaaacctatggaaaaactcttaggttatggaaaggggattatcccgatgccaaactaatttcagaggctttcacagttacacttaaaggagaaaattataaattggctattgatcttttaagagaagcctttgcatataatcctatattgaaggacacttacggttactacatagatttatggagtatttttatagatttaaataaaaataaggattttattatatctattaatcgattagagaatcttatggatagaaatgataagataagggatatttataaggattcaatagacacactaaaaagctatgatgaggataggattttgaatgaggcaattgatttggctgataggggtaatttgatagatgcttctaagttattggagctattggtagtttatgatgatgaaataagaaaggattatgcttataaattgtccttgtggaaacaggacttgagtatgtga

SEQ ID NO: 1017 - DNA, 1146 bp, Methanobrevibacter ruminantium
atgaagaaaaagttagaatatatacaaactgaaaaaataaaaaacaagaactatgaattttatcgcaacatagaaaataacaaaacagtgatttttagaaaaacaaagtttggaaaaagagagaaagtcaatatcatagattcagatgacttgacagagcagataattaatttatcatacaataaatcttctagaaataaaaaaattcaattcccttatgataaaatctgcaaatttgtttttaaaaacaattttcaagcatgcaatatagtatttaaactaggtatagactttaattattttttagatactgaagtgatcaatcagatttttgaatctacaagatcagacatagtcatttgtgcaaaggaagaaataatatatataatagaattccaaaaggataagcttaaaaagaaagataaaattcggtttggaaattatcagaccaatcttcataattattatcacggccgaaaagtaattgtttttgttattagttttgaccctaatgaagaattgggagacattccctatggatatgataaggaatatgggtttactatgcatgtcaaatcgtttaacgagcttgatgcggaagaaactataaatatcataaataaaagaattagaactagggctaaaataaattttattgatattgttttattgcattttctaccatttatgaagtctcataggtcccaagaagaactattaaggatagctgtggatttgacaaaccaaataaggaccttaaacgaagataagatcttggagttaaaaattacacaaactgtacttgcacaagaaattttaagtgaagaagaatttgaggaattattcaaggtgataaaaatggaagacactggattagttgaagaagttagacagctctattgggaacataaaataagaaatgacatgaatgagctaaatcaaatgagaaacgaactcaacgaaagaagcaaccaactcaacgaaagaagcaaccaactcaacgaaagaagcaacgaactcaaagaagaaggaaaaatagaagttgcaattaatttactaaaactaaaacaaccatttgatttaattgcaaaagctactgaactaagcgaaagcaccatcagaagccttcaaaagacaatattataa

SEQ ID NO: 1018 - DNA, 804 bp, Methanobrevibacter ruminantium
atgagcgaagaggaaattgactatacagaatttatagactttgaggattccaatctgatttcatttaagctggcagcaatcaacaacaaggtcagattttccatactcgaaatattaagggattttcaaaagctcaacatgaataaggacaagacattcaaaaaagacccttattactctcgcgaacttaatgagattcttttaaagaaatatgatattaatatttcccttcagatgttaggccagcatatgaagcagcttttgacagctggcttgattgaagaggttcctctaaagaaagaggttcctaataagataggtgccagaaacgtcaagggatatatcctaaagcctgatgcctttgaagagctgtttcttgaaatcaacttcctctcagatgagctcttaagtttctttgacttatataagataaaccaaaagttccatgatgaggactactgcatattgaccatattcaatggagcagataagggcaagacatttaaggtccataaggatgatacagtccttattggaagaaaagcagatttctcaaaaggagatcttgcctcatttgcaatacttttagacaatagctatactgcagtgagcaatgtaggcaaacctcatctaaagttattctataaggatgacagttggtgcatattggatgaaggaagtacaaacggtacttttatcggacaaaatgaagttgccactggcagaataactcctttaaagaagaattcatttttaaaattatccagaggtgaaggaggagcagttatttactgttctttctaa

SEQ ID NO: 1019 - DNA, 771 bp, Methanobrevibacter ruminantium
ttgaatattaggccctcatattcatatgcaagtatcttaaatgtctttatagaagaaaaatacaaagataatctagggtgctttcgaaacactaatttttatgatgtattagatttccaatcagatgattcttctttttactatgatatggcttttttcagcttctattatggggactataagtcatcattctttctaagccaaaaggccatgattttaggtcatgatgagggggacttgaaattattgcgtcttgcagctttcaatgaattgtctccaatcaaaaaactattatttgacagtataaaagaagagttctctaatattatcaaggaagacgatgaggaactgttcttattttatcttgaggacatgcattatttggagattgccttaaatcaaaaggacattaatgttgaagaggactttctaaatcttatttcaaatttatatattcaagtgaaatatatggattatgtggattattatgcaatgatcaatctatatcagttcttttatataaataagttttatagcgaggcattgcttcttataaatgagattctagctcgcaatctaaacgtatttaatttaaatagaaagttagatgtattgtttaatataaatgacattcctggagcatatgacgtctatcaggatataaggctattggatcctaattattttgattcatctccaaatagggaagagatgtatctggaagtgtttaccgaacatttctttaaaaatagtttgggtaagttagaataa

SEQ ID NO: 1020 - DNA, 717 bp, Methanobrevibacter ruminantium
atgactaatttagaattaaatatcctggatttaagcttaaatgaacttttaagaactgtaaataaaacagaatcaattcttaaagaccaatatgatgaaataaaggaattcagagacattatcttaactgctagaaatttacgctttgataatggaaatgatgcaaccatctttttagcaggttctggcaggtctggttttgtagctaagttctttgctatgagattgatgcatttaggctttcatgtatatgtttttggcgaaactttagttcctcctgttcatgatggagatataatcttattcatatcaaaatcaggtggagagaatgctgtaaccgattcaatcgaatccaccaagcttgaaaacattaaaaagtccaagagttccccttcaaaaaacaatatgatctttgagaatgtaaagattctatcagtttgcggaagctttgactgttacttggctagccactctgatgctaagattgtcattgaagcagaaagggatagaaaatccaccaaagaagagtctgaaagatttgattcattaggatttaactctaatgagcttgtaatcatgggaactggatttgaagactctgcattattgattcttgacgctttagttgtagagatgatgaacaatctaggtctttgcgaagaggacttggaaaacaatcatgagaatattaataggcctaaagtgtctaaaaaataa

SEQ ID NO: 1021 - DNA, 1113 bp, Methanobrevibacter ruminantium
atgtttgaattaagtggaaagtacaatacagctaaagtctttgcagacaatatagacaatgacagcgtatctcaaataattcaatttctcaatcagcctatagctaaggaccaatccatccgaatgatgccagatgtccatgcaggaagcaattgtgtaatcggaaccacaatgacaatcacagacaaggcagttccaaaccttgtaggctcagacattggctgcggtatggaaacagtctatcttgacacagatgaaatagatttcaatcgctttgatgagatagtccgcaaatacgtccctcatggctatgacattagggaaaatcctcatccatacataaagaaactaagactcactgaaatgagatgctatttcgatcttgaagcaggaagccaaggcaatttttccttaggaacccttggaggaggaaatcacttcattgaagttggaaaggacaaagaggaaaacttagtccttgtcgtccacacaggaagtagaagaatcggtgcagacgtatgcgaatactatcaaaaccaggcattgaagagctttaaaagaatgcataagactgcaacaaacaaggaactcatatactgtgaaggccaattgtttgaggactatatccatgacatgaagataatgcaggaatttgcaagctggaacaggaaggcaatcatcgaaaccattctcagccattatggaatggactatacagacagctttacaacaattcacaattacatagacacagaccataatcaaatgatcttgcgaaaaggagcggtttcagcttacaaaggagaaaagctattgattccaattaatatgagagaaggttccttaatctgtaagggaaaagggaataaggattggaattgctctgctccacatggtgcgggaaggctgatgagcagaagagaggcaaaggacaagatctctttaaaagaatatgaaaatgcaatgaaaggaatttttacaaattcagtaaacagaggaaccattgatgagtctccaatggcttataagccaattgaagccattgtaaacaatattcaagacactgttgaaattattgatattattaagcctgtttataactttaaggcttaa

SEQ ID NO: 1022 - DNA, 1761 bp, Methanobrevibacter ruminantium
atgatgggggattatatgaatacggattatcttaaggaatttgaagagttgaatcacactacagaaagcctatttgatttgggaatctctgggcttttaatcattttaaaggacggaacaaatctgaccagctggagtgagctaagcaatcctgatgatatcttatatctaagtgcagacttccggtgtaaggaaaattacactgaatttagtaattttaaaaatgcaaaggtgcttatcctacagaattatgtccgccccaattttggagtgggcagcttgtttttcaaagaggcagatctaattactaaactgtctacttggcattcattggtggctttctatggaataaactgggacatctccagcactgattctttaaagaatatgtttgccaattgcctttcattggaatatgcatattttgaggattgggacacttcccatattcgtaacttttggggaatgtttgttgcctgctgcagcttaaaggccatagatggaatggagaattgggacttgagctctgcagagaatatggaatccatgtttgagtcctgcatgtccttggaagacatttcattcctatctgactgggacatgtccaatgtggaaaacatctttgaaatgtttagggattgctatagcctaaaggatgcaagctgcttgaattggaaatttaagaatctaaaaaatggtgacaatctatttgccaactgcagaaagcttgaaagctttccaagctggtatgatgatgagttcatcaatcaattcggcatcagaaatcagctaaaccttattgatgacgattcatttttctataagattgcagggggattcgacccccaggacattttcatagcagtaggatatatcagggatgaagaatgcctgaaaagattgcttagagattcctctgtccatttttatgcaagaagggccgctcttttaaatccaaacttaaatgacacagagattttagaggaatttgcagatagcaaggattatgtggaaagggcctatgcaattgaaaatcctaatttcaccaatattggaatcataagaaggcttgccaataatgataaaagtcatttggtccgcttcaaggcagagaataagttaaaagagcttaaaagtgaaggacttgaaataatagaggattatcctagagagttcaagcaagcctttgaaggtcatgacagagaaagggcatctctagtcttatcccaatggagaggatatgattccacagatgctaattttattctggccaaggttatttcagactcttcagatgaggaaatagaattcagcgaaacctttgaagcctatattatatcaatggaggaaaaaccacaagacccatcattatttaattggtttagttccacagctgtagaatgtatggaaaaaagggtggatgaggatattggattctcccagttgtttaacaatatgtataagtcacatatgaactcaactgattatgcaacggcctttttagactttttccaagatattcttgaaaatgatcgcgtcgaaaagttgaatctgcttaggggtctagttgattcttgggatactgactgtcctgatgacgccaatatgcactgcgcttatgttattttaaatataaaaaagatttctaaagatgaattggaggatagaatagcgaaggctaaagtttgcattccagaaaatttgaattcatatcctaaactgatggcctttatgaatgcagtattggaggcagataaatag

SEQ ID NO: 1023 - DNA, 945 bp, Methanobrevibacter ruminantium
atggaacttgaagaaagaattgaagaagctttagaatatattcaaaatgatagcaattatgcattggaacttttcaatgggattctaaaggaagacccccataatataaatgctctcaatggcaaagggtcagcccttatgaagctgcatagaaaccaagaggctctagatgcatttaatgactcattatccgttgaagaaaatccttctgcatatctcaataaagggatcatactgaaaatcaatggagactataggaatgcattgaaatcctttgatagggcattgaactataatccccgattggcttccattgtgagtctgctcaaaaacgaaatactggaaatctttgagaaggaatctacggatataagtttgctatatgatttcaatgaaagctgtacagcactgattaaaaaagcttatggctataaaaaccaaggccttctctgggatgctctagactgcttggaggaagccgttaaacaagatccaaaatctgaaaattccataaatgacatcattaaaaaacttattttaaccatcaagaaagaattcttatacaaagaaataaattccaaaagcaccaaaatcgacaaattgaaatttcaaacaattaaaagcataattgttgaagacaatccccataaaacattactgcttacaaataagatatttgaaataaatgaaaatgatttagatgccttaaactatcagggcattgcctattttagcttgggagaatatattaaatcgatagaatcatttgataaatgcttatccattaatcccaattatacttactgctcatttaataaaggactcgttttaagaagaatgggactcttaaacgagtctttagactgttttaataaagtgatgaatgaatctgattttttaaataaggttaagccatttcaagaagaggttttaactaagatatag

SEQ ID NO: 1024 - DNA, 603 bp, Methanobrevibacter ruminantium
atgaaaacaatagcaaagcctttccagaattcaatagacataaagaaatctcaattcatctgtcgcctttttcctgcacagactgaaaaagaggctaaagatattataaaagagatatctgaagagtataaggatgccacacataactgcactgcttatgttgtaagcgatggggaaggctatgatgataatggagagcctggaggaactgcaggaaggcctatgctgaatgtcctaaagaaaaatgagataaataatgtggttgccattgtcacaagatatttcggtggaatcaagctaggagcaggagggcttgtgagagcatatagcaaatctgttcttgaatgcttggcaattgctgagatagttgaaatggaactttatgaactctttaggttcacttttgaatatcaggacattaaggcaattgatgctgaggttagggccaagaatttggctgtaattgaaaagcagtatgaagcacaggtcatttattttgttgcaacagataatgttggcattgttaaaagcgttcaagataaattggctaaacaggtaaaaatagagcatctaggcagcagatacttggaaaaaatagtttaa

SEQ ID NO: 1025 - DNA, 3513 bp, Methanobrevibacter ruminantium
atgatagttttaaacaaaagaaagaaatcttgggaaatatatcctattggaagtcctaaaggagctcttaatacaaaaaggcaggctgagtttgtaggcattctccgctttatggaaggggaggacggattatcaatcaagcgttttctaattaaaagcgataaggaagaaaagcctcttgctccttctaaggcgatcaatttattaagatctcaagctgttttcttggcacaaaaagatgatgaaatggaggcattccttgaaaagaacaatgtcaaggtcagatttacaaacatctgtcagcattgtagttatgaaggatatgtgaccattataaactcagatttttcatataactatcatgatcagctcatctgcaaatcctgtgccgaagagacaatcaagagagagcttcagcttaggggatatgacaagaaggtatttagaaacttcaagaaggtccttgaaaagactggcagcttggatgatgttttagagatgctttcaccaagatttgaccctctcgcccatacagacttgactttatttgacaccataaaggttcatgaggataagatacctaaaatcgcaatgaagcgtcttaaggttccaaaggaatttagggatgttctcctcaaggataaccaatatctcctgccggttcaataccttgcaattagggaaggcctccttaaggatgagaatctcttggttgtttcagctaccggaagcggaaagacattggttggagagcttgcaggggttccaaaggcattgaatggtaagaaattcctctttctgacccctcttgttgcacttgcaaatcaaaagtacagagacttcaagaagagatatgagccacttggccttaaggttgcaatcaaagtggggatgaacagaatcaaagcaaagggagagcttaagcttccagattcaaatattgccgatgcggacattgtggttggaacatatgagggtattgattttctacttagatcaggcaaatcagacctcttgaatgatttaggccttgttttaatagacgagattcatacaatctccgatgaggagagaggtctcagactcaacggacttataaaaagaatcgagcatctctttccaaacacccaagtgattggcctctctgcaactataaaaaatccaaagactttggcacaggactttaacatgaaactggtccagtataaggagcgcccagttcctttagagagacatatcgtttttgttaatggagatgttcaaagaagactgttaatgagaaaattagttcaaagggagttttactcaacatcctcaaagggattcagcggacagacattgatatttaccaattcaagaagaaaaacccataagatagctaatttcctatctggtaagggaataaacgcctccgcttatcatgccggactatcctactttaaaaaggaaaagatagaaaaggacttttcaaagggaaagattgcagcggtggtcaccactgcagctctagctgcaggagtggatttcccggcatcccaagtaatatttgagtcccttttaatgggaaacaaatggatttctccaaatgagttttcacagatgttaggaagagcaggaaggcctagctatcatgacaggggaatcatatatcttgttccagagattggaagtgaattcgacggtgaaagtgaggagtccgtagccctagatcttttagaaagtgatgtggagaatatcattgttgattatacagaagacggatcacttgagcagatacttgcagacatctcatcaaggtctttaactaaagtgagggatgtaatcaatttctataaggatattccagttccaattgatataaatactgcccttgaagaattaagggataaaaaagcgatagagatacatgcagatgatactattgatgtaactcggtttggaaaagcggtggctatgtcattcttgtcaattgatgatggggtaatcattaaggattccattaatgataagaattatttaagccagtattacagcaagccattctttaagaccaatcttagggagcttagaaggttgtccgataggattgatgaggagaatgaggagattcttaatagaaataggaagatacaacataagttggatcagttaaagaagaacgaatctcaaaagaaagaggataaggataaggaagataagactgataagaagaataagaagtctaaaaagaataaatctaagaagtctaaggattctaagaaggataaaggtaaagataattctaagaagtccaagaaatctgaggattctaagaaagataagaaaaataaaaataattctaataaatctaaaaaagataaatctgagaataagaataaatctaataaatctaataaatctaaaaaagataaatctgagaataagaataaatctaataaatctaataaatctaaaaaagataaatctgaaaataagaataaatctaataaatctaataaaaagaacagttctaataaggaatttaaggattctaaaaaagataaaaagtctaagaattctaaagacaataaatctgagagttctaaaaaggataaaaaatccaataaatctaataaatataataaatataataaatctaataaatataataaatctaagaaatctaataaaaataataagaattcaagttcaaagaacaaaaatgataattctaaagattctaataaagataaaactaatcataaagagtctaaatcagaatctaatcaatctaaaaacttagaaaaagacagccatcctatctctaaggactataagaattcaaatgcatctgtctctgatgatttaaaggactattctaaaaaagtaatgtataataaaagaatcaacatgtctaaaaagcagcataaaaccatagaagataagcctattcttgtaaacaagcttaactttaaggaaaatatatttagcgagatcaatccaagaatgtctaaaaaggaagtgaacgctaacaatcttcttaaggtccagtccatagcccttgacttggaattgtttgaaaatgcatatcttgctcctgttgttcataagcagatagtatctgcacttaaagtaaacttttccacaagattgttttcagaatcaacccttgatataatatcctctggtgaagccattgccaaattggatattaagttccaggatgctcttttaaagcttcagatagatttcttaagatgtgactgcaatgacaggccattctgtgaatgtcttcaaaggggaatttcctattatatattgaatcaaagattgaataagagggatcctattgacatttccaaatcacttcttaaggaatatcagattcaagcttatcctggagatattttctcatggctggatgcctatgtgagaaatttggatgctattaaaagagttgcacaggcatatggtaaaaaggacatagttaaagaagcggataaactaataaagataattgaaactggtaaataa

SEQ ID NO: 1026 - DNA, 387 bp, Methanobrevibacter ruminantium
atggaagagatagtatttaagccgatcggatatattaaatccaaatatgaaacagttgaaaacatgcctaaatccccaagggaaggcatggaggatgaggcagagctaatagtcaatgaagagtacttggaaagcatgtctgacatgaaagcaggcaaggagtatatggttatattctatttccataagtcaaacggatttaagcaaagggttccttttagaggtgacggtccaataacaggcttgttctcaacccatgcccctaataggccaaatcctattggagtttcaataataaaagtcaaggaaattaatggaaatgtgatcaaattcaatggtgttgatatgttaaatggcactccagtccttgatataaaagatgcttag

SEQ ID NO: 1027 - DNA, 339 bp, Methanobrevibacter ruminantium
atgaaaagagtagttgcggtttttcgtcaacaaaagtttgaagatgtaaaaagagcccttcttgcaataggctgtgaaggaatgaccatctccgaagtaaagggaaggggaagacagttaggtgttaaagaatcatataggggctctaactattgcattgaccttattcctaagacacgccttgaattgattgtaaatgaagatgaccttgaagatgttattgacacaatcattgaaagtgcaaggaccggtgaaatcggagacggaaagatctttgtatccgatgtagaggaagttattaggataagaactggtgagagaggttctaaggcggtataa

SEQ ID NO: 1028 - DNA, 570 bp, Methanobrevibacter ruminantium
atggaagaaaataaaaaattcgctcaaaaggtaaaagacattagagaaagacaacaaatgagtattgaagaacttgcagaaaaaagcggcgtaaagcttgaagtgcttcaggctatggaaaacggtgaaatcattccttcactcactcctcttacaaagatggcaaaggcccttggagtaaggcttggaaccttccttgacgataccgaacagctcggacctgtagttgtaagggacggcaagatggaaaacaccttatacttctcaggaagggaagacgtcgcaaatgcaacaaatcttgaattccactcattaggtgcaggcaagcatgacaggcatatggatccgttcatgattgacatagaccatgacgacgaatatgaattgtcctcccacgaaggtgaagagttcatctatgttatggaaggagagattgaagtggtatatggccaagacagcattacattatccaaaggagacagcatatactatgattcagtagttcctcatcatttacatgcaaaggctgaaaaggctaaaatattggctgttttatacactccattctag

SEQ ID NO: 1029 - DNA, 1665 bp, Methanobrevibacter ruminantium
atgagtgaactatttacagagcttccaattggaaagttctttgaaatgcaagtggaaaagcaaccggatcacgaatttatggtttatccagacagaaatctcagatttacatatgaacaatttaacgaaagggtggacaaccttgcaaaaggcatgctctcaataggcatagaaccgggagaccgtgtaggaatatgggcaaagaacgtccctgaatggcttacattcatgtttgcaacagctaagataggtgctgcaatcgtaaccatcaacactgcataccagtcccacgagcttgaatatgtcctaaagcaatctgaaatgaaagcgattgcaatgactgacggattcagagacacaagctatttcgatatcatctatggccttgtccctgaaataaaggaaagggaaaggggaaaccttaaaagcgaagagttcccttatcttgaatacattatccatgtaggtcaggaaaagcataggggaatgtacaacaccaatgaacttttattacttggaatgaactatgacaatgataagtatcaagagataaaggatgcagttacccaatatgacgttatcaacatgcaatatacaagcggaaccgaaggattccctaaaggagtaatgcttacaagcagaaacatcctaaacgacggctattacattggagaaaatatgaactataccgaaaaggacaggcttctcctccaggtacctcttttccactgtttcggaaccgtgcttggggtaatggctgtaatcacccatggctcaaccatggttgtccttgaggaatacgaccctctccttgcaatatcccccatccaaaaggagaaatgcacatcagtctatggagttcctacaatgtttatcggaatgatgaaccatcctatgtttgacatgtttgacatgtcctcacttagaacaggaatcatggcaggctcaacatgcccagttgaaaccatgaaagatgcaatcaacaagatgaacatgaaggaaatcacaagcgtatacggccttacagaggcaggtcctggatttacccaaacaaatgctgcagactcatttgaaaagaaaatcagcacagtgggaagaaaattccctaatattgaggtaaagattgtagaccctgaaaccggagaggagcttggccctggcgaaaccggagagattatgtgcagaggattcaatgtaatgaaaggatactacaacatgccggaaaagactgctgaaacaatcgagccagacggatggctacactctggagaccttgctacagtggatgaggatggatactactcaattgtaggaagaatcaaggatatgatcatcagagggggggaaaacatatacccaagagagatagaggaatatctattcacccacgaatgcgttcaggatgttcaggtggcaggtatccctgatgaaaaatacggagagattgtaggagctttcataataaaagagcctggatacgatgacattaccgaagcagacataagagacttctgcataggcagcatcgcaagatataaggttcctaaatatgtcttctttgttgatgagttcccacttacaacaagtggtaagattcaaaaatacaagttaggagacattggattaaaactcctggaagagagaagagaaagaggagaattataa

SEQ ID NO: 1030 - DNA, 879 bp, Methanobrevibacter ruminantium
atgacacttgttttgataggtcctgcatgtgaggatttgattataataggcaatgagaagagctctaggataggaggtgcaagctattttcaaagctttgtctatgaggagttttatgatgactacattgctattgtaaatgctcaaaacactgatttgattaatgaatttccagatatgtctaaaacagaactcattttaaaggacgatacccattattttatcaatgaatatccagataaggacaatcgagatattagaaagcaatccactaattttgcagacattccaattctggctgatgatttaaaagctatttttaacaatttgggattgaatgaggataatatcgatgcctttgtcataaatcctttaaacagcaatgacattcctttagaaactctagagtatttaaacagttttaatttgcctatatttatatcccttcagggatttttgagattcaaggataaagataattccatggttttaaagtcatatgaagatttggattatatttttaatattgctgaagcgatctttttagatgaaaaggaattaaagattgtcagtgatgaagataagtctgattctaaaattgaaattcaagacattggttttgatgaaaaaaccaacactatttttatcattacaaacggaagcaaagggtcaagaatcactgattttaagggcataaacataaagatagattcagtgaaatgtgataatatagtggatgccactggctgtggagatagttatatggctgcatttatttctaatcttctaaatggaaatgatttaaaggactctggtgattttgcatcattgattgcaagtaaaaaattagaattctttggtccttatagaacagattaa

SEQ ID NO: 1031 - DNA, 2817 bp, Methanobrevibacter ruminantium
atgtctgaaaatagatgttatgatccagattgtgatgctgaggattgccgtaatccccaacattacaattacatttgtttcgaccctgactgcaacgatgagaaatgtttgaacgaagagcattacaataagcagctattaagggattatcaagaaagcactgatttaagtgtttatgatcatagagaagagatagattatgatgaagatgttgatataagtctttgtggatgtcctgattgtgcggatgaccatgaccataatcacgaccatgaccatgatcatcaccatcatcatgaccatgaccataaccatgaacacagtcatgagcatgagcattcttatagtcatgagcatgagcatgagcacagtcatgaacatggccacgagcatggggatgagcatagccacgaacatagtcatgaccatgaccatggccatgatcacgagcatgagcatggggatgagcatagccatgaacatagtcatgaccatgagcatgagtctgaggatacttgtggatgcggttgcgatgatgatgactgccatgatgatttagaagaacatagtcatgagcatgaccatagtcacgaccatcatgaacatgaccatgagcatcatcatgaacatgaacatgaccatcatagccatgagcatgaagatgagcaccatcataatgaagaacattctcatgagcacgaacacagtcatgagcatgatcacgaccatgagcatcatcatgagcacagtcatgaccatgaccatagtcacgaccatcatggacatgaccatagccatcacgaccatgaccatggagactcctgcggatgtggagaggaccacgatgatgacgacttctcattatgtgcatgtcctgactgtgcagatgatgacgatgatgaccatggccaagaggaactcctcgcagagggaaagccactcatatacaacagacctattcaaatcatggtttccagtggaatattgtttatcacaggccatatcctcgaattcctctcattcagcccaacaattgtcacaataatctacatgcttggagcacttatagcaggctatgagatagcaatccttgcatacaagtcccttgtcaagcgtcacactgtcggtcctgcacttcttgtggttatcgcatgtattgcttccttcatcataggccacggtgaagagggtgcagctgtagctctcttgtactatatagcagaattccttgaggaccttgctgagcacagggcaaagcgctcaatcaagtcacttgttgaaatcgctcctgaaaccgctagggtcaaggtaggtgacggtgaagagtcccgcaggattgaagaggttaaagttggagagattgtgcttgtaaaacctggagacaaggttcctttggatggtgaagtggtctatggaacttcatctatcaatcaggcatcaatcacaggtgaaagccttcctgtaacaaaaaccgttggagatgaggtattctcaggtacagtgaacgaagacggataccttgaggttgtggttaccaaggaagctaaggactctgtaatcaataagatagtaacccttgtaaagcgctctcagcttaacaggtcaacaactgaaaccatggttgaaaagatctccaaatattacactccattgatgattataattgcagcctgcgttgcatttgttcctccactcgtctttggtcaggaccttatcgactggatctataaggcactttcaatcatggtaatatcatgtccttgcgcattccttatctccactccaatcggaatggtttcagctatcacatcagcaaccaagaagggtgtcctcatcaagggaagtacctatgtggaagagatgagaaacgtaaaggcagtcatatttgacaagactggaacactcactgagggaaagcttgaattaaacgacatcaacataataaacgacgaatacagcgaagaggagattgtaaggatagccgcatcccttgaaaacagctcatcccaccctattgctcaggcaatcgtaaactatgcaaatgaaaaggaaataggatttgaagagattgaagacttcagaaacgttccaggtaagggaatcataggaaatataggtggaaagcagtattatgcagctaacgaatccttgattgaaggaagccagttcaacatttcccaagaggagataaaccaatactcagcagaaggtaaaaccctgatattcattggagatgagcagtctgtcattgcaagcatcactgtaatggacagaatccgtgacaacgcttcagaagtaattaaagaccttaagagccaaggtgtcaagacattcatgctcacaggtgacaataagattgcagcaggtaaggttgcagatgagataggccttgactatgtctattctaacctccttccagaggacaagctaaacatattggataccctccgaaacaagtttggtgatgtggctatggtaggtgacggaataaacgatgctcctgcattggctagggcaaacataggaatagcaatgggtgctgcaggatctgacgttgcaatcgagactgctgatgttgctctcatgcaggatgacataagcaagcttccatacctattcagtttaagccaaaagacaatgaatataatcaagcagaacatcacccttgccattgtggtaaaggcactctttgtaatccttgcaatattaggattgattaccttgatgatgtctgtaggtataggggaccttggacttaccttggtggttatcttgaactcattcaggatagctatggttaaggatcctttgttttag

SEQ ID NO: 1032 - DNA, 384 bp, Methanobrevibacter ruminantium
atgaaagattataaggagcctacaaacgacaatcataatgacgatttatgtgaagtgtttcatcctcatgaggaatcaatagagcgtgcaaagaagcatgttctctctgaagaggaatattctgatttggctgaattctttaagatctttggaaatcctacaaggcttaagattatatcccttttaagctttgaggacctatgtgtatgtgacatctgcgaatcattaggattgaaccagaatgcagtgtccaatcaattgagaatattgcgtgcacataatattgtaaagtttgaaaaggaaggaaagtcagcaaggtattcattgacagaccttcatgttgaaatgatttataagatgggcttagagcatatgactgaataa

SEQ ID NO: 1033 - DNA, 639 bp, Methanobrevibacter ruminantium
atgggtaaagtgtttatcatgtcttatatttttattgatgaaagcggggatttgggaactaaaaaatcaagctccaaatactttgtgatggctggaataaaagttgaagattctcaaaaattagatagagttatcagaaaaatcaaaagagatgataaaaaaaatatcattacttctaatgaaattaaaggttccaatttacctcatgacataaaaattaaaattttaaaaaaattagatagtgttaattatcaagtttttataattatttttgaaaaaatcaataggtataaagttaatgatggttatgacaatattaaattgtatgatcttttggcttgcgaactagctaaacaaattgatataagtagttcttctaaaatctttattgataaatcaaaaaataaaaaagaagaaatagttaatttcaataaagcatttttggaaaatctgaataactttaaaaaatttcctataaaactagaacatgccaattcaatgagttataaaggtttacaaatagcagatcttatttcttgggctatttttcaaagtgttgaacacaacaataatgaatttatagatttaataaaaaataaaaaaataaaaagagtatttgaagaaaagaagaacctatag

SEQ ID NO: 1034 - DNA, 183 bp, Methanobrevibacter ruminantium
atgaattcagaatttattatacttttttctcatattcttcctttgattttaggatttttcagcatcttattaatgattaatggaataatggacaagcagaaggttataactgcctttggcataattctatttttggcagctgctttcagtccgtttgtagtcttgcctatcttaggagtttaa

SEQ ID NO: 1035 - DNA, 696 bp, Methanobrevibacter ruminantium
atgttagaaataattcctgtaattgatttaatgaattctgtagcggtttctggtaaaagtggaaacagagaaacttacactcctcttcaaactatatatgcgtcatcatctgatccattggaaattgcactttcacttaagagtgcaggtgcaaaggagatgtatattgcagatttggatttcattgaaagaaacggaaacaacaatatcttcaagataaaggaagttaacagtgtattgcctgtaatccttgatgtaggagtcgacaagcttgaaacatttgagtttctccttgaatttgcatataagataatagtcgctaccgaaacccttgaatcaatagaggaacttgggaagatatttgaaaagtaccctaaggagagaatcattgtaagcgttgatgtcaagaacaatgagctctatgcaaagaatatggatcttgaccttgaaggattcaaggaagtcttaagacgaatcgatcctaatgagataatattgcttgacatcagttcagtaggaacagaaggtggattcaataagcctctcttggaatcatttgaagagtttaaggacaagataatccttggtggcggaatcactccagatgaaataagtcaattggatgccttgggaatcaggaaggcattggttggaactgcattgcataagggacaaatcagattaaatcctttttaa

SEQ ID NO: 1036 - DNA, 624 bp, Methanobrevibacter ruminantium
atggaaaaaagtgaaatagaacattatttacgagatatctgggttagagaatatgaaagaggagaaaagctagttgtagatgaattcaatgctgatgatatagaattattagctaaaaaagaatatatcaaaacagatgatggctttgtcaatctgactgaaaatggagaatatttgggaagatcccttgttagaaagcataggatagctgaaaaagtggttgccgacttgtttttagcagatatggatgagatggaagagttggcagaccaaatcgagcacgttatgagtgcagaggttgaagagaacatctgccgaatcttgggaaaccctgaaaactgtcctcataataacccgattcctaagggggacactactcctggcataagcaaggaatattctgttcctttggtctcctgccatagcggagagtctggagaggtatcccatatcaaaacagaggacgcccgtaaattaagaaagatcatgaatcttggtcttattccaggctctagaatctgtcttattcaaaagtttccaaattatgtcttccaattgggaaacactcaattggcagttgacaaggaattggctaacgaaatatttattaaactagatgaataa

SEQ ID NO: 1037 - DNA, 219 bp, Methanobrevibacter ruminantium
atggatgaaaatgataataaaagtcagataatcaaatgtgaattctgcggattcacatttcaaaagtgtgatggcatcagctgtgattcctgccctattaattgcaaaacggttagatgtcctaattgcggttatgagattttgcctgagtccaaatcttataagttcctggaagatggtgttaaaaagataaggaataggctttttaagtcaatttaa

SEQ ID NO: 1038 - DNA, 1197 bp, Methanobrevibacter ruminantium
atgatagaaactgatgttttggtaataggtgcaggtcctgcaggctctgctgctgcaaagcatgcagccttaggaggggctgatgttattctaatcgataagaagtctgaaataggaactcctaagagatgtgccgaaggcatctatgaccatggacttaaatggctggggattgagccggaccctgcatgggctgttcaaagaataaacggaggaacccttattgctccggataaaacaagacttacccttgatgagacaattctgcctgaaaagggctatatcatagagagaaaggtctttgacaagtatatggctatggatgcagccagggctggcgctcagattatggtgaagactcaagcaaagtccattcaaaggggtgaagattccaaaggctcattttatactgttgactgtgagcagatgggagaaatcattgaagtgaaggcaagaatagtgatagctgcagacggtcctgaatcacgtgtagctaaggcatttggcgtaaattcaactacaaaaccaaagtatatgatgtctggtgtccaatatgagatggttggggtcaactgtgagcgtatggatttgatagagcttcatttaggtgcctttgcaggtggaggatatgcttgggtatttcctaagggagatgacattgcaaatgttgggataggaatatcaagcgaaagcgataggcctgcaattgactatctcaacgaattcattgaatcctatcctccattgaaggatgcaaagccggttgagcttaatgtaggaggagaccctatcggaggattgataggccagatttattctgataacttgcttgtttgcggagacgctgcaggtcaggtggatccgataacaggagggggaataatccttggaatgcttggaggcatgactgcaggccaggttgcatcaagagcaatcaaggatggcgattattccaaggaaaggttaaaggaatatgatgaattgtatgatgaatatactcaaggtgcaattcctaaattggcagttggccgtgatgtatatctttcattaagcgatgatgacttaaaccagatcattcatgcatttgaaggtcttgattataagagcatgagcccaaaggatattttaaaggtcttctttaaactgtctccaagacttgcattgaagtttaggaagttgtttaaggttgtgctctaa

SEQ ID NO: 1039 - DNA, 909 bp, Methanobrevibacter ruminantium
atgtttaataagaagatggttttagccataagcttattagctgttatctttgcatctatgtgcatagtttcagcagatgactctggagagggaagctttaaggaattggctaaattagtgtccggcgataataagaccggtgttataacattgacaaaaaattttgcaaatactgacggatatgatgcagatggaataaagatcactggagataatcttgtcattagaggggaagaaggcaaggacattacaatagatgcaaaaagtgcaggaaggattttcaatgcgaacggcacaaagaatgtcacttttgaaaatattcattttgtaaacggcaattcttccgatgcaggtggtgctgttctattaggtgaagagccaagcagttcagtaaagaattgtcaatttgacaactgctattcagatgcatttggcggtgctgtagatggaaatgccataggatgcacttttgaagattgcagcgcaaactaccatggcggtgcaatattcgatggatctgctaccaactgcaccttcaatgactgtttctcaaaaagctgtggcgggagcaaatttcctatcataaggcaaccaattgccaatttcacagactgctattcctattggcaaggcggtgcattgtatgaagtggaagctataggctgcgactttaaaaactgctattcaagcgaaggaggttccatgtgtggaggctctgcatttaactgcaatttccaagactcccttgctaagaatggaaatggtggagcgaccttaaacacaaccgctaaaggctgttcattcagcggatgcagtgtaacaaatggagaaggaaatgccatgtatggaggcactgctacagattgtaaattagataaggcagatgctgttaaggttaactttaaatag

SEQ ID NO: 1040 - DNA, 441 bp, Methanobrevibacter ruminantium
atggcgaatttaagttttatcaataataattttaaaatgattgtgggaatcttgtccattatcttagcgatagttgtttatttcattacacctccatatattgaattttacttgatatttgtatttttaattccggcaatagccttgattgttcctaatgatgcaattaaaaatagtagagcaataggtgctcttacttttattttagtcattattgtagcatattttgcaattagtggaatgttaggggcctatgatgttcttacaaatatgtatgtcaacggtttaattaactctactcctagtacaagtgatatcagtgcttgctctaatggctatttgatggtattgatttatgcattattcaatatattttgtggagcattgttctttaaacgaacaagtagtattgatgatgttgatgatgaagatgcattttaa

SEQ ID NO: 1041 - DNA, 1407 bp, Methanobrevibacter ruminantium
atgcaattggattttaaccatgtcttaactcggatttcagattatgaaaagcctattgtcttgaatcatgatgttgttttaacaaggtctgaagcccatcaatttaagaagggaatagaaatcaagcgtgataatatagttattgatggaaatggccattccattgatgcaaggggcaaaaaccgtattttcaatgtgctctctaaaaatgtagtcataaagaatttcacctttaagaacggattttctgaaaagtttggaggagcaatcagagttgcaggggaatgtaagctcataaattgcacttttgagaataatcgtgcaaaaaaaggaggaaatgacatttctaacggctctgaattaagcatctgccattgtaatttttcagatgctgatggttcaatcaataatttaggtacaatatatcttttaaaggatgaggaacatgagataaagcctcttatttctaataatggtgaaattaaaagaatcattccaaagcatgatgtctcttttcttataaatggtgataaggaccatataaagggcgcccttattaggataggggataaaagcggattttccaatgatgagggagcatgtgttttagaaggaatcgaagagggaaaacattcgctagaggtatctgctgagcattacatctcatttaatggaaatattgatgtttcagaaaataatgtcctttttgacattcagctagagagactgattcaaaggcatgacattaaaattttagttaagcataagggtgagcctgtcagtgatgcaattgttagcgttggcggcataaagggctctacagatgaaaatggagaatgcatctttgatgatgtagaggaaggagaaatatctgtaaaggtaaattccaatgaatatgagaatcagaagtataccatcactgtctctgataataaaacaaccttccctattaatttgggattcactcatttgataactccattccctgcaagtgatgaggatccttatatatttgccagctattctcatgatgatgcaaacagggtttttctagagctaaagcgctttcatgattgtggcttaaatatttggtatgatgagggcattgaatcaggacttggttggcaaggtgttgttgagagtaagttaaaggcttgcactctttttattgcatttatttcagctaatgctgtggaatcaattaatgtaaggcgagaaatctttttagctattaataagaagattccggttgttccaatatatcttgaaaagactgaattgcagtatggtcttgatttgcagctgtctccagtacaggcaattttgaaatatgccatgactgaagagttttatgtggaaagatgcagaagggcctttgtaatgtatggattgatggatgaggaatag

SEQ ID NO: 1042 - DNA, 759 bp, Methanobrevibacter ruminantium
atggcaaaagtgacaagcatatttttctctccatcagagactacaaaaaaagttgtaaatcagatagcagagaacttcaaagaggaaaaatcaatttgcgacttattatatttcaatgataaaaaggaatttgagtccgatgatatagttattgtaggaatgcctgtatttgcaggaagacttccaaagactgcttcagaaagactatcaaagctaaccggtaataatacaaaggcaattgctgttgcaaactatggaaatgctcatgttaatgatgcattgatagagcttgttgacattcttaatgaaaacaattttgatgtgattgcagcggcttccactgtcagccatcattccatctttgatggtgttgcgttaggaaggccagatgaagatgacattgaaaagattaatgactttgcccaaaaggcaattgaaaaaatagaaaatggaggctcccttgaatcagatattccaggaaacaggccttatacagattataagcagcttccatttgttgtggcatgcgatgtggataaatgcgtattctgtcttgaatgtgtttcagtatgtcctgagaaggccattccagatgatgaccctgccgatatcgaccttgagatatgctcaagatgcactgcatgcataaacatatgtccagaggatgcaagatcatttgctggagatgctttcctatctaaaaagccactatttgaagaggcaaatgcagaaaggaaagagcctgaattttatttctaa

SEQ ID NO: 1043 - DNA, 297 bp, Methanobrevibacter ruminantium
atggaagcaaaattaaaaaaattaactcaagaggatatcgacgacatatctgacttttttgcaggagtcattgataagaaaatcgcatcttctgtaaagtctcaaaaagagattcttgctatggatattgatatagaagtagcatacaatgatgaaaatgaggaactgatggtagatgtagatgttgatataactacagatgaactgtccaacttatcagatgaaaaagtcaatcaattaatcgaggactcttatgtggaacttgatgaatacattaacgacaattataggaaatga

SEQ ID NO: 1044 - DNA, 348 bp, Methanobrevibacter ruminantium
atggaaattccacaaaatgtacaacatcaattaaatcaattccaacaattacaacaacaagctcaagctgttaccgttcaaaagcaaaatgtagacatccaattaagagaaacagaaacagctctcgacgaactcaagaaaactccagaagatgctgaagtctacaaatccgcaggtaacttactcattaaggttgaacgtgcaagcactttagaagatcttgaagacaaggttgaaactcttaagttaagacagcaaaccatgcaacgtcaagaagaaagagtcatgaaaaagcttgaagagatgcaagcatccattcaacaagctatgcaaggcttacagggatag

SEQ ID NO: 1045 - DNA, 135 bp, Methanobrevibacter ruminantium
atggagctcactctagatggaaattcaataaaaatcaaaatagatgccgaggacgccacttcctttagggcatcaatcaattcagcaatcaaatggataaagctggctgtagagattaacgaattggtagaatag

SEQ ID NO: 1046 - DNA, 492 bp, Methanobrevibacter ruminantium
atgcttatttccacatcaagaaaaccttcacagaaaacaagaaccttttgcaagaatttctcacatgcatttggctttgactatacaaacagaggcaaaagcagcttaagggatttgcttgtaaaggccaagcaactaggtcacgacggtctcgttttggtctatcaaatcaagggaaacccaagcaagctgacattctatgacctggaagaaaatgaaagattggctcttctcatatcagtaaacactaccaatgagcgtcttcacataaagccagaggaattgaagatacgctcaacagttccagaattggatattctagcagaagttctagggattgaagtaaccaaggaacctcaagactccaattatataaggatctcatatgcagattatgatgacgagagcaattttgcaattttatatttcattaacaagaaaggagaacagattgattttagaatcaatgtcaaaaagattgtagagccttaa

SEQ ID NO: 1047 - DNA, 132 bp, Methanobrevibacter ruminantium
ttgtataaatgtccagaatgtggcgaagaagtcgaccataaaggatacatggaaaataaatgtcctaaatgtagatataggattttatttaagaaagttcctgaagttagaaaactcgttaaagcaaggtag

SEQ ID NO: 1048 - DNA, 270 bp, Methanobrevibacter ruminantium
atggctagaacaaaaaaagtaggaataactggtagattcggtgctagatacggaagaaaagcaaaaagatctgtaaagaacattgaagaaaacatgaaaaagaaacatgtatgtcctaaatgtgacagaccttatgttaaaagagtaagcgctggaatctgggaatgtaaaaaatgtggtgtagtattcaccggaggagcttacgtacctgaaactcctatggctaaatctgcaacccgtagtattaaaagagttgttgggggagaataa

SEQ ID NO: 1049 - DNA, 792 bp, Methanobrevibacter ruminantium
atggatattgtacctgaaattactagaaaaagtattacaagacttataaatgatggtaaaagagctgatggaagagcttttgatgaaagaagagatattttcattgaacctaatgtgattgataaggcagaaggttctgcaagagttaaattaggagacactcaagtcattgtaggtgtaaagccaaccattggcgaaccatttgcagacactcctaacttaggtgtcttaatgaccaactgtgagcttttacctatggctgctcctggatttgaaccaggtccaccaagccctgaatcaattgagcttgcacgtgttgtagaccgtggaatccgtgaaagcgaattggtagaccttgaaaagctatgcattgaagaaggtaagaaagtttggatgcttttcattgacttgcatgtaatcgattatgacggaaacctcttcgactgtgcaaatcttgctgtaatgtctgcattgcttaatacaaaattgcctgttgctgaatacattgatgatgaagtggtcctatccgaagatgaaacaatggaccttcctgttagggacaaattggctttatccacttttgtaaagataggcaatggattgatcttagacccttcccttgaggaagaggaaatcttggatgcaagaatcacaatcggagtaactgatgaaggaaatcatatctgttctatgcaaaaaggcggagaagaacctctaacaagagatgacattctcgatgcagtccatttagcatttgaaaccaaagatgatcttcttagttatctcgactag

SEQ ID NO: 1050 - DNA, 711 bp, Methanobrevibacter ruminantium
gtgttttttattatctcagaaaatgaaaaattaagaggggacggaagagcatatgacgaacttcgtccgattaaaatagaagctggagtcttgaaaagagcagatggttcagcttatttggaagtaggtggaaataaaattttagcatctgtttatggtccaagagaatcttatattagacgtttattaaaaccaaacactggtgtaatcagagtaagatacaacatggctccattttcagtggatgatcgtaaaagaccaggtccagacagaagatcaactgaaatctctaagattgcagctgacgcacttagacctgcattgatgttggaatctttcccaagatccatggtggatgtttcaatagaagtaattgaagcagaaggaggaacccgttgcgctggaatcactgcagctgcagttgctttagcagatgctggaattccaatgaaggacattgttgtaggatgcgctgcaggtaaggtaaatgatgagattgtattggacttatctgaaaaagaggataaggaaggacaagctgacgttcctattgcaatcatgccaagaaccggtgagattaccttgcttcaagcagatggaaacttgactgaagaagaatttgaagaggctttggatttagcaattgaaggatgtatgaaaatcagcgaaatccaacatgaggctcttaagacaagatatagttcccaatag

SEQ ID NO: 1051 - DNA, 1476 bp, Methanobrevibacter ruminantium
atgggaagtatatgtatgatatatgtgaatgagaaagatttagtagttcctggagaattattggcagaggatgattattattcaggaagaggaacctttgaagatgatggaaaaatatgttccaaacttttagggttggtttctttaagaaacaagaagataagtgtaattcctctaaaaagcaaatacattccgaaaaaaggagatgttgtcatcggtaaaatcgatgatgtaagattttcaatgtggggagttgacattaactcaccttactctggaatcttgccggcatctgaagtattcggaagagagaaaaaggaattaagtagagttttcgatatcggtgacgttcttttcttaagaatcgtcgatgtcgatgaggtcaagaaggttaagttaggattgaaaggccgtggaatgggcaagtttagaggaggagtcattgtagacatcgctcctaccaaagtccctcgtttaatcggtaagaaaggttctatgattaacatgatcaaggataaaactggctgtaagattgttgtaggtcagaatggtcttgtttgggttaaaggtaatgaagacatggaacaaatcgttaagaataccattaaattaatcgaaagagaagctcatacctctggtttaaccgacagagttaaaaacaagctctgcttgcttattgatggagaacttccagaagaggaaactgaagtcatggaagaaaaggaagagattgttgaagaatcctttgaagaaggcttgaaaaagcctgaaattcaagatttcagagatgaagttgaaaaagaaattgctgaagagatggctttagaagagtctgaagaagacttggatgaagagtttgatgattctgaagaacttgatgactctgatgaagagtttgatgattctgaagatatttcagatgatgaagattttgatgactctgaagatgatttggattccgaagaagaaattgattatgcagattctgaagatgatgaagatgagctcgcaatagaagaattagaagaaaaagtagaaaccgaagagttcatggatgattccgatgaggattctgattttattgaagaggatatcatcgaattagacgaagatgcagaatcccttaatgaagaggatgatgaagaggaattcgatgtccttgaagagtctgaagcagaaatatttgatgaggcggaagtccttgatggagctgaagaaatctcagatgatgagcttgaagaagtaatcaatgaagcgatctcagaagatgaagaatctcaagatgattctatagaagatgaaagtgaagatgaagaggaaaaggaaaaagaagaaaagtctaaaaaacctaagtttttagacactttcgaatatattaacgaacagaaaaagaaaaacaaatcttcttttgatttaagtcgtgcagataattccgactctcctactttaaacatttcacaaagaagaggtatctaa

SEQ ID NO: 1052 - DNA, 705 bp, Methanobrevibacter ruminantium
atggttaatatagatgatgctattattgcaagattagaatcttacggtgaaaagtttgagattttagttgatcctgatttagctgcagactttagaaatcctgataatgaaaaagaaattgatattgaagagatattagctgtagaggaaatatttaaagattccaaaaaaggtgacaaggcttcagaggaatccatgagaaaggtatttgacactacagacgttttggaagttgcagagcagatccttcataagggaaatgttcagctgactgcagagcaaagaagacagatgcaagaggataagagaaagcaagtagttgctaagatagcaagagagggaatcaaccctcaaacaggtcttcctcatccggcagtcaggatagagaatgcaatgaacgaatctaaagttaagattgatgctttcaaatcagtggatgaacaggttcaaacaactttaaaggcaattaaagttttaattccaattaaatttgaaaagataaaaatggctgtcagattgcctagcactgctgcaggcaatggctattctgcaattcgtccatttggaacaatcttgaatgaagaatggcaacaagatggttcttggattgcaattgttgaaatgcctggcggtcttcaagatgattttaatcataaaatggcttccatctcaggaggagaagctgaaactaaagtaattaaataa

SEQ ID NO: 1053 - DNA, 144 bp, Methanobrevibacter ruminantium
atgtcagtaaaaaaactaatcataaaaaaggttattcttagcaaaactgctagaaaaaccgcaaagaagggaataatgtttgttgtgccttcagatttctttgataggcataggcatttaggaaaaattgttgacatgatgtag

SEQ ID NO: 1054 - DNA, 885 bp, Methanobrevibacter ruminantium
atgcaacctttacaacaacagaatgcaggttatgacagagcaattactgtatttagcccagatggaaggcttttccaggtagaatatgcaagagaagctgtaaaaagaggtaccacttccttaggtcttaagtcaaaagacggcgtggtccttattgtagataaaagaaccgtcagcagattagtggaagcaaagtcaatcgaaaagatattccaaatcgacgaccacattggcgtagccacttccggattagttgctgatgcaagagctttggttgaaagagctagaatcgaatctcagattaataagatcacttacaacgaacctattcttgtagggggacttgctaagaagatctgtgacttaaaacaattatatacacaaaatgggggtgttagaccattcggttccgcactcattataggcggagttaatggcgaagaaactagattatatgaaacagatccaagcggagccttaattgaatataaggcaactgcaattggttctggagtgcaagctgctgtagatgtctttgaagaaagatatgaagaagacttaagcttggaagatgcaatcaacttaggcttagatgcactttatgaagctactgaaggcagaacaactgaagacagcgtcgaaatagctgtaattgaagttgcaacccaagcttatagaaagctttccgatgaggaagtttctggctatgtaaaagatcttcttgagagaaatgctgaagaggaagagccagaagaagaagctgaagaagaagcagtagaggaagcagtagaggaatcagaagaagcagaagacgctgctgaagaatctgaagaagaaacttctgaagaagaagcttctgaagataaagattctgctgaagaataa

SEQ ID NO: 1055 - DNA, 2244 bp, Methanobrevibacter ruminantium
atgaactttatgaaaacaaatcttaaaaaaacaacaatcatattggcactgctgatggccattttaattttatcgattggagccatctctgcaaatgatttaacatcagcagattcaaatgtagatatgaataatgatttaaacacaaatttggatagcaatgatataatcgccaattcaaacagcaattcaattgatgctgaaattgatgaagcaaactattcaaatcaaagagcagatgccaaggaaaagttaaaggaaagcaattcattaatagaaaacgaaaatactgaaggcaatacacaaatagaagatgaaaattcaagcccttcaaataaaacagatacatcaatatcaattgaaacaaacagcatagaaaggggatccgatttaacaatctatctaaaggacataaatggaactggaatagcaaatgaaaagctatcaatccaaataataaacaagacctacacaagaacaacagattcaaagggctctgccctttttaaaataaatcttgcatctggaaaatatcctatagcaatatcctacaatggcagcgaagattatgaatcatcatcagatgacttcaacataagcgtttcccctatgaaaacaaagatcaatatgctcagcaattccattgtaaacggaaggaaactaactatagaattgttggataagaacaacaatccattaaaatacaaaaagatctccattatcctaaataaaaagctatataatctcaccacaggcaaagatggaaaggttagcttaaacattaatctgaatcctggaaaatttcctatccaaataactttcagtggagatgcaaactatcatacagtatctaaaagctctgcgattgatgtatataaattaaaaagcagctttacagttccaaaaacatcaatcataaaaggaaaatacttatatgtctatttaaaagatagcgaaggcaaagcaatcccatccgcaaaggttgccttcaagatcaatggagtaagctccacaaaaacaacagacaagaacggaagaatcagccaaaagataggccttaaggtaggaaactataccgtccagctcaactataatggagacaagtcccatttgaaaaaagtccaaagctttaagattcgctcttgcaactccaaaacaaaattcactgtagctaattatacagtggtgagaggaaaatacctaagcgtctatctgaaggattcagaaaacgccaatcttgcaaataagaaagtgaccttcacatatcttaaaaaatcatatacaaagacaacagacagcaatggaaaagccagcctaaagatgacagaggcaggaacaactaccgtcaatcttcaattcaagggaacaggcccatatctaaagtcaagcgcaaatgtcaaaatcaaggtactaaaaaacacaacagcagatatcattgcaaaaaaccagacaagacacttgaacggcagttccacaataaggtattatgtaaagcttactgacaataacggaaatccaatagaaaatgaaacaatagagcttaaggtcagatgcaataacataacaacaggaagcggaaacaagattactaaaaagaccatcgtattaagctcagataacataattaacaagagcgaagacaagaagctcctaaacgagatggcaaagatcctcagggcaaaaggatataaggtaatcgtttccggaatcggacctaactatcatgtaagcgatgtaagggactattccaatgtctgcgtattcagccttgtaggaggagtcgacagcggaatgtttgttgacatgtcacacagctactataagaactaccttaaaaaatacaagaaccagttcgtattgggatgtgtagcccctccggtatatcttaatttaggtaatatgacctggcttaaaagggctcatgatgatgactacagtccgaaaagctttaaaggactttattatccaggaaagtacttcaatacagtgactaaactggattatgtctatggtgatggtgctgaagagcttgtcaataatttcttaaactatgcaaaaaaaggtaaaagcatagaccttggacagtcagtacctaagacaactacaacttataagctcactacagacaagaatggaaatgcttatgtcgatttgcaagtaggcacttataccatttcctcatctatattaggcaataattataaggttgacacccaaacaagcaaggtaaatgtgattaagtag

SEQ ID NO: 1056 - DNA, 378 bp, Methanobrevibacter ruminantium
atgaagcttaaggtcctgcctcccacccttcgtaagaatcaccattatcttattctggatgtaaagtctgaagtaaaactttccaaagatgatatagttcactatatatgggacgcttgcattagatattggggagagaaccattcaagtaacttcaatctatgggtcatgagacactatcctattgaagaaactatctataataatgagcctgtattcaattataagacagtcttaagatgtcaaagatcttatgaagatgatgttcgctctgcacttgccactttaaacagatataataagaaaaagatatccataaatacgattggaatatctggaactgttaagtctggcattaataagttcattgacgaataa

SEQ ID NO: 1057 - DNA, 972 bp, Methanobrevibacter ruminantium
atgaaattccatgacttgaacataagaggaacagactacaataacgatttggctctaatcaaagaggcctataagttcggatgggattatcttaatttaaattattcccaagaccattataaggaagccttatcctataaggatgatttgcttgaggaaatatctctttttgaatggaaagacagctatagaaacaaatacaacagccagtccatagagatttccatgggaatcaacattcagaatgccaattcaaatgagataagaaagattgtaaacaaatataggaacaattgctcttatatgagtgctttaggcggggacttaaaggtaaaccgtagcgtatgtgaaaaccataggatggatgtattgtcccgcccatattataaaagaagggattccggcatgaatcatgtattggctaaggaagcagcccgaaacaatgtggctatcgaattatgcttccgtgacgtattaaagaacagcctgaagtttagggctaatataatcagcagctttaaggaaataatgatgtttcataggaaatataattttcctatcattctgacaactgattccaaatcaatctatgacattcgctcaacaaaggatatagtcggcttctttaagtcaataggattttcagacaaagagatttataatggattctattactatccaagggagataattgactttaaccgccaaagaaagaacatggttattaagggagttaaagtgattgaaggagcaagtgattttactgaaattgattcaaaaactcctaaatttgaagagtctgaatgttttgatgaagcaatatctcaaaaagaagatgatttctttgattgtgatgaatctgaagatgatttctccgattatgatgaagaagatgaagtttttgttggggaatctgaagatgaatttactgatgttgagttcgaatctcttgaaaaggaggatttattatga

SEQ ID NO: 1058 - DNA, 441 bp, Methanobrevibacter ruminantium
atgattcataatatcagatatcgtgtttttatttatgaaaatgaagataaggataaggttttagaagccctactcaatatacttccaacagcagagcctgaagctgaagaggcagaggggcttctcgaagagaagatgcttattctaactggagccatctccaaaaagagagaaaccaaagagttcttaaacacccttatcgaatccattggagaagatcaattaatcaagctatataatgatttggatagaaagatggatgaaaaaggcaatctcttcctaagattatccaaagagaaggcattagatgaggaatgggaaatattggatggtggagacagcatacatctaaagataaagatagctgcatatccggctaaaaaggaagttgcattaaaaaagattaaagaagtcttcccagaggatattataaatgcttag

SEQ ID NO: 1059 - DNA, 552 bp, Methanobrevibacter ruminantium
atgatgtacaaatatattagagatgcatggaaaaatccagatgagtcttatgtaagggaacttatgtggcaaagagttcctaaatggagaaaacaacctgcaattaccagaatcgacaggccaaccagaatcgatcgtgcaagatctctcggttacagagctaaaaaaggtttcgtagttgtaagagtaaaagttagacgtggtggacgtagaaaaactcgtttcaaacacggtcgtagaccaaaaagaatgggtgtaaacaaaataaccatggctaaatccattcaaaggatcggagaagaacgtgttgctaagaaataccctaacatggaagtattaaactcctactgggtatggtctgacggaaaatacaaatactttgaagttatcttagtagacccacaaagtccttccattaaaaacgacccaaaaatcaactggatttgtgaaaaacagcacagaagcagagctctcagaggcttaaccagtgctggtaaaaaaggccgtggccgtagaaatggaggaaaaggcagtgaaaaaagattaaaataa

SEQ ID NO: 1060 - DNA, 420 bp, Methanobrevibacter ruminantium
atgattaaatgtgataattgtggtttaaaatttgatgatgacactgaaatatgtcctaattgtggcaataaactagattctacccaatctgttcaagaaactgaagaagcttctaaaaaatgccctagctgcgggtcactcattggaattaatgagtttatttgtccaagctgtggaaataagatagaggaattaaaaatcattagaacatgtcctaattgtggtgtgaatttggatgatgatgcggtattctgtgataattgtggtgctaatttgtcttcaacttcagatcagattcaagagttcaataaatctttaattgagtctaataaatctttaatggaccaaattgctgatttgcttactaagtttgggaaatttatcgatgatttattctcttcatttaaaaaagataagtaa

SEQ ID NO: 1061 - DNA, 921 bp, Methanobrevibacter ruminantium
atggttaaatgcagtaattgtggtgcagaagtgggagatgcaagtttttgcttttcctgtggtgagaaggtagatggtggaaatgtagattctaacatatgccctaaatgcggtactgaaaattcaaaaggaaccgtattttgtgttggatgtggtcagaaatttgataatgcattagttccagaatctgtagcgcgcaaacaaaaggaatgggaacttagacgtcagcaaatcattgaaagatatgatcagcttgcagatgagtttggaattaaggataaggattatttcctaaccagtgtggtaagggttaatatgttggaagagaaaactactaaacataaagtttggggttctgttggctcttatggcggaaataaaactacaattgatggtttcttcttaatagaagatgataagtttgtctttatggaaatcgataatagagactggaaaaaagtcaatgcgggaataaacaatttctactttgacaagattgtttctatgagaattacaaaaagacttggtgacatttcaagatatgaggacattactaaaagaacaagtctaaattccgctcatgccattaaaagagccattcaaaatgatatccaatctcttaaagccacaagatttaaagatcttattgtaaacaacgatagtgctgatatgtttgataggttattaatcaagcttgtagataacacttcatttgaaatcagacttcctagctttgaatttggagagaatttggtggcattgtttgaaatatctagaaacagtcctcaaactgttgtcatcgagactgattcaaaaccaagcaaagcagatcttttaaaggaatataaggaactattggattctggcgccataactgaagaagagtatgatgagcttaaaaaagaggttttatctagttaa

SEQ ID NO: 1062 - DNA, 534 bp, Methanobrevibacter ruminantium
atgttagttcgtaatttagatttcttgtcaattccaaaggaattttcaaaagttgaattagatatttatgaaggtaaatctatcgttcttgtttatattgaaaacaaaggttattcactagtattaaaaaagaacaacgaaaacgattctatattcctactaaaaactgatttggctccagataatattgattctgataaagaagacttcattaatgtaataaaaatgttattggataaaatctacgaaggtgcagagattaaggaatatgaaaagcagcaccacgagcatgtgttcttacaattgatggatttattgattgaaggagaaacagttgaaacaatcactgaagaatctaagatttatgccgacattgaaaagggattcatgaagttggagcttgatatcatggataacaagatcaattccttaaacagtgcaatcggtgagatttcaggtaatttaaacaatcttggaagcaaagttgaagatagcaagatagaaaacagacttaagaaaactttctctcaataa

SEQ ID NO: 1063 - DNA, 549 bp, Methanobrevibacter ruminantium
atgaaagaccctaatatggacaggattcttgaagataataggaaattaatggaagaaaataggaaattgaaagaggatttaaaagaattgaagaatgaattctatcaatttaaaaaaaattcaagacccggaaagccattcaacttagaaaataatgatgattataaaccttctggaaactattatttccataataattttaaagaagaatttgatgatgcaaacatcaaatacaattccaaggataatccagaaggaagcttccacaatgactctgcaaatatagtggatatgagcctaatctcatttttagcaaggtccaataaaagggttgaaatactaaaatcattgaatcaaggggacaaaataccatccaccataagcaaagagattgacgacagcagccaccacgtctccaaatacctctcaagcctaaaagaaaaagaattagtcgtttgcatgaatgaagaggataaaagattcagattctatagaataactgcaaagggcaaatactatttggaaattattcagaacaaccaatactga

SEQ ID NO: 1064 - DNA, 546 bp, Methanobrevibacter ruminantium
atggcagatttaaaaggaaccaaaactgaagaaaacttaaaggccgctcttgctggcgaatctcaagcacgtgtaaaatatgaattctatgcctcccaagctaaaaaggatggctatgttgaaatcaaggacattttccaagagtcctctgacaatgagaaggaacatgcaaaaatctggttcaagctcttaaacggtggaaaagtacctgacaccttaactaaccttgcagatgcagcagctggagaacatgaagaatggacttcaatgtataaggaatttgctgagaccgctagagaagaaggctttgatgacattgcagcattattcgatgcagctggagcaacagaaaaggctcacgaagacagatacaatgctttaactgataagataaaagcagataaggtctttaagaaagatgaagagattgcttggaaatgtaataactgcggttatatccactatggaaaagacgctcctgaagtctgtccgttatgtgatcacccacaagcacacttcagaaaacaagacactagttatatctag

SEQ ID NO: 1065 - DNA, 978 bp, Methanobrevibacter ruminantium
atgtgtacagcaagtgaatatttaacagaaaaccattattttggcagaaactttgattatgaaatctcatacaaggaaagagtttgcataactccaagaaattatgaatttaaatatagaaaaatagatgatatgaaatcccattatgcaattattggaattgctgcaggtattgacgagtatcctttatactatgatgcttgcaatgagaaaggggttgctattgcaggtcttaactttgcaggaaatgctatatatagggaaatggaagaggatatggttaatgttactccatttgaattcatcccttacctcttatctcaagcagatagtgttgaagatgtaaaagaattgcttcagaatcttaatttagtgaatatcaattattccgaaaaccttccattgtctcctcttcattggatgatttccgataaggattcatctataattgtagagcctttggaagacggcttgaaggtatatgacaatcctgtaggagttttaaccaacaatcctaaatttgatatgcagctgtttaatttaaacgattataggaacttgtcagtaaagacacctgaaaacactttctctaagaatctcaatttggatgactatagcaggggaatgggagcaatcggacttccaggtgacttgtcatcagcatccagatttgttaaggtggcattcacaaaggaaaattcattttccggcacaagcgaaagcgaaagtgtctctcaatttttccacattctaggttctgttgagcagcaaaaaggattgacatttatcaatgaccctgatttatatgaatataccatttattcatcttgctataatacaaacaagggtattttatattataaaacctatgacaatcatcagataactgctgtagatttaaatagggaagatcttgatggggatggattgataatttatcctttgattaatgaggcacagattaactttattaattaa

SEQ ID NO: 1066 - DNA, 546 bp, Methanobrevibacter ruminantium
atgaaaatcttagcattaataggaagtcctagaaaacacagtaactgtgaagcaatcgttgacgaaatagcaaaaggagcagaagaaaacggccatgaagtgattaaatacattattcaagatttggatattgctccatgcagtggttgtgagctatgccgtaaaggcaaggactgtcgctatacagatgacggcactgaaatcatagaccaattggcagatggagcaagcgttatattggcaagtcctatctatttcggtcagatgtctgctcaagcaaagacaatagtggataggttctatagcattttcaacaatccaaataaaagcttctcaaaagatgcaaaggcagctattgtattgactcatgcttatcctggggattatgatgcttatcttcaattgaccattgcccagcctttccaaaacaatacagaaatggaatttattggagcaatagatgctggagatttaaagttcccaggtgatgtaaaggataagccagagatcttgagagaagcttatgagttgggtaaaaagttctag

SEQ ID NO: 1067 - DNA, 1497 bp, Methanobrevibacter ruminantium
atgaaagaattatatgaaaaaatgattaatgaatcagtagctgcattgcaagcagatattgatgtaattagtgcaaatagatacaacgactttaagattgttgatgcaaaaccttatgcagatgctgtagctggaatgacctgtatagacggacaagcaaaatctgtaattgacttgcacaagaaatctgtggaaagccattacaaggtattgacttccgttgctgaaaccatcagacctgaagacgatccatttattgaacattaccaaactcctcctatacttgaaatcctatgtgaggaagacggtgaatttgcagacagtatggctacatttattcaagctattgctgacagtgaaacattgattacaagagaatccgtccgccgttacggtggattctatggtcctacctgtgtagtggactttgctttgatgccaggaagcacttccaatgtagtaaaccaaatcttgaagaccattcacattcctgtaatgcacaaacaagcaatcctctctgccaaatcttggggtatgaacacatcctatggtattggtgattcatttgctcatgcaattgaaaacggtgcaactgcagcagaagcagctgcaaaagaagttgaatcaatgcaaatgatctataaggaacctgtagaggctcaaggtaaattaatggacgatgcaggacactcttcatttgatgtaagagcatttatggaaggatacaaaaaagaaatgagacctgttgtcaaagctgctatggatgatggcgtgcattatggtaatatcgtaaccgtacctgcatactgtgtaggggacattggtcaccacatcggtcaagcaagctacaacatgtgtaaggatgacgtgactttagctattattcaagcaactgctaaagtaatggaagcttccttgaaagacaacattggcaaatttatgcatccatcacaagtcttgaacttagctaccggttcaactgcatgtgctactgagtacattcttgaattagatggatttaattccactatggttgtagacttattaaccaaaagattccacaactttgtacaacaatatcctaccagaggagcagctgcagaattgcacaactgtgactttatggacatgattcacagaggttccacttacataagcgctgcaagaaaagcaagaagcagtgcaaaaatcgaccttgtacctaaagtcaatggatttgctgttgacttaggagcaatcacccataatgaagttctcatgaacccacaaagatacacttatcctgcttgtggaattacagtaagattctcctcactcatgagacttgcagactatccatgtctccttactcctgaacctgtaactgcaaccatgatgactaacatcattgcactcaataaggaagttcctggttctcctgtaagaggatgtaaaaactgtgcttcttgcataattgatgcaaaacacgaatactgtcaatggaaagaatctgtatag

SEQ ID NO: 1068 - DNA, 627 bp, Methanobrevibacter ruminantium
atgaatgaaatagttttaaatcatccattaataactcataaattggctattttaagagatgtaaacacaggtacaaaagaattcagagagcttgttacagaaatatccactcttttatgctatgaagcaaccaaagacgcaaagcttgaagaggcagaaattgaaactcctcttgctaagatgaagacaggcaagctgaatgaagacaattatgcagttgtccctatcctaagggcaggtatgggtatggttgaaggaatcatcaatgtgattccaaatgctaaagtaggtcatataggtctttataggaatgaagagacctttgaacctgttgaatattactataagatgcctgatggaatcggagataggatagctatgattattgaccctatgcttgcaacaggaggaagcgtatctgcaaccattgacaagctaaaggccgatggggtaaagcaaatcaagttcctatgcatagttgcagcccctgaaggaatcagggctcttgaagcaaatcatcctgatgttcagatatactgtgcaacagttgatgagcacttaaatcctaatgcatatatcgttccaggtcttggtgacgctggagataggatttatggtactaaataa

SEQ ID NO: 1069 - DNA, 1188 bp, Methanobrevibacter ruminantium
gtgaattcaactgttggcgaacctgtgctatctgttccagttgctttaatcacttctgggataggtacactcatttatgtaatctgtacacggaatagaagtccggtgtatctgggaagctcatttgcattcattgcacctatggttgccggatatgccatcggcggaaaatcaagtatcttctcagcattgatggttgtaggtttggtctatgttgcaattgcaattatcatcagggccaccggtaaggaatggatcaataagctattgcctcctgtaattgtaggtcctatgattatggttattgggctttgtttggcccctaccgctattcaggaaataggacttgatcaggctgtagttccaatcaataacattattgtggctcttgcagcattcctgaccactgctgtaatagcaatccgtggaaaaggagtattgaaggttattcctttcctcattggtattattgtagcatatgtcgttgcagcgttattaggtatggttgacttttcaggattcttttcagcaagcctctttgaagttccagagttctatatgccgtttataaactacagcttcaatcctacagctcttcttacaatagttccgattgctcttgtaacaatggtagagcatgttggggaccacaaggtattaggggaaatcattggacgtgacttgattcaggaccctggattgaacaagacccttcttggtgacggtcttgctaccttctttgcagcgctcctcggtgggccagctaacaccacttacggtgaaaacacttctgttgtaggtcttacaagagttgcatcaatctatgttatcggtcttactgcagtgtttgcagttatctttgcattctccggacacttgactgcacttcttgccgctatgcctaaccctgttatcggaggtgtggctattcttctttacggattcattgcagtaaatggtgtaaagctcttgattcaagaggaagttgatttcaacaataacaaaaacattgttgtagcagctaccatgttggttttaggtttaggtggagctaccttgtccgttgctcaaggtgacttatctgtgtcaatttctggtatggctcttgctgctattgctggtgtaatccttaacttgataattccagaaagaaaagaagataacaaatttgttcctgaagttaaataa

SEQ ID NO: 1070 - DNA, 480 bp, Methanobrevibacter ruminantium
atggctaaattaacatttaggaacgctagcgaagaggatgtgcctttaattttagaattcattaagaaattagcagattatgaacatagattggatgaggttatcgctacagaggaagcattaaaatactggatttttgataagcaacaagcggaagtcatatttgcccttgaagatggaaaggaaataggatttgcatttttcttccttagcttttcaacatatatcgctaatgtcaacatgcaccttgaggatcttttcatagaccctgaatatcgtggaaatggttatggcaaggctcttcttcgtgagcttgctaaaatagtaaaggagagaggatatggcagattcgaatggacatgccttgactggaatcagccaagcaaggacttttataaatccattggtgcaaaacagaaggattggaatgtatttcactttacaggccaagaactagaggatttcattaatgaggattaa

SEQ ID NO: 1071 - DNA, 1455 bp, Methanobrevibacter ruminantium
atggattatgatgtaatatacattggaagcggaaatgcatcttggcaaggtgctaggttcttgagaaaagagggtctgaagattctaattatagaaaaaagcttatatggtggtacatgtgctaataggggctgtaactctaaggccttgcttgatgctccatatgaaatcaaggcatttgcagataactttgaaggctatggcaagtctggcaattttgaagtggattggcctgcccttatgaagctcaaaagaaaaagaatagcaaacatggctcctttcttggacggcaaatataaggaatatgatttggatgttgcccatggggaaggatacattgtggatgagcatacagtgagagttggtgataagacattcacaacagataagatagtaatctgtactggcttaaagccaatcattcctgacattaagggaaaggagtatcttcatgacagcactgactttttagacattgaagagcttcctaaacatgcaatcattattggaggaggctttgttggaatggagtttgcatcaatccttgctgaggcagggcttgaagcggatgtgatcatcagaggaaacatggccttgaaattcttccatcagccttatgttcaaaatgtaatcgagatcctaaaggaaaagaacattcgattccacttcaatgagactgtaaatgaagtcattaaggatgattctgtggtcattgaaaatccagaggagagagttaatatcttcgaaaacgctcagaatactgatgatgatttaagggacccagatgcaaaggtggacaataaggcttatgaaaatgcattcactgtcaactgtgatagcggacttagcttaaccggcgactatgttattgcagctatgggaagaacagccaatgtggatacaataggccttgagaatgttggcttggattatacaaaagccggaataaaggtaaataactatttgcagactgctgtacctaatatctatgcatgcggagatattgcagatactggaattgcaaagcttgtgactgttgcaatccatcagtccaaatatcttggaaaggcattgttaggggatgctgaggaaatagtctatcctgttgttccggcagttgcatacacaatccctagaatagcaacagtaggtgttccagcctatattgcagaacaaagcgatgaatatgatgtccataggataagatatggaaagtcatattcccttgagcttaaaaatgacacaagatcagaggcaaaggtcattgtagataaggatttaaatatagttggtgctgaaatatatgctgcagatgctgaaaacgtggcaaatatgtttacttttataatcaatcaaaagattactcttgaagagcttgataatatgatttatgcattcccttcaagcagttctgtttgtttgtataaattgcataatattcattataagttctag

SEQ ID NO: 1072 - DNA, 540 bp, Methanobrevibacter ruminantium
atgagaatttgcgtttatggtgctggaagcactcaaataaaatcaaaatatacagatgaagcatataagttaggggaggaaatagctaaaagaggccatgatcttgtattcggaggaggctctacaggaattatgggagctgtatcaaaaggagccatagacaatcatggaaaagtcttgggaatagcccctgaatggatggaagagtttgaaggaatctgcaaggattgtgatgagttcatctatacagaatcaatggatgagagaaagaagctctttttggaaaattcagatgcattcattatagcccctggaggaataggaacccttgatgagttttatgaagtaatcgtgctaaagaagctaaataggcatgataagaagattgtgatatttaatatgtttaattattatgatcatatgcttgagatgattgattttatgatagaagaaggagtcattagggctggaagagataagaagacttttaaaatagctgattcaattgaaaaggtctttaaaatcttggaaagagaatga

SEQ ID NO: 1073 - DNA, 492 bp, Methanobrevibacter ruminantium
atgtcacatccacatgttgagtcaataaacaatatgaacgcctcttctttaattggcattatggaagagtctaaaattacttatgtacgtgaaaatctggatattcatttgcatgctagtcagataaaactgttaaagcaggttagaaaacatgaaaagcctcatcataaacgcattagagttaaacgttatgagcaagcggaaaaatcagacttattcaatttgcatttggatttgtatttgaataattataagaagcttgctaagaaaggattgattgaaatcgatgaagatcctgaaaacggtcttccttatgactgcgctttaactgaaaaaggaaaagaagttttagatgatatcgataggcttgagaaggattgggaaaaagttgtccacattgatgataatgatttggaagctttaaagagaatagctcttgattcctttgaaatctcttatcagcataagaaaaagcaaaactttattttttaa

SEQ ID NO: 1074 - DNA, 321 bp, Methanobrevibacter ruminantium
atgggcgaaaaggttttttatggaaaagggattcgcagaatcaaggaagaagaccctcaattatatgattctattgaaaacttggataagaatatttggaatgccaattcattggattataggactcaaaagttgattgcaatagcaatttcagctacaaatcctgaaagttcttcattcctaaagcaattatccaaggctaaaaaagagcttgatatcagtcgtgatgaagttatggatgttttaaaggtagttcttctgacatctgggatgatgccctttaataaggctttagaagtggtcaataagttatatgactaa

SEQ ID NO: 1075 - DNA, 336 bp, Methanobrevibacter ruminantium
atgagagtgagtattatgaaagaagaagtattctacggaaaaggcatggaaagagtaaaaaaagaagatgaaggtttatatcaagctattgtaggattaaacgaagctgtatggaatggaaaagtcttggattataagactcaaaaattgattgcaattggaatagccgcatccaatgcagatagccgtgcaactgaaaggcagattatgagcgctaaaaaggaattgggagtcactcgtgatgaagttgtagatgtattgaaggttgttttattgacttctggcatgcagccattcaacaaagccttgcagattgcaaataaggtatttgaataa

SEQ ID NO: 1076 - DNA, 414 bp, Methanobrevibacter ruminantium
atgaagatgcctgaaaagatagacaatatgatgtttgcaccttgcggaatgaattgcaagctttgcataaagcacatatccaagtcaaacccatgccctggatgcctgattgacagtccaaacaagacaaagaatgccttaaaatgcaagataaaaaaatgtctggagacgaagagggtaaaatactgtggcagatgcagtgaatttccatgcaagcttatgaaaaagcaggacaagaactataaaaaacgctacaattactcaacattggataatgcaaaaagaatcacttacactggaataaataggataatgcttgaagacaagttaaattgggaatgtccgtcatgcggaggcataataagcattcaagagagagtttgcagcgattgtggattgaataaggaagattaa

SEQ ID NO: 1077 - DNA, 774 bp, Methanobrevibacter ruminantium
atggagatagaacatacacacgaacttatcaaagatgtttttggaatgaatatgaaagaggcaaggcttttagacgatctcttaaagactaacgacctatccgagatattggaattaggctttgcacatggagtgtcctcctgttactttgcatccacacttaaggatatgggaaaaggtcacttgacaaccatagacaatactacagctaaaacccgtaatcctaacatagaggaattattaaaaaagacagggcttgaagaatatgtgacctattattttgaagcggtttcatacaattggagattgatgaagctgattgaggaaaataacggacctatatttgacttttgctatattgacggcgcccacgattggaacaatgacggatttgcattccttttagtggataagctattaaagcctggaggaattataatatttgatgattataactggagcttttcacgaagcccctctatgagccagtctccaagagttcttgccatgtcaaaggaagaacaggaaacccctcaaattaaaaaggtatatgatatgctagttaagacccatcctaattatcataatttcaagatcttaaatgacaatagctgggcattggctcaaaagaaggaagaagaggacctttttgaaaaccaagtaaataagctcgaatctgaaaacaggaaattgagaaaaaagcaaaaggagattatgtcttcaaacagttggaagatgacaaagccattaagacagcttagaaataaaaaataa

SEQ ID NO: 1078 - DNA, 636 bp, Methanobrevibacter ruminantium
atgaaagctaaagagatgatggataagaaatttgtttatgtatcaaaagacgatacaatagaagctgtttctataaaaatggaagaatctaaaagattcactgcccctgttttagataaggacatgaaattggaaggatggattacttcattcaacattacaaaaggcttgcgcgaaggcaagaaactgatttcagaggtaatggatcctgttgagaacatattggccattaaggaagatgaggctgcaaagaatgcggttattgaaatctcaaagcataagctaatcagcgttcctatcattgatgatgaaaataaggtcattggagtatgcagatctgtagatgtggttgattcaatgtcttccctttatgacattaaggttagcaagatttatgaagctatggaaaaagagcttaaaggggttacttgggatgaattgatggaggcttctgctaaaatcagtacaagaaccacaggggtaaagatcactgctgaagaatatgagaagaatattcagaatgccactttcggtgaagcgatttgggcaactggtggacttgaaaagttctttgcaggtcttatttcagttggagaaattgtaattgcacgtaaagtaggccgtgcaagacgctag

SEQ ID NO: 1079 - DNA, 828 bp, Methanobrevibacter ruminantium
atggaaattaaactaaaaaagcagattgaaaccttagagagggaaataactcttaaatctgtagatttagatgaagatattgaagattttaatgtggatattcatagctatgaagataatgacaagctcattaccatttcacctcgctgtgtcagatgcaatctttgtgtagaggaatgtcccattaatgtaatcagttcttccacttggcttaaaagggctaagattggcgaaggctgtgtgcaatgtgaaatctgcgctcagacttgtcctgtttcatgcatttatgtatgggatggggaaactgtaattaaagaggatgattctgtagaatacaccttaaaagagcttaaggttccccatagaaatcttaaaatggaagacatttccataaatcgtgaagtctgcattggctgtggctcttgcctgaagtattgtcctactaatgcaatatcccttagaagcaaggagtttattgaagcccatggagaggaatgccctgaagttggagccattgactctgaacatggtcatatgtattcatatattgataaggaccgctgctgcggttgcggatcttgtgcaaacttatgcattcagggagcaatcactcttaagagagatttaggtcctgtggttatttacagccaccttgatgtaaatcaggacatctgtgtggcctgtgagctatgtgaggataactgtcccgtcggcgccataaaggtggttgatggtgagatagttcttaataatgacaaatgcataagatgtaaggaatgcagttcaaggtgtcctgtaggtgctttgaatttggtttcagataattag

SEQ ID NO: 1080 - DNA, 1029 bp, Methanobrevibacter ruminantium
atggatgaaaaggatttaaaatcttcaaataatgtgactgctgaggatttaggcgttgatgagatagtctatgatgcaatcaatgtagatgtcatcggctttggcgcattgaatgtggataagctttaccgtgttggccatattgcagagattgatgaagaaagcttcatcaaaggagaagagcaatctccaggtggttctgcagccaatacaataatcggcctatctaagcttggatgctccacatcttatatcggaaagatagcagatgatgaggaaggagacctattggaatataaccttatggtcaataatgtctatctgacaaatcttatctatgccgatagtggcaattcaggcaaagtacttggatttgtctcagatgagggagatagggcattatatgtcgaccctggagtaaacgatgacataactattgatgagattaatccattgaatgtaaatgcctgcaagatacttcattacacctcctttgtaggggattcctttaatgctcaaaaggaattgctcaatgtcttaggtgatgatattgtattaagctttgatcctggaatgctatatgttaaaaagggagtcttagaacttaaggaaattcttgaaagaactaatattcttctcattaatgaaaatgaactgaaaatcctctttgaagatcattataaggaaaaattatctgtctctaaggatttgacctttagggacttggcagttttcatccgtgatgatggcattgatacagttgttgtaaaaaggggagaaaatggagtctatgcaataaataaagatgatgatgaggttaaggcacctgcattcaagtgtgaggcagttgatacaactgctgctggagattcctttaatgcaggcttcctgtattcatatcttaagggctatgatttggctaaatcatgtctgattgctaattgggtggcttctaggtctgttcaggcaattggaatatctggattgcctaatctggaagagctggaagagttcatatcttccttatga

SEQ ID NO: 1081 - DNA, 1107 bp, Methanobrevibacter ruminantium
atggtaaaaaaggtttttatcacagattgtgaaggtccattgactttaaatgacaacgcctatgaactagctgctgaatttattgaagatggagataagctattcaagatcatcagtcgctttgacgactacctagttgatgaggttcatcttgaaaactatcatgcaggggacactctcaagcttatcgttccattctataagttagcagggcttacaaacgaaaagatgattgaattttcaagaaataatatctatattgttgatggctctaaggacacccttaaattagcaaatgagcttatggattcttatatagttagtacaagttatggccaatatattgaagctctatgcaattatatgaactttccatttgaaaacacatatcacacacaactagatatagatggggctactaattttaaccaatctgataaaaaatcatcaacaattggagtcaagtctccattgtttattgaagagcttaagaaagtggaggaatttagaaagataattcttgagcatggtgatgaaaatgaggatgacttcaatgtattgtatgacattttctttaatgagtttccaaagcttgaaataaacaagtatatccaaagtgttaagactgttggaggaaagggcaagcagattgcagttgaggatatagtggagagattatctcttgaggaaggttccataatctatatgggtgacagcataaccgatgtagagcctttgcagtatgcaagggacaatggtggtttatctgttagttttaacggtaacgagtatcctttgaatgtggcagagatagctgttatttcagacaatacaattgtaagctcaattcttattgatcttcattccagatttgataaggattatgtaattgattttgtgaaagcatatgctgaaaaaggtccagatgatgcattcaaggattttgaagttgattattcacttgttgaagagtttgaaaagatattttataataggcaggcccctataattgatataattacagatgagaatagggattatctgcttggattaagcaagaagatgagaaatggcattcggggtaaggatattggcggattaggataa

SEQ ID NO: 1082 - DNA, 114 bp, Methanobrevibacter ruminantium
atgattcataaaaaatattatatgaaaaatgaattttatctgttaattaaagagattaatcaaaatatgatgtttatttattcaaaagagtattatccaaagacaggaagatag

SEQ ID NO: 1083 - DNA, 1452 bp, Methanobrevibacter ruminantium
atggtaactgtcaaccctataccaagaccattgcgtgatgttcatatagaatatgagattgataatgaaaagtgcataaattgcagtgataaaccttgcttaggcgtttgcccgattgatgcagtctatcaggatgaaaacaccaaattaatcaagttagatgagcactgctttggctgtgtattatgtagcaatgcatgcccttatgatgcaattcacataaagaagaccttatctgaacctatccgtgaaaatgttccaaacattaataaaaagctttgcagagcctgtggagcatgcgttaacgcatgcaagtctggagctatccatctcaagtccactggaggagaggagatgcacagtgaaatagatgagaataagtgtatccgctgcggatattgtttcagggcttgcccaactgatgcaatcaagtatggagagattcttccaaagacagttaaggaaggtaagactctctgcattgaccatgaccaatgcataggctgcatgacctgtacaaggatatgcccttccaagggagctataaatgtcggaaagaccaataagctgccgttcattgaccctgcctactgtgcaagatgtgaagaatgtatgcatgcctgccctacatatgcaatagactatgttgaaagggaggaggcatttgagtcattcaataaaatcaagacattggagatagcatctgagatattggatagggatataaataagatatccaaaggcataaccaatattgacaatgttttggtgaagctccttgatgacatctctaaggattatcatttcgatgactttgactatgaaaactcaatggacattcgagacgttccaaggggaatggagttttcagatgttgagatattcacatgcacaaactgcagatccattgtagttaatgttacagaatacctgaacgagcgtttgaatgcccagttgaataaggatttggatgttgtaaaggtattggaccttgtggaattcttcccgccttcattaggaattgaagtggtggaggaaaactgcataagctgcggattatgtatggatgtatgtccaaccaagtcaataagccttgacggacctaatccaattaagatagatacagacaattcatgcgtatactgcggattatgtgccgaggcctgtaattttgaggcaatcaagcttgccgaagagttctttacaaacagaaaccatgagatattctttattaaaagagaccttaggggaagaagaaacggaactgtagagataaatcattccgcttgccaattatgtgaggtctgcattaagaactgtccggttgatgcaatgtcagttgaagatgatatgataactgtaaatcatgatgaatgtatttcctgcagaaactgtgagggaatctgtccggtaaatgcagctagagtctctacaatatggcagttcttatag

SEQ ID NO: 1084 - DNA, 1035 bp, Methanobrevibacter ruminantium
atgtcctcaattatttggtatatttatgaatttgcaagaaagacttggatagatggcttctttgatgcaaaatccaaagaggacatagcccataagccagacagattcagagattttcctaatgtaatcaaggaaaactgcattggctgcggatcatgcacagcatcctgtccatctccaaatgcaatcaaattaatcagggattcagatacagaagacgcctttggcctaatctatcctgtaatcaataaggcatcctgcataagatgcgggttctgcgctgaagtatgcccatccactccaaagaccttggaatgcggagagaatcactttatccgtgaagagttcaatatcattccatctaagagaaaatacattgtagacgattacctatgcataagatgtcataagtgcatggacgcctgtgaagtgggagcaatcgaagagtttgatgatagggtttctgtaaatcagtccaaatgcatttcctgcggcaaatgcctagaggcatgtcctgttaaaggtgctatgagaggagtatttgtaaataacctggaagagcaaaagaaaatcatcaaccttgctgtaactactttagaggattatatagaatcaaagcaggatgatttgattcaattaggcactgacaagctatttttagatgaattaccttttaaacctatttttgataagtcactgaatatcctaaatgataaggaagtggttcacgaggttttagaggatgcaatcaacagattgaaaatcagaatcataacctgggacagtgagaactgtaaaaagtgtcaaatgtgcattccagactgtcctaccggagcaatctcctttgattatgacaaggacaccatagtgagggataaggaaaagtgcttaaggtgcagcatctgctatcagacctgtccgtttggagtaatcaagtatttcttagctaagtttaatctagataaaaacgataatgatgaagaggttattcacatctctgtaaaagcttctcaattagcggaaaggagggcttaa

SEQ ID NO: 1085 - DNA, 1128 bp, Methanobrevibacter ruminantium
atgatattaccaattggaccaattcatccaggcttaaaggaacctttaaggcttaagcttcaaactcaaggtgaaaaggttataaaagctgagattgattatggttatgttcataggggtattgaaaagattatggaaggaaagacttggcagaaatgtatttacttatctgaaagaatctgtggtatctgctcatatgaacacacacaaacatttgcagagactttagaaggaatctctggtgtacaagctcctcttagggcacaatatttacgtgtaatcacaaacgagatagacagaatccagtctcacctgcttgcaaattcaacattcttcaagacccttgaccatgagacattgttcatgcatgtacttgccttaagggaatatgcaatggactctcttgaactattaactggaaacagggtcaatctaggctggaatgttgttggaggggttagaatggatgccgatgagcgtcattttaacgctatccttgaaaacatgaagaaaatcgaagatggattcgacagacacgttgcattgtttgaagaggctcctatagttgccttaagggcaaaaggagtcggagtcatgactaaggaagaggccataaaaggccatgcagtaggtcctatcggaagggcttcaggcatcaagcatgacttaagagaggaacattatacttataaagatcattttgacttcaagcctatttggagaaaggagggagacaattatgcccgtactttaaataggctttatgaagtggagcaatccattgacttggtaaggcaggccattgaaaacatgccaaaaggagatataagaactcctgtagacatcccttcaggatatggggaatggagaaatgaggcccctcgtggagaggtaagatatatggctgaaaccaatggcgatttaatcaagaggatttcaattagaaccccaagtattatgaatattgattcatgtgcaagatatatgcttaaggacgttgctacagttgctgatgctgtttcaacctatgcatcatctgatccttgcattgcctgtactgaaagggtggctataactgatattgattctggcaaatataccactaaagacttttttgaggtgaaatag

SEQ ID NO: 1086 - DNA, 462 bp, Methanobrevibacter ruminantium
atgcttaagaaacttaaagatattgtgagaaaaagttcaattcatgtctgtatagtaaactgcggaggatgcaatggctgtgatgtagagttagttgcacttttgtccccaagatacgaccttgaacagtatggaatctatgttcacaataatcctcgtgaagctgatgttcttttagtgactggtgcagttacagaacaatggagagacaatttaagaaggatctatgcaaaggctcctgaacctaagattgtggttgcagttggaaactgtcctcagtccggagatgtcttcgcacaggaagggggaagagttcttgctccggtttcagacttcattccagtggatgcagccattcctggatgtcctccaagaccaagtgaaattctagaggcagtcttgacagttgctcctggagctattgcagctaaaggaagagctcaagatgcaagaaaagattag

SEQ ID NO: 1087 - DNA, 384 bp, Methanobrevibacter ruminantium
atgaatagtgaagaaaaatacgaaatgatgaaattaagagttcttcatagttttaaatgggaaaaggatcttaccattccattatctgaagaatttggaatttccaaagaggaatttgaagaaattcttatgaatcgttttgacatgagtgatttggaaaatatgcatgctacatttgaaatagcaaatagagaaaagataaaaagacagatgcatcttgatttaagactctattggctaagcgatgttgctaaattaatatctgaagaggatgcagatagaatttgccatcaattgacaaaggatgttattcagcatggcaaaaaatacgaagatgccttagatgaaggcagagctcaaatagttgaattattaagagaataa

SEQ ID NO: 1088 - DNA, 156 bp, Methanobrevibacter ruminantium
atgaatgatgaaaaaggaatgagagtattaactttcattagttgctttaggagtctttattgttgcaggtttagcagcatacttccaaagcattctagcatttcctatggctataataggtttaatattcgttccatttatattgatgcaaaatag

SEQ ID NO: 1089 - DNA, 327 bp, Methanobrevibacter ruminantium
atgattagtataggtgctaatggatttcaattgttgataaattatatagtggctatagtagttgcagtcattatcgcttttgccttaagattgccacttcttcccgaaaggccaatcaggttctcttggactactagcgcactgtttccaacccctatttttgctataggaatattggcaatattttattcattaaatgtttattggatttatgacggtctcatcttaagcgtgattgtcggattagcttccgctctctttgtaaagtatggatttgactacatattcccaaagcctcctcaaatcgaagacggggggaatgtctaa

SEQ ID NO: 1090 - DNA, 1494 bp, Methanobrevibacter ruminantium
atgaaaatagaagtactggatacaacacttagagacggagagcaaacccctggaatatctctaaacactattaaaaagttaagaatagccacaaaactagatgagataggagtcaattcaatagaagcaggatctgcaataacctccgaaggggaaagggaagcaataaaggcaatcacctcccaaggactgaatgctgaaatcgtaagtttttcaagaaccctaataaaggatgtagattattgcttagaatgtgatgtggatgcagtcaacattgttgttccaacttctgacttgcaccttcaatacaaactaaaaaagacccaagatgaaatgcttgaagatgcagtgaaggtaacagaatacgctaaagaccatggagtcaaagtggagcttgcagctgaagactcaacaagaacagacatccaatacctaagaaaaatatttaaggcaacaatcgatgccggagcagacagaatctgcccatgcgacactttaggaatcctaacaccacttaagtcctttaacttctataagcaatttacagacttgggagttccagtaagcgcacattgccataatgactttggccttgcagttgcaaacaccttatccgctatcgatgggggagccagcagattccatgcaaccataaacggacttggggagagggctggaaacgccgcccttgaagaggttgtagtctcactatacacattatataaagacgaaagcaatgaaagaaaatacgaaacagacattaagatagatcagatttacagcacttccaaattggtttcaagattaagcaatgcatatcttgctccaaataaaccgattgtaggtgaaaatgcgtttgcacatgaatctggaatccatgcagacggagtcattaaaaacagcgcaacatatgaacctatcatgccagagcttgtaggacacagaagaaaatttgtaattggaaagcatgtgggaacaaaaggcttaaacaaccgactggaagagcttggccttgaagtaaacaagaagcaattaaatgatattttctataaggtaaaggaccttggagacaagggaaagaccgtaacagacacagatttggaagcgatagcagagcatgtcctaaacatagagcaggaaaagaaaatcaatcttgatgagctgaccatcgtatcaggtaacaagatcagaccaacagcctcaataaagttgaacattgaaaatgaagaggtaatagaggctgatgtaggtataggtcctgtagatgctgcaataaatgctgtgaataagggaattaaaagctttgcagacattcagcttgaagagtaccatgtagatgcagttacaggaggtacagatgcactcattgaagtaatcatcaagctcagcagcggagataagatcatatcagcaagagcaacagagccagatattattaatgcaagtgtagaggcttatatagatggtgttaataggttattggagaataaataa

SEQ ID NO: 1091 - DNA, 525 bp, Methanobrevibacter ruminantium
atgaaatacaataaagaattagctaatttagacaatgtagaaatattaggctttaaaggaactatagaaagcattccaaaaacattggaagagatagacaatatcagaaatagctgttgtgatgttggaaccatccaacttatgaatgcagatgcaatagctgggcctaaacaccttgaacatggaacaatccatgcaatgaatgcatttgaaaggggagacaatctagctaatgatttaggaatagagatcttacttagaacatctgcccaaaggcaaatatccaaggcctttaagatacttggactgaaggaaggggaaatgaacatagccgttgtaatgatagattgtccagattactttatcgatgaattatctaatatatttataagagatgatagcgttttagaagccgacgaatcaaaattaatgaagatatatgatattcctgaaaaagaattaaagaccatacatcttagcgacatattaattgataaaacaagcaaattaatcattgcccaataa

SEQ ID NO: 1092 - DNA, 1014 bp, Methanobrevibacter ruminantium
atgaatcttaaatttaaaaaaccatcaagagaaagtcaaatggccatgtctaaagtggctattggtgaagataatattgattatcacaatatggccgaggaaaagctatccaatgccactaatcatcaatatgctaaattggtaaatagtggaaatgcagctattttaacagccatgaattctattgatggagcaattttaatacccgatcaaggagcctggaatggctttaagcagattgctaattttttaaataaggatttgataacagtcactacaaatcaatgcattattgatttggattatctgcaagaatccattaatcaaaatgacgacaatattgatttggatgatgaaaacaataagtctgccctatttttaacaagctttgcagcttatactgcagagcaggacataaaggaaattgcaaagttccttcacaaatacaatattctccttgcagaagatgcctcaggagccatttgtgatatgaaaggagatttggccaatggaaaatactcagacattatcattggatcaacaggctctccaaaaataatcaatgtcgaagatggtggatttattacaacaaatgataattctctcctagaaaagtcaagacttattttaaaaacttcaaaatgctcaaatatcacagcctgtggaatatctcatgaaatagaatatgcaaaggacaatttgaataaaacaattgatttcaccttaaatcttaaggaaaaattaaatgatagcactgattttgaagtatttcactcaaataaaagaggaatcaatcttattctaaagacaaacgaccctaaatcattatcatataagctaagacaggagtttgctctagacagccatggaatgattactaaatgtcctaattacaatagattgaaggaaaaggctgtagctattgagataaaaaatcttgatatttcctgcttaaatgagcataattctaatcaaatattcaacactattaaaaaatacgaagattttgcttaa

SEQ ID NO: 1093 - DNA, 1194 bp, Methanobrevibacter ruminantium
atgagaacatcaaaagctactaaaaatgcatatctggctaaattaactgaaaagatacagatgcagtcagttaatgtaggtcgcgaccttgacggaagcactcctccctcagtgttcatagggcgctggagctatcctaaggtatatgccggacctatgatggtagcccaaactggagatacagctattatggactctccagagagttggattggtcagaataaaacccaagaggatattattggctataggatgaatttagttagaggaaaacagctaatcagcattaaggatttggaaaatccttttgttgaaaagcttcaggacatttcccttgctgcaaagtcaattgacagcgaagcaacctttgggtcccggccaagcggtgcaatgttcaatgaggaaagcatgcctcatggccctagcgctgttatcgagaagtttgatatagatgcagttaaatgggacaggcaactggaaaaaagcttttatgacactgaccttaaggcaagggatgcggtgatgaatctccacaataaggatgttccattctctgccatgcaaaaggcattctctgtaggggcatttggtataaagaaaaacaggagacttgtacctacccgatggtcaatcacagcctgtgacagcaccattgcagatagccttttaaaggaagtgaggcattataatataatggactcatatagggtctatgagttttcaagccttaagaattattatgcaatcatcttaaccccaactgagtggcagtatgaatggtttgaggcattcattaagattcttggaaaggaagagatgatcttttcagattatgagacaaacactgataagagagagtatagctgtgttggaggatgctattacacagctaagatggctgtgctggataagctggccaagcttaagcttcagtcaggtgttatcattcttagggaagcatattcaggttatgtccctcttggagtgttcaatgtgagggaaaacattaaatatgcaatgaatggcgattataaggagtttgaatccttgaaggactctttagcttattgctcaacaaagcttaagatacctataagcaagtatgtaaagcagagcaatctcttaaatgagcttttgcattcacagcagactacattggatgcattctttaagaaatctccagatttgcaatag

SEQ ID NO: 1094 - DNA, 927 bp, Methanobrevibacter ruminantium
atgttagaaccaaaagaatttatttctgatgcgattgcaaagatcaaagaggaaattggtgatgaaaaaaccattatcgctttatctggcggtgtagacagttcagtttgttctgtgcttacacaagaggctattggcgataacttaactgctgtctttgtaaatcatggattgcttagagaaggtgaagcagaacaggtttgcagtgttttcgaagaaaggttaaacttcaaatatatagatgcttccgatgagttcttaagcgaacttgcaggtgtagaagatcctgaagagaaaaggaaaatcatcggcagagtctttattgaagtattcgaaagagaagcacaagctgttgacgctaaatacttagttcaaggtaccattgctcctgactggattgaaactgaaggggaaatcaagacccaccacaacatggcattgccaagcggaatggtcttaaaggtagttgaacctgtcagagacttatataaagatgaagtaaggcttgtaggtactgaattaggtcttccagacagcattgtacaaagacaaccattcccaggtcctggtcttggtgtaagggttgtaggagaccttaccagagaaaacctggctgtctgcagagcagctgatgcaatcgtcagggaagaggttgaaaaggcaggcttggataaggaattatggcaatactttgctgtgcttaccgacactaaggttaccggtgtaaaaggagacgaaagagactttggctatcttgttatcattaggttgatcagttccattgatgcaatgactgcaaccgttcctgaaatgccttgggaagttattagaaccatctcaaaaagaatcacttctgaagtttctgaagtcactcatgttgccttatccattagtgataaaccaccaagcactattgaattctgttaa

SEQ ID NO: 1095 - DNA, 240 bp, Methanobrevibacter ruminantium
atgtttgataatgcagatgacttcaaaaagaaagcactcgacaacaaagacgaattaaaaagagaatacatcaacattcctataggagaagacgaacaaagtttcagaatctctggaattggtgaaaaagctatcaaaattgaaaaatacgtaaaatatgatgacatggtagatgctgttgaatctggcaaggaagaaggtttagaagcagttatcatgaagtttgtagaagaatactaa

SEQ ID NO: 1096 - DNA, 567 bp, Methanobrevibacter ruminantium
atgaaaattttagttattaataataaagggcagtacaatcacaggattcagagaactttacagaacttaaagattccatctgagcttgtaaaaaataaattatccatttcagagattgaagaaaaggagcctataggattgattctagggggaggaccttcaatcgatggtgtaggtaatgcagcagagtatataaaacattttgacattcctattttaggaatatgtttaggccatcagttaatagctaaaacttttggtggagaagttgccacttcagacactgaaagctatgctcaagtaaaaattaatattaatgaagaaaatccactttttaaaggtctcacatcacctatggatgtatggagttcacataaggatgaagttcattctcttccggaggactttgatatcattgcagagtcttctctttgcgatattgaagcaatgaagcataaagaaaaagagatttatggaattcagttccatcctgaggttcatcacactccaaaaggtgagtatatctttaaaaacttttatgaaatttgtcaaaattataatgagtaa

SEQ ID NO: 1097 - DNA, 948 bp, Methanobrevibacter ruminantium
atgatttttatggaaaattatgatattataattgttggggcagggcctgcaggcctaactgctggcatgtatgccggtaggcagaattcaaaaaccctaataatcgataggggatttgctggaggcttaggtcttgaagtgcctttgatgcagaattatccaggttttgatttgatttctggaatggagctcattcaaaagatgaaggcacaaactgagaattattgtgaaataaaggaaaatgaaaccattcaatctatagaaaaaactgaagatggtttcctgcttaaaaccagaacttctccattattgatgtctgaagaaagtgatgaaataagggagtttaaagcaaaggcaatcattttagcaactggtgcctctcacagacacttgaatgttccaggggaagctgaatttttaggtcgtggagtggcctattgcgctacctgtgatggaatgttttttatagataggactgtattgatggttggcggaggaaacagtgcagctcaagaggcactttatctaaaaaaccttggatgcaatgtaaagctcgttcacagacgtgatcagttgagatgtgagcatcatcttcaaaaagctcttgaagaaaaggaaatagaggttatctggaatgcaactgtagaggaaatcaaaggagatatggtcgtagaatcagtaagacttaatagaaatggccaagaggaagattataagacagatggcgtctttattgcaatcggtgatgatccttccaatgagattgctaaggaattaggaatcgaccttgatgaggatggctatatcataaccgataagaggcaggcaacaagtgtggagcatgtttattccgcaggcgatataactggtggagtgaaacagtgggttgtagcttgtggagaaggtgctgtagctgctatatctgcttataatgatttgaatttgtaa

SEQ ID NO: 1098 - DNA, 1848 bp, Methanobrevibacter ruminantium
atgatgggtttagagattcaccagcaattgaatacaaaacacaagcttttctgtccatgttctaccgaacttaccgatgatgaatttgatgacggtatcatcagaaacctaaggcctacccaaagtgaattaggccaaatcgacagagctgctcttcaagagtctctaagacacatgacatttaagtacgaatcatttaacaatcacacctgtcttgttgagatggatgatgagcctccacatgcattaaacagggaagctcttgacatatgtatcacaatcgcttcacttttaaatatgaaaatggtggatgagttccatacgatgagaaagcaggttattgacggcagtaacactggaggattccaaagaacaggtcttgcagcaactgacggataccttgacactccatacggcagagtggctatagagtcattaggccttgaagaggatgcagcaagaagaatcgactcagatgatgagtttacccaatttaggcttgacagattgggaattccacttgcagaaatcactacagacccttccatgcaccatccggaacagattaaggaagttgcatatatgatcggacaggtcttaagaagcacaaatgttaaaagaggccttggaactatcagacaggatgttaacatcagtatcacaagaggtgcaagggttgaaatcaagggtgttcaggacttggaccttatgcctgagattgttgaaagagaggttcaaaggcaattggcacttgcagacattaaggatgagcttattgcaaggaatgctagcgttgatgatacaatctacgaccttgatgaggtctttaaggacacctcatctaagatattgtcaaaggccaactgcataaaaggtataattcttagaggctttgacggcctcattggaaaagaggtccagcctggaaggagattcggaacagagctctctagctatgctaaaaagatgggtgtttcaggtcttttccatacagatgaattgcctgcttatggaatcaaggcagatgaagtggatgctatgaaagagttccttaaaatcggccctcaagatgcaatcatcattgtagcccacgatgaggatatcgctataaatgccttaaatgaggtaatcagaagggcagagatggcatttgacggcgttgtagaggagacaagaaaggcattggatgatggaaacacagaatatatgaggccgcttccaactgcaaacaggatgtatcttgaaacagacattccattgttccagattactgatgatatggttgagccaattaaaaacaaccttccagagcttccagatgctaaaaaagaaagaataaaagcagagtataagctcagtgaagatttagctagccaaatagtcagaagacttttaggagacacttttgagtcattattggctagggttaaagtggatccaaccactgttgcttcagtccttgtatcagaccttagggatttaaagagggaaagatataatgttgatgtattgactgaagacaaacttgtagaagtgttctcccttttagaggcaaataaaatttctaaagatgctttaaaggacctgcttgtggaagtctgtaaaaatccagatgaaaatgttgaaaagatagctgaagatgctaaccttacccttttaagtgaggaagaggttagagcgataattcatgagatagctcaaaataatgaatccatgattaaagagcgtaatatgggtgctatgggtcctttaatgggcatgagcatgaaacagctaaaaggaaaagcagatggtagtttggttaataagatagttagagaagagattcagaatattttaaatggttaa

SEQ ID NO: 1099 - DNA, 1308 bp, Methanobrevibacter ruminantium
atgacttataaagaaatttctaaagagtttttggataaggcaaatgttaccattggtgatgttatcaaggtgacaaaggaagatatttcctatgaaggaatattgcttgacagatccgaagacgcaaaggacgcttatattgtaattaaacttgatagcggttacaatgttggagtaaacattgaatctgcaactattgaacttattgaaaagggagaccaacctaaaataggatttgaaggagatacaattgaaaaagacccaaacaaacagaacatatcaatcatctccactggaggtacagtctcttcaatcattgactataagacaggtgcggtacaccctaaattcacagcagaggaccttcttagagcaaaccctgagcttttagaccttgcaaactatgatgtgaaggcattatacaacatattatctgaaaacatgaagcctgaatactgggttaaggcagcagaatcaattgctgacgatataagcagtggggctgacggaattgtaattgcacatggaacagacactatgcattacacttcagctgcattgagctttatgatcaagactcctgttcctatagttgttacaggtgctcaaagaagttcagacagaccttcaacagatgcattcctcaacatctacaactcatgtggcgctgcattatcagacattgcagaggttacagtgcttatgcataactcattggatgacggagactgcgcacttcataagggtacaaaggtaaggaagatgcacacaagcagaagagacaccttcagaagcattgatagtgaaccaatagctcttttaagggatggaaaggtaaaatcagtcaatctcccatatgtcaaacgtggggaaaatgaattggaattgaatacagacattgaaagcaaggttgcacttatcaagtctttccctgggataagctctgatataattgactatcatatcgataagggatacaaaggattgctcattgaaggaacaggacttggacatgttccagattatatggttgattcattgcaaagggcaaatgacgaaggcattcctgttgtaatgacctcacaatgtctatatggtacaatcaatatgaacgtttacagtacaggaagactattgcaggatgctggtgttatttccggtgtggatatgactccagaatgcgcttatgttaaattggcttgggctcttggtcaaagcgatagtttagatgaagttaaaaagattattcaaaccaatattgctggagaattgaatgaaagttcttcacttaagtatttcttgaactag

SEQ ID NO: 1100 - DNA, 840 bp, Methanobrevibacter ruminantium
atggaattaactagctacttaagtcaaataatcatttcagtgataatatttatcatcctatgcctcctagcaaatcaagtgaaaaaaataatagaaaagcattacggaatacatttaaatcctaatgattttcttcctattgaagagattaaatcattaatgcagctttattttttgctcataatactgcttatttacatatgcatcatgaacttcttttttaacaattttggaataagcggggaattgatctttatcaattcattaatagacattatcttatcagtatttctagtgacaatatattatgacggctctacaagaggcaagataattagcatattccttttgcctattgtatccatatcctatatcctctttggaggatcattaattagatattgggatttcatccgcatccctatactgctctatctggttgtgattttctataacaagtttatagattatacagaaagaaataaccttggaaaaacaattctaatcctattaagcattatctatacaggaattctcttaacaatagtcttagaaaaacaaaatcctatagatgcagtggcaatggttacaaatgcaattacaagcaatggatatgccgctttaggagacagcgaaggaggagtcttgactagcgtattcctagcttggggaggatatattatttcaggagtcgctacagccacattagctgcagatatcattcatagaaactctagaaagaaatttaggaatatggaaactaagatagacaatcttgagaataagattgataatctggaacggataattgttgaatctcaaaaggagaatgaagaataa

SEQ ID NO: 1101 - DNA, 429 bp, Methanobrevibacter ruminantium
atggcagacaagtttagcaaagagaagaggagttatatcatgtcaaggattagaggcaaggacaccaagcctgagatccttgttagaagctacctgttctctaaagggcttcgctttagaaagaatgacaagcgatatcctggcagtccagatgttgttctgcctaaatacaatactgttgtctttgttcatggctgcttctggcatctccatgagggatgcaagcatgctaagattccaaagtcaaatgttgagtactgggaaaagaagctttatggaaacagggatcgtgataagcgcaataagaaggagcttgaagatatggggtggaatgtgattacagtttgggaatgcaatctgaaaaaggataagcgtgaaaagactctttttgagctctacaatcagataatctctgaggatgaggactga

SEQ ID NO: 1102 - DNA, 615 bp, Methanobrevibacter ruminantium
gtggtggcagccttatgcacagaggcacttggaaaggacagggttatcggagtccttatgcctaatggagtgcaatcagacattgactatgcaaagcttcttgtaagtcatttagacataaagcattacataataaatataagggatgctgtagatggtgtattaagtcaaatgaccaaatctggcattgaaatatccgaacagacaagaatcaaccttcctccaaggattagaatgtccaccttatatgccataagccagtctaacaacggaagggtggcaaacaactgcaatctttcagaagattgggtgggatatgccacaagatatggggatggtgccggtgacttcagcccactttcaaacctgacagtaagtgaagttaaggaaattggaagaagccttaatttaccgagtgagatagtggataaggtaccgattgatggactctctgaccaatctgatgaagagaagcttggatttacttatgatgtgttggataagtatatacgaactggcgaaattgaggacaaaactacaaaagaaagaatcgattacctccatgatttgaataagttcaagttggagcttatgccaagctttgaatataagtga

SEQ ID NO: 1103 - DNA, 1494 bp, Methanobrevibacter ruminantium
atgactgatattaaggtagataaaaacgtagaaaaggcaaaatctagccaagtagaagaaagagttattaaaaagccagaatccttatatgattccttcccaagaaagggaaatgacatttacaatacccactactgcgcaggatgcggtcacggtattttacacaagctaattgcagaagtcatggatgagctcaatatacaagatagatgcgtcatgatttctcctgtaggatgttcagtattcggatactactatttcaactgcggaaatgtgcagactgctcacggtagagctccagcagttgctacaggcatatctagagctgaagacaatgcaattgtaatgagctatcagggagatggagacttagcatccatcggtcttaatgaaacattgcaggcagctaaccgtggagaaaagattgctgttttctttgtaaacaatacagtttacggaatgacagggggccaaatggcacctaccacacttgtgggagagagaacagtgacttgccaaaacggaagggaccctcattatgcaggatatccattacatatgtgtgagcttgtagacaatcttaaggcacctgtatttattgaaagggtgtctcttgcaaaccctaagcttattagaaaggcaaagatagctattaaaaaagcccttatgattcaaaaggaaggaaaaggatactcatttgttgaagtattgtctccatgcccaaccaatataagaagggatgtaaaaggagttgaagacttcctaatcaatgagatgggtaaagagtttccagtaaagagattcagagacctatctaaggaaagggctcctgttgaaaggaatgtgagtgacttctctattgaatcattggataaggcatttggcgtagacagaacaaaagaaatcgctgaagttgaagatgactttgaagactgcaaggtaaagatagtcggtttcggaggccaaggagtcttaagcacaggtcttacccttgctcaagctgcatgcagtgagggaaaagaagtgtcttggtatccaagctacggtccggagcaaaggggaggaacttccaactgttctgtaacaatctcagcaaagactatcggatctcctgttgtagaggaatgtgacgttctaattgcaatgaacaagccatcccttgaaaagtattcaatcgatgtaaaagagggcggaaccattctttatgattcaagagcaggaaactacacaaatgacaatcttgatgttaaggataacgtaaagattatttccattccagcaagagagatagcaactgaaataggcaatgccaaggctatgaacactgccattttaggtgctcttatggagcttggaaaggacagccctatactatctcaagatgcctttgccgaaggtattaaggaaacctttgcagctaagccaaagcttattgatataaatctaaaggtattggatgcaggggctaaatggttgagagaaaacattaattaa

SEQ ID NO: 1104 - DNA, 1167 bp, Methanobrevibacter ruminantium
atgtctaatcaaatagttaaaggaaacactgctgtaatcatcggtgcattgtatgctggctgtgattgcttcttcggttatccgatcacccctgcaagcgaaatcctccacgaggcttccaaatactttccaatgcttggaagaaaattcgtccaggctgaaagtgaagaggcatctgtcaatatgatatatggcggagcttccacaggtcacagggtaatgagcgcttcatcaggtcctggaataagccttatgcaagaaggattcacctatttagctggtgctgagcttcctgcagttatcgttgacgttatgagagcaggtcctggtcttggaaacatcggccctgaacaaggggactacaaccagatagtcaaaggtggaggccatggaaactacaaaaacattgtccttgcaccaaacagcgtacaggaaatgtgtgacttgacaatgaaggcatttgagctttcaaacaaatacagaaaccctgtagttgtccttgctgacgctgttcttggacagatggcagagccattgaaattcccagaggaagctgttgaacctgtaattgacaattcctggtctgtaaggggaagcaaggaaaccatgaataaccttgtaacttcaatctttttagacttcaatcaactagaggactttaatttccaaattcaggaaaagtatgaaaaaatcagagagaatgaagttgtctatgaagagtatatgcttgatgatgcagaatatgtaatcgtttcctatggtacaagcagcagattatccagaactgctgttgacattgcaagagaaaagggaattaagttgggattacttagaccaatcacattattcccattcccagaaaaaagaatcaaggaattagcagatgaaggtgtccaattcatctctgttgaaatgagtaacggtcaattaagagaagatattaaggcagctgcaaattacgacgaggtccatttggtaaacagaatgggcggaaacgttatagagcttaaggacattctaaatgaaatataccaaatggtaggaagcgatgaacgccataaggttgacagtgaagacaaggaatttgacaaatcctacctctcagataaggactataaggaagaattggataatgacaactatcacaatcacaggatggtagattag

SEQ ID NO: 1105 - DNA, 255 bp, Methanobrevibacter ruminantium
atgaaagtaaatcaaatcaaaccataccctatcattagcaaaaacaactgtaaggcatgcttaagatgcataactgcatgtaaggaaggctgccttaagttaagtgaagagattaatgatagcggatatcaatatgcagaatatacaggagaaggctgtatcggttgcggggactgttattacacctgcccggaaccattagccattgaagttcatattcctaaaagattaagaaaatcagcaggtgatgcctaa

SEQ ID NO: 1106 - DNA, 1665 bp, Methanobrevibacter ruminantium
atgacatctttaataggaaactttgtaaacagagttgattttaaatcctataaggatttttacgataattttgaatttaatgtaccaaaggacttcaactttggttttgatgtagtggatgagtatgcaagaatagatccggataaaaaagcattaatctggtgtgacgattatgaaaaaagggtttttacctttttagatatgaagaaattatccaatcagactgcaaacttctttaagtctcaaggaatcaataagggagatgcagtgcttcttacacttaaaaacagatatgaattctggatctgtatggttgcacttcataagataggtgctatagctatcccaactactcatatggtaaagcttcatgatatagtctaccgtgttgaaagcgcaagcataaagatggtggttacagttgaagaggaccaattgcttcctgattttgagcagtgcgaaaaagaattggacatagagcttaagaaagtcttagtgaatagctttagggatggctggtttaattttgataatgaaatcgctaaaatgagcgaggagtttgaaaggccaactggagatgaggcaacccatgaggatgagacattccttatctatttctcaagcggaaccactggaaaccctaaaatggttgcacatgctcatacctatgcaatcggacacctcataactgcaaaatactggcataatgtcgttgaagacggtgtccaccatacctctgccgatacaggttggggaaaggctgtttggggtaacctttatggacaatggattgcaggcgctgcaatatttatctatgactatgtaaggttcaatggtttggatttaatggaaaagatcattgaaaacaaggtaaataccttctgtgcacctccgacaatctataggttcctcattaaggaggacttgtcccaatttgacttttcagacattcaatatgcaactaccgctggagagccattgcctccagaggtatttaaaagatttaaagagttcactggccttgaaatcaaggaaggattcggtcagacagagaccactctctcccttgcaaccttcatttggatggaatccaaaacaggttgtgtaggcaagccttcaccggcattcaagataggccttttagatgaggaaggaaatcctgtggatattggttctgaaggagaaatatcatttgatgtatctggaggaagacctgtaggtctgtttaaggagtattatagaaaccaagaaaagaccgatgaagcttggtacaatggatattaccactgtggagacactgcatatgtggatgaagacggatattacacctttgttggtagaaatgatgacattatcaagtcttcaggttatcgtatcggaccatatgaagtggaaaatgcagtaatttcccgcccttcagtcttggaatgcgccataaccggtgttgatgatgaattaagaggccagattgttaaggcaacaatcgttcttgcaaaaggatacaagccaagtgaagagcttaaaaaagaaatccaagatcatgtaaagcatgagaccgctccttataaatatccaagaatggtagaatttgtcgaagagcttcctaaaaccataagcggtaaaattcaaagaaaaataatcagaactaggaaatcaatttattaa

SEQ ID NO: 1107 - DNA, 561 bp, Methanobrevibacter ruminantium
gtgattgaaatgagtgacgtaaacaaagatatcggtatgagaattagagaattaagagaattatccgatattacaacagaagatatggctaatgaacttgatgtagatgaagaaacttatatttcctatgaggacggtattattgacattccagctagtttcttataccaaattgcacatatttttaaagttgatttagctttgattcttactggtgaagaaactcgcatgacttattttgatgtaacaagagcagataagggttttgctgttgacagaaggaaagaatataagtatgaaaacttatgcaagaaattcgttcataaaaaagctgaaatgtttattgtaactgttgatcctaaagaagatgctatgccttccttaaattcacatgccggacaggaattcaactatatccttgaaggaactgtgaagattttcattaaggacaatgaaattattttaaacgaaggagattctattttcttcgatgcaacttgtgaacatgctatggttgctttaaatgatgaaaccgctaaatttttagctgttattatgtaa

SEQ ID NO: 1108 - DNA, 369 bp, Methanobrevibacter ruminantium
atggtaaatagagaagactgtgttatctttaaacaggaatacggtaatgaattattagtaaaccaacaatatgttaaaatcagagctaaggaagaaggattcatgtcttttaaccttagagtccctaaagaagatatggaaggtattgaaaacttctttaaagggtttaaaatcccagaaccaattcttatagacattgcatgtacaggcaatattcattgttactttaaaggaatttcaccaatcataaataagccggagtattcctttatttccgttagcgttcaggaattgaaaaaggaaattgttgaagaggaacaagagattggcatccctgcacatgaatgtgttggctgtgggcttcactaa

SEQ ID NO: 1109 - DNA, 717 bp, Methanobrevibacter ruminantium
atggcaaatataatagagattaaaaaccttgtgaaatcttatgaaaatggtaacatcaaggctttaaatggcatagacttgacaatagaggaaggagagtttgtatcaataatcggaccttcagggtctggaaaatccacattattaaatatgctaggggctttagacatagcagatagcggaagcataaatgtggcaggctatgacttgacagtcaacaagaatctaaacaagttcaggggagagaagataggatttatcttccagcttcacaatctcattccaaacatcagtgttgttgaaaatattgagattcctatgtactctcaaggaaaatcatctaaagaaatgagaaaaaaggctcttgagctattggatatggttgacttaaaggacaaggccaatatgaaaccaaataagttatctggtggagaacgtcaaagggtggctattgcaaggtctttggcaaatgacccttcaatcattttagcagatgaacctacagggtctcttgattctaaaacaagcacaaagatactcgaacaaattcataagttgcataaggagaagaatattactttaatcattgttactcatgacatgactgtggctaagttagcagatagggtaattgaagtgcttgacggtaaaatacttaatgctgaagaaagtactctcttggataataagatagagataaaagttaatttgttttaa

SEQ ID NO: 1110 - DNA, 1035 bp, Methanobrevibacter ruminantium
atggatttattattaatcttatcacaagaacatgataaactgccattggctgaattaagagctgtcttggaaacagaagaaatagaaactgaacttgaaatggtatgccctggcttggttttattaaaagagcttgaggaagatgtttttgatgattattatagattgcttgttagaagattaggatatactcatgaagtccatcaattgattaagacagtagactgctctgatttggaatctgaagttaaatcaatcgattggtctgagtttattgatgagaactttgctgttagggtaaaaaggttcaatagtgaaatagacactgtagacactgagagaaaaataggaggatatatcttaacaagtactgacaatatctctgtaaacctatcaaatccaaaatcttttattagggttgtagcttataagaacactatctatttatgttatggcaaatatcaattgaataaaaagtattttgaagagatgaaacctcataagaggccatttttccatccaggatgtatgagtcctaaattagctagatgcatggtaaatctctcaagagtcaaggaaggagatttggtcttagatccattctgtggaactgggggaatccttatagaagcaggtctcataggagcaaaggttgttggctgtgacattgactggagaatgaaaaatggaactgcaactaaccttgaatatgctggaataaccgattataaaactcatgtggtggatattcgtgaaatggaaatgtatgaagaggctgatgcagttgtaaccgacccaccatatggaatttctacaaccacttgtggagaaggtgcttctggaatatttaaagaatttttagaatccattgaacacagcatgaaagaggatgcacttttagtgatggctagtcctgattcattagacatagattccctatttaaggatgtaggctttgttttattggaaaggtatgcgattaaaatgcatagaagcctgactcgtatcatttctgtgatagctaaaattgattaa

SEQ ID NO: 1111 - DNA, 1299 bp, Methanobrevibacter ruminantium
atgagttttgattatgatgtagcaattgttggtgcaggacctataggctctagtttagcttatgaacttgctcaaaacggtttaaaagtttgcttaatagataaaaagaaacgtataggtttgcctttgcaatgtgcaggaattgtaaataaaagaatttcttcattatgtgatattccaaaagaattaatattaaatgaagctaaaggtgctttcatacattctaaaaatcattcattaactgtttctaaaaaggaatctcaagcctatgttttagatagggttgcatttgatcagtacttatttaatcgagcaagggagcatctggacacttatctatcttcaaaggtagtggatattgatacagagcttgggattgtccaattcaaattcgattgtgagattaaaacaatccgctccaagattattgtaggtgcagacggtccattatcactttcagctaaaaaggtcaattctaagttaaattattttaatgcaagccaatatcttgttaaggttgataagattgatgaaatgtcctttgtagatttatatgcttggggagatctctttccgggatttatctgggcaattccagtttatagtaatatttataggattggattgtttagcgaagatgactataaaagccaatccaagatgctggatgactatctggaaaatgaatttagatatgatgaatatgaagttttagagaaatataagggtaaaatacctatttatgataaaagtaataaattatttaagaataggcttattttaataggggatgctgcttctcaagtcaaaccaaccacaggaggcggaattctaattggattagagtctgttcaatttgcaaaagatgctattttaaatgctttaaatactttagactttgataaaattgattttgatttagttggtggttctgattcaaatgaggatgattctgatttaaatgatgctaattataaagaagaattaaataatttcttagatgaattgtctaagattttagaaaactatcagaatgattttgaaaatagattttcaaaagagtttgaaattcaatttaaagtccaaaaatcattatctaccttatctaatgatgatttggattatgtattaactaaattaaaagaaaaagatgctgataaattaatatctgaatatggagatatggacaatcaatccaagttagttaaggaattcttaaaaagaggcttgattttttcattggctcctaagattcataaaaaggaattggctaagatttggttgttaaataaagattaa

SEQ ID NO: 1112 - DNA, 297 bp, Methanobrevibacter ruminantium
atgatatttgttttagcaaaagcaatacctaaagatgaagaagcttgtgaaaaaattgtagaatttgcacaagacttgattgaaaattcaagaaaagaagatggaaacatcgactataacttatattccaacacttgtgatggaaccttgttgtttgttgaacaatgggaatccaaagaaatattaggagctcatttacaaactgaacatttcctcacctttggaaaaaatatagcagatttagttgcagctgaacttgacattgctgtttacgaagcggaagcaactgatctttaa

SEQ ID NO: 1113 - DNA, 684 bp, Methanobrevibacter ruminantium
atgaaagtagcggttattggtggaactggtccacaaggtttaggaattgcaaaaagattcgctattgaaggtgttgaagttattgtaggctctcgtaaggaagaaaaagctttaacaatagtggaagaaacaattgaagaacttaaagattatgatttaaatattgtaggtatggctaatgaagatgcagcaaaagaaggagatattttaattttaactgtaccattagcagcacaaaaacctactcttgaaggaattaaggaattttgtactgataaaattgtattggatgcaaccgtccctcttgaaacagctattggtggcaaaccattccgtttcattgacttaatggaaggttcagcagcagaaagaactgcaaaaatattggatggaacaggtgcaaaggtaatctgtgcattctgtaacattagtaattctcatttatccaatattccaaatgaaatcgattgtgactgtttaattgcaggagatgataaagaagcaaaagaaatcgctaccgaacttattaataaacttcctggagttaaagcaatcgacactggaattttagaaaaatcaagaattattgaaaagatcactccattattaatcggattaaacattaagtatagatcccattatggtggtctcagaattactggaattcctcaatttgaagattaa

SEQ ID NO: 1114 - DNA, 825 bp, Methanobrevibacter ruminantium
atgattattagtgaagaactttttgaaggaatttgcgatttggacgattttaacctattgaaatttgttatcagctctgagctacgattgaaaatattgtttagcctatatgaatccagcaaatcaattaaggagctggagtctgagattaatagaaaatccggcaatatttccagaggtttaaatgaattaaaatcctgtaaattaattacaaagcttccaaataaattgtttgccatatcatctactggatttttggttgcaaagaatctggaaaatctaatggataatatgggatctattgagtctaatggagaattttgggaaaatcattccatcaaatcaattcctaacaaatttctaaaggaattatccatctttaataactctacattagttaaatcaaccattacagattttgccaagcctattaatctatacttggaaaacattaaaaagtctacatatatctgcatgatattgcctgtattttctaaaatcttcaatgatgccgttaatgacgctataatcgaacatgatggctatttggatttggtgactacaaagaacatttatgatttgtcaattaaatcagactctgacaataagattaagtccttggtgagagataagaagatcaagttttatattgtggatgaccttccaaatatcttctttacagtttcagatcagtttgcttcattataccttttctttgatgatgttgtatttgacaattctgaaatgcttttattggaagacgatttaaatttaaatgatgcctatagattctataggttctttaagaatgaaattttaaaataa

SEQ ID NO: 1115 - DNA, 861 bp, Methanobrevibacter ruminantium
ttgacaaatcgatttgaagaagaaaattttcttgaacttcaagaggatataaagtttcttattaactctgaaattcgtttaaaaattttaggctgcttgtataattcctctgcttcaataaaacagatagaagcaattacaaattatagttacagttcaattcttgacaatatcaataagctggagcaaaaaaagtttatttatagcatagaggataaattttatttatataataaaacaaggctgaaattaaacagcattctctattttaacaaatcagccacatttttaagagagaattctgatttcttaaatcagtctcttatagatattaactctgaagctataaaggatttatctgctcttgaaggctctagactaattgaatctaataatattgatttatttaaatctactgaaatctttcaacgttctttaatgggatttaaatttttaaaaggtatcttcccttatttccatccacgacatgatgatattattagctattggatagacaatgattgcactgttgaattaatacttcctgatgaggtttcagaggctgtaaagaatttcattattgattatgttccaaaaagccctggaattaagaatagatttgtcaaattaaaacctaacgaccataacattcaattggcttttacagtgtctgataagtgttttgttttggctttatatactaaatctggccagtttaatcaaaatgcagtgctggtttcaactaatcctgaagctatcacctttggattaaagctttttgaggaatatgaagaattatgcggagattatgtttcactagagaatcttatttatcctaatggaagggaggatgattattag

SEQ ID NO: 1116 - DNA, 1275 bp, Methanobrevibacter ruminantium
atggatgattctccaaatgaagttcctgaattaaatcgcccaactaaaatagataatatagaagagcctaaaacagttgacgagcttcaaaaggaacttgatttacttaaagctgaaaaccaaaaaaccaaacgcaatcttatgtggaaggttaggaaacttgaaaaagacaagattctaactgaaaatgaaaaaatacgtttggaaagagagttaaaatcattaagaggtgaagttgaaagattcagatcaccgcctcttgttatcgcaactatcactgaaatcattgacgattccagaatgactgtaaaaagcagtaccggacctagtttcctaatcaattattctaaattccttgatgaagacctattgaagccaggttcaagggttgcacttaatcaacagacctttggcgttgtggaagttttgccttccgaaaaggatgcaaatgtatctggtatggaaattgaagccaaacctgatgttacctatgatatgatcggtggtttggatgaacagattatagaagttaaggaaactgttgaattacctttaaaacatccagaattattcgaaaaggttggtatcgacccaccgaaaggtatcttattatacggaccacctggaaccggtaagaccttgcttgctaaggcagtagctaatgagacaaacgcaactttcattaaggttgtcgcttctgaattcgttaagaagtacattggtgaaggggcaagaatggttagggaagtgtttgagcttgcaaaggaaaaggctccaagtatcatcttcattgacgagcttgatgcagttgcagcacaaaggcttaaaagttccacaagtggtgatagggaagttcaaagaactcttatgcagcttttggctgaattggacggttttgaatcacgtggagatattggaatcattggtgcaaccaacaggccggatatcttagaccctgctttgcttagacctggaagatttgacagattcattgaagttccagctccaaatgaagatggaagacgtgaaatccttaagatccatactaaaaagatgaatatagatcctgaagttagaatgagtgagttggttgagcttaccgaaggattatctggtgcagatttaaaggctatctgtacagaggcaggtatgtttgctatccgtgaggaaagagaccatatcattaaggcagactttgaggatgctatcaataagattatgggtaaaaacaagacaggtaccttagatgataatggcggagtaatgtttggatag

SEQ ID NO: 1117 - DNA, 504 bp, Methanobrevibacter ruminantium
atgaactgtgaaatttgtggtaaagaaatcgaaggaaaacctttaagaactaaaattgatggttcagttttattagtttgtaacgattgtgcaaaattcggtagggtccaaagggacactccccttgagagaaaatttgtaactcgtgataagaaaggtagaaaagaagcaaatgctaaaactaggcctaaaaagacttatactaggaatgaagaacctatggatgagcttgtagaggattttaaccttgttgttaggcaagctcgtgaagctaaaggttggaaaagagaagagttagctgccaaaatctatgaaaaggcttctgtaatcaacagaatcgaatcagggaagattttacctgatttaaaattggcacgtaaacttgaaaagaccttaaacattaagctaattgaaaaatatgatgatatggatttagaagcctataagagttcttctgctggtcctaatactttaggaagtattgttaaaattaaaaggaaataa

SEQ ID NO: 1118 - DNA, 423 bp, Methanobrevibacter ruminantium
atggctttgatattaattagaggagaaaacaacgcaaagatattaaatgcaattgccgatgtagaaaggcatgcaaatctgactttagaaacaaaaccgaaaaaagtggatcctaaatttgcagacaaactagttgaaaatgttttaaaatcacctttaagaactaaatctaaggttgcaaccgcttttcgtgtaaaggaagacactactatagctattcttcaagttaaaaagatacatccacctgcacatattgttgtggtaagcaatacctatgatggctatagggaattaagcaaaatcataaatgaaggcaaggtctttaaaggatattattccaataaatcaagttctggaacccgaatgaaagattataaattaactaagacctcgactaatgagggtttaaatatttatatgtaa

SEQ ID NO: 1119 - DNA, 1125 bp, Methanobrevibacter ruminantium
atgattatacctactttaggttgcccttccaactgttcatattgttggggctctgaggacaatgcagaattaatggatatcgatgtaattaagcaaattgttgaatggctagctgattttagggatgagccggttcacttcaccttccatggaggagaacctttacttgcaggctatgatttttataaggaagctcttcctcttttaaatgatgcagagacccatgaaactgaaggtttttcattgcaaagtaatttatggcttttagatgaggaaatggttgaattattctctaaatataatatagcaataagcacaagcattgacggccctaaggagatcaatgactatcaaaggggcgaaggctactatgacaagacaatgaaatcagttaagttagctacagaccataacattcaaattaattttgtatgtaccttcacatcctactctaaagatttttcagatgagatatatgatttctttaaggcaaatggattgaatttaaaaatccatgctgcacttccatcccttcgtggaaataatgcagatccatgggctcttcctcaggatgagcatggaaaattgcttattgattggctggataaatatctctatgacttggataagtttgtaattatggatttggaccatatcgctaaaagcagcttaagaagggttggaaccctatgtacatttaatgattgcatgggaactacattggctgttggccatgatggttcaatctatccttgctatcgttttgtcggaatggatgagtatataatgggcaatgtttatgacaagccatctatggagactttagagcaatctgaagcttgggaaaagcttatggaatttaagaatttcgtagatgaggactgtgcagactgtaaattcattaaattctgcagaggaggatgtccgtataatggaatagtggctacacaatctccaagggcggtggaccctcaatgtgaagcttataagatgatctttggtgaagtctcaagaagagcaaatgaagactttaagaaaaatgcaatggcggcatttggtggtgccccaagggttagaaaagaaggagatcctttttcaataatggatttgatgactaaaatgtaa

SEQ ID NO: 1120 - DNA, 219 bp, Methanobrevibacter ruminantium
atgaaatttgaagatttaatggcaaaatgtccaaaatgcggttctcaagataaaactgctgttagaagatttattgacaatcatcatgctcatgctgaattaaaagagtttaaatgtgataactgcggttttgtttatgaaactggaaaagattatgaggataatgaagacgaaacaattaaaaaaggcttaatcaaagaattaaataaaacaatgtaa

SEQ ID NO: 1121 - DNA, 1047 bp, Methanobrevibacter ruminantium
atggattattccattaaaagtggcatatttggccttgttgtagcagatgcattaggagttccttatgaatttaaagacaagcattactgtgatatgaatcctatgactgatatgattggtcatggaacctataatcaggaagctggaacatggtctgatgacagctctatcgctttagctacattagatggattaactgactatgaatttggcgaagatgatgttgaaggcatgaggattaagaattttgccgaaatcattgattatgattcaattgcccataaattcgcagattggctaattaataagaaatacactcctcatggagatgtatttgatgttggaaacacaacaagccatgcaatctattccttttatgcaggtaaggtcgatgcattgcatgcaagtggcgcaggtaaaaaggatgctggaaacggatctttaatgagaatattgcctgtctcattccttatttacttcttatcattgaaatatgactttgatgaggaaggtgaaatggaagcaatccataatctgtcttcaattactcataggactttaagatgtcagatggcttgtggaatctatataaaaatcgctattgaactcttaaagaattattttgactctgaagatgattcaaacttgttggaattagttaataatggtataaattcagcaaaagaatattatgaaactaaagaggagtttgctcatgaattaagtatttatgaggacgtattctcccttgagattcaagattttgatagggatgatataaaaggttccggatatgttgtagaagctcttaaggcagcattatggtgtcttttaaataatgatgattataaggacacagctttggcagctgttaatttaggtcatgatactgatacaactgcagctattgctggtggattggctggaatttattatggatatgacaatatcccatctaattggttagataagatagcaaaatctgattatattggagaattgtgcaataatctttctgattatctttttgagattttggaggattaa

SEQ ID NO: 1122 - DNA, 780 bp, Methanobrevibacter ruminantium
atgtcgttagaaattctaaaaaaaggcacaagtgaaaactttttgctaaagcagatcattaggaaaaattttacaagcaaatataaggattctgttttaggcatactttggagttttttcaatcctttaatcacaatggccctattgacagcgattttttcatcagtctttgcaagaaacattgaaaatttccctgtttacttcttaacaggccgttgcgttattgattttttcaatagcggaactaaaatagctatgacctcacttaaaaagaacagcggtattttaaataagatatttgttccaagatatgtatttgcattgggaggaatcttttctgaattcattaactttttaatgagtatgatagtgcttattgtgattatgattgtaactagggcgcctttccatttatatgctattttttcagtcattccaatagccatcctattcatactgattttaggagttggactgacactttccatactctgtaccaaatttacagacattgaatatttatataagatatttaccagcttattagtatatgcttgtgcgatattttatccaatagacattgttccacaacctatcagacagtatatggaattaaatccgatttatggtattatagctcaattcagagagtttgtcatgtatggaagattcccatcaacaaagttgatgctgataacctttttaacttcaatagtaatctttataattggagtaatcatatttaagaaataccaaaacagaattacattagagttataa

SEQ ID NO: 1123 - DNA, 1230 bp, Methanobrevibacter ruminantium
atggataataagaatgaaaatagcaataagatcaaaacccaattaataccatctattcataatactgtatctctccaagcacacctcactacaaaagatggagagcctattgtaggagaggaagtcgtatacaaattatattccatagacaaaagttttcttacccaatattctcgtataacaaatgaagaaggcttagttcaccttacattaaacataaagcataaggtctatattgaaatctgctatgagggcagtgaaaaatacgaatcaaacaatgtaatgacctttaggacaaagccttcagatgatgagaaaaacgttaaaacaaaacatccccttcaagttcaaagagaagaaaagttggaacaaaagaaaattgaagagaaaaagaaaaatctattggatttccaacaaaaacaaaaagatttggaaagtgtggatgaggacaacatagccatagagctaaagaatgtcaatttaagttttacaatcggatccgataagatagacaacttaaaggaatatgtaatccgtaccatcaaaagaacaaaagaaaagaaaacaatattcaaggctacagatgatgtgtcctttaagatatataaaggggaaaaggtcggcttaatcggctttaatggagctggaaaaagcacattgcttaagatcatatcaggtgtctacactccagatgacggagaggttatagtcaatggaaaaatagcgcctttattatccttaggggcaggatttgataagaattatacaggaagagaaaacattttcctgaatggagcgattttaggatacaatgaagagttcttaaactcaaaatacgatgaaatccttgaattttcagagcttggacaattcatcaaccttccagttaaaaactactcctctggaatgctttcaaaattaggattttcaatagccaccatagtggaaccggacattctaattcttgatgaggtattgggagtgggagacgttaatttcaaacgaaaaagtagagaaaaacttaattcattgattgaatccaatattaccgttttgcttgtttcacatacaatcagtgagataagaaatatctgtgaaaaggccatctggcttgaaaacggtaaaatcagagaaattggagaagtcaatgacatttgtgataagtatttggaagaagctaaaaaggtaagcgatgataagactaaaaaattaaagcctaaacggttttaa

SEQ ID NO: 1124 - DNA, 414 bp, Methanobrevibacter ruminantium
atgaattttaaaattaaggcaaagggacataagaacgttttatccctacataaatccacttttgaaataaccaaagacaaggatctctccttatctggggattgcattattggtttggacattgataagtgcatgttggactttcctaaggaatttaaggaaaaattagcaaatgatgagactatagtgactgtgaaattaaaaagcccaaatgcttatgatgagatagtgggatatggccatcatgacttgactttagaccatccgacagatattgtatgcagaaaaagtgattttatatgctcaagaactttaatgattaaatctgataaggcagctattgatttaaatagagatttaatcgaggatttggctaatggtgaatcattagatgtggaaatcattttaagctaa

SEQ ID NO: 1125 - DNA, 939 bp, Methanobrevibacter ruminantium
atgataataaatactggtttaagaacagacatccctggattttttagcaaatggttctataatagaattgaagaggaatatgtctacgtcagaaacccatactacaaaagccaagtatttcattacaagcttaatcctgaactggttgactgtataatattctgcactaaaaatccaaagcctatgctatcaaatctagacaagatatctgaatttaatcaattctggtttgttacaataactccctacaaaaaggaaatagaacctaatgttccatcagtaaacaaagtcataaaaagttttaaggaactttctagtcaaactggaaaagaaagcgtatccttaagatatgaccctattttaataaacgataaatacactttagattatcatattgaggcatttgaaaaaattgcaagctccctatcagaccatacaagcgaaataataatcagcttcattgacctatatgaaaagaccaaaagaaacttcccacaagcaagagaagtttctaaagaagaaagactaattataggcaaagagttttcaaatatagcaagagaaaacaatcttatcttaaagacatgcgttgaaggaaaggaattagataaatttggaatagattcttcaggatgcatgactaaagaagttatagaaagagcgatacataataagctcgatgtaagagttaaaaaatcaagaaacagaccatgtgactgtcttttaaacaatgatattggagaatacaacacttgcaatcatggttgtctctattgctatgcaaattcaaacaagcaattggttaagcgaaactttaaaagacacgacccagattctcctatattgattggaaatataagagaagaggatgaaattaaagaaatcaatcaggaaagttttttaattcatgaagatacagttcagacaaaattattttaa

SEQ ID NO: 1126 - DNA, 459 bp, Methanobrevibacter ruminantium
atgaaaggaacatattgtttaataatatctatgaaaaaatcggataaaatcaaaataggcaatctatatccagaagcttataaattcaagaaaggatattatgtctacatcggctctgcaatgaattcacttatctcacgcctaaatagacacttatctgatgataaaaagatgcattggcatatagattatctcctaacaagcgaatatagcgaaattcgagagatactttttacagactctgaaaaaagaatcgaatgtgatctagcaaacgaaatagctgaagacggattggaaattgaaggatttggctgttctgattgcaattgcaattcccatttaatattcttcaatagaaaaagagatgctttaagaagggttaaggacgcttatgaatcattaggtattgaatattatgatttaaaatattttagaaccatagataataaaaaggattag

SEQ ID NO: 1127 - DNA, 2883 bp, Methanobrevibacter ruminantium
atgaaaataatatttaaacgttgtttagttttaatttctttaatttttattttaattttaactttaggacttgtatcagcttcaaataatattaatcaaattaatgatatgaattgtagtgtatatgaagattatagtgaaaatattatcacagcagatctaaattcaaattctaatgagcttaattcagattttgcttatggtgattcagattctgaagaaatcttagatgaaccctctcaaaagcttaaaacaggttctgataattctgattttaaagacatacaaaatttaatcgataatgctaaggaaaatgatgtaattgagcttagcggaacctatacaggtgattctctaattgtagtaaacaaatcattaacattaaagtcttcttcaagtgcaacacttgatggagaatttctaaatgaattaatggctataaatgctccaaatgttatattggacaacatcaactttataaatgcaaattacactggtcttagtgtaaataacaattatgtaaccattcaaaattgtaattttgacggctgtatcaatggagagttaggatgtgccttaataatccatgggaataatgtaaatgtattaaactctaattttacaaataatgttgcaaataagtccagctgtcatcatacggatggggcagcaatttatcttattggaaacgattgccaaatcgataattgcagttttataaataattggggttataattttgaaacatcctcatcaggaggagccatttggataaagggaaataatattgtaattaacaattcatatttctttaataattcagctaccgctgaagttggatggacattccatggagaggagataacctatttggcagatggatatggcggagcagcctttttagttggaaaaaatgtaaaaataatcaattccctttttgatagtagcctttcccatgcacaagggggagcattgtattataagtctgcatatgattgttcaataatcaattcaacctttttaaattcattttctgttggagagggaggcgtaatctatttaggtcagaatattgatgggctaatgatagattcttgtaattttataaacaacactgcagacggattggatggagttttagtcaaatacaccgatttaggcagtgttttatatgcttcaaagttcgctgaaaatgtagtgatcactaattcaagtcttttaaacaataaaggaacctctgcagtctactttttaggaaataacttaaatatttcaaattcaatcatagaaaataataatctatcaactgcagtaatttatatgaatggaagtatgaatgacaatttctggtctaagaactttgattctgcagatgagtttaagaatgattgcttcattattcgagataatgagtctcaagttcctgatacttggtttaacttagtttgtgatggcttggatagtttaaaggcgaagggtgtatatgattataatatgtcctttgtcttaaaggatgcttctttagataatcatgcctcaaaaatttcattaacaaataatcttcctaattatcatattaacttaaaaaacagtgcaaagaataagattaatccaaatgaacttgtgattgttgacaatcaggcagacttcacttatgattatattgagtctgctaaggattccattgatgtttatgatgattataataacttgatcttatcaaagaaggttttatctggaataacttatattaatgatagtggaaatgatacaaaagaccttcaggatgcaattgatagtgccagttctggttctttaatctcattatccaataagacttatgttcttgatacaatattaataaataaggatattcacatatctggagaagaaaatacaactgtcatgctttcaaatagttcagattatatatttaaaatctctaattgttctgctgcaaactattctgattatggcatagccatttcaaacattaattttattttagataatggagatattgttgccttagctgaagctgtaaatgggtctggctcattatctattgatgttgcttcaataaagataacagacaactcatttacatctcgtgaaggtgtagtgagggaatcaattactattcttgagcttgatagccaaagggctgtcttagcacctacaagaaatatttctatttctaataattccttggaaattggaatgaatccatttgattttaatgtaaagtctgtcataaatggctctgatgttagagtggatgtagggggcaatttagccagcaaaaaagccagtcagatcatttgtaaagatatggtcactaaagccattgcaagcaatgtagattcccgctctggagaatactttaatgtaagcttaaaggatagccaaggcaaaccattgcaaaataagtttgttcagataggttttaatggtgctgtttataatagaaccactaatgaaagcggagaacttagattacagataaatcttgcttataaaggagtttatacatttgccatatcctatttgggtgatgatgagtgcaacggttcatttgaagttgctaagataactgtaaatcctcaaagtcctattttaatggccaataatgcaaaatataaggtatcatctactaaaaccctttctgctagttttaaatcaatgaaaggaagtcctatttctggcaagacaatcaaattcactgtagatggcaagacttatagtggaaagactaattctaatggtattgctagtgtgaaagttagtttaaataagaagggaacttataaattcactgccaagtttgcaggagataatacttttgcagcggtgactaagtctgctaaggtggttattagttaa

SEQ ID NO: 1128 - DNA, 804 bp, Methanobrevibacter ruminantium
atgaaaagacagaaaaaaatagctatctatggaaaaggtggtataggtaaaagtactacagtagctaatattgcagcagcttacagtgaagacaataagaaagtcatggttattggctgcgatcccaagtcagatacaacaagaacattatgcggtaagagaatacctaccatagttcataccttaaaggacaataagaagccagagcttgacgatttggttttcgaaggatttaataaaatcaaatgtgttgaaagcggagggccagagccgggggtaggctgtgcaggtcgtggtgtcattgttgctatgaaacgtttggagaacttaaatgcctttgaagaggaatttgatgtaatcttatatgatgttcttggagatgtggtctgcggaggattttcagttcctctaagggaggattatgctgatgaggtctttatagtatcctctggagagtatatgtcattatatgctgcaaataatatatcaagaggaattaaaaaactaaaaggaaatcttggaggcattatctgtaactgcaaaggtatagacaatgaggaagagattgttaattcttttgcaaaggagattggcactcaagtgattggagtgattggcagaagcaatctcattcaaaggagcgagttggatgcaaagactgtagttgagtatgctcctgaatcaatagagtctgatgcttatagaaagcttgcaaaggacatttttgataatgataattattcaactccacagccgatggaagatgaagacttcgagaatttctttaaatcatttattgattaa

SEQ ID NO: 1129 - DNA, 1260 bp, Methanobrevibacter ruminantium
atggtagagttattggctccagcaggaaattttatttcattaagcagtgcattaaagaatggtgctgatgcagtttatattggtcttgaagaccttaatatgagagttaatgcaagcaatttctctttagaggatattaaaaaggccagtgaaatgacaaaggaatatggggctaaattatacgtatgcacaaatacaataatgaaagataaggacattgaaatgctaaaagatcaattgccatatattaaggaatatggagctgacggtatcatattgtcagatatttcactgattgaattggcttctcaaaatggccttgaagcccacgttagcgttcaggaaaataccactaatttttatgcccttaagacccttgaaagattaggtgcaaaaagagccatcctatctcgagaattatccttagatgaaataaaggaaatcactagaaaactaaaggagtcagattccactattgaaactgaggtttttattcatggtgcaatgtgcatggcgatttcagggcgctgctttttaagctatggcctttatggcagaagcgccaattgcggagattgtctccagccttgcagaaaggaatggaaattaagctttgaggaaaatgaagatgatgatgtaatcaatttctcagactgtgatgacgaatccttcataatatcccaatcatatgacgattcctataggacaaatttcttctctccaaaggatatggcattgattgaacatattccggagcttattgaagcgggaatcgattcatttaagatagaagggagagcaagatctcctgattatgttgccgctgcagtttccgtttataggcaggccattgatttgtattatgatgacccagataattggcaatttaatcctgaatggatggaagagcttatgaaagtcttcaatagaggctatgacacaggattttattttgacactccttatgagatcagcgaaaacaatcaatccaagttcattaaaagggatattggaaaggttgttaattattataataagattagggttgcagagcttaagatatgggatgatctggctcttggtgaagagataatgattcagggacctactacaggttcaatcacacatgtgatagagtctatgcaaattgatggaaaaagtatagaaaaggcagaaaaaggttccaatgtggccattgccattgatgaaaaattaagggaaagcgattttgtttataagttagttcctcgcgaggagtaa

SEQ ID NO: 1130 - DNA, 1443 bp, Methanobrevibacter ruminantium
ttgaaagataaatgtggtatagttgggattcactccaaagactcctctaaggatgtttctcacttaatttattatggtttatatgctttacagcataggggacaagaatctgcaggaatagctacttataatattaattatggcttgaatttccattgtggaatgggattggtaactgatgtttttaataactccctaatcaatagcctaagcggaaatgtaggtattggtcatgttagatattccactacaggccaatcaaaaatagagaattcacagccatttttcacagaattggatgatggatttatcgctatggctcacaatggagacattgtaaactcaggttctttaagagacgaattaactaaaaaaggataccaattcaagtcaggcactgattctgaggttgtctgttatttaattaaagaggcatatgaaaaagataaggatattctcaatgttattgatgctgtttcccaaaagctaattggttcttattccttagttattttaatcaatgatgaattatatgttttaagagatcctatggcaatgaaacctttgattttaggccaaaccaatgatcattttgttgtagcatctgaatctgttgcatttgatgtcatagatgctgaaatcatccgtgacatggcgcctggggaattgctatactttaagaataatgagattaattcctatatcttgccatctgcaaaaggttccagaagagcccattgtatgtttgaatatgtttacttcgctcgtccagacagtgtcatagatgatagaagcgtttataatacaaggcttagaatcggtgaagcattgtttaaggaaaaccctattgatgcagatttagttttacctgttcctgactcctctattcctgctgctatcggctattcaagagcttcagggattccatatggtgagggattaattaaaaacagatatgttggaagaacattcattatgcctactcaagaagagcgtgaaattgctgttaggctcaaattgaatcctttaaaacatgaattggttggaaaacgtgttgttgtaatagatgacagtattgtaagaggaacaacttccgaatctttagttagaatccttaaggctgctggagctaaggaagttcatatgctaatcggttgccctccggtaatcgctccatgttactatggggttgctttggcaactaaagatgaattgattgcagctaatttggaaattgaagaaatcagaaagcagttaggtgctgatacattaggttatataagcattgaatctcttatcgaagccattggcatagatggggacagcttatgtttaggttgtattactgaagactatcctactgaaatacctgaggatttagaggctgaatcctattatgattactatcaagacctaaaggatgctgttgaagaagatgaatag

SEQ ID NO: 1131 - DNA, 1413 bp, Methanobrevibacter ruminantium
atgaataatgattttgaatctgatgaatttaattctaatgacaataacaataatgattttgaatctaaattggtagatattcgaattgttttaactgatttaaattatattgaagcgatttctaaagcagtaagtaactttgatttatctaattttaatgtaaacatttcatctatcattccaagctcagatattgaaattgcaaaaaacactatcattggtgctgatttggttttaatcgccacaagttctgattttgaaggaaaagaattatactcaaactttaaaagggctttaaagacggattataattttgttgaatatttgaaattgccttctttagatgaattggaggattacgattatgattatgacgaggacaatacctttgaagatgagatagccaattccataattcgtgcaggattatacagcatttctaacttgtcatcaatcaataaatctaaaaaagcttattataatgttaaaaaggattttgatgatagccgtttaagatttgaaaagattacaaaggaaaatgatatattattgaatgaatcaaagcaaattagagagaaaaacgaaaagcttcgtgaagaggtaaaaatacttcagaaagatttagataacattaaatcagattattcagatttaaaatcaagatttgaaagcattcactctaaaaactctttggaagtcttctctttaatggaattatggcaagatctctttaatgaaacttttacagaggagatttataggtttattctaattagcacagacaatttccgccctaagaatcttatgattggacaaggtgcaatttgtgctgaatcaaaggaagatgcaatggattggttaaagattattaaaacagcttttattctctcagacacaaataagcaagagttgaattttaataatttcaatagcaattttaaatttgaagacttggattccaatatttcaagcagtcagaatttggattccaatatttctaacaccagatatgatttggattctaatgattctaatcttttttctagtttagattctaatatttttaatgcgcataattcagattcttcagatgaatttatttataatgaaagatttgaaggaaataataattcccaagaggaatttagacaattagattttgatgatgctttcgatttaaatgacaatgaaggtcaagaatcatttaatcaaaatgatttagataattcctataattctaaagatgacccttcagatgagataaatgttttcaatctaaagtctcttaaaggatttagagaggaatctgatgaagatgaatccgatgaaaatggggattactcttatgatgaggatgatgatttagatgaggctgatgacttgtttaatccattctcaaatatttgggattaa

SEQ ID NO: 1132 - DNA, 1191 bp, Methanobrevibacter ruminantium
atgattaaaactgatgtattggttattggtgctggacctgctggttcttcagctgctagatttgcagctaaaggcggcgtagatgttattcttatggataagaaatccgaaataggcgctcctaaaagatgtgctgaaggtgtatccaaaaagacttttgataagttagaccttgaaatggatcctcattgggttacccaagaaattgcaggggtcagattagtcgctcctgacggaactgatgtatggcttgatgaagatgttattgacttgcctgaagcaggatatatcctagagagaaaagtctttgataagcatatggctatggaagcaggaagagaaggagctcaaattaaaatcaaaacccaagctaaaggcttgaaaagagaagaagatggaagcttcactgtaacttgcgaatccatgggtgaaacctttgacattaatgctaaaataattatcggtgcagacggtcctgaaagccatgttgcaagatgggctggcttgaaggcatacaccaaacctaaacacatggaagctggagttcagtttgaaatgtgtaacgcaaaaatggaaaagagcaatgttcttgaattctactttggaagcgtagctcctggaggatacttctggcttttccctaaaggagatgacattgtaaatgcaggacttgctatcattccagatatggctggagataaatccgcttacgaatacttagttgatgctgtaaacaactgttatgctactaaagacgctcagcctgttgaattgaatgtagggggagaccctgtaggcgggcttgttaaggaaatgtacggcgacaatatcatgctttgtggagatgcagcaagccaagtaaacccattgactggtggaggaatcaccaatggtatgatgggcggaagatttgctggtgaagtggctgctgaagctattaaagcaggggactgctctaaagacttccttaaaaagtatgaagatttagttaaagaagaaatgggtcatgaaatgcaaaaatacactaaagtctgtgattacttatggactttagatgatgatgacttaaacagcatcgctcatgctttccaagatatggaatttactaaaataagtacaactgagcttgttaaggctgttattaaggttcaaccaaaagcagctttgaagttaggtaagttgttcttataa

SEQ ID NO: 1133 - DNA, 165 bp, Methanobrevibacter ruminantium
atgattgtaaaagactggtgttcatactgtggctgctgtgcaggagtatgtgcaagaaactgcatagaagttaaagaaactgctttagtcatctctgatgactgtaatgattgtggaatttgtgtaaaagcttgtcctttagcggcattggaattagaagaatag

SEQ ID NO: 1134 - DNA, 606 bp, Methanobrevibacter ruminantium
atgcctagttttttaaatatacgtggaaataatcatgaccctaaagaccctcaattaattagagacggtattaaattgggagtaaactataaaagattctctaaagagccagtattaggtaaaaatatcttgcttagatcaaatactgttatctataatgatgttatcataggggatgactttaaaactggacataatgttgttgtaagggaccataccaccattggtgatgatgtgttgataggtacaaacactgtcattgaaggtggatgtaagatcggaagtaatgtaagcatccaatccaatgtatacattccacgaaacagtataattgaagataatgtatttgtaggtccttgtgcctgttttaccaatgacagatatcctgttagagttgaatatgatttgaaaggccctcagcttagaaaaggatgttctgttggtggaaatacaacattcttatctaatattgaagttggagaaggagctattgtagctgcaggtgcagttgtaacacgtagtgtgcctccttattatttggctataggtactcctgctaagattaagccgttgccaacttctttaagagttccgaatatgatttaa

SEQ ID NO: 1135 - DNA, 312 bp, Methanobrevibacter ruminantium
atgacaaaacatgtatgtcctcgttgtggttcaactaatgttgagtggattattccacaaaactggtctaaatgggaatgcagggactgttcatacacaggacctattatagacgcagatgatgatttaattgctgaaattaaagcagattgggaagaaaataaagaaaaatacatagaagaagagtatgctcgtgctgaacagatggcctcaggtgaagatgaacgtcttgatgaagagatggaaattgcagaagaggacgagctttcagacgaggaattggataaaaaactggaagaattggatttatga

SEQ ID NO: 1136 - DNA, 1161 bp, Methanobrevibacter ruminantium
atggtttatgatgttagtgctcttttaagtcatattaatcgaataaggcgtgagataggtcatgaagaggttaatatagaaatcaaagaggttttatataatattgaaactaatgagatgtggataatcaccaatgaccgtccggataagtctgcagttattggaaaaggaggatgggttgttggaagacttagagaagagcttcaaataaatagcattcatgtggaaagctattcagactttttgacaaaggaatataggatgggactgtccttaaataagctaaaaagctttgtcacaacagaagatttaagcgatgatgttaagctttcattatacaatctaatcgatttattaactatcaaatcggataatttgtattcatttgactttaagtcctattttgatgatttggaaaatggcccttattcgtatttcgaagcagagaaacctgttgcaattgtagccttatctggagggacagatagtagcttttcattgatacttgcaaaaaaattaggatttaatcctatagctgttactgtagatcctggaactatcgtgcttccaaatcaattcaaatataatattgacaagttaacaagcaagctggatgtaaagcatgaatatattccagtggcttatgatgatataattgaagattcacttgcagggagattccatccttgcggaaggtgttcaaaaagaatagaggaaactttatttaaatatgctgtagataatgatattcctatggttatatttggagatatgctgtcaactggcagtcaatgcataactgagcagttttatggtgaaaactctgaagattcagtttctcaagatttagaagattcagtttcttcagatttagaagattcattcaatactgaattagaagattccatcaatcataaacttattagacttaatctaccggctgcactagctgtttccaaattggagaataaagctctaacaagccattatgaattaaataaatttaagggattcggatgccctttattgtatgaggttcataagaagtttccacatatgaagaagtattccattcaaagaatcctaagggaaactcgttcaagtgctttagagcctggtgaagctttagatttaatttggagtttttataaaactgattag

SEQ ID NO: 1137 - DNA, 1419 bp, Methanobrevibacter ruminantium
ttgaaaattagaactggaagacttgaaaaggaaatgactgatgaagctgcggtatacacatcttcattggaatttgacagatttatctttgatgcagacattcgctgcaattacgctcatacatccatgcttaaagctcaaggaatcattgatagcgaaatagctgataagattcttgatgcattggataagcttagtgaagagggctttgatgcccttgaatttgaccattccgttgaagacgttcatatggctgttgaaaactatgttacaaagcttgtaggtcctgaagctggctttatgcacactgcaaaaagcagaaacgatcaggtggctacagacataaggcttcttttaagggatagaatcagcgaaatacaaattgcaatacttgaattcattgaaggaatactggagcttgcaaaggaacataaggaaactgtaatgatcggatacacccatttgcagcatgctcagccaattacattggcccatcaccttatggcgcatgctcaggccttaaaaagggactaccaaagattggatgacacctataaaagggtcaatctaaatcctctcggctcagctgcaatggcaaccacaagttttccaatagacagagaacttacaacaaggctcttaggctttgatgattatcttgaaaactccatggatggtgtatcatcaagagaccatattgcagaggccgttttcgaccttactgcactgtgcacaaccctatcaaagatatgtgaagagcttgtcctttggagcacatatgagtttggaatagtctcaatggctgatgaatactcatcaacttcctcaatcatgcctcaaaagaaaaatccggacgttgctgaagttgcaagatccaaatgtgcaatagtaaacggagagcttatgacaatcctaaccattcttaaggccatcccatacacttataatagggatttgcaggaaatcactcctcatttatggaatgcctgtgatgtggcctatgatacattaaaaatcacaaatcatatgcttttaactgtcacattcaatactgaaagatgcttagagcttgcaggtgcaaactttgcaacagcaacagacttagcagacattatggttagggaaaggaagataccattcaggacagcacataagattgtgggaagaattgtaaatgaggcagttgctgaaggattgaatccaagtgaaatcgatggagcttatgttgacaatgtggcagatgagcttggatttgataaattgaatttagatgatgatttgattcacaatgccttaaatccaattgaaaacgttaagataagaaatgttcctggaggaccttctcctgaaatggttcaattggctattgacaatatgaatatatttttagatgtggagtttgaaaaacaaggcatctga

SEQ ID NO: 1138 - DNA, 159 bp, Methanobrevibacter ruminantium
atggctactaaaaaagaattatacactgtagaaggggacaaaatcgtaagaaaaaacccattctgtcctcgttgctctgaaggcgtattcatggctgaccacggtgacagatacgcttgtggtaaatgtggatacactgaaatgaaaactaaagaatag

SEQ ID NO: 1139 - DNA, 315 bp, Methanobrevibacter ruminantium
atggaaattgaaattactgaaaagaaagaaaatattttatttgacagaacagaagttaaatttaactgcttatatgaaggagaagcaactcctaaacttttagatgttaaaagcaaattagttgctttacttgacactaaaaaagaattaatcgtagtagacaatattcaaccaggatatggtgaacctaaagcaacaggatacgctaaagtatacggaagagaagcatccttattagatgtggaaaaaccaagcgtaattgctaaaaacaaagaaccagaagctcctgctgaagaagaagatgaagcggaatag

SEQ ID NO: 1140 - DNA, 501 bp, Methanobrevibacter ruminantium
ttgtttagaatagatgagaattcaatagatgaatttaaaaaaccattaggagtactgtatcctgattttgaagatgcaattcctatgataaaggaggctagttttctaatctctgttggtgatcagactattaaaaatcttcttgataacgatttatatcctaatttagggattattgacaatcgtattcaacgtaaagatcataatcatgatattattcgtacagaaaacattctaaaggcggacaatcctgcaggtaccattactgaagacctatgggaaaccatagagttagctatttcttcaatacttgaagatgaggacactcgcattattgaagttaaaggggaagaagatcttgcagttcttccatgcttattaatcgcacctgaggatgctgttatattatacggccagccaaacgaaggcttggtctttgttaatgtttttgaagctaaagacaaggctaccagactcatgactttcttcaataaggaatag

SEQ ID NO: 1141 - DNA, 183 bp, Methanobrevibacter ruminantium
atggctttacaagcttgtacacattgcaatttattaactgaaaagcaacaatgtcctgagtgtaagaatcctacttctacaaattggagtgggcttttaatcattacagatcctgaaaattcagacattgctcgcgagttaggtataaaaaaagcaggagaatatgcattaagagtaagataa

SEQ ID NO: 1142 - DNA, 570 bp, Methanobrevibacter ruminantium
atgacaactattgagggaactgtaagaattccaccacacagatttggtgaacctcttgaagatgtagctattgaaactttaaatgagtcctacaacggtcagcttgataagaatttaggtttaatagtcggtgttaccagcattgaagaaatgggtgaaggagttctcattatgggtgatggagctgcttaccacaatgttatctttaacgctatcttctttaagcctgaacaacaggaagtcgttgaaggagaagttattgatatagctgaatttggtgcatttgtaagaatcggacctatggatggtcttgttcatgtatcacaagtaactgatgattatataaattatgatcctagaaacgcttctcttatagctaaggaatctaaaaagatccttactgaaggagacagagtcagagctagaatcgttactttaagtcttaaaggaaaaaccgttcaagaatctaagattggtcttacaatgagacagcctaatttaggtaagtttgaatggattgaaaaggaaaaggcaaaagctcttgaaaagaaaatggctaaggtggaataa

SEQ ID NO: 1143 - DNA, 402 bp, Methanobrevibacter ruminantium
atgaaatctgaatcaagagaagtttttattgatactaactttttcatgattcctttccaattcaatgtggacatcattgaagaatttaaaagggtattgcctaattataaattggtgacaaccacatttgttattgatgagcttaagggcttaaaaaataacaataaaggaaaagtcagattagcagcaggtttgggattaagaatagcccaatctgatgagatagaaattaggaatgtttctttaaatgatggagaatctgtagatgatgctttaattagaatttctaaggtattggctacaaatgacatagtcttaaagaaaaaagctaaaaagaatggaatcgctttggtctttttaagacaaaagaaatatcttgctgtagatggttatttggcttga

SEQ ID NO: 1144 - DNA, 1224 bp, Methanobrevibacter ruminantium
gtgaaagtacaatctgatgttaacataggactggtgggccatgtcgatcacggtaaaacaactcttactaaagcattgtctggtgtatggacagatactcacagtgaagaaacaaaaagaggaatatccattcgtttaggatatgctgatattgaatttagaaaatgtccaaattgtgaagaacctttatgctacactactaaagaagtctgtgaacattgtggcagcgaaacagagcttattaaaaaagtatcatttgtagacgctccaggacacgaaaccttaatggctactatgttatctggtgctgcaattatggatggtgctgttttagttattgctgctaatgaagagtgcccacagccacaaacaaaagagcatctaatggctcttgacgttattggcgtaaaagatgtagttgtagttcaaaataaggttgatattgttcctagagaaagggctattgaaagttacaaagaaattaaggaatttgtaaaaggcacttgtgctgaagatgcaccgattattccagtttcagctcagcaaggagcaaatattgatattcttattaaggctattgatgaaacaatcgtcactcctgaaaaggacttagataaacctgcaaggatgcatgtggccagatcttttgacattaataagcctggttcccatccagataagattaaaggtggagtaatcggaggtagtttgactcaaggtactcttaaaattggggacaccattgaaatcaggcctggaatcaatgttaaggaaaacaagcagaataagtggatcagcttaagttctgaaatcattggtcttcaagcaggaggagaggctgtagaggaagtgggacctggaggtctcattggagttgctaccaagcttgaccctgcattgactaaggcagattcattatccggttctgttgcaggtatggaaggcaccttgcctgacgtattgcatagctttgatatgaaaacagaacttttggaacgtgttgtcggtactaaggaagaaagggatgttgacccaatcaagcttaaggagcttttaatgattaactgtggtacaacaaccactgttggtattgttaccagtgttaaaaagaacattagcgttgatttgaaattgcctgtctgtgcagacaagggtgatagggttgctttatcccgtagggtcggcgcacgttggagattgattggttttggtatcattcaatag

SEQ ID NO: 1145 - DNA, 390 bp, Methanobrevibacter ruminantium
ttggcatttaaaattgttgtatctgaaaaagaattaagctatcaattagaagttgaagaagctaaacaattaaacggtttaaccattggcgaagaatttgatggtcaaattgtaggattagatggctatactttaaaaatcactggtggtagtgacaaaaacggttttgctatgaaaagagacgttgatggtcctagaagaatcaaaagtcttttaactggtggagtcggctacaaccctaaagttgatggtgttaaaagaagaaaaactgtcagaggaaacactatttccgaagacatcgttcaaatcaacactattgttaccaaagcaggtagcaaatccatacctgaaatcttaaatcctgaagaagaagaggaagcagaagaataa

SEQ ID NO: 1146 - DNA, 1791 bp, Methanobrevibacter ruminantium
atgaagattagatcaccaattgtatctgttttaggccatgtagaccatggtaagaccacattattagattatattagaggtagtactgtagctgatagggaagctggtggtattactcagcatattggagctactgaaatacctattgatacaattaacgaaatatgtggagaatttatttcaaaactagcaattaaagatacaattccgggattgttttttgtagatactcctggacatgctgcattcacctcacttcgtaagagaggaggagcattggctgatttggccattttgattgttgacatcaatgagggcttcaagcctcaaacatatgaggcaatcaatatcctaaagatgtataagactccattcattgttgttgcaaataagattgacaggctctttggttgggaaactcatgaaggagcttcctttatggaaagctataataaacaggctccaagaatcaagtctgatttggacttgaagatttatgagcttatgggcaagcttcatgaggaaggtttccaatctgaaagattcgaccacgtaactgactttgcaagccagatatccattgtgccaatctgtgcaaaatcaggtgagggagtcattgagcttatagcattattgcttggtcttgctcagcaataccttacacagcaattggaaataagcgaagatgcccctgcaaaaggaactgttttggaagttaaggaagaagtgggacttggaattacagttgacagcattatctatgacggagtaatccgcgatggtgatgagattgcattgatggatgcaaacaatgttgtcacaactaaaatccgttctatcttaaggcctttgcctcttgaagagatgagagattccaaaaacaagtttaaaaaggtcgatgaagtcgttgcagctgcaggtattaagattgcagctccaaaccttgatgatgttgtttccggctctccccttagggtattaagcgaccaggaggatgtggaagctgaactcttgaaggaattggaagacatcactgtcgacactgacgatgagggaatacttgtcaaggctgataccttaggttcccttgaagcggttgttcatttgcttaaggagatggacttgccaatcagatctgctgaaatcggagacatcagcaagagggatgtcatcaacgcatcaatcgcaatggatgaaaatgaggaatatggcgtaataatcgcattcaatgtaaaggttcatccaaaggctgaggatgacctgaagaattctggcgtaaagctctttgccggcgatgttatctatcagataacagaggattatgaggcttggatagaggaacgtaaggaagctcagaaaaagcaatggctcgatgcaatcatcaagcctgctaagatcatgattcttccaaagcttatattccgtcaaagcaagcctgccatatgtggtattgaagtggaagccggtacaatcaagactggatattcattgatggatgcaaatggcgactatgttggtgttgttgcaagtatggaagataagggtgaaaccttacaggcaatgccaagaggtcaaagggttgctatggccataaacgatgcagtggcgggtaaggactttgaagagggagactcattatatgtggacattccagaaaagcactttaaggtcctagaacgtgaatttaaagacaagctaactgaggatgaatttttagccctagatgagatcgttgaaatcaagcgcaagcgagatagtgattggggtaaattaggtcttttcgagtattaa

SEQ ID NO: 1147 - DNA, 453 bp, Methanobrevibacter ruminantium
atgattgaaagaagctttgttatgatgaaacctgatgcggtatctagacgtttgatgggtcaaattttaagccgttttgaagataaaggtctcaaaatcgttgctatgaaattaagacaaattgatgaagatttagctaaagaacatcatggtgaacacaaggaaaaaccattctttggcggtttagttgaatatatcacttcttctccagctttaaccatggttattgaaggagacgacgctatttctgtaatcagaaaaatggtaggagcaactaatcctaaggaagcagatatcggcaccattagaggagacttcggtatggatactggaagaaacattatccacgcatccgacgcacctgaatctgctgcaagagaaatcgcactcttctttgatgaagaagaaatttgtgattattctatgtctgataacgcttggatttatgaataa

SEQ ID NO: 1148 - DNA, 162 bp, Methanobrevibacter ruminantium
atgagaacttgttcattctgtggtaaagaaatagaagaaggtactggaaagatgtatgtgaaaagagatggtacaatctatttcttctgtagtagtaaatgtgaaaagaatatgataaaacttggcagagtaccaagaaaagtaaaatgggttaaacaatga

SEQ ID NO: 1149 - DNA, 207 bp, Methanobrevibacter ruminantium
atggaagaaggaagtccagctgaagttatagaagttctacacagaactggtatgactggagaaatcatgcaagtaaaatgcaggattctcgaaggaagagacaaaggaagaattttaacaagaaatatcatgggccctgtacgtgaaggcgatattttaatgttactcgacacaattagagaagctaaggagattagaactccttaa

SEQ ID NO: 1150 - DNA, 408 bp, Methanobrevibacter ruminantium
atggatggcaaaagccagatgaaaaaggaggtaaattatatggcaaacatttatgtaaaatttgacacacctgaagaaatcgctaacaaagcagaagaagctttagaagtagcacaaaatactggtaaagtagcaaaaggaactaacgaagtaaccaaatttatcgaaagaggaaacgcagctttagtcgttatcgcagaagatgtagatcctgctgaaatcgttgctcacattcctgttcttgcagaagaaaaagaaattccttacgtatacttagctaccaaagataaagttggtgcagctgctggtttaagtgttggaactgcttccgcttgtattgtcgatgctggagacgctgctgacttagtagaagaagttgttgaaaaagtagcagaacttaaagaataa

SEQ ID NO: 1151 - DNA, 198 bp, Methanobrevibacter ruminantium
atggaattaccaatcgctcctataggaagaatattaaaaaacgctggtgctgaaagagtagctgacgcagctaaagaagaattagctgaagcaattgaagaatacggtaacgaaattgctcaaaaagcagttaacttcgcacgccacgctggtagaaaaactgtaaaagctgaagacatcaaattagctattaaatag

SEQ ID NO: 1152 - DNA, 1197 bp, Methanobrevibacter ruminantium
atgattagatgtgtgtcttgtggagaagaatacgaagatgatgaagttatctacaactgtaaaaaatgcgggtctgttttagaagtggaaatggaagtcgatgttcctaaatccacctttgaaggcagaagagataacttatggaaatataaagaatgcttgcctgttgatgcagataaaagggtttccttagatgaaggaggaactccattctgcagatgtgaaaaattaggcaaggaacttggcattgacttatatgttaaagtggaaggatccaaccctaccggcagttttaaggacagaggaatgactatcggtatgactaaagcaatgatgcttggtgtggatactgtaggttgcgcttccactggaaacacctcagcttcccttgctgcttatgctgcaagagcgggacttagatgtgctgtatttttacctgcaggtaaagtggctcttggtaaattggcacaggctatgttccacggtgcagaagtgttctctatcaatggaaactttgatgaggctttggaagctatgactcagcttgcccgtgaaaaatacttatacttactcaattcaatcaacccattcagattagaaggtcaaaagaccatcggttatgaaatcgtacatgatttaggttgggaatctcctgataggattgtattgcctgttggaaatgcaggaaacatttcagctatctggaaaggaataaccgaattccataatgcaggattcatggatgacgttccaatgatgactggtattcaagctgaaggagcttgtcctattgctaacgcttatagggataatactatggatatggttcctgttgaaaaccctgaaaccattgcaactgctatccgtattggagctcctgtaagtgctgttaaggctttaagagcaatctatgattccaatggtatggctgaaaccgtaactgatgaagaaatcttggctgcacagaaattgcttgcaaggactgaaggcgtaggtgtggaacctgcttctgctgcttccattgcaggtcttaaaaagctagttgaacaaggagatgtcgataagggagaaagagttgtatgtgtcgtaaccggacacttgcttaaagaccctaacactgcaatcgatgcatgtgttgatcctgttcaagtggatgcagacattgataagattaaggagattttgcttaataaatag

SEQ ID NO: 1153 - DNA, 1092 bp, Methanobrevibacter ruminantium
ttgattgatccatgggcatcattttcactagattatgataaattagtaaatcaattcggtataaaaaaatttgaagaagttttggatagcattgaagatcctgcaaggcttatgaaaaggggagttatctttggacatcgtgattttgacaagttagttcctttaatcaatggaggcaaggattttgcagttatgactggtatgatgccaagtggccaaatgcatataggtcataagatggttatagaccagctcaattggtattttaaaaaaggagcaagcttatccttatcaattgcagatatggaatcatatgctgcaaggggaataagcttcaatcaggcaaaggacattgcaataaatgaatatttaaaaaattacattgcattgggccttgacttgactgcagataatgtgaatgtctatctacagtcacaaaacaagacattgaatgacttgacatttaagttggctaaaaaggttaatttcaataatatgcatgccatctatggatttaatgaaagcacaaacattgcacacttatatgttcctttagtgcaggttgcagacattttgcttcctcagactgaagagtttggaggtcctaagcaggttgttgtacctgtaggtgttgaccaggatcctcatcttaggcttacaagggacattgctgctaagatgaatgaggaatatggatttttagctccagcttccacttatcacaggttcctaactggccttacaggagataagatgtcaagcagcaagccgaatactgcaatttacttgaatgaaactccaaagcaggcagagaaaaaggtcaaatcttctaagaccggaggaagagagacacttgatgaacagaaggaattaggcggaaggcctgatgaatgtgttatctatgagatgcttgtctatcatctgattgatgatgataaggagttggataagattagggaagaatgcataaatggagaattgatgtgtggacattgtaaggttcatacagcagagcttatgaaagacttctttgaagacttgaaggttaaacaagaagagtctttagatattgctgaatctctattggattaa

SEQ ID NO: 1154 - DNA, 516 bp, Methanobrevibacter ruminantium
atgcgtggagatttatctgatggaatagttacagtcaaaattggagaaggaaacgaaagagctatttcacttaatcaaaaaagccagttcggtaaactgtctgaagactgtttagagctttctcttatggaagcttcctatctaatggaaagcggacgtttggatatttatgaagatgatgaaaaatgtcaattggattatatcattgacatgataaaagaccaagatctttatggaaaatacttggtttatagggatttaaaaaatagaggctatattataaagacaggatttaaatacggctctgaattcagattatatgaaaggggaaccggccctggcaaatcacactctgattttcttgtaaaggtcttgtatgaggcaaatgaagtaaatgtcttagactttgcaagctatgtaagggtttcacatggagtcaataagaaattattgcttgcagttgtagatgatgactttgatgtgacttattataatattgaatggacacgtccgtaa

SEQ ID NO: 1155 - DNA, 654 bp, Methanobrevibacter ruminantium
atggctcgtgaaattagtgaaaatattgaagaatatttagaaactctctacaaatttggaagtaaagattcatatgtatccactaccactttatcaaaggaattaggaatagctccaggtagtgttactcaaatgcttaagaaattagaggatataggatatattgactatgtcccttataagggagcttttttaactgctgaaggtaataagattgctcaaaagattacaagaaaacacagaatccttgaaaagttcttgaaggatgtcttaaacattaaggatgagaacctccatgctcaggcatgcgctatggaacattcattatctgatgaggctgaaagggctatctgccatatgctggagcatccagacacttgtccagatgataatatcatccctgcatgtgactttaactttgaaagctgtgaagattgcttgaatgaccaccttgattttgatgacattgaagagagggactttaatcttttctcaatttcacaattgtctaaaggagatgagggtgaggtattgtttataagaggcagtgatgatgctttagcccaatgtgttagagtgggcatcaccgttggtagcaaagttaaaatagaggaatctgaaagccctaattttttattctatcacagtaaatga

SEQ ID NO: 1156 - DNA, 348 bp, Methanobrevibacter ruminantium
atgtctagaacttggagtttttataaatcttttaagaatttgatagttggtgttaatattagaactaaacttttatttttatcagcattattgatattattattgtctatatcttctgtttcagcagacagttctatagatgattctaatttagatattgattctaatttaggtattgattctaatttagatttaaatgcagatttatatgcagatttaaataattttgatgattttaataatctaaataattatgattattccaataattatgttgattatagtgatattttagaaggggattccttaatctggaaattgaaaagaataatcattttaataaattaa

SEQ ID NO: 1157 - DNA, 3033 bp, Methanobrevibacter ruminantium
ttgcttttagcagttttattaatgggatttgtattaatatcctctgtatctgctattgatattgatgaagcaagttcttcaagtgacttatcagattctagcatttcaaatgattatttagtagcaaactctggagatgattctgtagctagttcaagtgcatctagttcaattgctgcagatgattcagatctttctaacaatgctagttcaagtaatgttaatttcgaaaatgaagttttaagtactaataataatgaagatacagaatccgaaattgtaaaggattctaaaaatcaattgtcttcatcttctcttcaagctagtactaaaactaaaaccactcttaaaggcagtggaagctccgtctataggggcaatccatattatgttactttaactgatagtaatggtaaggttttagctagtcagaaagtgacttttaacatccttggcaaaaattacactaggaccaccgattctaaaggtgtggcttccattaacattaatttagccaaaggaaagtataacatagcttgcttatatgcaggcactgaaaactatgcttcatcaaagctatctgtagctttgacagttaatttaatgtccactaaaatcaatacaggtggatcaaccgttaaaaaaggaaatgcttattcagtgaccttgactgatggaaatggaaaggcattatccagtcagaaggtgaccttaaatatccttggaaagaattataccagaaccaccgattctaaaggtgtggcttcaattgcaatcaatttggctgcaggtaagaaatttaccttgactgcatcctatgctggctctgcaaattatctctcttccaaggtatcagcaactgttactgttcaaaaaggagatacaagcataaagcctagcggaacttcaatcgttaagggaaatagctattcatttaccttggttgatggaagcggcaagggattggcaaaccaaaaggtcgccataaagatatcaggcaagtcctacagcagaaccacaaactcaaatggtgtggcttcaattgcaatcaatttagctgcagggaaaaaatattcaatagtctgctcttatgccggctcttccaattataaggcttcaagctcaacagtaagtctctctgttacaaatccaagtacaaacagcaagactttctccattgcaaaaatagaagctgccgccactaacctaaaggcttatgtaaataagaataaggcagtgcctacaactgtaagcgttggcggaactaacttgaaaatctcagagttttcatacttgatgtcaaaagccattgtaaatcttaattccaataatactaatgccataactcttccaagcggcatctataatggggcatcagcttccaattcattaaacgctacagtctataaggcccaatatgtggacttatccaaaagggtctataactatatagacaagaataaggttcctgctgcttatggtactgtttataatgccaatggcgcttccttaggaaatgcaggatttaacctttacacatttgcatttgcaaagattttggatttccataagaccaataagtatttacctaattactgcagctttgacagttctgtattcaaggcgtccaatggttcaagctcaagcaatagctccagttccactaacagttcaagctccactaacagttcaagcggatcttcaaactccagcggatctggaagttcaactcctgcagttaccgttaaggctacaagccttaaggcagcaagcacttccgttataagaggagatgactattcagttactttaactgatagcagcggtaatgctttggctaaccagaagattacatttgccctttcaagttccagctacactaggaccactaattcaaagggtgttgcttcattgaccctcaatttagcaggtggcaaatattccataactacttcatatgcaggcacatcagcctataaggcgtcaaagcttacaaacacagtaactatttcaaacagctcttccagattcttcttgaatgacattgaaacagctgctgagaatgtcaagacttatgtcacaaagaataaggcgttgcctaataccgttacagttgcaggcacccaattgaccctttcacaattctcctatgtcatggctaaggccattcataatataaatgcaagcaactctaattatatctcccttaaaagcgttgcaagcagcaattctactggagattatttggacactacagtctatagggctcaatatatgaacctaaccaatagggtcatttcatttgtggaatctgataagattactccaactttcgctacagtctacaacagcaatggaaaatctgtaggaaaggctgaattcaagctttacacctttgcatttgcaaagattctagctttctataagaccaataattatttgcctacctattgtactttccaaagctcagctatcggtgttgttccagatgttgcaactaatgtgacaatcaacagcaagatcaatgctaatatgaaccaattcaaggttggattgaatgagaagaacactgtcagcaacctttcagcctatttggtaggtactggccagtcaacaatcacaacaaacattaagaatgttgctgctcagctaaccaaaggattgaattcaactgcaaccaaggctcttgcaatatataattttgtaagggatgacatttcatacagctattattcagacagtaggaaaggtgcagacggtaccttaagctctggatctggtaattgtgtggaccaagccagtttggttgttgctctttgtagggcagcaggcattcctgcaaggtattcacatgctcaaggatgtaccttctccagcggattggttacaggacacgtatgggctcaaatccttgttgatggcgtatggtattcagcagatgccactagcgtaagaaatagtttaggaaatattgtaaattggaatacaaattcctatcatagtatgaagcagtatgctgctgttcctttctag

SEQ ID NO: 1158 - DNA, 3897 bp, Methanobrevibacter ruminantium
atggaggataatcttttgaaaaatagaaaactaattttgataagtatcttccttgttagtctgcttgcaatttctgctgtaagcgcaaatgaggatgtggataatggacttatcgattcagatgattctatcttgcagtcagctgaagtctctgattctgccattggatcagattctatcttgcagtcagctgaagtctctgattccactatagaatcagactctattgaactggaagataagggtaatgttttaaagtcaagtgataatgcttcttttgaactagatgataaaaataatataggatcagcagattctgaattggaagacgattatttagaacctaaagaaaagaatgttctttcaatggatgagaatgcatggttttataattatattgtgtggtatgatggtgatgatggagattgggtttcccttgattttgtagatgatttaaaaaatcctgaaaacatcaccatacgattaaacagttatgacactccatttgacggtgtggatttggctgttataaatgattatgactattcaatcactaaattaaccactgatgataatgggactgtagtttataatgttccatatgaggttgatgaattatctgtctttgtaggcttttggtatgatggggattttgtggccacttatggaaattgggaaagttacacaatctgcgcagtgaattggggcacttggtatagggacccttctaaacggacttacgacttttatgtctctgtgtctgatatggacacttatgaaagtccaattggcgcacaggtggtttttacaagcgattccaatcaatatgtcggaacaatagatgagaatgaaagagcaatcataccaaaggtcagctatggcacttatgatgtgaaggtcatatatgacggctattgcattcttaatctttcagattctagcgccattgagttctatgacgaccatcatacagaccctgattcacttggtgatgaaaggatagattatatgtatgtagatagtagtggagtagtttatcttgacctttgttatgatggttctctaaaagtgccagacaactccacttatgagccttatggtgatgacaacccatccggtggcggttcaggcaatcaatctggtggaactgttgctaatggcacattcacttcattgcaaagtctgtttaaccgtgctgcagcaaattcaacaatatccttaacaagggattatgtctatgatgatggattcgacatcaaaggaatagtaattaacaaggatctgacaatcaacggtaatgcccacacacttgatgccctaggcaaatccagaatattctatgttaacaatagcactgtcaaatttaacaatatcctatttgccaatggtaatgccactcttggaggtgccatttataatggaagtgccgtaaattgtctttttattaataatactgctcaagatggtggtgccatttattatggaagcgctttagtatgtgattttataaacaattccgcatctaggaatgggggcgctatctatagtggcggtgccgtaaactgtagctttataaataactcagccaatttaggaggcgctgcaatttatgattccttgtttgctgtgaattctacttttgtgggtaatacattggcttctagcaatcctacaggaggaagcgctacaacagatgtaagtgtggtgtcatttaatccaataactacctatatacctagccctccatccatgacaggttcaattggttggggaggtgccgtacttgactttacaaggcctgttatctatacggattataatgaaacattttacttgttgactaacttcactcttcagcaagatggctttaacaattacggcaatgttcaattgactggcagggatttggtcttcaagtcattatatccttactctggaaactattcaatggctcttatcatctctggacaaatctttactcctacatatgtccttggggaaaatgatacttatgaagcccattttaaactgaatggtctttctttagggctacatatggtttatgcatatgttgatttcggatatccggaatattatagctatagaataggtggaggctatatggatagggttgcttacgatagaactgcggagataatattccctattctcattaataagacagtagaaatctcatcttccaatctgaacaagtattacggtggaaccggaaagtatactgtcactcttacagatggcggaaatcctatagccaatgcaaatctcaatgtctctctagctggcaagacatatcctttaaagacaaatgcaaatggtcaggcaagcatggatataaaccttactcctggaacttatgaggcagtctgcacttatgatggagtttctcaaagatcaaatatcattgttcgctcaactataaatcttcaaaacctcactggcatttatcagaacgctaaagtaaatgccacattcttgaatgctgcaggcagtcctttagcaaacactaaagtcagttttagagtaggttccaagacttacagtgcaacaacaaatgcaaatgggcttgctacagccaatgttgatttagctgcaggcacttatgatgtgattgcaataaatccggtaaataatgagcaaaagacaagcaagctcactatttccaaagctaagtcttctataagtttaagctctacaagcaataatgataaggttaccttaacagcaagcttatccccttcaactgcaagtggaaatgtgacatttaatttaaacaataagaactacactgcaaagataagctctggaaaggcaagccaaaccattactggattgaatgaaggaaactacactgcaaatgcatattactctggagacagtaatcttaactcttcaagcgcaagcactaaagttgttgttaaaatagtcattccaactaaaataatctacaaaaatatgaccactggacctgtagcaaaatcagatggcaggataggaaattatttctgtgtaaaacttgtggatggcagcaataatgcattaacaggccttccaatcaagataggcttcaatggaaaaatctatgacagaacaacagactcaaacggcgaagcaagactgcagataaaccttgctaatgcggacatatacacctttgcaatctgctaccttggagacgatgatcatcaagcatcctttgaagtggctaagattgatgtaaacaagaagtatccaaagccaaacagtgcaaatggaaactccaatggtgtgcctgcccaagagacaataagcaatacaaagcttaagacctatatccaatacagcaatatgaccaccaaatcagtccttaaatcagacggaagggtgggagactactttgaagtcaaattgctggacaataacaaaaaggcaatggcaaatgttccaatcaagataggtttcaatggaaaaatctatgacagaacaacagactcaaacggcggtgcaaagctacagataaacctcttaaagccaacaacatacacatttgcaatcgcatacctaggcgatagcaaatatcaggcttcatttgaggtagcaaagatagttgtaaaagcccaaagccctaaactgactgctcctaaaaagacatttaaggcaaatgcaaagaccaagtctgtctcagcaactctaatctccgagagaggaaagcctatggccagtcagagccttaagtttacaataaacggcaagacatacacagccaaaaccaattccaatggtgttgcaacagtcaatatcagcctaaacaagaaaggaacctattcctgcacagtcaagtttgccggagtgactggagcaaatgcaaagaccactaaaacaacaataaaaattagttaa

SEQ ID NO: 1159 - DNA, 1650 bp, Methanobrevibacter ruminantium
atggcacaaattaatcaacctatgtatattttacgtgatgacactgaaagatttcaaggaagacaagccttaagaatgaatatttttgcaagtcagcttttagcaagcattgtaagaaccactcttggtccaaaaggaatggacaagatgttggtggataagatgggagatgtagttgtaacaaacgatggtgcaaccatcttgcaggaaatggacattgctcaccctgcagctaaaatgctagttgaaattgcaagaaaacaggaaaatgtagttggagacggaactacaactgttgtaatcattgctggagaattgcttaagaaagcacaggaattaatggaagatggaactccagtacctaccattcttatgggatacagattagctgttgctaaggcaatggaaatcttgtttgacatttcttttgatgcaagggataaggacaccttatttggaattgcaaagactgcaatgaccggtaaaggttctgactatgctaaagatgaacttgcagaattacttgttcaagctgtaaagaaagtcgaagagggagaagaggtagataagaccttaattaaaatccacagaatcaacggaggaagcgtagaggattccaagattgttgacggaatcttcatcgaccaaggaagggcaaacgaaaccatgcctaaggaaatccatgatgcaaagatagctcttatgaaatatcctttagagctaaaggacctcgaaaacgctaaagttgactttaccgacccattacaaatgcaaatatttttagacaatgagcaagagatgcttaaggaaatcgctgataagatcatagactccggatgtaatgtattgttctgtcaaaagggaatcgatgatgtagtgcaacactacttatccaaagaaggcatcatggcctttaagagagtcaagaacactgatgttaaaagaatcatgaaggcaaccggtgcagagcttatcacaaacattgaagacttaactccagatgttttaggaaaagcagattacatccaccaagaaagagtatttgaccaaattctaaccttcattgaaggctgcgatgaacctaaagcaagctccatcttaattagaggaagcacaaggcatatctcttctgaaatagaaagggctatggaagatgcattaggtgtggtagcagctacaatcgaagaaggaaaggttgtaagcggtggaggatctcctgaaattgaaattgcaagacaattaagattatatgctaattcaattggcggaagggagcaattagctatcattgcatttgctgacgctttagagattgttccaagaaccttatctgaaaatgcaggtcttaacacaatcgatttgcttgtagagcttagggcagctcacgaggacaatccttatatgggacttgatgtatttgaaggaaaagtggtggacatgaaggaagctggtgtaattgaacctcaaaaggtcaagaaacaagcaattcaatctgcacaagaagcttgtgaaatgattttaagaattgatgacttggtagcagcagccggagccctccaaaagccagaccctgatgagaacttagataatagtggaatgcctcctgcacctggaatgggtggtatgggcggtatgcctcctatgatgtag

SEQ ID NO: 1160 - DNA, 780 bp, Methanobrevibacter ruminantium
atgaatttagaaggtgtagaaaaaacaatgctcttgaccttatacacaaaggcaaagcattcacaaaagccaaatcataaattttttgattatatggcaatagatataatctctgaaatcgattatgacttttccatagctgataaggacagatccatgcaaatgggagtaatatcaagaacaatcgtcttggatgatatggtatctgaatatatacgctcacatccaaagtgcacaatagtcaatattgcctctggaatggatactcgattcaacaggttggataatgggataatcaagtggtataatgtggatttggaaaattcagctaatttcagattgaattacattaaggatacagaaagggtaaagaccttagcctattctgccatggatccttcttgggcagaggaaatagaagcaagcggggatgttttatttatcattgagggtttaacaatgtatcttactgaggtcgagaataagcagattctggatatcattgatgaaaacttcaagtcatgcactatatttactgaaatcatgcctcctgtttccgttgagaatgtcaaggagaaatccgttgaggaaatggatgccaagtttatttggggagttcaagatggctttgagctaaggagattaaaccctagattcaattgggtaaaggatgtaaatctttttgatggaatgaatgtctataagcccattaccaaattgttcacttggattccttttataaggcgcagaatggattttatagctgttttagaaaaatag

SEQ ID NO: 1161 - DNA, 975 bp, Methanobrevibacter ruminantium
atgatgaggaagaatgatagaagttcaatcaatccatttacaggcaaggagcactatgacactgtagacgatgacaagttcttggaaggctgctttcaagggtactatcaggaactgcagcgctcccagttattagacaacactccagaaggccaatttatcgttcaagtggcagttaaactgatcaatacagttaatgaattccttacaaagataggaaggcaggattatgttgagggatattatgaatgggatgttcatttggttgcaaacaatagcgtaaatgcctgctgcatgcctggaggaaagattatcgtatattcaggtatcttttcaattgcaaacactgaagagagaatggcattcatcctggctcacgagatggctcatgcattgcttgaccacggaaggacaagggcaagcgcccaaagcacaaagaacactgctgcttctgttgcatgggtgggaagctttgcattggacatggtaggattaggcggtcttggatctcttgcaagggcagccaccaatattgcaagtgtcgggtcccaatacttccttcttcagccttggggaagggaccatgagtttgaggccgataagcttggaatgattatctgtcaccttgcaggctatgacatccgtgaagttcctaaattctggaaggaatttgcaggagacaaggcaagcaattttgatttcttttcaacacacccttcagatgccaagaggatagaggtaatggaagcctctgaaatagagattctaaacaccactgacttttacagcaagccagtattgcctgagacacctaaggcaactggagaaaggaagaatactaatgccaagccccaagaacctcaagctaaagccgttgctgataacaaatcgactcatttctgtacaaattgcggcagtgaggtagctccagatgataatttctgtacaaattgcggagcaaagataggaaaatag

SEQ ID NO: 1162 - DNA, 201 bp, Methanobrevibacter ruminantium
atgattgaagagcataatcaaaaatcagttgaagaactggttgaaaacttttcttatgtttatgtttattttgctgatggaagatcaattagaatctctaaggaaaaaaagtttgaatttaaggacaataagttttatatttatgataaggatatagaagttaatatagttgatatagagttaattgagtttactgattga

SEQ ID NO: 1163 - DNA, 1221 bp, Methanobrevibacter ruminantium
atgaaagctgatgcatacaaaatagttgataatgtttactgggtaggtgttttagactgggatattcgtgactaccacggatacaccttggatggaactacctacaactgttaccttgtatttggtgaagataaagtggctttgattgacaatgtctatcctggaaagtctgaacagttctggggaagaatcaaagatgcctttgaaaaagaaggaagggaattcaaaatcgatgtagtcgttcaaaaccacattgaaaacgaccacagcggctctcttggtgaagttgttgccaaattcccagatgttgaagtttactgctctaaaaaagcagaacctggacttaaaaaccacttgccagagcttgaagactttgaattcaacactgtaaaaaccggcgacactcttgacattggaggcaagaccttccaatttgtaaacgctcctatgcttcactggcctgacagcatgtttacaatgttgatggaagatggaatattattctccaatgatgcattcggtcagcacatctgtgtatctgaaagattggacactgatgtggatcctgttatcctaaccgatgctgctagaaaatactatgctaacttgattactctcgcttctccaatggttggaagaaaaatcgatgagcttgctgaattaggcattgtagataatcttaagatgattgctccatgtcacggtcagatctttacaaaccctgaattcatcattgacctttaccaaaaatggtctaccggaagctatgaaggaaataagatcaccttcatctatgataccatgcaccattcaacccaaaggatggctcatgcaatggctgaaggggtcatgagcgaaggggtaaaggtaaagatgtacttcatgcatgatgatgacaagtctgacgcagtgacagatgtccttgactctaaggcaatcttcgttggagcccctaccatgatgaacaatccattcccgggaataggagatgtcatgtactacttgaactgtcttagctttggtaacattgaaaagaaaaaggcagttgtattcggttctaaaggttgggctggaggctctgcaagaatcttagctgctaaccttgaaggcgctggatttgaagtggtcgagcaaatggaaatcgacttcaagcctaatgaagaaatccttgaagaatgttatgaattaggtaagaaagttgctcaattgattaaggaataa

SEQ ID NO: 1164 - DNA, 843 bp, Methanobrevibacter ruminantium
atgagtttgaaatactttaataatttaacttatgaagagattggagaatataatgacaaaatagtcctatttttacatcctaagctattatcacattggatttggaaaaaacaaatagaagaatatgataaatactttaataattatcactgtatctttattgacctgcctcaccatggagagagcaaatttgatggaaaattttccatagaagagtcctcagatatactcattgaatttataaagcatttattgaacaataaaaaaagtgaatcaataaatattgtagccataggccttggagcttcaatagccattgaaatactcaataaagaaactcacctaattaatcacatcattctatctggccttgaaatcgcccagattagagaaaaagaagaagagacaatcataaagagacttgctaaaacaaaagcagaatatctgaatatgaagcctgatcagtttatcattaaggcttatctaagatactatggaataaggaaagaatattatgatgatttagaaaaaagcctagacattcctattagaaaagaagaggaaatagcatataagtccttaaattatataatccccgatttctctaaagaaaccatagaaaaagacaatatactattggtctatggaaataaggacaatttcaatagcacaaaatctgccataaagcttaagaaattgttcttcaatgccaaattaattgaaattgaaaagggaaatcatctttggaacataattgattatgaactctttaatcaagtcattattaactttatacaaaaggaaattatctttaatgatgaaaggataaaagaaattgattga

SEQ ID NO: 1165 - DNA, 915 bp, Methanobrevibacter ruminantium
atgaaaataggcgtaattggttatggaaatatgggttccatgatagcaaataacattctcgaattgaatttgctcttggccgatgaggaacttatagtttcaaacagacatattgaaaaaatcgaagaattaattgaaagatatccagatggaaaagttcagattactgacgataacactgaattggccaagtcatgtgaaaagatcattatttccgtaaccacccctaatttcaaggaagtgctcgatgagataaccccttttattaatgaaaagacccatataatctatacctgtgccggacttgactttgaacacatcagctctttttacgacggcaaattaagcttagtcattccaagcttggcatcaactgtaacttcaaacaatgccataagctcaataggaaggagaaaaggaattacccttataaagcataatgagaaggtagacattcaagacagctatttcttagaggatctctttaatgaattcagttatgtgagaacattaaaggaccataatttcttttttgaagaaaatggaaacttagcttcaaacaatccaaaattggaaatatgcaccatccttacaagttgcagccctgcatttatagccttgatgattgataattttgcagaaaggataagcaatatttcagacttaagcaaagatgaggcagaggatatgatcttaaaaaccgtcattggaaccgctatcctaaaggaagataaaaaaatatccaatagcgaaattatagaaaaggtagctaccgaaggcggaataactgcagaaggtattgacctattggataaaagattaaattccatttataagaaactcattaacacccttttaaatagatatgaagaagttagtaaagaaatggacgagctttatttaaaagataattaa

SEQ ID NO: 1166 - DNA, 339 bp, Methanobrevibacter ruminantium
atgaatcctaaacaacttaaaaagatggaaagacaaatgaaaaagatgggtatggacatgaaaagcatcgatgatgttgaagaggtcattatccgttgcgctgataaggaaatcatcattactaatgctgatgtaagtgctatgaatgtaatgggacaagaaacttatcaagttacaggaactgctgtagaggttgaaagagaagttgagcttgtcattccagatgaggatattgaaatggttgcaagcactgctggtgtaagtgttgaagctgctgaagaggctttaagagaatgcggtggagacctagcagaagcaatcatgaaattaagtaattaa

SEQ ID NO: 1167 - DNA, 2001 bp, Methanobrevibacter ruminantium
atgtttgaaattaaagcaaaagatatgagaggacgtgtaggtgttttaaaaactaatcatggagagattaagactccaaacctaatgcccgttattcatccaagaaaacagacagttgatgtaaaggaatatggggcagacattgtaattacaaatgcttatttaatttataaggatgaagagttaagtaaaaaggctttggatgtgggcttgcatgagctaatcaactttgatggtcctatcatgacagattcaggctcattccaattatctgtctatggtgatgtagacattacaaacaaggaggtcattgagttccaggaagctatcggaactgatatcggaacttcactagatattccaactggaccatatgtggatagagaaaaggctgaagaagacctcgaaatcaccattgaacgtgcaaaagaggcaataagttatgtaaaggacaatgattacgagatgaagataaattctgttgttcaaggttccacttatccagatttgagagaatactgtgcaactgagcttacaaagcttgatgcagacttatatcctatcggcgcagttgtgcctcttatggagatgtatcactaccgagatcttgtggatgcagtgatgcattcagtcaaatgcttgccagactcaaaggcacgccacttgatgggggctggacatcctatgatatttgcactttgcgttgcaatgggatgcgacttgtttgattcagcagcttatattctatatgctgaagcagaccgtctattgactacccgaggaactgtaaagcttgaaaatcttaatgaaatgccatgttcctgtgaggtatgctgtaagtacactcctgatgacttaagggctatggataaggaggaaagggtgcagcttatagcacagcacaatctccatgtcagctttgcagagcttaggctcattcgccaagccatttatgaaggaagtcttatggaacttgtagaggagcgctgcagggctcatccaatgttgcttgatggtcttaggcatcttggagagtatagctttgacttggaaaaatacgacccaagaagcaagaagtctgcatttttctatacaggtcctgaatccttgaaaagagctgaagtgacaaggcatttaaacaaattaaatgaaatggataagaggaaaaatcttgttgtcctgccaacttatacaaagccatacacaaaacatttaacaaacagcttcaatgagttatttgtttatgcaaaggatgaatcattatctgaagatgcagagtgtaaaatagagaatggtgaaactgactttatggttttagacactccattctgtctcattccacttgaattggatgaagtttatccgttaagccaatcagatgcgcctagaatacgtgataagatggctattgaatttgcaagggactttttaatagactttgctgaagactatgacaatgtcctcatacatcctaatgttttagaggagcttgagcttgactatatagaagaatacaattatccggaggaaatcaagttcgaaaaagatgatattaagaagttaaaggcaattgcagattaccagtttggaaatggagcaggagatgcattattcactggaaaaatcaagatagaaaaaagcaaaaagactggtaagattagacatgtctatgataagaatcagattattgtaaatatgagagcctctgacagctttttgattctatctaaattaggtgcaaaaaggcttgctgcaattgaaggtatgagaaataaggtcatgattgacaatagcgtagaatcatttgcaagggatggaaaaagcgtatttgccaagtttataaaagactgtgatgaaaacatcagatcaaatgatgaagttcttattgtaaatgagcaaggtgagctattggcattcggcaaggctcttttgaattatagtgaaatgctggactttaatacaggtcaagcaataaagactagaaaaggatttaaggattaa

SEQ ID NO: 1168 - DNA, 1854 bp, Methanobrevibacter ruminantium
ttgaaaattaattcatttagagttttattatttattataataatcagtttatctttcattggtttttctactatttctgctgtggatttgtctgattcttgttgtgatactcttatttcagatggttctgatggtattattttaggtggatctgatgatattagtcttagcgatgaaaataataatttaaattttgatttaaatgataatccggattttaatttagattatgatagtaattcttatcctaatttaaatttatcttctaattcaaattccaagtccagttccaatacatatggtaatgattttactttatccagattcaaatccgttttaacttcttcatataacttgaatggaggcagctttgaagatattcaatctgccattaaccatgctgctgatggggatgatataatcctcaatggcacttttacaactactggctcagttattgtaataaataagacattaactatcattggaagtccaaatgctgttttggatgctaaaaacatatcaaagatttttcttgttgaagcagatggggtgaaccttaagaatctaactttcatcaatgggaaatcaaggaacgaaagtgataatgggccttatcaaggaacagttaactggcaggggagcaacggaactatcgttaattgcagttttattaacaatagcggtgatgagaaaagttatggcgcctctattctttggaaaggatcctatgggaaaataagcgattccatttttaaaaacagttattctggagctaatgggggagcaatatttgctttaggagaaaatttaaccatcaataattcagagttcatcaataaccatggaaaggaaggtggagcaatctatttcggaggttcttcagctatgtggattataaattccattttcattaacaactctgcagattctggtggcgcccttgcagcttgcgctatgaataggcaagtgattaactctaaattcattggcaactctgcaaataatggagggtccatttcatggtgcggttctaatggattgattagcaattccactttcattaataattcagctgatcaaaaaggaggatcaattttatttacagggactaataatttagtcaagggctctgtttttattaattcttcagcgaacattggaggggccattaattctctcaatagattgaattatattaatgacttaagatttgaaaacaataatgcaagccttggagaggattgctatggagatttggaatttaagagattttcaacatctattgcttccgaggatatggttacatctgccattgatgctaatctcgatggcagaaatggcgaatactttaatgtaagcttaaaggatgagtatggcaatccgttgataaataaggatattaaaataggattcaatggcagaatatataataggacaacagattccaatggccaggcaagcttgcaaatcaatttaaagtattctatggtttatacctttgcaatttgcttcttaggtaatgatgacttttatggaagttttacagtttcaaaaatcactgttaagactcaaaagcctaatttggaagtaaataactttaaatataaatcttcaactaagtctaaagtaattaaagcaacattgaaatcatcaagaaacaatccaattcaaggaaaaacaattagttttactgtgaataataaggtttatacagcaaaaaccgattcaaaaggtattgccagtgttaatgtgagcctgtcttctaaaaagacttatgctttcactgtaaagtatgctggtgatgacacttattcttcagtttctaaatctgctaatattttagtttattag

SEQ ID NO: 1169 - DNA, 1224 bp, Methanobrevibacter ruminantium
atgacttatatcgaagaagctacagtgattgatgatacaatatatgacttaataaatgaagctttcgaaaatgaaagaaaatacaatgaccctgtgtatagaaactccatatttaaaggtcataaggaatactttgtaaagacagatgatgggtcatacagcatcaaatcaaaagaaatcaataacaaggtggaaacactccacacctctactggagccataagcgaatcatttgaaaagttcataaagccattgaaactggattacagccaggacattgctatcttagacatttgtgcagggctaggatacaatacttctgcagcaattgacgattttatgaaaaattcaaccgaagatgcaaacctccagatagaccttctggaaatatccaagccaacccttgcagcaggattgatggttccatctcctataaaggcacatgacattacaaaaaaggcaatagaggatgcccttatagcggaagattatgcatcactctccttagaggaagaaagcataccagataatataaatttaaatatattcattgacgatgcaaggaaagtcatacaaaaactggaggacaatgtctatgatgccatatttttggatccttttagtcaaaatatggcgcccgagttagtatccgtggacttttttagggaatttagaagggttattaaagataatggaatagtctgtacatatacttcatcagcgcctgtaaggatggcatttattgaagcagatttttatgtatcattaggcccaatcttcggacggtttcaaggaggaacattggcatcaccctctccaaaaaatttgaccaagtcccttccaaagaatgatgagataaagatggcattatctgatgtggggattccattcagggatccaaatctaaacctatcatcaaaggaaatattagacaacagaactgaggagcgccataatgcgcggcataacactaaaatatcttcagcggtaaagacacctatattcctagcacaggagatggatgatgagccattgaagagaagagttgagcgaaaccttagaaaaatgaacattcccggagtattatcagaggaagctttttatcttgtggggcctgaggaaaactatagtgaggattatgcagaagataacaattcaagaactcgtgttattgaaatggctaaacgattggatgagattaaaaacaataaagtaattttttaa

SEQ ID NO: 1170 - DNA, 474 bp, Methanobrevibacter ruminantium
atggacgtaaaaatcaaagagaaattggataatcttttcaattatatttctaatgcattaagttcaatttactcaagaaaagatgaaaaggattatcatgattttatttcttccataaatggcagattgatttgtatggctgatattctagacgaatctgaagaatttgaaagagaatattacacatttcttaaaatcaaaaagatgatttattatgtcttagagaatattgaatctataaaccgtgaagattgtttaagagtatttgactccttctctaaatttaatcttttaatcttgttaaaattcaattatttggatggtggaatatctcaagaagagtatcaaacaaaatttgatgatttcacattgtatttgagggaatttagggaatatttctatttgaatgtctatgaaaaagatggaagattcgatgctttgataaatgaagtatcatatatttttgtaaattag

SEQ ID NO: 1171 - DNA, 378 bp, Methanobrevibacter ruminantium
atggataaaaaaataaatttgattaattttttttgggaagaaatactttttggactttttaaagaaaaatcggaattcctttcctgttttgtcaaatgctcaaatgaagttccttcgaaattcgaaataaataaagattatttgttaaataaactacaactttataattgcggtttaaataattttagaaaatattgtgatttatggcattctttagaaaatttaggcattcatgaggaggatcgtaaaattattttagatgctcatgattttgcaaaagatcagtttacaatatttgtgactgttgatgaagaattttataatgctgtcaaatctttttccaaattaaatattgacaaatataaattattgaattaa

SEQ ID NO: 1172 - DNA, 291 bp, Methanobrevibacter ruminantium
atggattttattgatacaaatattgcgattgcatatacatttttcccagataagtattttaaaacagttgacgattttattgtaaattccactgaattctactgctcaaacaatgtttgtgaggaatataagcgaaaatataaatctattttcacatcatttgaatatttttttgatgaaattattctagctttagaaaataataatcgcatatttcttaataaatgttcttttgaacaatttgtattgtcacaaacaagtgatataatctggatatggataaaaaaataa

SEQ ID NO: 1173 - DNA, 522 bp, Methanobrevibacter ruminantium
atgtacaatatcaatgaaaaaatcactttaccaaggattgaaatcaaaatggacgtaaaaatcaaagagatattgaagaattttcttaataatatttcaaacacattaacatcattaaataacaaaaatgatgaagagaaatctttagagttaatttcttcaatgaaagaatatttgttggattttgctatgtttttaaaagaattaaaagaatttcaaaaagaattttctttttttctagtaattagaagaatgttaaattatgttttagacaattatggttctctatgctcttctaaaagatctgtcatatttgattcattatttaaattttttgaattattaagaatcaaacttagctttttagaaggtatttattccaaatcatcatatttaagttattttaataaatttgatacatatttggatgaagtaaaaacggaatattatttaaatatatatcaaagaactggcgaatttgatgatgttatacctagaatatctcaaattatacttgattag

SEQ ID NO: 1174 - DNA, 2034 bp, Methanobrevibacter ruminantium
atgggtctatttgataacattaaaaagattcgaaataaggaaagtgcaaacagctcatctgccatattggcttccacatacaataagataaaccgcagatttggggttggaacagatgcaagcagctacattgccaaaaacatgcacaagttctatataacaagctccaagttttcaaaaggggtccaaatcaagaaccttctaagaaagctagacatcacaatccatcctgaaggattcatatacttcctagacgaatttagaaatcttgactatcatggccaaataataaacagtcctatcgactactcacttattctagactattccatctatgacctcaacgaattttacttcaaccctaaggaaggtccaggcttcagaaaccagtcctccgactacaatagggaaatgctcgctatccttgatggaattgagcttctcatatatgaaataaacaaggcattggcaaagtcctcccgtgatgacaagtcaaagtacatccgcatctttgaggacataatcgacaagaaggctagccattttgaagaggcccttcaaagaatacttttccttaatcaactcctatatcagacaggccacagcctaaacagcctaggccgtcttgaccgtatccttgaagactattactacaacgacctgaatgatggatacataactaacaaggaggcattggaactgattaaggatttcctaaaggccctcgattcatactcctggtataagaccgatgacgagtcaggactggcaagccagctaatcacccttggaggaaagtacatcgatgagttcggcgaatactatttctacaatgacctcacctatatcttccttgaggcaatcggccaggtcaatccaaaggatgttaagatagcactcagactaagctataagactccagacgaccttatccaccttgcattagattgccttaacgaaaacacaatatacattgaagagggtgtcgctgtaagttttatcattgacaatcggatatttacagctgacggagccaccattgaggccaatatagattcaaacatagtcttctcaaatgatgaggcaatcatcccaaggcttctcgacttcggatactcaagcgatgacgcatataattatattctatcagcccatcttgaacctacattcatatcctgccttgatgaaggcaacctatcatctatctctcttttaaagccattgaatgacatatttgaagacaagaatgagttaagattcataataaacttagactaccttatggagctttataagaacaatctaaaaaaggaaatcgaagaaaaaataagcgccctagatcaaatacaatggaaccaagaccctttcttatcattattctcagctgaatcatatgaaaaccaactggacatatcccaaggaggctccagaaacaatcattttggaattagattctatgggctccaaaacactgtaaacagcttatataaccttaagaaaatagtctttgaggacaagaccatagaccttatagaattggataagatgagaaaaaacaacttcaaaaggggcaaataccaagaaacattcctcctccttaagaacaatccagtaagattcccacaaaacaaccctgagatagcaaacatctccaacgaaataatagcattcataggcgactcaataaaagactacaaaaacagcctcgacggaaagctcaagtttggattaagcgccccaaggtacatgataaagaatgataagagagcatcttttgacgccacattaaaggacatcccgccagcaagacttttaatatcaagccaaaagacaaactcagatatattcatcttcaattcaagcttagactacaaaagctcagcaataaacggaaaccttatagagctaaatataaacacaaacgacaaacaactaaccaatatccttgtagaagcaatcggatacggtttcgaccagctccaaataaacttaatcagagaagagataatcaccaaagaggatactgaagaatag

SEQ ID NO: 1175 - DNA, 636 bp, Methanobrevibacter ruminantium
ttgaattctgataagaagattacaaaggaatcctcaattttagatattggatgtggaaatgggaattttttatctcaattaaaaagaggaggatataaaaatctcacaggaatagacttatttattgaagaagagaatattttagaggggattaatttaattcaaacttccttagaagattataaaccttcagaaaaatttgatttaattgtttcgaatcatgcttttgaacatatggataatcaattagctaatctaaaatgttttgaaaatcttattaaagatgatgggttaattttattaagaattccgattaaatctgagccaatttggaaaagatatggagtaaattggtttcaaattgatgcacctagacactttttcttacatactctaaaaagttttgaaatattatgtgataaaaccgaccttaaaattttagatgtgatttttgatagtggatatgcccaatttgttttcagtgaaaattatcaaaacgatattgcttggggagaagatggatggactgattttaggtctaataaaaaattaatcaaaaaatataaaaaagagaccaattttttaaattcccaaggacaaggggatcaatgcatgtttgttcttaaaaaaatttaa

SEQ ID NO: 1176 - DNA, 327 bp, Methanobrevibacter ruminantium
atgagaatattaaacggtgaaaatatgaaatgtccaatatgtgaaaatgaggagaataatttaactttcataattaaagaaatgcaaataggccttagagaagaatttgagtatattgaatgttcaaattgtggttgtctttttattaaggagatccctaaagatattgacaaatattatgatacagattatgcccctcatttaaaacctaaaagttttaatgaaataatttttgataaaggttctgcaataattttatctaattcaatcctatctaatttaatcccaaaagaatttgtcccccccccatttaaaattaataaataa

SEQ ID NO: 1177 - DNA, 1098 bp, Methanobrevibacter ruminantium
atgaaatacgattatctaatagtagggtccggccttttcggatccgtatttgcttatgaaatgaacaggagaggcaagagttgccttgtaatagaaaagagaagccatattggaggcaatgtttacacagaggaaaagcacaatataaatgtccataagtatggtgcgcatatattccacaccaacaataaagaggtatggaattatatcaatcaatttgcggagtttaaccgctacacaaactcacctgttgccaactacaagggcgaattatacaaccttcctttcaatatgaacaccttctaccagatgtggggagtgaaaactccagaggaggccaaggcaaagattaagcagcaaaaagctgaggcaaatattgatgagcctcaaaaccttgaggagcaggcaatctcccttattggccgagacatatacgaaaaattagttaagggatataccgaaaagcagtggggaagggattgcacagatcttccatccttcattatcaaaaggcttccggtaaggttcacctttgacaacaactatttcaacgacctctatcaaggaattccaatggggggatatactaaaataattgaaaagatgcttgatggaattgacgttgagctaaacactgattttcttgaggataaggataaatggatggctatggcagatagggtcttatttacagggatgatcgatgagtattatgactactgctttggagagcttgaatacagaggccttgactttgagtttgagaccttggatatggaaaactatcagggaaacgctgtaattaattatacagatagagaaaccccttatacaaggataattgagcataagcactttgagaatgcagtctctgataagaccgtgattactagggagtatccaaaggcttgggaaaagggccaagaggcatactatcctatgaatgatgagagaaacactgagctatttaataggtataatgacttggcagataaagaaggcaatgtaatctttggcggaaggcttgggatgtataggtactttgacatgtggcaggtcattgatgaggcattgaagttagttaaatctttagaatag

SEQ ID NO: 1178 - DNA, 183 bp, Methanobrevibacter ruminantium
atggagattcaatatttattaaatcaagccctggaaaatgaaaacataagagaaatagagattgttgtaaaaatattaaaagagtttgaaaaaatcacccaaattaaatttgaattattgcataaagagttaatggaaaagccaaaaaagggcttaaagcaaagcaaattttcgataatatga

SEQ ID NO: 1179 - DNA, 156 bp, Methanobrevibacter ruminantium
atgaatcaaaactcaaaaaaagaatttgaaaaaagatatgaggagttctctaatttcttttttaaatgcgaaatagaatatcatacattaaaaggcaaaacaaaacatttgatggcgaaaaaatatttaagtctttttgatatggaatatctgtaa

SEQ ID NO: 1180 - DNA, 582 bp, Methanobrevibacter ruminantium
atgtatatgaatacaccaagccagaaaaacattgatattaaaaactatgaaagaattttcaaagaaaagattaattttgtagttgaaaaaatctcaaggttttttaaaggaacttcacaagaagattcttttttaaacgaaaaactactcgatttatctgatccctttattaaatcccgaataaaagaaattaaagaaacaactgaatctattgcagaatatttaaaaatagaatacatcaactatgatgaatattatgattttagagaaattcaaagcatgatgaaccaaactcttgattatggaagtatcgaagagttaaaaatcatattaaagatttttaatgaattcaaaaatttaacagaatttaaatttgaactattaagcaataaatcccactctaagagcattagctttaaagatattgatgaagaatcaaaagaaatctttgaaaaaagatacggagaatttagtaagttctttttcaatcgtaaacgagagtattatgcaatttttgaaggagaatgtgaagaggacgtaagtgaattctttgaattgatgaaaaagcatgcattaaagtag

SEQ ID NO: 1181 - DNA, 684 bp, Methanobrevibacter ruminantium
atgaaattattcatagatagcaatgtaattattggttactgcatagaaatagattattggcattattatgctgaaaacctaatgaaaaatgaaaatatatactggtcaactacagtaaaaggagaatctgaatataaacttgaaaaattaattaaaacttattcaaacttttttaatcaaattaaagaagatttagacaaagagattattagtaaaactgaattcattaaattagtgaaatctatagaatatattaataacaaaaaagtacctttcgaacaagaaaatttagcaaatttagtttggacaaaaggtggatggttagatgatgtaaactctatagaacttaatgaaaatctaaatttaatttcacaaggactaaagaaaaagatgtatagaaattataactactgtgatgaaatgttaaatttatacgaaagacaattcaaagcagaatatattcagttagtcaaaagattagaagagcttaaaagaggaaacagagaaatacattctccagatagtgaaatacttgtagattgtcatgatttgtcactttcacaaaatctagatatgggctttattacttctgatggagatatagtctattttaaaaaggaaattaaaaaaatgaccaatataaaagacattatttatttaaaaaatgttcataggtacacttaa

SEQ ID NO: 1182 - DNA, 1785 bp, Methanobrevibacter ruminantium
atgtgtgggattgtaggatgtgtactaaaagaaggcaaagtagcccctatcttatttgactctatatctaaacttgaataccgtggatatgattctatcggcatagcttgtgcagatgaagacaaaataaatcttaaaaaggattcaggaaaaattgcagaagtcgatgcaaagcttgacttatgtgatttggaaggcaaatatggaattgcccatgtaaggtgggcaactcacggagatccaagtaaaatcaattcacaccctcatctcaatggcgacggcaccattgcagttgttcacaatggaatcattgaaaattatctctcaatcaaggaagagcttgaaggggaaggttaccagtttgtctctgataccgacactgaagtgattcctcatcttattgacaaatatatgaaaacaggccttgatttgacccaatcagttcgcaaggtaatcggtgtcattgaaggggcatatgcacttgcagcaatatcctccgctgagcctaaccgcatagttgcaacaagaaaggacagtccccttatcgttggaataggagatagcgagttctttgttgcatccgactatcctgctatcttaaagtatacaaacaacatcgcattccttgaaaagggagaaattgtcattttagatgaggatggagtgaagttccttgatgaaaatgaccaagagatgactaaggagattgaagtcattgaatggtcccctgaaatggctgaaaagggtggttatgatcacttcatgattaaggaaatcaatgaacagtccacagccattaaaaacaccttgaatgaaaaggataaggtaaaggaaatcgttgatgaggtcaagggaacaatcaatagggttgtctttgtggcatgcggaacctcctatcatgcgtccctcactggaaaatatcttatcgagtcattggtgggaataccaactgaggtattgctggcttctgaattcaagtactctgcaaaggccttaaatgacaagacccttgtaatattcatatcacagtctggagagactgcagacaccttaaaggcacttgatgttgccaatgaaacttcaaagaccttggcaattgttaatgtgaggggatcatctgcaacaagaagggcagactatgttattcaaactcaagcaggtcctgaaattggtgttgcagctactaaaacctatgtaagtcaattggtggctatctacttattctcagcacttcttggtgaggatcatgagcttcttaagagattggaaaaggttccggattacattgaagaggtcctccaaaagcgagatgagattaaggaaatctctaaaaagtataagagggacaaggatgccttctttattggaagaggattctcctatcctattgcattggaaggagcacttaaattaaaggaaatctcatacatacatgctgaaggatatgctgcaggagagctaaagcatggtcctattgcccttattgacagaaacattccagtagttgtggttatacctccgggccaagaccataagaagatcatgagcaatctccaagaggtcaaggcaagaggcgctgatgtattgggaatcggtgcagttggcgatgaggacttgatttcagagtctgatgatacattccttataaactgtgatgttgatgatataattgctccacttgtttatatagttcctcttcagcttttaagctatcatgtttctgtaattagagagcttgatccggacaagccaaagaatttggctaagtgtgtaactgtggaataa

SEQ ID NO: 1183 - DNA, 708 bp, Methanobrevibacter ruminantium
atggaaaatgctcctaataaagaagacattaaaaagattgcaggagacgatctctctaaggcagaattaaaaaagagaattatagaattatatgattctggccaaacaatgatggatattgcagattctgtaaatagaagtaaaatttatgtaagcaatgtcattcatggattttacgatgaggatgagattaaggtccgtcaatatgacaaattaagagggaaagcaaaacttgatttttcaagatatagaagttctacaggtatttatagggttagttatgtagaaaacaaaagaagcggaaatgattattggtcatatcagtactatgacgatggcagattgaaaagaatcgtttctgtcaatttatacaagcttaaaactgttgtaactgaaaaaggattggactggtttgaatttactgaagaagctaaagagatggttttaaaagataaggaaaactttgatgaaagctctcttaagagaacaaacaagactggattctacagggttacaaagcgaaaaaccaatacaaagcaaggatacacttgggcttattcatttaaggagaacaatcatctttattttgtaagttccatcagcatttcaaagcttaaggaaaaggtcttaagcaatggctgggaatgggaagaattaactgaggaagccactagattggtagaagaggattctaaaaagcgaatttaa

SEQ ID NO: 1184 - DNA, 750 bp, Methanobrevibacter ruminantium
atgattgaaatggattctaaaaaattactttatgaaggaaaggcaaaaagtgtttttcaaggtgaaaatgctgatgaagtcataatcgactttagagacgacatgactgcaggagatggagcaagaaaagaaagcatgggaaaaaagggttatttcaactcaattatctgtgcaaaaatctttgagactcttgaagaggcaggagttgaaacacagcttatcgaactaaccgagccatgtgtcatgaaagctcgcaaattggatatgatccctatagaggtcattgtaagaaacatagctacaggaagcatcataagaaaattcccatttgaggataagagcccatttaatcctcctctcatacagatggactttaaggctgacgaatttcatgaccctatgttaaatgatgcaatagctatcgcccttggaattgcctctcaagaggaccttgataaattaagggagcttgccttaaaggtcaacgaagtaatgagcaaaatgtttaaggagattggaatcatccttgttgactttaaaatcgaattcggtaaggattcccaaggaaatatcatattaggtgatgagataagcccagatagctgcagactatgggatgccgaaacccttgatatgcttgataaggaactctttagacaaggaaaagatgacgaggtcattgatgcctatgaagaagtctttaacagactcttaaccgaagaagataaggcaaaatggaatattaaatag

SEQ ID NO: 1185 - DNA, 273 bp, Methanobrevibacter ruminantium
atgatgtatgatatcgaagttaaagtttccctaaaagcaggaatgttaaatccagaagcaactaccattcaaaggtcattatcccttttaggatacgaagtaaaaggaaccaagacaaaagagattatcagctttgtaatggaagcggaatccgaagatgatgcaagggcaaaagtggatgacatgtgtcaaaagctattatgcaatccgatcattcacaactacactataaaaatcatcaaaatggactttacctgtgcaagctgcgaataa

SEQ ID NO: 1186 - DNA, 654 bp, Methanobrevibacter ruminantium
atggcaattggaattataagattccctggaactaactgtgaccgcgacgtttataaggctatagatcttgctggcggagaggcagaatatatctggtggaacaatgaagacttgactgattatgatggaatcgttatacctggaggattttcctacggagactacttgcgtgcaggggcaatagcttccaacacacctgttgtggaaggggttaaggcacttgtaaaggaagaaaagccagttcttggaatatgcaatggagcccagattcttggagagattggacttgttccaggattgttcattacaaatgaagtccctaagttcaattgtgaatggagcagacttaaggtggcaaacaataagacaccgtttacaaagaactttgatttaggccaaatcattgacataccaatagctcatgcagaaggcagattctacactaaggatattgatttattgaaagaccaagaccaaatcgtgcttcagtttgcagaagagaaccctaacggatctatggaagctatcactggagtaagcgatgagtctggacttgttgttgcaatgatgccacacccagaaagagccacaaccaaattattaggctcagatgacggtcttgaattctttaaagggatgttagatagtatttaa

SEQ ID NO: 1187 - DNA, 714 bp, Methanobrevibacter ruminantium
atgccagtatatttaataggtgcaggtccgggagaccctgatttaataactttaaaagctgtaaaagcattgaataaagcagatgttgttttatatgactatttagccaatgatgaaatattaaaacatgccccagatacagcaaagcgcatttatgtaggaaaaaaagctggagagcattataagacccaagatgagatcaatcaattgattatagaagaggctaaagaaaatgaaaatgtagtcaggctcaaaggaggagacccatttgtattcggcagaggtggagaagagcttttagcccttgcagaagagggaatcgactttgaagtcattccaggagtcacctcagcaatcggtgcacctacaagcatggcatttcctataacccatagagctgttgcaacatcctttacagttgtaacaggtcatgaagaccctacaaaagaaaacaagcaagtaaaatgggattatactgcagacaccctaattatcctcatgggaattggaaacataaaagaaaacactgcagaaattatgaaatacagagatccagacactcctgcctgtgcaatcgaaagcggaacactccctaacgaaagggttgtctttggaactcttgcaacaatagcggataaggaaatcaatacccctgcaatacttgtgattggaaaggtcattgatgtattcaagcaaataaagggaattgaataa

SEQ ID NO: 1188 - DNA, 1512 bp, Methanobrevibacter ruminantium
atgaaaattctattcttaaacttaccatatgaattcaatataagcagggctagcagatggcctgaaaagaccaaatcaggtaccttatattatccttactggcttgcatactgtgttggggtatgcgaacgtgagggatacgactgcaaattggttgattgcattacaaaggcatatacaaccgaagatacagttgaagaggttaaaaactaccaacctgattatatcatggctgaaataacaacccctacttgcgcttatgattatacagttataaatgccattaaagaggcttatcctaaggcaaaaatacttattggaggaactcatgcaacaatattgcctgatgcagtcttaaaagagtgtttaggcatcgattatcttcttcgccaagagtatgactatactgtaggggagcttatatcctctgatgatgttgcatcagtgaagggagtctcctatagggtaaactctgatggtgtggacatcgcatctttaggtatcaatctattgactgaaccagttgactttgaagtaaggcataccgaagacagagagcctcttgaggacttggatagccttccatatgtttcaaaggtttaccagaagtatctaaacttcgatgactatgcatatgccttcgctcaaaagccaatgattcagattgtatcatcaaggggatgccctaaccagtgcaatttctgcagctatccatctacaatgggcggaagaatttataggacaagatcagtcactgaccttgcagatgagtttgaatacatcttgaaggagcttccagagattaaggaaatctttattgaggatgacacattcactgttaatcagccaagggttattgagttttgtgatgagattataaaaagaggcctaaagcctatctggtcctgcaatacaagggttgacttaacctatgagacaatgaaaaagatgaaggatgccggttgcagattacttgtttgcggatatgagtctggtaatcaggacgttttaaatgagactaaaaagggaataacccttgaacagtcaagagcatttgcagagaatgccagaaagttagacattaaagtatttggctgctttatgatagggttgactggtgacagccttgagacaatcgatgagacttataagtttgctcaatctgtttatccggacatgtgcttcttccagcaagcggtaccattcccaggtactggattttatgattgggctaaagagaatggctatctcattacagaggactattccaaatggctgaatgaggatcggtatcttaattgtctggtggactatccttatgcagatcataaggagatagagaagttaagagacagtcttatgagcaagtattatttctcatttgcatatattgtaaagactttcttagctaaccttgattgggttgaattcaagagagtcatgcgaggaggaactcagtatattacttttagacttaaaaaagctttaaataagtctgataatttggattaa

SEQ ID NO: 1189 - DNA, 777 bp, Methanobrevibacter ruminantium
atgaaaaagaaaatagcaatcacaagacctcaagaacggtcaaaagccgcaaaggagtttatagaaaactatggatccgaagcaatcatagtcccaacacttgaattgaaactggaaaataccgaatcactaaagaacctgatggaaaaatccaatgagctagactggttgatatttacatcagtaagttcaatcgaatcaatctttgaattctatccggacttcttggacaagttgaatccagagtgtaaaattgcaaccataggtactaaaactgcagaacttggtataaaaaaaggactccctatagacatcatacctaaagattatactgctgaaggactgcttgaagaatttgaaagaatcgacttaaataataaaaatgttggcgtccctaggacattttctgcaaggactattttacctgaaggacttaaaaatatgggggcaaatgtgatcttggctgaaagttataaatcagtcattccagaggacacaagcaagatagaaaaactgattcaatgcatcttagatgaaaagattgacggaatcacatttacaagtcctttaactgtatcaaacctttttgaaatagctaaagatgaagataaggataatctagttgaaaagttatctacaacaacccttactgtagctattggaccaattacaggtaatatattgaaccaattaggagtaaatcacatctatccaaaaaggtatactgtaaaagacatgattgacttgatgtttagggagttaaacaatagggaataa

SEQ ID NO: 1190 - DNA, 906 bp, Methanobrevibacter ruminantium
gtgaatggagaatatctgatgtttattgattcagatgacacatatccaaaagacgcttgtgagattctcttaaataaaatagaggaatatggatgcgacattgcctttggaagatatcttaggcattatccggaagagaatttcataagaaaatcctacactccctatatcgacacccttgatgaaccatatcttagctatttagatgatttagtaaagggatccaactttaagggaatagtagggagcctttggaaaaacatattcagcaagttcttctatggtagctccatagatatgaataagttcaattcaaaggaatctgataattcccacccaaaggaactggataaaaattataaaaataataaagagatattcataagaaatattaaggatgaaaataaagaggaaatagctatcttaaagattttaccttcattttggactaaaatctatagaagcgaacttataagcaaaaacaatatcaatttccccgaatgtgtctctgcagaggatttgaactttctattggaagcatactttaaaagcgaaaatggaattttgtttttgaatgacaagattgtctataattattttatgcgtttagaggttgtagataagtcagttacaaaaaatatcaatttcagattggtttatgattcaattaaagcatatagattgtcttcagagctttgtgacaatttcaatataaagaataaggacctgttcctaaacccttatctattaaactggataagcttatggctaagcagaaaaaatacaaaagaggaaaataagatatttttagaggaatttgataagttagataagactaaaaagtatggtttgaagtataaattgattttaaagaccacaaaattattattaaaaataaaatcataa

SEQ ID NO: 1191 - DNA, 324 bp, Methanobrevibacter ruminantium
atgaaagaagtaatgatatggccaatttatttagatgcagacaaatctctaaatgaaggcagaaagatatcacaggaatatgctatttcagaaccaagaataaaagagattgaaaaggctgctcaaaaattaaaatacaaatatactgttgaagaggataagtcctatcctggagaatggtataataaatctggaagaatcataattgaaactgatgattcaaaaaaagaaattcttatgaatttgtcaaatagcattaaagatattagagaagctagaaagaactataagcctactaaaaaaggtaaaaaaggaaaaaaatag

SEQ ID NO: 1192 - DNA, 1443 bp, Methanobrevibacter ruminantium
atgatagaaacattaccaccagacatgaaacagaaatatgaagaggcaaaggaacttatagagtcctcagaagacattaaaatatatagccatacagattgtgatggaatatcttcaggagccatcctatccactattttaaaaagaataggaaaagactatgaaatagagatagtaaatcttgatgtcttggaagatttggaaatagaacatgaactaaccatcttttcagaccttggatcaggacagcctgtagacaaacatgccaaaaaagattcaaaaatactgatattggatcaccaccctccacttagggaaatggactatccagacagtgtggaatatacttatctcgagataaatccaatgtttcacgatatagacggttcacaggaaatctgtggaggaggactatgctatctccttgctaaggaattcggctatagggacctcagttggataggagttcttgctgccattggagatatgcaaaacactaaaaccggaaagcttcaagggatgaacaaaacaattcttcaagatgccaaagaagaagggctagtcagctccgatactgacctgtcattatatggcagacaaacaaggcccttatttgtagcattatcctatttcagtgatgttaaattgcctattaccaacaataagaatgaaacaattgcgcttttacaaagattaggaatacctagaagaattaaagatgaaagcgttccttcaggagaaagggcaaccaccctcagtgacttgaatgacgctcaaaaaagggcattgactagcgaattgataaggatgatatcaaacgaaattcctccaagatatagcatttatgttcctaaattggtaatagctgacacttacgaattcttagccgaagaagacggcacattcctaagggatgcatctgaattttccactgcaatgaatgcatgcgttagaaataatgaagaggtcgttgctttaaaaatcctagaaggaaatagagctgaggcattagatgcacttgaaatcatttctaaagaccatagaggttatttggccgagaacattcaaagcattgaggatgagcataagattattcaaatgaaaaacctgcaatactttgacggctcaggaatcagaagcaatgtagtaggtacaattgcaggaatggttcttagctatggagattggagaaagcccatgattgcatttactcaagtaagtgatgagaatcaagatttaaaaatatctttacgctgctcaagacttttggcatatgatggaattcactttggaaacattataagagaagttgcacaaagcttaggaggaaatggaggaggccataatgttgcttgtggtgcatatattcctaaagataaaaaagatgaatttttaaatttgatgaatgaaaaactagaaggaaaattagctcttgaagactaa

SEQ ID NO: 1193 - DNA, 828 bp, Methanobrevibacter ruminantium
atggagattttacaaaaaagaggagctttaactcattttcaaatattaggtgaaatatctaagcaagaaccaaacttaaaacaaaaagatttggctgaacgtttaggaattactatccaagcagtttccgaaaacataaaaacattaaccgaacttgaatacattacttcaaaagacggaagagcaccatataaaataactcaaaaaggaattgcaaaggttaaaaaagatgcaatcatccttagaaaatatactgacagtgttcttgaaaccatgacatattataaatccacttggcctgcaattgcaaaagaagacttgaaagaaggagacgaagtaggtttatatatggaaaatggaagattatatgcatcaataaacgcccaaacttcagcatatgcagatgtgatattagacactaaaaaaggctttgatgttgctctaacaaatctcaaaggaacaattgaaatcaaagacagcaagattttaatagtcacattgcctccaatcaaagatggaggatcacgttctgctgatttggacttggttaaaggaatctatgaaggaaactatgaaaattatggattaagttccattgataaggttgcagcaatcggcaccacttcacatgcagtagccaataatttaggcattccaatagacattgaatttggagtaagcgaagcttcccaatctgcagttagaaaaggacttaatgttatgattctttccattggagacatgagcaagaatattagtaaagatttagaggatgctaatattcaatatcaagtcatagatgctaagaagtctgtaaaaactgcctaa

SEQ ID NO: 1194 - DNA, 696 bp, Methanobrevibacter ruminantium
atggaaaataagcttataagacaagacactagcgatttagatattgtaaatcatccagagattaagggtttacagattattgaaggaaaaataaattttccaatcagttggttaaatcagcaagggtactgtgaatacacattatatctgcaatacctaaaaggcattaaaacaatgccaactcaggctatgaccacaggcactaaggaacatttaaagttagaggaagaatttaagcaaactgcaaccccatcaagttttgatgatgcatttaaggaatctaaggaaaaggaaatactgtctcgtgaaatgtttgttatagattctgaagagggggttcgaggttttattgatgagatttggatgactccagatgagattgtgataattgatgataaaccgggcaatagggcttatccatcatctatgaatcaagttcgtgcatattgtttggcctttaaaaacatgattggcgatgataatcgtataatcagaggcgctttaagacaaagaggcactgacaatatattttggagtgaaatctttgatgagaaggttgaagagaatatattatatttaattcaccgtatgcatggtctatttgaaggcactaaacctttcatacctactaaaaatggaaataaatgtagagcatgcagatatcaatcctattgtgaacacaaagttgatatttag

SEQ ID NO: 1195 - DNA, 441 bp, Methanobrevibacter ruminantium
atggatttatttgtaaaaagaatcattgcttacattcttgatttctttgtagtttcagcatttatgtggattttctcatatttagcttatttctttattaattatttaaatatgttccaaatctaccattatttcatttttatacttccaatattaattttagtttactttacattcttggaaaagaatataggggcaactgttggcaagaaattaatgtttatagaagtgaaatctactgttgctaaaagaagtagaaatggaaggaattataatttaacttatgggcaagcatttattagatctttatctaaaatctactggttccctataatcattgatgtgattcttggtaaaattgctggaaaaaccagattactcgatggattttctaaaaccactgtagttgaagaaagagtagacagatatctttattattaa

SEQ ID NO: 1196 - DNA, 1011 bp, Methanobrevibacter ruminantium
atgaaaataggtatgtcacatggagctggtggagaagttatgggtaatctaatttcagaaaccattcttaataatttatcaaaaaaagctgttgaaggaggtttaggcctagatgctttagatgacggagcaactatacctttaggcgattatgaaattgtatttacaactgatggtcacacagtaaatcctttattcttccctggaggagatattggaagaatttcagcagcaggaaccattaatgatgtttcagttatgggcgcaaagcctttagcaatttccaatgcaatgatcttgcaggaaggctttccaatagaggatttggataaaatcatcaagtccatgagtgccacttgtgaggaggctgatgttgcagttatcacaggagacactaaagtcatggaacaggataagcttgaaggaattgtcattgtaaccacaggtattggaatagcaaaaaaaggagaggtaatcaaggattccacattaagcgttggagataagataataatttccggaagtgttggtgaccatggaatgagtttgatgtcctttagagaaggctttggatttgaaacagagttgaaatctgatgtggctcctatgtggggaattatttcaaaggctcttgaagttggaggtgtcactgcaatgaaagaccctacccgtggaggtcttgcaaattgcataaacgagatggctcgcaaatctggtgttggagtattgcttcaagatgaagccattccagtgaagcaagaagtcagagcggcatctgaaatgttaggaattgacccttatgaagttgctaatgaaggtaaggttttaatgggcgtaaaggctgaaaaggcagaggaaattctagaagccattaagactgataagtatggtgccgatgcagctatcattggtgaggttattgatgatgataaggttttaattgaaacgggaattggaggcataaggattttagagactcctattgcagatccggttccaagagtatgttaa

SEQ ID NO: 1197 - DNA, 378 bp, Methanobrevibacter ruminantium
atggcaatttgtcaaggaaaatcaactagaacaccttctggtgctagaagagttgcaaatcgtggaaaaagaaaatctgaattaggtagagaatctgcagaaactaaattaggggacaaaaatttaagaaaaatcagaacccgtggtggaaacgtaaaaaacagattagctagagacaataagattaatgtagttgatgcagaaggtaaagctcaaactgtagaaattttcggtgtaatcgaaaacactgctaacccaaactacgtaagaaggaacatcattactaaaggtgctattgtagaaactgcagctggaaaagctaaagttacttctagacctggccaagatggtgttattaacggagttttaatcgaataa

SEQ ID NO: 1198 - DNA, 681 bp, Methanobrevibacter ruminantium
atgccagaatccccagagcaattagctattgaaaaagaaattcaaatccaaaaggacaagtttttaaacttctttaatggagagttaccagatacaatggaacttgaatttgagggattctacagaagaggtttttttgtaagcaaaaaaagatatgcagtaattgaaaatgagaaaatcatagcaaaaggtttagagcttgtaagaagagattgggcaccaatagctaaaaaaacccaagaggaaatattgatggccatcctaaaagagggggatgttaaaaaggctgaaaagatcattagcaaagtccttaggaaaatcaaatcaggagacattgcaactaaagatctaatcatacatacccaaatcactaaaaatcttgatgactataagcaaataggacctcatgtgattgctgcgcgtgaaattgaagcacatggaattaaagtaggtaaaggaacaattgtacaatatataatcagtaaaggaaaaggttctattagccaaagggcagtcccttatgaatatagtgaaggagttgaatatgataaagaatattatattgaaaatcaactgattccagcagtttcaagaatgatggaacctttaggatatgataaaaatagattgagagaattggcatcaaccgaaagacagcaaagtttagatgcattcttttag

SEQ ID NO: 1199 - DNA, 681 bp, Methanobrevibacter ruminantium
atgactaaagctgtgttctttgatatagatgatactcttttagacacttctagctttgcagatcttgcaagacatgcggctattgaaagtatgtgcaacaacggtttacctttagaacctgatgaagcatatgacctattaaaagatattattaaagaaaaaggttcaaactattcaaaacactttaacatattgacaaaagaagttttaggtaaggaagatcctcttttagtggcaatcggcatgaccacttaccataacgttaaatttgcacttttaagaccattccctagaacaagtgccattttaatctacttaaaaagtaacggctataaattaggggcaataacaaatggaatcacaataaaacaatgggagaaacttgtcagattaaatttatatcatttctttgacattgtaattacatcagaggaagtgggagttgaaaagccagaccctgaaatctatcttgaagcatgcagaagaatggcatgtgatgttaaaaaaagtgttatggtagggaataaactagatattgattgtatgggtgcagttaatgctggaatgagtgcaatacttgtaaattccactttagatgaagaggaaaaagaaagagttaataatgaagacattgatataatagttttagacagcatttccgatgttgatactgttttataa

SEQ ID NO: 1200 - DNA, 273 bp, Methanobrevibacter ruminantium
atgagtgattttgaggaagtaatgactgaatacatcaaaatctcaaaacaccgcgaaaaagtatttaaaacattgaaagatggttctaaaaaacctagtgacattgcaagagaaacaaatttaaacatcaacagtgttagtttatctcttaaacagttaactgaaaaagaattggtttatttattaaatcctgacgacaagaaaggacgtttatataaattaaccgaaataggcgaaacaataatcaaggaatttgatgaaaaaaccgaataa

SEQ ID NO: 1201 - DNA, 777 bp, Methanobrevibacter ruminantium
atgacaaaaattagacttatctcatggaatgtaaatggcattagagcaattcataaaaagggctttctagactggtttaatgaagagaaagcagatattgtaaacttacaggaaaccaaagctaaaatagagcagttaccaaaaaaattaatcaatgttccaggctataccagctatttccactcagctgaaaggggaggatatagcggagtggccacttacacttcaatagagccaaatgaagttattaatggaatgggaattgagaaatttgatattgaaggaagattaatcagattggattttgatgactttactctcttaaacatctattatcctaatggaggtcgcgacgaagagagattgcaatataaattagacttctatgatgcatttcttgattatgctaacgatttaagagaccaaggaaaaaatcttgttatctgcggtgacttaaatactgcacataaggaaatagatcttgcaagacctaagcaaaatgaggatgtatcaggttttcttcctatagaaagagaatgggtaagcaaatttctagacaatggctatgtagatacctttagaatgctacatgaaaatgaaaaagaaaaatatacatggtggagttataggactagagcgagagaacgcaatgtagggtggcgtttagattacttcttcgtaaacgaagaatttaaagacaatgtaagagcatcttacattatctctgaagtgatgggttctgatcactgccctatagctttagaaattgaaatttaa

SEQ ID NO: 1202 - DNA, 1548 bp, Methanobrevibacter ruminantium
atgagtgaagttatagataaaatcattaatgaattacatatttatgaaaaaaaattacttaaagagttagaaaagaacgaagatcttagtcctgatgagatagctcaagatacaggcttaaacattaagtctgtaatgagcgcagcaggaattctcgcttccaaaggaatcatcactgttaaaaaagatgttgaagagaagttcagcttaactaaatatggtaagaagtatgctgaaatcggtcttcctgaaagaagaatccttaatgagcttcaagagaaaaaagaattgcatatgaaagatttggctaaaatagacagtcttgaaaagaaggaaatcaatattgcaattggctggttagttcgtaaaggctgggctaagataaacaaaggtgtagtgactatcactgaagttggagaatcttctaaagataaattaggtgatgatgaagttttacttaatcttttaaatgaaaagggaagtttatctcaagatgaacttgatgaagatatggctaatggtttagcagcacttaaagataggaaaaaattaattgcaagtgaaaaaaccacttcccatagcttccagctaaatgacttggcttatgagattttagataagggctttgacttaactgaagaggctacccaattgactcatgagcaattgaaagacggcagttgggctaaactaaaatacaggccttatgatattaatgctgaatatcctattttcttcccaggtaaggaacatccattaagaagaatcattcaggaaattagggaaatcttccttaaccttggctttacagaagcaaaaggagaatatttggagtctgcattttggaatttcgactcattgttccagcctcaagatcacgctgcaagggagatgcaggatacattttatgtaaagaatccattgacttgcgacttgccagatgatgaccttgttgaaagggtagctaaaacccatgaagatggtggaaataccaattctgaaggttggcattatgattgggatgcagatattgctcgccaatctgttcttagaacccatacaactggaatttctacacaagcactagcaaattgggagcttcctattaaaatgttttcagtaggcagagtatttagaagagaaacctttgactataagcatttgcctgagttccatcaagtggaaggattggttgcagctcctggaatcaattatcaaaatctcctcggaacattaaaggaattctataagaaattaggctttgaagttagattcagacctgcatatttcccttacacttatctttcaactgaatgtgaaatctatttggaagagaaggaaagctggatagagcttggcggatgtggaatgtttagacctgaagttttagaacctttaggtgttaaagttccagccttagcatttggtttaggtattgaacgtttagctatgattagatatgacttatctgatattagaatgctttataagagtgatatcagttggttaagggaagttcctttagaagaaggcattaactttgaataa

SEQ ID NO: 1203 - DNA, 900 bp, Methanobrevibacter ruminantium
atggaagcaaaccaaatagcaaaattggcacaaattgcatcagcgttagaagttagtggttatccaaaacctggaaatgttcataggactcgtaattatgatgatatggtctttgaagactttataatcagtggagttgttattggagataccattcgagaattggctaatcacacccaatccattgatgatttgtctgatgcaaatttaggcaaatatattttagaggcagttgctgaaacaaataaatggattgcaaataataccaatctgggcattatgatgatgtgtgttcctattgcagctgctgcttcaataagtgatgattttagccaaattcaagaaaatgtaggtaaattgatggatgcaactactgttgaagatgctgtagatttatatgatgcaattaatttagctgatgctggaggaatgggggatcaggatgagtttgatgtaaccagcgagaaggctaaggatgaattgcgtgcaaacaatcaaaccatgtttgatgttttaaagatatctgctccttgggatagattggcatctgagcttacttctaaaatgcctgtttcctttgaaatcggttatccgacattcactggtttctgcaattcatgtgaggatgttgataaaatcaataaggctactgtactcactttcatgacacttttatcagagattccagacactctcatttcaagaaaatatggtgatgaggttgctaaagatgtgtctctaaaggcaaaagagcttttagaatttaaagatgatgatgactttgtagaaaagcttttagaattcgatgactatctctatgaaaataaatataatcccggcactactgctgatttaactgcagcatctatatttattagctatttggataaagaattctaa

SEQ ID NO: 1204 - DNA, 996 bp, Methanobrevibacter ruminantium
atggattttccaaatactagaatgagaagatatagaaaaaactctaaaataagagatatagttcgtgaaaccaaattaaataaagaggatttgatttatccaatctttgtaaaagaggatttaaaggatgatgaaaaggaagagatttctacaatgcctggagaattccgattttctataaatggtgctgtggaatatgcaaaaacattggaggctaaaggattaagatcaatcatcatattcggtattccaagtgatagcgaaaaagatgaaatcgcaagccctgcttattctccaacaggaatagttcaaaagaccgttcgcaaattaaaggctgaaactgatttagttgttataactgatgtttgtctttgtgaatacacttctcatggtcattgtggaatattgaaggaaaatgaagatactgattttggatatgaaatattaaatgacgaatccttaaagttcttggcaaagactgcggtatctcatgcagaggctggtgctgatattgtagctccttctgatatgatggatggtagagttgcagcaatcagagaggctcttgatgaggcaggatattataatacaatgattatgtcttattctgttaagttcgcctcttctttttatgctccatttagggaagcggcatgctcttctccatctgttggaaataggaaatcctatcaaatggatccagctaatgctcgtgaggctattcgtgaggcagagcttgatgttactgaaggaactgactttttaatggttaaacccgctttaccttatttagacattattaaaacagtaaaagatgaatttaatctgcctttggtaacttataatgtaagtggcgaattttcaatgattatggcaggaatagaaaatggctatttgactgaagactctattatggaatccttattatgcattaaaagagcaggtgcagacttgattattagcaatttcgctccatatgctttagatcatttataa

SEQ ID NO: 1205 - DNA, 1101 bp, Methanobrevibacter ruminantium
atgacaaatacaattggaaaaatctttagaattactagttttggttctagtcatggaaaagcacttggagctattgtagacggatgtccagctaatctagaacttagtgaagaagatatacaaattgaattaaataaacgcagaccaggaaccagtgctttaacaactgcaagaaaagaacaggaccaagtggaaatattatcaggagtatttgaaggaaaaacagatggaactccaataactggagttgtatacaatacaaatcaaaaatctaaagattattcatcacttaagaacactccaagaccaggacatggagattactgctggatagaaagatacggaaactacgactataacggaggaggtcgtggaagcggtagaattaccataggccatgtaatcggcggagctatagcaaaaaagcttcttagtgcaaaaggaataaaaataatctcccatgttgtgcaaatcggagatataagagcaaaggaagcaaatattgaatcacttgaagaaaacatcacaaagaataatgtaagatgtggagaccttgaagtggccaagcttatggaagatttgattttatctaaaaaggaagaaggaaactctgtagggggagttgttgaaacaattgctttaggagttccagcaggacttggagaacctgtttttggaaaaatagatggagatttagcaaaagtcctaatgaacatcaatgctgttaaaggagtggaaatagggttaggatttggtgttgcgaccaaaacagcaaaagaaatcaatgatgaattctattacgaaagagatgatgttaaaactaaaacaaacaattctggaggaattcttggaggaatgacaaatggaatgccaattgtatcaagaattgcaattaagcctactccttcaatttctcaaattcaagaaaccattgatttaaataaaaaggaaaacactacaattgaaattaaaggtagacatgatccatgcatctgtccaagagttactgcagtggctgaatcagcaactgcaatagttttagcagaccatatgattcgttcaggatttatccatcctacaaatttagaaaaaagagtttaa

SEQ ID NO: 1206 - DNA, 942 bp, Methanobrevibacter ruminantium
atgaaaataacatttttaggttctggtggaggaagatttaccaccattagtcaaaaaagaatgactgggggattcaggcttgataatttcggtggaaagaattatcatatcgacccaggtccaggtgcccttgtcaggtcttaccaatttggtgtaaacccaactaaaattgatggaatttatatttcccattcacacactgatcattatggtgatgcagagattcttattgaagcgatgactcgtggaatgacaaagaataatgggattattatggggagcaggtctgtttttgaaaagtataagcgttggggtcctgcaatttctaattaccatagaagcaattccaagaatctgattttggttccaaataaaatcaaacgtttccctgatttttcaataaagggaactgacaccattcatggagatcctacaggtgtgggctttcagatggaagcaaataacttaaaggtttcctacacttccgatacaagatattttgaggaattgaagaaatatcataagggtgcagatatattgataggaagcgttttaagacatgatgatgatgctatcaagggacatatgtgtactgatgactttataaatttggttggtgacgttaagccaaaattagctataatgactcattttggatttaagatgattgctgccaatccggttgaacaggcaataaaggtttcaaagaacacaggtgttagaactcttgctgcatttgatggaatgttggtggatgttaatgaaaaatatcctcaaaagtctcgtatgttaagacttaaggacagatttgcagctcatatgaaacaagaagacgtttattcaactaattttaaagttaaatcaaataaaagaaataaaatgagaaataagaagaaatattataataataatgattctaataattcttttagctctaaataa

SEQ ID NO: 1207 - DNA, 927 bp, Methanobrevibacter ruminantium
atgagtttaattattgcttatgtaggaaaaaaaggatgtgtaatggcggcggataagcgtagaattgcttatttcggtttaaaagaacaacgtgaaattttagaacaagaaatttactctggtgaaattcataatgatgaagaattatatgctagggctgaagagttagatgttaatttaaaagttacagataatgcatgtaaagtaaaaagcattgaaaatgttgctattggtgaagtaagctctagaggaacaatggaaactaaaaggaaaagaatttatggtacaagcaatggttttaaaatcattgaactttccggttctcatgtattaaactctaaaagaggagtctcttcaataatcgtatttggtaataaagttactaaatcattagctaataaaatgattcaggaaagatggaagcctagtttcagtttaaaatatatgggagagatatttggagagattctaaaggacattgctgaaatcactccttctgtaggtaaggattatgatgtgataattgaaaaaaataatttggcaaagagccaagttcaagattatatagatgaagtcgctgaaagggacgttaaagttttagctaaattcagggcacaacttagagagcagttgatggaacagaatgaaaatataaaattggcttcaactattattgaagagggatccgttggcgaaatcgttataattgatgataccttaattgaagtgaagttaaatcctgatgttagggcatttgatgttaattggaaggtccttgcaggtcctggtgaaaatgttttaatggttgtggacgactctgaaggtcttgataagggcgatgagatagtaattgaagacgaagtcttatgcgttaagaagaataaggctaatttgaaatgtgatataattttatgtcatcttgaataa

SEQ ID NO: 1208 - DNA, 381 bp, Methanobrevibacter ruminantium
atggtaaaaattaatgaaatttacagatgcaaccactgcggaaatataatcgaaggaatcgttgaaggtgccggagaacttgtatgctgtggagaacctatggaactcttagaacctagacaattagaggaaggtggagtaaaacacatccctgtagttactaaagaagatggaaaaattgtagttaaaatgggagaagttgaacaccctatgttagaagaacactacattaactttgtccaattaaccattggagatcaagtcttccgtgctaacttaaaaccaggagaagaaccaaaagcagtatttgacattaacgctgaaattgaagacataaaagcaatcgaatattgtaacatccacggcttatggcatgcataa

SEQ ID NO: 1209 - DNA, 2343 bp, Methanobrevibacter ruminantium
atgaaagaagcatgccctaaatgtaacggaactggtttagtagcagtggatacaaagatatgcgatgcatgtgatggaacaggatatgaagacacttttgaaatgaaaaaccatttcaaaggagttaccagcaatgcaagagcaaaatttgatttggatgcagatcaagacattccatgtgaagtatgcaatggaaaaggtgttgtggatgtttttgaagactgtccctactgtaagggaacaggccaaatcaacgtatgcaacagctgtggaaaggcaattccagatgataaggattactgtgacgaatgcaatgaaaagcagcttgaagaaaagatgaataaagtaaaggaaagactggaaaatcctaaaaagcttaaagtcgagtcagacattgaaggaaaggaaatcgtatacgaattagacggactatgtgatatgagtgacttggaaatcaattcactttacaaaggaaaagtcacccgtgtagaaagatacggtgtttttgtaagccttaacaatcaggtttggggattgatgagaaccagcaaccctcacaataaggtcggagacaccatctttgttaggatttcacagattaaagagagaaaacgtgaagttgatatggttccggcacatgtctttaaaggagaatatgtagtcaagaaactatccaagaacattggaagaaccaaaatcgaaacccttgatgaaagctctcttaaaagcattgttaaagtatacggagaagtcatacaaatccaacagacatcagggccaaccatctttacaatcactgacgagacttcaatcacttgggctgctgcctttaatgagcctggagttagaatgtatcctgaaattgaagtgggagacattgttgaggtcattggagaagtcaatcagcacaatggagaaatacaaatcgaatctgaatccatctccaaattagatagtgatgaagctgaagcaatgaaagaattgattgacattgctttagataaaaaagcagaacctgatgatgttgatttcttaattgaaagccctgttcttgaaagattaaagccaaaaatgagagaggctgcaaaagtcattagaagagcagtgctggatggaagatccatacttgtaaggcaccataacgatgcagacggaatctgttcaggtgtggcaatagaaaaagcagtaattccatatttaaaggaaaacaatccagacaatgatgcagaataccactactttaaaaggtctccgagcaaagccccattctatgaattggaagatgttgtaaaggacttgtcctttgcacttgaggaccttgacaggcatgggcaaaaactgcctcttattgttcttttagataacgggtctacagaagaggatattgttgcattgatgcaagctaaaatatatgacattgaaatcgtggttattgaccaccactccccaggaaatctaattacaaaaaccttaaggaacggagaaacagtctcaggagatgtggaatctgctccagaagacattatgggaggaactgtagcagttgacgaatatgtggacacacatgttaacccatatcttgtcggaggagactcgcagattacagcaggcgcattggcaactgaagtggctcatttcatcaatccagaaattgaagacttaatcaagcaccttccaggaattgcagcattaggtgaccatgcagaatcagatgaagcagaacagtatgtggaacttgcagcaagtaaaggctactcaagagacagattaaagcagattgctgagtgcattgactttgaagcttacttcttaagattcatgaacggaagaggcataatcgataccatcttaggtgttgacaatattgacaaacatcctaaaatggttgatgcattgtataaagagtatttaagacgtgttgacactcaaatgaaagcagcgttgccgaatataaaaagagtgaaattagacaatggcatctactttaatgttttagatgttgaaaaatacgcacataagtttactttcccagcaccaggaaaaacctgcggatttgtccatgacaagattgtaaaggaaatcggcgatgacaagcctatcatcacattaggacatggcccagactttggtgttttaagagcaacagacacagtacaccagctctttggatttaatgtgaataatattgtaatcagtcttgcagataagatacctcaagcaggtattgatggaggaggccacgaatgtgcaggatccattaaatatattgagggtcttggcaaacaggtattgactgaacttctcaatgaagtcagtgaaatgactgacagttctaagaattaa

SEQ ID NO: 1210 - DNA, 375 bp, Methanobrevibacter ruminantium
atgtacagtgataaagttatggatcattttgcaaatccaagaaactctggcgaaattgaaaatgcaagtggtgaaggtactgttggaaatcctacttgtggagatttaatgacaatctatatagatgttgatgatgatgaagtaattcaggatattaagtttaaaacattcggctgtggtgctgcaattgcaacaagcagtatgataactgaaattgcaaaaggaatggctgttgatgaagctttaaaaatcactagaaatgatgtagcagatgctttagatggtcttccgccaattaagatgcactgttccaacttagctgctgatgctttagctgaagcaattaaggattataaggaaaagcaagaagaataa

SEQ ID NO: 1211 - DNA, 1209 bp, Methanobrevibacter ruminantium
atgatttatatggacaattctgcaacttctccagttaaagaagaagttttcaatgcaatggttccttacttaaaggaagaattcggaaatccttctgccttttattcattaggtagaagtgcaaaaaaagcagttgaaactgcacgtgaaaatgtggctaaattaatcaatgctgagacaagagaaatcatctttacaagtgggggtactgaatccgacaatatggctataaagggcatagcctttaaattggaagataaaggaaagcatatcattacaacagtaatcgagcatcctgcagtacttaggacctgcgaatacctagaaacaaaaggctttgaagtgacttatcttccagttaaggaaaatggtattcttgatattgaagacttaaaggaagcaatcagagacgataccatcttaatttcagtaatgcatgcaaataatgaaattggaactatccagcctattgaagaggtcggtggaattgcaaaggaaaaaggcatcactttccatgtggatgctgttcaatctgttggaaaaatccctgttgatgtaaaaaaagcaaatattgacttattatccatctcttcccataagctttatggtccaaagggagtaggtgcgctattcattagaaaaggagtaaggattgaaaccttgattcatgggggaggccaagaaaacaatctcagatcaggtactgaaaacgttccaggaattgttggattcggtaaggctgcagagattgcttataataatttggatgcaaatattgaaaagcttcaagaaatcagagaccttcttataggagaggtattggataaggtcccagaggcatatttgaatggtgatagagaggagagactccctaacaatgcaagcttcagatttgcagcgattgaaggtgaagggctaatcctaagattggatgcgaaaggaattaatggggcaacaggttctgcttgttcttctaaaaacctaaaggcatcttatgttttaagcgctcttggattggaggatgctgaaattcacggctcattaagattatccttaggagtagagaattcaatcgaagatgttgaagttgtatcagatgccattgcagatgtggttggaagcttaagacagatgtctcctttatgggacaatgagaaaaacgaatccttagaattggatgaatccaaatttacagatgtggatcattag

SEQ ID NO: 1212 - DNA, 1320 bp, Methanobrevibacter ruminantium
atgacaaataaaaattatggattaagtactttaggattacacgcaggacaagaagaaccagacccagcaaccggtgcaagagccgttccaatctatcagacttcgtcttatgtattcagcaatacggatgaggcagctaacagatttgcacttcaggaatttggtcaaatctacagcagattaactaaccctacttcagatgcatttgaagcaagaatcgctgctattgaaggaggaaattccgctatctctgctgcaagtggtttggctgcaatcagttatgctttgttaaacattacaccgcctggtgatgagatcgtatctgcaaacaacctttatggtggaacataccaattgtttgattacactttcaaggatttggcacgtaatgttatctttgtagattcccaggattatgatgcctttgaagctgcaattaccgataagaccaaggcaatttatgcagaatcattaggaaaccctaagttggatgttcctgactttgaaagattagctgaaattgcacattctcatgacattcctttaatcatcgataacaccgctgcagtagggcttgtaagacctttagaacatggtgctgatgtcattgcagcatctgcaactaagtttgtaggcggacatggtactgcagtaggaggatatattgtagacagcggaaaattcaattggggaaacggcaagttccctacaatatctgagccagatccaagttaccatggaataaactattgggaaatattcggagatttcccaggtcttggaaacattgcatataccttacgtatcagggcaagattattaagggatttaggtgcaacccttgcgccagttcatagcttcatattcttgcaaggattggaaaccttaacaatcagaatggaaaaacattctgaaaatgctttaaaagtagctcaattcttggataatcatcctgcagtcagttgggtaaactatccaggtcttgaacatcatccaagccatgaaactgctaaaaaatatttaggtgacaaattcggtgctctcattgctttcggtattaaaggaggtcttgaagctggtaaggagtttattgataatgttgaattattatccttgcttgcaaatattggagacgctaaaagtttggttatccacccggcttccactactcaccagcaattaactccagaagaacaggaaagcactggtgttactcaagatttaatccgtttatccattggtttagaggatgttgacgacattattgctgatatagatcaagcattagcaaaagtaagtgaaaaattcggtgatgattaa

SEQ ID NO: 1213 - DNA, 2100 bp, Methanobrevibacter ruminantium
atgactgatcttaataagatgtttaatccagactctgttgctattgttggagcttccaactctgaaggaaaagttggttatattattgtaaataatatgatcaatgatggttttaaaggaaatatatatccaattaaccctaaagatgatgaaattcaaggattaaaagcatataaaaatgtatctgacttaccagaggtacccgaccttgtaattgtttccattcctagtgttttagtaaaccctgtcgttgaagaatgtggtgaattcggcgttaaaaacatggtagtcatcactgcaggatttaaggaaattggcggagacggtgtggaaagagaaaaccagcttgtagctttaggagaaaaatatggcataaatattattggtcctaacagtttaggtatcaccgattcacacactccattaaatgcttcattttcacagatcatgcctcctgaaggaaatattgcattcatttcccaaagtggagctatgatggtagctattatcgattggagcgtaacttccggaattggtttcagtaagattatcagtttaggaaacaaggctggaacaaccgaaatcgagcttatcgaatacttatcatatgacgatgagactgcggtggttatctgttacttagaatcaatcactgaagatgacgacttcgttagaaccttaagaaaagtgtcctataagaaaccggtcattatcttgaaatccggttccagttctgctggtgctgaagctgcatcctcacataccggtgcattggcaggtagtgacattgcgtttgacacagcattcaagcaatctggtgtatttagagtaacaactatggatgaattgtttgatgtcggtttggcattctccaaatgtccattgcctactggacgtaaccttgccatcattacaaatgcaggtggtggaggagtattgtctgtagatgctatggaaagatataatttggatttagttaaatttgatgagaagaccaatgcaagacttaaagaggcagttcctgaagagggaagtattaaaaaccctattgatgttttaggtgacgctcctgttataagatataaggaatctttagaagctgttttagattctgatgatgttgacggattggttgtcatggtatgtcctactgcatctgcagatgctgatggaattgccgatgcacttgttgaaggtgcaagtggatttgacaagccggtcattgctgttaacatgggtggacctatatttgaaaatgctaacgatgtcttaagggataatggaattcctacctatgtattccctgaaactgctgtaaaggtatttgactaccttgcaagatttgctgcagttcaagatagaaattatgatgatcctgtaggagagcttgatgacgttgataaggaagctgttgaagaaatattcgctaaagtaaaagctgaagaaagagacactttgcttggtagtgaagcttatgctgtagctgaagcttatggaattgaagcagctcctataaagcttgcaacttccgctgaagaggcaggtcaattggctgaagagatggaattccctgttgtgcttaagattgcatctgataagatcttgcacaaatcagacattggcggtgtaaaggtaggcatccaatccaaagaggaagcagaagaagtcttcgaagagatcatggctaatgctaagaaagctcacccagatattgttccaaacggtgtggaagttcaaaagatgatggattccggtatagaagttcttgttggaatggttagggattcacaatttggtcctatgattgcatttggtatgggtggagttcttgtaaaccttttagaggatgtttcatttaaattggctaaaggcttgaccactgatgagattgccgaacagatggaaagcactaaagttatgggacttcttaaaggtttcagaggagaggctcctggagatattgaagcagttaaatccgcaatcattagaattgcaaaactcactttagacttccctgaaatctctgaacttgatataaaccctatctttgtatatgagaaaggatcaagtgctttggatattaagattaagttggcttaa

SEQ ID NO: 1214 - DNA, 1443 bp, Methanobrevibacter ruminantium
atgacaagggaaaaaggagagttgaacacattattcgcagataagatcaaactctttgtatgtggccctacagtttatgatgatgctcatataggtcatggaaggacctacatatcctttgatacaatcaagaggtatcttgaatttaagggatattcagtattctacttgcaaaacattacagatattgatgataagattattaatcgtgcaaaagaaagcggcatagattctaaatacttagctgagaagtttgaaaagagatttatagaagatatggctgcattaaatgttacaagcgtaaactattttgcaagggcaactgaccacatagaagaaatcttagatcagatccaaaggcttatagataagggatatgcttatgttactgaaactggagtctactttgaagttgccaagtttgaagattatggaaaattgtccaatcgtaaattggaagatttagaaacccataggatagatattgacagttccaagaaaagtccacatgactttgccttatggaaaaatagggaagctccagaatatgcaggagaacctgtttgggattccccttggggtaaaggaagacctggctggcatattgaagatactgcaatcactgaaaagtactttggccctcaatatgacattcatggaggaggacttgaccttattttccctcaccatgactctgagattgctcaaatggaagctgtctctggcaaggagcctcttgttcaatattggatgcatacaggattcttaaatgtttcaggagaaaagatgtctaagtctcttggtaatttcattacaatcagagaattattgaaggaatactctggagacacttttaggctatttgttcttttaacccattataggagcccaattgacttcagtgaagtaagcttgcatcaggctgaaaggaatgtctctagaatcaagaattatcttgaaaatcttgatgagaaaataaatgacatatttgaaaagggaaatctctctgaagaccttcttaaattagcagaattggaagaaaatgaatttgatgaagaattaatcaattttgattatttcaaatcaaattaccctgccttaaaagaaggagtaaatgagtttttcacaagtatggatgatgatttcagcactccaaaggcaattgctgcaattttctcatttataaagcaatcaaataaggacttagaagaagatgatttgattatagatgatcttttagcaattaaacactggtttaaggacattagccaaattttaggtatcgatttctttgtttataaggacgaaaccagtggaaatgaagcggaattgttagatataattgctgatgttcgtttaaaattaagagctgaaaagaagtatgatttgtctgatgaaattagagataagcttatatcattaggcattgaagtaagtgattaa

SEQ ID NO: 1215 - DNA, 381 bp, Methanobrevibacter ruminantium
atgaaaccaccttgtgaaatggtagtatggtatatcataccagccataagatctgaattagctaaagacttattaaaattaggcatgaaacagaaaaagatatctgaattaatggatattactcaaccagctgtatcccagtatttaactgataaaagaggcagcggaattgggtttaatgatgatgttaaggcattgattcaagaatttgctaatgacttaaatgatggtaccgcaaccaaatttgatataattccacgtacctgttatatatgtaaaagaatcaaaacagaagacgtaatctgtcaaatccataaggaaaaaggacatatgcctgcagattgccaagcatgtttaggttcagaggcacatttattataa

SEQ ID NO: 1216 - DNA, 741 bp, Methanobrevibacter ruminantium
atgtttgatgatttaaaagatgatctgcaagctgcaaaagcaagagaccctgctgcaagaagtagcttagagattctttgctgttatcctggaatatgggctattcttttgcacagatggaatcattggctttggactcataatttgccattttggggaagattcttctcacagatttcaagattcctcacaggaattgaaatccaccctggtgctcaaataggaaaaagagtgtttattgatcatggaatgggaattgtaatcggtgagacaactattgttggtgatgatgttttgatttaccaaggagtcgttcttggtggaacaagtttaagcaaaggaaaaagacaccctactgttgaagatgctgttgtaataggctccggagcaaaggttttaggaaacattacattaggatgttcctctaaaattggagctggagcagtcgtattgcaggatgttccaaggggagctacagcagttggtgttccaagcagaatcattcatgaagaccgtaaatgtgttttggatttagagcacgaattcccagaccctgtctcatcagctattgatttgcttttcgaacgtcaggaagagcttgaaaaaagaatcaatattctaagccactttcacgatatcgatcatgttgaatttagtcatgaccctaaagttgaagaggtatttaagggcgctgatgaaaagtctttttataagttgaataatattattgaagatgaatga

SEQ ID NO: 1217 - DNA, 957 bp, Methanobrevibacter ruminantium
atggtgaatattccagaactaaaaagaggcatagctaacgatatgactgaagctattggaaacactcctcttgtaagattaaacagattaacagaaggattagaagcagaagtgcttgtaaaagtagaatcttttaatcctgtaagtagtattaaagatcgtatagcagtaaacttaattgaaactgcagagaaagacggattgcttaaggaagattcagtaattattgaacctaccagcggtaacactggtattggtctttcctttgtagcagctgcaaaaggctataaattaattttaaccatgcctgagaccatgtctattgaaagaagaaagcttttagcagtcttcggtgctgaaattgtcctcactccaggtagtgaaggtatgggcggagctattgctaaggctaaagagttggctgaaagcactccaaattcatttatgccacagcagtttgaaaacaaggcaaactctgaaatacacagattgactacaggtcctgaaatctggagggacactgatggtgaagtggatattgtcgtatctgcagctggaaccggcggaactgtaacaggtattgctcaatacattaagcctttaaaggctgaatttaaggcagttgctgtagagcctgcaagttctcagactttaggaaaaggagaaaaaggacctcataaaatccaaggtatcggaccaggtttcgttccagatgtattggatgtggacctaattgatgaggtcgttccagttaaggatgaagacgctggaaacactcttcttagacttgcaagagaagaaggtatctttacaggtatatcttcaggtgcagctacttgggccggattagagcttgctaaacgtcctgaaaacaaaggaaaaactattgtagttatcttgccagacactggtgagagatacttgtctactgaatgggtctttggagacttattctaa

SEQ ID NO: 1218 - DNA, 606 bp, Methanobrevibacter ruminantium
atgactctctttaaatacattataacttcaagccctattggagaaataacaatcatttggaggaaaaaaccacaattccaaattgaagaaattattatttccaatccaaatcagacatcatcacaaatagctaaagaaaaatacgaaaaagaaggagaattagctattaataaaaagtcaaaacaattaaataaggtcttaagggaaatggagaattactttaatgaaaaggactataaattctcccttaaatatcttaatctagataaattaaaaccatttcaaagagctgtgcttgaagctgaattcaagactgaaaaaggaactgtaaatacctataaagaccttgcaaaggaaattggaagtcctaaagcatatagggcagttggaagtgcacttgctaaaaatccatttccaatcatcattccatgccatagaacagtaaaaggagataggacaattggaggattcagcggatttgcaggaggtcttgaatctaagaaaacacttcttgaattggatggtttaatgattcaaggcaaaaaaatagttggagatagtcctataatttcactggataagacttctcaaacaaaactggtttaa

SEQ ID NO: 1219 - DNA, 648 bp, Methanobrevibacter ruminantium
atgagaggatttaaaatgaatgatgaagagaaaataagagagatctttaggagattaaatgaagtttatactatccgtacttttcatgaccatgacccatacaaggtattgattagaacaattttatctcaaaggacaagggatgaaaatacagatcaagctgcaaacgctttatttgaagtttatccagatatttacgcagttgctgatgctcctgttgagcatgttcaagagctaatcaagcctgcaggattttatagggtaaaggcagctcgtattttagaggtttcaaggatattgatagaccaatatggcggggaagttccaagagaaatggatgagatgctaaagcttccaggtgtagggagaaaaacagctaattgtgtgattgtttttgcattccaggatgcagctattcctgttgatactcatgttcatagaatatccaacaggtggggaattgctgatacaaaggatccagaggaaaccgaacaggttttaatggaaaaggttccaaaggacttatgggttgacttgaatgatttgatggttcagtttggtcagactatctgcaggcctattggccctcaatgtgataaatgtcctattagtgatctttgtgactatgatgtgagtaaattagaatag

SEQ ID NO: 1220 - DNA, 1368 bp, Methanobrevibacter ruminantium
atgaatcttaaaataaaaaacttttctaaaatcaatggaactgttaaagcgccatcctctaaaagctatagtcatagggcagttattcttgcctctttatctgaaggcaaatccaagctctttgatgtattgtactctgaagatgtcctatcaaccattagggcatgtgaagcccttggggcaaggatagataaaaagaaagaaatcatcttaaagggagataaaagtcagacagttgactatttggaagtttatggaactgggggtaaattgcataatgttagtgacgacccttcttctgacatgattgatcttgcaaactctggaaccacacttagaatcatgacaagcgtagcagccttatctgacaatgaagtgatatttacaggtgacgattcacttaagacaaggcctatgggtgcattgattgatgcattggagactttaggtgttaagatagagtcattgaatgaaaacaataaggctcctcttaagatttatccaggatatgaaggaggacagacagacattttgggaagcatcagctctcaatttatctcttccattcttatttctgctcctttatctgagaatggtgtggagcttgaggtttatcctgaatttgtatcaaagccttatgttgacatgaccatttccattttggaaaaattcggaatatccgttgaagaggaagagtatcaattccatgaaacctgcaagaaagaacatactgattgtttgggggttaaattcattgtaaagcctcaaaaatacattgcaagtgattatattgttgaaggagatttctcatctgcatcttatttgcttgcagcaacagctattgcaggtggatatataagagttcaaaacttattcgctgattccaagcagggagataagttaattctggatattttagaggaaatgggtgcaaatgtcactgtttttgatgattatgtttctttaaggtctgatggaaacttaaagggaattgatgtaaacctatcaaatgctccagacttactccttactgtagcggttcttggagcacttgcagaaggaaaaacaaccatatctggagtaaagcatggcagattaaaggaaaccgataggatagatactacatgcagggaacttgaaaaattaggatgcaaacttgaggaatttgaagatggaatgactatctacggaaatacaatttcagatggaattgtagagtctcatggagaccatagattggctatggcattttcattgattggattgaaacatgatgttgaagtggaaaatggcgaatgctttgatgtttcattccctaattttatagaggctatggcagagattggaatagatttggagcttaaataa

SEQ ID NO: 1221 - DNA, 411 bp, Methanobrevibacter ruminantium
atgagtcttgataggtttatagaagcacaaaaagaagattatgacatggcttttagagaaatcaacaatggtagaaagagaaatcactatatgtggtatatatttcctcaaatcaaaggcttaggccatagttccacttccagatattatggaattgacggtcttgaagaagcaaaggaatatatggaaaatgagtatttaagcaataatctaataaaaatttctcaaaaattattggatttggagactgatgaccctatagagatatttgggtctactgacagcaagaagctaaagagttccatgactttatttgaattggttagtgataatgaggtcttttctttggttttagaaaagtattttgatggaaatagggatgagaggactttagatttagcaaataaataa

SEQ ID NO: 1222 - DNA, 786 bp, Methanobrevibacter ruminantium
atgaaaggaatcataggagcaattgccggagacataattggatctactcacgagtttcatccaattaaaactaaagacttttctctttttaataaaaaatctcattttacagacgatactgtcatgactttagcgattgcagattggttaattgaagataagaattcaagagatgtattaattcaaaaattaaagttttatggtcagaaatatcctaatgcaggatatggaagaatgtttatgcagtgggtgctgtcagagaatccattgccttatggaagctggggaaatggctctgccatgagagtatctcctgttgcatgggctggagagagcctggaggaagttcaacaattggctaggctgtcttctgaggttactcataatcatcctgaaggaatcaaaggagctcttgccactgcagatgccatttatttggcaaggataggttcatctaaggaagaaattaaggagcatattgaaataagatatgattatgacttggatagaacagttgatgagataaggccaggctataagtttgatgtttcctgtgcaggatgtgttccagaatcaatcatctgctttttagaggccgatgactttgaagacaccattagaaacactgtttctttaggaggagatgcagatacaatggctgctattgcaggacctattgcagctgcatactgggaagttcctaggaatattgcatataaatcaattcataggttggattataggcttttgaatgttttaattaaatttgaagacaagtttttatag

SEQ ID NO: 1223 - DNA, 729 bp, Methanobrevibacter ruminantium
atgtctaaaagaatcatttttattttgatgttgattgccttacttggcttatctgctgttgcagcagttgacgctgacccattaactgataatcaacttaatccaactattttttatcttgattttaatcatggcgctttaaatgatggttttaaaaaagaatttgatctctttgagtatgttccaacatttgatagcgtagacctttacaacgatggagaaaatgtctctgtaagcttttatagtttaaatcctaccattgatgtggataacttaaatgatgagattatagattatacatttgaggttatggaagatcctaaagccaatataactacattaaaggatggaataaggaacatatgctctgagtatggtgcagatgatgtcaagattaatgtggattctgtaattggagaggatgaaattccagttatttttacaactgaaggagattccatgcttcctaccataaaaagtggagataaggtcttggtgaataagagtcataatattcacgttggaaaccttgtttcagcaaactcttcagagtatggccctatctgtaaaagggttgctgatatagatggagattcagtttatcttgtcagtgacaataagaaggttactcgcgagtattatgatgattattatgtggaatataagggaatcactacatgggttaatattgatgatattgatggtgtgattattgacattatgaattaa

SEQ ID NO: 1224 - DNA, 222 bp, Methanobrevibacter ruminantium
atggttgaaattactagcaaaacaaaatatatggatctcttaaatgaatatcctttgcttaaaacagatttggttaagaaaaatcctaagtttggatttttggtaactccaatgggtaaaattagcttatgggaatctgacctttccgaagtcagtgaacgtgctgaaatgactgttgaagatactgtaaatttatttattgaattagtaaactcttattaa

SEQ ID NO: 1225 - DNA, 1059 bp, Methanobrevibacter ruminantium
atgaagcatagattaaatttagataataaagacccaaattatattttgttgaaagaaatatttaaaattatggattctagaaaatccaaaagtatattagcatcctatggatttaaaaacttaaatagaacaatatttacttttaaaattatatttataagtatgttctttggaattgacattccattcattttaaacgagcttaaatccaaaaaagaacttcgcaaatactttaatatttctgaagttttgactgcagatcaagtttataaaattttttcagaaataaactctgaaaaacttataaaatgtttaaacagaatcttaaactcaaggaatatggttaaaagaataggaaaaaagacttttattgttgatgcgaccccagtggacgtagatattaatttccacagaaataaaaagactaaagaacatctggaaaaaattaatctcaaatggagttattcatcctctaaaggttattatattggatttaaagcaactgttgtattagattatgattctatgaatcctgtttgtattttagtccactctggagctccaaacgatgcaaaacttttcgaagaaattttagaaaaccttcaaaaaagacgaataatcagaaaaggagacacattaatctttgataaaggatattacacctataaaaactaccaaatcggaatcagcaaatacaaaatcattcctttcatttttccaaaagaaaaattcagcagaacccgattggatgacattttaacttatccactagccgtatttaacaaaacaaagagaataatgaaagaaaaaagattatacaacagtttaaaaatggaattaatgaaaaaaatagattcatgggaaaaatttaaaccaataaggggcaaaatagaagattttttcaaattattaaaacaaggcttgaatatgagagaaatccacaaatatactccaaaatcagtagaaaaaaccgtttatctaaatgtatttttgggagcactgattatatcacaaggattttactcaaaaacgaccatacaacaattatctgaaaactaa

SEQ ID NO: 1226 - DNA, 2820 bp, Methanobrevibacter ruminantium
atgaatgcatttttaactttaattatttttattattcattttatttggaggaatattttgacaaataaagaaattcctaaagattatgaccataagagcgaagaaaaatggcagaaaaaatgggaaggagatgagatttacaaattcataggtgatggcacaagaccaagatacattatagacaccccgccgccttatccaactggacttcttcatatgggccacatcttaaattgggcttatatggatttcaatgcaagatacagaagagaaaaaggcatggatgttttattcccgcaaggttgggactgtcatggtcttccaactgaggttaaagtggaagagacacataatatcaagaaaaatgatgttacaagggcagaatttagggacatgtgtactgaattgacctcacataacattgagcttatgagaggacagatgcgctcagtaggtttctcacaagactggagcagggaatacattaccatgactccagagtacagaaaaagaacccaattgtcctttttaaagatgtatgatcagggattgatctatcagggaattcaccctgtaaactggtgtcctagatgtgagacagctatcgcttttgctgaggtggaatacagcgaaaacaccaccttcctaaactatgtcaatttcccgccagcagacgttccagaggaagtattggctaatgttgaaggcaattcatatgtaagatatgcagattgtccagacaatgctgatgcaagcgtaccaggtgtattgattgcaaccacccgtcctgagcttatgtctgcttgtgtggctgtagtggttcaccctgatgatgaaaggtacaaccaattgctcggaaaatatgtggaagttcctttatctggccaaaaagttaaaatcattgcagatgaagaggtagatatggaatacggtaccggtgcggtaatgatctgtacatttggggataagactgacgtcgcttgggtaaataaatatgatttggatgtcattgaagcaatctctgaacaaggtatcttaactgctgctgcaggcagatacgaaggaatggaacttcaggatgcaaagaaacagaccatcgaagacttaaaatctgaaggataccttacaaagcaagaggaagtggaccagaatgtaggccaatgctggagatgcaagacccctattgagattcttgtcaaaaagcaatggtttgttggcgtaaccaaattgattgaagaaagcaaaaaggcttcaaatgaaatgcgttgggttccagaacatatggaaagccgtttattaaactgggcagatgctatggaatgggattggtgtatttcaaggcaaaggttatttgcaacccctattcctgtctggtattgtaaggactgtggaaaggttatacttccaaaagaggagcaattgccaattgatcctacaatagacaagccacttgaaccttgccagtgcggatgcaacgaattcatccctgaggaagacgtattggatacatggatggacagttccatatctccattatctgttgctgactggccaaatcctggctgggaagagattttcccatcaagcattcgtccgcaaggacacgatatcatcagaacttgggcattctacacaacccttagatgcttggccctcactggccagaagccatttgatgacattgtaatcaatggtatggtattcggtgaagacggatataagatgagcaaatcccgtggaaatgtaacaggtcctgaagaggtaattgctgaatatggtgcagatcctttaagattatgggctgcaaacagtgttccaggctctgacgttgcatttgactggaaaaacatcaagcatggatacaagttcatcagaaaattctggaatgcattcagattcatcagcatgcacatctttgatgaagagtctgaaaaggccttaagcggagacatcgaatcaatcaaagcaaagctaaacccaatggacacatggatttttgcaaaattgaacaaggtaaataagatagttgatacagcattctatgactataactatgctactgcaataaatacaatcgaacagttcatttggcatgatttctgtgatgaatacattgaagctgtaaagtacagattatacaatgatgacattagtgaagagtcaaggattgcagcaaaatacactctcagaactgtaattgaagattcattaaaacttcttgctccaattgctccattctttgcagaagaggtttatcaatactttgatgaggataaaagcattcacagcactctctggccagagattgaccctaacttagactccactcaagtggaagaagacggtgatttggctattgaactaattggagaggttagaagattcaagtctgcttccaaaatcccattgaatgcagatgttgaaagcactactgtctacatcaatgagaaaacagagaaccttaaggatgtatttgaatactttgcagacgacattaaaggcactttaaagattcaagactttaaggtcacctcaggtaagcctgaagttcatgaaaaggttattgaaattgagccagacatgagtaagataggccctacctttaagaagaatgcaggtcaggtcattggattcattaaatcaaccgatccgaatgagatagctaaacagctagaggaagatggcgagatagctattgcagacggcgtcatcactgaagatttcttaaagatgaaaaaggaaattgtaggtgcaagcggtaagaaggttgacattttgcaatctgaaaaacttggcgtaattgtagaagtagttagataa

SEQ ID NO: 1227 - DNA, 1656 bp, Methanobrevibacter ruminantium
atgcctgttattacatttaaatatcaagatttaaaagatttaggtattgatatggaaaaagacgaacttatcaatactttgccaatgatggcaagcgatatagaggattacgatgatgaggaaataaaagtggaattcttcccaaatcgtccggacaacctttctgttgaaggggttgcaagatcatttaaaggttttttaggattggaaactggaataccaaaatatgaaatagttccatcaggtgaaaaagtcacagtaagtccggaagttgcagaaatacgtccatttatcaagtttgcaaagattgaaaatgtggacttctctggagataagatcaaatacatcatggactttcaggaaaaccttcactgggtaatcggaagggacagaaagaaagtagctatcggagttcacaatgcagatgtcattagcggaccatacaaatacatagcaactccaaaagacgaaaatgcctttgttgcccttgaaatggaagaggaaatgactccaggagaaatattgacccaacataagaaaggggaaaagtatgctcacttgattgataagtttgacaaataccctcttattctcgataaggacaatcaagtattatcaatgcctccaatcatcaatggagaacttacaaagctcacagaagacactaaaaacatcattgtggatgttactggaactgatgaaattgcagttacacaggctttagatattttatgcgcatcattcgctgaagtgggaggccaagtcaaatccatggaagtggaatatgaagatagaaccgtcataagccctgactttactccaaaagtcaagacagttcatgttgacttgacaaacgagcttatcggaggaactgacttaagccctgaagatattaagaagctccttgaaaaggctagatttgatgctaatatccttaatgagaatgaattggaagtattcatcccaccgtacagagtggatatcctccatgaagtggacattgtagaaaacattacaatccaatatcatatcaatgcagttgaagccaaattgcctgatataaccactgtagcaaatgaacataattggtttaaatctgaaaagacaatcagagagcttatggtaggacttggattccaggaaatcatgagcctaatgcttaccagcgaagaaagccaatatgaaaaaatgaatgctgaggaaatcgaccatgttcaagtctcaaagccaataacaatcagcggaacaatgattagaacaagtcttttaaatagcctaatggaatttttagaagacaacaagcatcaggaccttcctcaaaagatatttgaaataggagatgtcctatatatggatgagtcaaaagaaaacaagacaaaatccgcgaaaaaactagctggaatgatttgtcatagctctgcaaactttacagaaataaaatcaactgtttcaagcgtgctttccaatttaggatacactatggaaatatccaactcaacaaatggtagttttattccaggaagagcagctgatgtgattggtgaatctaaaagtggtaaagtggttggattctttggagaaatctctccagaggttattcgtaactttgaattagagtatccagttactgcatttgaaatagagttcaaactttaa

SEQ ID NO: 1228 - DNA, 699 bp, Methanobrevibacter ruminantium
atggctcaagtctttaattatcattgcagatcttgtgatttttattttacaattcataactatcgattttgctttgatgataaaatggattgcattgaagagtatatggctttattcactgattctgattatggtaatgattccttaatcaaaggtcgtgtaattgaaaagtactgttcaagttgccagaagactgtaagaatctatcagttcactcctgactctagcatttacactacagacgcttcttttgactttttaaaattctatattcctaaaaagcatgattttcttttagaatccattgattttcataaggaattgattgaattaatagagaataatgagaatttgaaaaagattagttcttttatagaggataatcatgtttataatatttatgaattaaatttaaatcattatttgaatactaaaaggtccggattcaattcaaatcaattgataaaggatattgggctttatttagatgccattaatgataatctagatagatttgatgattttattatttgcatgaattcgactgaggataattataatttggatttggagggaaagatgtttgatatggatgtctgtcctgagtgcggagaggagttttatccaatcagtctaaagaatccttgtcctatctgtggtaaaaatacgatggaaaggtctagagaaatgattgattaa

SEQ ID NO: 1229 - DNA, 429 bp, Methanobrevibacter ruminantium
atgataataaataaatctttaaaaattaattctaactctaattttcaaataattgacatcacaaatgagattagtagaatccttgatgaaataaagtttaatgaacctaattcgatttccaatggcattttaacaattttcactaaacattccacaagtgccattgttgtaaatgagaatgaaagaggactcttatctgattttgagtttattttagatgaattagtcgccgataagaataattatgctcatgatcggattgacaacaatgcctcttctcatcttaagtcatttttgctcggttcatctgagacaattccgattgtagatgggaaaatcgatttgggaacttggcaatctatcttttttgttgaattggatggtcctagaagaaataggactattgatttggtttttattggtgaataa

SEQ ID NO: 1230 - DNA, 123 bp, Methanobrevibacter ruminantium
atgattacttgtaatgtttgtggccatttaaatcctccatctgctctagtctgtgaaaactgcggttctgatttgtcagacagcccagacttaggcggcggatttgatgatgacgaccggtaa

SEQ ID NO: 1231 - DNA, 519 bp, Methanobrevibacter ruminantium
atgagtgaaaatcaggaagatgaaacacgaaaaaccaataattatgaatttgacaactctggatttaaggctaaggattatgatgatgcagaggagtttgaaatttgggacttggagcaaatctttaaggacagagtaaaaatattgcaggatttaaacaatgaattttgggaagcctatgaaggatccaaaacagaggcctctggcagaagaaaagacaaaaaagaaagattggaaccattaagcgtaagggtaaagccacataccaaaaggttcctaaaggaagactctatactttcagcaagggaaatcctagaaatttatgaggaattttataatggtcgtgatgattatatcaaatccttaaaaagggatgaaattcaattaaaggaagaattgtctgaaattgaagaaaaattaaagaacgctcaggaattcactgaaaaattaaatgaaatcaagattcaaaaggatcaagaaaaagaaagagctaaaaagattaagattaatattgaatag

SEQ ID NO: 1232 - DNA, 144 bp, Methanobrevibacter ruminantium
atgtatagatatgagaatgatagattggcatctcatgaaatagaccccactactccttcaaagtatgtatattggaatgctaaaagacttcttgaggtcttaaaggaagtggaagctactaaaaagcaaaatcaagataaataa

SEQ ID NO: 1233 - DNA, 633 bp, Methanobrevibacter ruminantium
atgtcagacaaagtaaaagcagaagaagtaaaaagtgaagaaactcaagtaaaagatgtagatttagtctttttacttgataaaagtggatccatgtatggtgtggttagagacactatcggaggattcaattcatttattgaaagagaaagagagaaaaatccgaacactcatgtgactcttgtgctttttgacactgaatataatgtattatacactagaaagccaattgctgaagtggaagaactcactaaaaatgaatactatgcagatggatgcactgcacttttagatgcaattggaacaactatcaatcgccttgataggcaagtcaacaatgatgttttatttgtaattacaactgatggattggaaaactcttcaagggaattttcaaagtccgacattaaaaacatgattgctaatcataactgggagttcttattcatcggtgcagatattgactcttatggagaggcattaactcttggaattgacgaatcccatgcagctaattatgaaaaaacttctgcaggattaggtgctttgtttgattctgttggagatgctcacgaggaaatcagtcgtggaggatctttagatgacatgagttggaaaagaagattaggttaa

SEQ ID NO: 1234 - DNA, 1614 bp, Methanobrevibacter ruminantium
atgactttggattatcaactatctgaaatcaaagaattggaaaatcaagaggaattaataagcatcattcaaaatcctaatttagatgatttaaggcgcagtgctgctgcttctaattataacttaaataataaggattttttaaaagaactggcttcaaacattaatttaaactataagatacgtcgtggtgccataaaaaatcttaatttagatgatcaatcattatttattgatattggcttaaatgatgagaatattcaaattcgccgtgcagccattaaaagaatcaccgatcaggatactctcacaattatcgctcgagaaagccttgattttgcctctcgcttgattgcagtggaaaagatttcagatattgctgtaagattggatattgcagtaaaggattcaaatgatttggtttcatttaaggcagttgatttatatccttttttaagcactttaaactctttattttacaactttaattgcagtggacgctatgttgataatgcattaaaattaattgactttattgacttgtgtctatctaaagattttaataaggaaagccatgatgctttaaataaatttaaagattatttaaatgatttaattaatattaagctttcagacttaaaggaagttccatatcatttagaaaaatcattctctcgtcgcgtattaactaatatggccatattgacatgggatttggcctttgccataattgattatacagaagatgattatgaactgttaaagatattcaatgttcaaaatgatataagaattcgcctagctgctcttaaaaagataaaatccgagcattttttaattgatattgtttcaaatttccgaacaggacactctttatatgacgataccctaggtagtttgcaaaggagattttcttacgatcttgatgaatgcctgtcaatccataagttcactcaagaagagcttattgatttggcagtatattccggatttaaaaagacccgtagaatagtggttaagtatataggggatatggaattattggaatactgggctttaaacgattcatatactggatttcgaagggaaattgtaagtttgccaaactttaataataaggagcttttatctaagctggtttttgaagatgattgtgacagagttcgcttatatgcagttcgaaaaataaatgaccaggaaattttatctaaattagctgtagatgattcctattgggctgtaagagaggaggcggtttctaaaattagagacgaatccattttaatagatcgagctttaaacgatccaaacgttatgattatcatagccgctttaaagaatcctaatctcaatgatagacaaaccataaataagataggcagttatccaaacttttgggttactaaaatcattgcagagcatcctcttacagatgatgagactttaattgacattgcactcaataatccatggaactatcctcgtgaaaaggcaatagagcgcatttatgataaagatgttttaaaatatattgcagaaaacgataaagacccttggatatctcttatctcagaatccagattaagaaaattggatgaaaatgaaaatgtgtga

SEQ ID NO: 1235 - DNA, 306 bp, Methanobrevibacter ruminantium
atgacaaatcaagtaatcgaagatatggctgaagtatgtcatgatgaatgggtaaaatggagcaagaacatttctgaggaattggctcttgcaattgatgtattgaaaaaggacattgagtttgctcacgaaaagggcgttgaaaataaggaagctattgaactggttgaaaaatttgaatcccgtcttgaacgatggggtgctttatggattccatatgaggatttaactgaagaaatgaaggactctgatagaaaatatgcaattaagatgtttgacattgctgaggaagctttaaaagaataa

SEQ ID NO: 1236 - DNA, 240 bp, Methanobrevibacter ruminantium
atgatagtggagaaagtttctaaaaatgaccagtgggaagattacttcataaaaagcaaatcatccaataaggaatacattatcactatagatcttttagaaggcactgtaagctgtgactgtgaagactttaagtatagaaaggaaaacttaaggtttggaggagtccgtctaagtgataaggccaatcactgcaagcacataaaaaagatcttagagattagggacgatttggactag

SEQ ID NO: 1237 - DNA, 216 bp, Methanobrevibacter ruminantium
atgtttgaaaaacaaggatttatagaaaggagaatctttaaaaataaagaatcttttatgtataaggggttcttttcgcataaagaagattttattaataaaggagattttatagaaaaggaaaagagtttaaaaaagcaaaattttataaaaggcaaatatgcaaacttgatttttaaaatggatgatgattgtattattttaaaaggaggctaa

SEQ ID NO: 1238 - DNA, 1032 bp, Methanobrevibacter ruminantium
atgaaaaccactttagataataaaagcgttaaaaacaattcaagaaacagcaaaaatgtaaggagcaacttaagagacaacagaagcatgagaaccaatttaagagctagcagaaacatgaaaactggcttaggggatgttaacatccaaagcaatgatgaagctactaaaaaatgtccctcttgcggatctgttgatttcgaaatcgactacgctcgttctgaggtctcttgtaagtcttgcggtttggttcttgaagaaaacatcattgattttagccctagcggaaccgcaataaacagggacggtcaaaatctcactcaaaacggagcaccatgcagtattactaaacacgataaaggtttagctactgattttaaattagaaaaccttaaacatgacagggctcgttgggcacgtattagaagattacaaaaacaatctagagtcagcggcagtcgtgaaagaaatttagcaagggcattcagtgaattgtccttattaatttccaatctgtcccttcctagagacgttaataaagaagcggcttcaatctacagaagagctcttgaaaaggatttggtaagaggcagaagcattagcttattaatctctgcttctttatacgctgcatgcagagtatgcagagttccacgtaccttcgatgaaatcgctgaagtttcaactggcagcaaaaaatccatagctaaaaactacaggtttttaaatagagaattggctttaaaaataaggcctgcatctccagttgattacattcctagatttgcctctatgttagagttatctagcccagtagtggttaaatctattgaaataattaatgagcttaatgaaaagggattaattgcaggtaaaacccctgctggtgtagctgcagctgctttatactactcttctcgcgtgcttggagaacgcagaactcaaaaggagattgctagcgttgtaggtgtaactgaggtaacaatcaggacccgatataaggaaatgactaaaggattaaatttaaattaa

SEQ ID NO: 1239 - DNA, 528 bp, Methanobrevibacter ruminantium
gtgactattttagatggtattttagaagataataagaaatttgtagaaagctttgaaggagaagaaatgtctcaccatgcacagaaaaaattagctattttaacttgtatggactgcagattgattgactttttcgaacctgctttaggacttgaaagaggagatgcaaagattgtaagaaatgctggaaactccattgtaggagaagacgcaatcagatccattggcgcagcattatacaatttaggcgctgaagaagtattggttgtcggccacactgaatgtggtatggcaggtgctgacgctgaagcattaaaggaaaaaatgcttgcaagaggcatcaaagaagaagacatcgccaaatacgatatcgctgaatggattggtggatttgacgatgaggaagaaaacgtcctcaatgttgtagaaaagattaaaaaccacccattaattcctgaagttccagtgcatggtcttataattgatattgtaactggtgaattaaaagtattaaaagaagattattag

SEQ ID NO: 1240 - DNA, 837 bp, Methanobrevibacter ruminantium
atggcgaataatggacatggacatcatggagctgcaaatttaactccagaacaacagaaaaagatgatagagcaagagatgaagctctttgaacatatgaaaaacatcaaatacaaaattgctgttatgagcggtaaaggcggtgtaggaaaatctacagtagctgctaatctagctgaggcattccagaaaaaaggattgctgacaggtattcttgacgctgacattcacggacctaatattcctaaaatgttggatgtcgaaggagaggatgtaatcatctcaaatggggaaatgattcctgtcatgagcagaaacgggatcaaggtaatgtctatgggatttttaattgactctcaagacactcctatcatttggagagggcctcaaaagtcaggttccattaagcagtttatggcagataccgcttggggagatcttgatgttctcatcatagacaaccctcctggaactggagacgagccattgacagtgcttcagtccttgcctgaagtcgatgcagtaattatggtcacaacacctaacagcctatcccatgaggatgttttaaaatgtgtgggaatggttaagatgctccatattgataagattgggcttattgagaatatgtcttattatgtatgtcctcactgtggtgaaaagactaatatatttggtgaaagccaaggggaggactttgcaaatgagatgggagttaaatatttaggaaaccttccactaactgagcaagttccagaatctgccaataaggacagcactatggtaaatgcctatgcagagtctgaagttgccactaagttttttagaaatgattga

SEQ ID NO: 1241 - DNA, 2997 bp, Methanobrevibacter ruminantium
ttgcttttagttctaatggctttgcttattcttgcaatgtcatgtgtgtctgcaagcaatgcaagtgataatttggatgatttaaccatttcagacagtaattcactagatcttgtatctacatcaaattcagatattttatcttctgatagtggtgttagttctgatgatagttcaaatgatgcttctggtgatgttcttggttctgatgtatcaagcaatgaatcaaataatcagtctcaatctactttggattctaataatcaatctcaatctggtttagattctgataattcaacattattagattcacagtcaaataatcaatccaattcagaatcaagtgattcctctgatagttcagaaactgtcatcaaaaatgcaaccagcatatcagtttcttctaaaactgttgttagaggaaattctctcaatattactttaaaggataatgctagcaccttattatctaataagacagtcacatttaccttcaatggtaaaacttataataaaaccacaaatgctaaaggaattgctagcttaactcttacagcgactcctaaaaagtacttggtgaaaattgcctttgttggtgatgagctttatgaggcctcttcaaaatcagtgaatgtcactctaagcaagactccaaccagcatttcaaactcaggcaagtcaatagtcaggggcaaattatataagcttacattaaaggatgctaaaggaaaggccttatccggcaagaaaatcagcattagctttaatggaaagaaatataccaagactacaaattcaaatggccaagtcaacctaaccataaatgtaaatgtaggtaaaacttataaaatgacctataagtttgcaggagattccaattatctctcaagttcaggctctgtaagcattaaggtcaagatgggcacttccataatcggttccggatcaagcatcgtcaagggaaagtcctatacagtcaccctaaagaatgccaatggtgctgttttgtctaatcaaaagatagcctttactttaagcggcaagacttacaacagaactacaaatgcaaaaggtcaagcaagcctaaagataggtttaagctctggaaagacctataatttgacttataagtatgccggcaattcatattatggaggatcttccggcaaggtttccctctttgtcaagactccaaccactatgaagaactctggcaagaccattgtgagcggagagacttataaggtcactttaaaggatgctgatggaaaatctttggctaataagaaagtttccataactttcaataataagacctatgccaaaacaaccaattccaacggtcaagccagcttaacaatcaaagggacctttggaaggtcatatcctttaagctataagtttgcaggagacagcaaatacggacctagctccggttcattatgtcttagggtcaagaaggcaacaagccttaagggttccgcatctagcattgttcaaggaaaatcctatactgtaactttgaaggattccaatagcactcctttagctaatcagactatcgtattcactttagatactaagaaatataacagaactacaaatgctaaaggtcaagcaagcctaaaaatcggattggctgcaggaaagacttataatttggcttataagtactcaggtacttcatattataatggctcttcaggatctgtaaaattaaaagtcaagttcccaacaagtcttacaaactctggtaagtctgtaatgaatggaactggctataatattgtcttgaaggattctaaatccaatttagtctccaataagacaatatcaattggattcaatggaaagacctatgatgaaataactgatgcaaacggaacagtcactctattgattgatgcaaacgttcctaaaacatataagatgacttataagttcgctggagacagcgattatggagcatcctctggaactgtcaatctaactgttaaattcaagaacgccttcaccatctctcagattatatcagcgtcttcaagcttaaagtcatatgtattgaagaataagaaggttccagctacagttagtgtgaatggagtctcccttaacttaacaagctttacatatcttatggctaaggcaacaataagcattaattcaaataagacctctggaagcatattgttagttcctgtagattctaattatacaaataacggcagccgtatcaacgctaatctctataaggcaaattatattgatttggctaaaaaggtaataagctctgctgaggcaaataaactcgttccaaatagcgtttccactaatataggtcttgtttcccatgacctctatagctttggccttgctaaggcattggtcttctttaacagcgatcattacctgccaaactacttgattttaagcagtgacgatgttggcgagaaacattcaactgtaatccctagcaatgcaaggggaaatgcatcccaattcaaggcaggattgaatgaggcagagaccttgactgctgctcagattgcaaaataccttgttgcttcaggccatgatgctacaaactctgaaattaaagcattggcagctaagttggtttcaggaaagacttccctttgggataaggcaaatgcaatatttacttttgcaagagacaacattacctatagttattatgcggattccaaaaaaggcgcagcagggactttgagttcaaagagcggaaactgttgtgatcactccaatttgattgtatccctctgcagagcagctaatataactgcaagattctcacatgcacaaggatgtactttctcaagcggtttggttgcaggtcatgtatgggctcagatatacattgatggtgtttggtacactgcagatgctacaagccgaagaaacagcttgggaaatattgtaaattggaataccaatcattataatactttaaaacagtatgatcacttatctttctag

SEQ ID NO: 1242 - DNA, 2478 bp, Methanobrevibacter ruminantium
atgataaatagactaagaaaagactttggaagaataataaaactcataatcttccttatattggaagtaattcttttctttgcaatcacccaaacatttggcgggatcataatccccgacttaaagactgcatttgcaataatcatcgctttatcaatattaaacgccctactttggccaactatcacttacctatccctaagattcatagtcttgaccttaggatttggaacctttttaatagacggagtccttctttatataataagcttattcatacctggagtgtccattaacggaatagcattattttcaattcccctgcttatcggactaatatcctctatgctttcaataatcctaaacattgatgacgactatacctactatcgatacatcttggaaaaggagatgaaggtgatacataggaacatccccaaaaaggagggattcctattcctggaaatagatggattatcttatagaatcataaaagaagccctagacaacggagatatgcctaccctcaaatcatggattgacaaaggcagccacagattgatctcttgggaaaccgatctttcaagccagacaagctcatcccaagcaggaattctccatggaaacaataacaacatacctgcattccgatgggttgaaaaggatcatgaaaacagaatcatctcctcaaacggaaggacagattcgaaattgattgaaaaaagaatatccaatggaaaaggcttattgtcattaaatggagcaagcagaagcaatctgttctcaggagatgccaaggaccatcttttaacattcagcagattcagcgattcagaaagcatcaattcaaacagctggttttatctttattcaactccctatgtaattgcaagaatattggttctcttcatctttgacatgattatggaactgttatcaagagtcaggcatctgttcaagaacattcagcctcgcctcaaatggagaggattgaagtattttgtagcacgtgcaggaaccaatgttgttctaagggaagcaacaacattcacattaatcggagacgtctttgcaggagagcacaatgtaatctatgcaacatatatgggctatgatgagattgcacatcactcagggatagaggactttgactcattctatagcctaaggcaaatcgacaagcaattcaagcatatagaaaatgcgataaacaattcaaatagggactataagataattgtgctctcagatcatggtcaatcaaatggtccaagctttaaacagaagtttgatattagcttaaatgacttgttaagtgaattcctacctgaaaacattacagtacatagtattttgcattcaaatgatgaccacttcagcaaagagttttccataaatcaccttggctcagaaaaccttgaaaaattagataaaagagtggaaaatactaaggaaaagctggatatcaagatagacaatacaaaagaaaaactagaccacagaatagacaacacaaaagaaaaactagaccacagaatagacaacacaaaagaaaaactagaccacagaatagacaacacaaaagaaaaaatagacaccacaaaagaaaaactagaccacagaatagacaacacaaaagaaaaaatagacaccacaaaagaaaaactagaccacagaatagacaatacaaaagaaaggatagattccaacttggactacactaaagaaaagatcaacaccagttttgatggagaattaataaatacatgggataaattaatcaaatttaaaaacaaatcatccaataaggcctttttagacaaattaagaaagaaaagaactttaatcaataacgatgagccaataatagataggataaacaatgtttcagaggacctctctgaggatttggaagttaatatagagctttccaaagagaagataacaagtgacaaggcggctcagacaattgttctatcttcaggaaatcttggattgatttattttacagactggtccaatagaatgagctatgaacagatagaggatgcatttcctggactcatcaatcaacttgcttcacatgatggaataggttttgtaatggttaaatcagatatatatggcacattggttttctccaatgacaatttattttatcttgaaagcgaagagtatgtgggagagaactttttagacaagtttggtaaaaatacagtacaaaaacttaaaagaactgataaattcgctcatgttccggacatacttgtaaacagcgaatacaatatggagacaaatgaggtctatgcatttgaagaattgattggaagccatggaggcattggaggaacacaacaatatccattcatattatgtccaagcaattgggaaagcgaagagatctttggtgctgaaaatgtatataaattctttatgaaagagataaataaatcatggaatcaaagcaagaataaatag

SEQ ID NO: 1243 - DNA, 489 bp, Methanobrevibacter ruminantium
ttggaaactaaaaagatgtttttggttatattattatttgcatttattgttataggaggatcttattcggtatttgctattgtttcaaatggcggaggcaataattctctctcttgggacaatattacaattgcaggtccttctggaaatgtaagcgatgatggcaataatagtgatgatggtttattaggcatttttaattccggcgattcttcagattcaagttcaagcaattcaaatactggttccagttctagtcagtctagttcttcccctgcgcgtagttcaagttcttctagttctagttctagtcagtctagttcaagtcaatctagttctagtcagtctagttcctctagttcaagttcaagttctagttctagccagtccagttctggttctagctatgattcaggctctggaggcagcgttgttgaatctggcggacattattatgatgtaaactctggtgatgagctcgattggtaa

SEQ ID NO: 1244 - DNA, 507 bp, Methanobrevibacter ruminantium
atggaaacagaaaatttaattattgtaattcttttagttttaatagctatggccggaattttctgtgcatttttatacacattcggtacaggaggcaatgatttagctcctgttgagccaaatctcacagctaatcaaactaatgttacaaacatgactaatgatactgctaacgctacaacagttgatgctcctttaaataatggggcttatggatccagttccatagacagttctagttctaatggcttgagtggatctaactcttataatggtggctctaacacctataatggcggttcaaatactaataatggcggttctaacaccaataatggtggatcttcctcttctgattctggtaatggcggttctgtcgctcctgattctggtaatggtggttcatcagattctggtaatggtggttctgtcgctcctgattctggtgggggcggttcatccagtggtggttctgaacctgcagccagtggcgaatcttcaaattaa

SEQ ID NO: 1245 - DNA, 1497 bp, Methanobrevibacter ruminantium; identical to SEQ ID NO: 85

SEQ ID NO: 1246 - DNA, 612 bp, Methanobrevibacter ruminantium
atgaaagtattattaattaacggaagccctcataaggaaggatgtacctttacagctttaagcgaaataaaaaaccaattagaaaaggaagatatcgatagtgagattttttggataggaacaaagcctgtaagaggttgcattgcttgtaagaaatgcggacataaggaaggaaaatgtgcctttgatgatgaccctgcaaatgagataatcgataaactaattgaggctgacggggtaattgtcggatctcctgtttattatgcagggcctaacggtgcattatgcgctgtgcttgatagggttttctatgcatcaggtggcagatttgcatttaagcctgcagcatccgttgtaagcggccgcagaggtggagcaagcgctagctttgacagattgaataagtatttcacaatttcaaatatgccaatcatatcctcacagtattggaatatggttcatggaaacactccagaggaagtaagacaagacttggaagggcttcaaacaatgagaaccttggcaaagaatatggcttggatgcttaaatccattgaaaacagtgatttgcctaatcttgaagataaaatagccactaactttgtgagatag

SEQ ID NO: 1247 - DNA, 795 bp, Methanobrevibacter ruminantium
atgaaagaaagattagataagtatttggtaaacaacaatcttatcgctagcagaacaaaatcaaaggaaatgattaaatccaagaacgttaaggtaaacgataaaattatcaccaaagcaagctatacagtcagagatggagataaggtggaaataatcaacgacgaatccttaagatatgtctccagaggcggattgaagcttgaaggagcgatagattcattcaatctcaactttaatgaaaaatccattatggacattggatcttcaacaggaggatttaccgactgtgggctgcaacatggagcaaagagagtggtggctatagatgtaggaacagacataatgacaaccagccttagggatgatgatagagtcgacttatatgaacaaatgaatttcaaaaatgctccaagttcattatttaaagatatagacattatcgtttcagatgtgtcttttatttcattaaagcacattattgatagaattgcccaagaagatgatgactttgaattggtgtttctcataaaaccgcaattcgagtgtggaaaagaaatagccgaccaatttaagggaataattacagataaggaagtccataaggatgttattttagagataaaagaatattttaaaacaaaaggatattatctaatagatttagatgtgtctaaaataaaaggcaaaagtggaaacattgaatatttaggccattttaaagcaaatgaaaaagttagagaaatagatatagaagaagtaatcgatagggcctttatagatgaagaaaattaa

SEQ ID NO: 1248 - DNA, 393 bp, Methanobrevibacter ruminantium
atggaattagactcagaacaagttgtaaaaagaatagaagaactcagaaaagattacagttgttcacaagcaacccttatgggaatttgtgaagttggaggcatgcctactgaggaattggcccttcttgcaaaaggattctctggtggtattggcggaaccttctctgaaggaacctgtggtgctgtaaccggtgctgtaatggctttaggatttttaggtgctgatgaaaaacagattatttcagcttctaaaaagttatttaatgaatttaaagataagtatgagtctgtaacttgtggatacatctcaaaagatggtgatgacaagtctccatgtgttgaagtatgtttatttgcaggtgaaaaggtctgtgaatacttaaaagaataa

SEQ ID NO: 1249 - DNA, 822 bp, Methanobrevibacter ruminantium
atgagttgttataaatactggggaaaaattgaagaaatcgcaaacaaactttcaagctatggtgatttggataatgaaggcctttctgcattggatggtactgatattgatgagattacaaagattttagatgagattgaagtcatagcccacgataaggaaatcgattttgactctgcaaagcacattctagacgatgaaaagatgaacaaggcattgcaattgattcgtaagttctatgtctatataggagcaaggctagagagggaaaatgcattgacaatattggaggccgatgatcctaaggtcgctttggattcattccacttttatgatagatacataggccttatagataatgaaaggcaattagctaatttcaatgaaaacaagacctttgtattcttgggaagcgggccattgcctcttacaattatcatgtttaatatggtgacaggctgcaagtgcataggcattgaacaggaccctgatgttgcagacctttctagaaaagtattaaagcgtttagatcttgatgaaggaattgaaatcgtaacaggtaatgaaaagacaattgcagaattagattatgacattctaatgattgctgcatttgcagagcctaaagacagagtatttgcaaatgtctgggacattgtagatgaagacactcctgtgctttataggacttatacaggtatgagagctattctttattctcctgtaactgaaaaggacacaagaggattccataaggaagtcatgttgcttcctagaggaaaaacaaataatacttctgttttaattagaaaaattagttaa

SEQ ID NO: 1250 - DNA, 612 bp, Methanobrevibacter ruminantium
atggaattaactggtaaaaacatatcctttaaatacagttccggatccagacaaatcttaaaggatgttaacataaccgttgacaacaagaagattttaggattgtttggagacagcggaagcggaaaatcaagcttatgcaagattcttgcaggacatatcaaaagatatgaaggtgaggtaaggctagatggacaggagattccaaagggcttcgatcctattcaattgatttaccaacacccggaaaaggttatgaatcctaaatggaagatgcatgatgttttaggagaatcctgggaagttcctgatgacttgttggaagactttggtattcaaaagtcttggcttaacagatggcctgcagagctttccggtggtgaattgcaaagattctctgtcttaagagcattaaaccctaataccaagttcttaatagctgatgagatgactactatgctggacgccattacacaggttcagatattcgaatcagttttaaagatagttaaagagcgcaatatgggtttattggttgtaagccacgatagggacttaatggatattatctgtgatgaagtcatttaccttgatgacattaataatatttaa

SEQ ID NO: 1251 - DNA, 1065 bp, Methanobrevibacter ruminantium
atgagtgatttaattaatgtttcaaatatttccatttcatttacacaatatgtaaaaggccttaaccaaagggaattgaaggttatcaccgacttgaccttagacattaaggaaggggaaatcgtagctgtcttaggttcaagcgggtcaggtaagagtttgcttgcacatgcaatacttggaatattgccacataacgcaaacctttcaggtacaatggtctataagggagaagtcttgacagaagagctaaaggaaaaattgcgtggtgatgagattgcacttattccacagtctgtcaatttcctagacccattgatgaaggtttcagatcaggtaatcggcgaatgtaaggatgaagcagaggaaaaggaaaaaagagccaagcaaagagctatctttgaaaagtacaatctctctgaggaagtggatgacatgtacccattccagctttctggtggtatggcaaggagggttcttgtatcaaccgctcttctaacaaatcctaagcttgtaattgcagatgagcctactcctgggcttgatgaggagtctgtagaggaaaccttgaaccatttaaggcagatggctgcagacaatgtgggagtattgctcattacccacgatattgatgctgcattgaaggttgcaaacaggattgcgattttctattcaggctatgtaattgaaattgccaatgcagaggatttcagtggcgaaggtgagaacttgctccatccatataccaagtctctctttaaggcattgcctcttaacggatttgaacttacaaagggacatcagccattgcatggtgagattccggtaggctgtccatattatgacagatgccctcataaaatggatgattgtgataagacaagacctcatttaatccctattgatgagaataaaagggttagatgctttaagtatgagggagagataaaggacagttctgaggagcaggttgtggatagttctgaggagcaggttgtggatagttctgaggagcaggttatggacagttctgaggatcagataaaggatggctctgaggagtag

SEQ ID NO: 1252 - DNA, 993 bp, Methanobrevibacter ruminantium
ttgttagacaaacagaaaatacttaagtttttaggttataaactcgttcgttttgctattttattaatagttgtaatattattaagttttatattaattgacatgtctcctattaatccggttaacgcttatatttccaatatggttgtaagccctgaaaagattgctaaactagaagcatattggggtgtaaatcagccgattactgaaaaactgatcaattggttaggaaatattatcactggtgattttggaacttccttaatatacagaactcctgtattgcaggtaattgctgaaaagttcacagcatcccttatcttgatgctaaccagttgggtgatttctggaatattgggctttgctttaggagttcttgcaggatttaaaagagacacttggattgatagggttgtaaaggtatactgttacgtattgcaatctgcacctaccttctggattgctttgcttgttgtaatggtattcagtatttatctgggatggttcccagtaagcgggggcgttccgattggggcgctgagtcaggatgtgtccttcttcgattggttgaagcacctgatattgccggcatttacgctgagcattttaggagttgcatcaattgcactctatactcgtgacaagcttattgaagtaatgacaaccgattacttcctctttgcaaaggcaagaggggaatccggatggaccttgattaaaaggcacggtataagaaacattctactacctgcaatcaccttgcagttcttatcattcagtgaactcttcggtggaaccgttcttgtcgaacaggtattcatgtatcctggaatcggtcaggcagccgtttcagcaggtttgagaagcgacgtacctctgctgttgggaatcgttatcttcagtgcgatattcgtttattgcggtaacctgattgcagatattctctataactttgtagatccaagaataagagaaggtgaggaaaatggatga

SEQ ID NO: 1253 - DNA, 957 bp, Methanobrevibacter ruminantium
ttgattacaactgttgtaggtagttttggaattgacttaaaggagcctaagactctaggcgaaaagataaagtcttcaattggaatgtacgacccatataagatagcaatcgaagaggctgtcaaactgcagcttgactgtggcatagacatcataggggacggtcagccaaggggagatatggtaggctcttttgtaaagcatattccaggattctcttatgaaatgaactcttcagtcattgtatctaagataagggctcctcaagtggatataatgataaaggatttaaaatatgctaaaaaggttcttgaagcggaaataaaagcaagaaacatgagtggggatgaggccaatagaaaaggagtaaagcttatgctgacaggaccttcaaccattgtacactcttcaaggttagaatctttctataaggagcgtaatccggcaatcattgattgtgcctatgcattaaggcgtgaggtcgagtcagcagagaaggcaggagccagttatgtacaaatcgatgatccatttttatccactggaatggttgacttaaaggttgcaaaggaatccattggaatccttacagatggaatcgaaatgcctatggcaatgcatgtctgtggtaatcttgatggctgctttaaggagattgccaagtttccaattgatattttggactgtgagtttgctggaaacaatgtgaatattggaattctagaagaaaacgctagcttgctttcaggtaagaaattaggattcggctgtgtggattctgctatgaatgcagttgacgataaggaagaggtaagagcactcgttcaaagaggaatcgatgcggtaggcaaggaaaacatgcttcttgatccggactgcggacttagaaaagtggatattccaatagctatggaaaagttaaaaatactctctgatttagctcgtgagtttaattag

SEQ ID NO: 1254 - DNA, 309 bp, Methanobrevibacter ruminantium
atgtctttctgtttagaaacttatttgcaacaaaatgatgattataaaatacttatacaacgttctggggtcaagcaatgctataagctcattgaagataatgcaaaagagattattcatgtaaaccctggagataaagtattaggtgctagattgattggacttcctccaatacctgttggaataaacgaagaggaagggaccattttgattacttataccaagccatgccatggaactgcagctattgagattccaatctctcaggaagagattcaaaacgttagggacatggatattggtgcttaa

SEQ ID NO: 1255 - DNA, 462 bp, Methanobrevibacter ruminantium
atgaaagcattagttttactcggatgtcctgaagctccttcacagacccccattggattgtatgcttcttataagctaggccaaatgggatatgacgttacagtatcaagcaaccctgcagcgggaaagatattggacatttcagatcctgaaggggtttatgtaaagaagagggtagatattgaaaagtgtttggatgaaatcgaagagggagattatgacctcttggtcggttgtgttcacaaggatgctgcagccaccttctttataacttattatcatatattaaaatgcaaggctcttgcccttgtcttctcaagagatgcagaagaggttgcagagtttgctgatatggttgaatcctctaccgatgcagatatcattgctgtaagggctttccataatccgaatccgatcaaggtaagatttgacaaatatttaaagactttagaggaagaataa

SEQ ID NO: 1256 - DNA, 510 bp, Methanobrevibacter ruminantium
atgggattaatatcagacacacatataagtgaaaagagaggaaaattgtccaatcaaatattggaatcttttaaaggagtcgatttgatacttcatgcaggagatataagttcacaaaccgttttggataaattgaattcgatagcaccaaccatagcagttgaaggaaataatgacagagctcgaaaaacccttgatttaaatccctctgaaattatagagatcgatgggataagaatacttttaattcatggcgataagcttccaagcagagattttgataaatactgcaaatttgcacttaaagagaatgcagacattctaataagtggacatagccacagaccacatcttgaaagacaagaagatattcttatgattaatcctgggagccctaacagaccaataaaaagcgacgcatcaatagccattttaacaattgatgaagaaaaagagcataaaaataaattagataaggttaaagtagaatttataaaaatagaaaaataa

SEQ ID NO: 1257 - DNA, 117 bp, Methanobrevibacter ruminantium
atgcttatatgtcctatatgtggctatccattggatagcgatggccgttgttggaactgtggctattgggttgagactcatccattagatccattccagccaggctctggctattaa

SEQ ID NO: 1258 - DNA, 129 bp, Methanobrevibacter ruminantium
atgttagattgtcctgtttgtggaagtgaattagacgaaaagggtcaatgttgggtttgcggatacaacatggctccatgtgaccatccggatgattatgattatgacgacttcgaaccgcaattgtaa

SEQ ID NO: 1259 - DNA, 504 bp, Methanobrevibacter ruminantium
atgacttttaaaaaagagaaattcatcaagcttttaatgtttatcatcagcaggtcttcagacaattataatgtaggaaaaacggtcttatcgaacatgctatattttatagactttaattactttgaaacatatggagaatcattaacaaatgaaatatatattaaatcctatttgggagcagttccaagccattttgatgagattgttcgtgaattgatttattataacaagatatacagaagaagggagccatactattaccatcatatcaataaatattatctgacaagccttcacaatattgatttggattataaggaattgattgttgtaggtggtgtcttggataatcttatgggattcagtgcagttgagatagttgattatataagtggagacgcaccatttaagattgcaggctttgatgagcctttggattatagttttgtattctatagggattttgattattctgttaggaatcttgattattattggtga

SEQ ID NO: 1260 - DNA, 603 bp, Methanobrevibacter ruminantium
atgaatggtggaaataacttagataataattgtaaaaaccttggcaatatccttaatcccactgaagtgaacaatcagctattgttccataagttcataatgataaatgagattctggataagcgaaacaagaagcaaaatccagaaatgaaaagcattacaaagggccagggaagattgattgttcttttaaagagaaaggacaaactatccaccaaagagctctctgaaatattgaatgtcagtgtaagctcccttaatgaaactctaaacaagctggagcaaaagaacttcattaaaaaggttccttccgaaaaggacaaaaggattcttcttgtggaattaactgaagagggaagacaactcgaatttaaaaaccatgaagacattgacatctttgacttcttaagcaaagaagaaaaggaaaaccttaacgactatttaaatcaattgacactatcccttcatgagaaattcaaaagggaagaccctgaaaagtatgcaaagatagttaaaaacagaaaggaaatctttgataaatactttaaagatgaaaataacaatgaaacctgctttgaattcattgattgcagtaaaaaatag

SEQ ID NO: 1261 - DNA, 738 bp, Methanobrevibacter ruminantium
atggcaaatgcaattattactggtggatccagaggaattggtaaagctatggctttaaagttaggtgaattaggttacaatgtagttattaactatcgcagtgactcatccaaacaattaactgaagatgtaatcgcagaaatcaaagataaatatggtgtagaggccattgccgtacaggctgatgtaagtaaatttgaagattgtaaaaaattggttgaagctgctgttgatgcattcggcgaagaaatcgatgcccttgtaaacaatgcaggaattaccaacaactctaacttcattgacttagagcctgaaagatacgaagcggtaatcaacacaaaccttgtaagcatgatgcacatgtgccacttatgtctcccatatatggtagaccgtgacactgctattgtatgcactgcttctgtaggcggtttgactggtgtaattaatcaagcagactactgtgctgctaagactggtgtaattggattatgccgtgcattagcattggaatttgcacctagaaaagtacgtgtcaactcaattgctcctggtatgattatgactgacatgttacgtggagtaaaccaagatgaattgaacgctcttgcagcaacaatccctcttggacacattggtgaagttgaagaaatcgctggtgctcttgaatacattttgactgcaccttacttaaccggacaagtaatctcacctaacggtggatttgttcttcaataa

SEQ ID NO: 1262 - DNA, 1032 bp, Methanobrevibacter ruminantium
atgaaaatatggattgatatatcaaatgctcctcatgtaagattttttaaagatgtcattaagtattttgaagatgaaggagatgatgttttagttacagcccgtaaatttggagacattcataagttaatggatatgtatgatatagactttatatctgtaggaaagcatggagtcacattggaagagaagctaaaggaaagtgcagagagagtcgttaacttagcggatttgatttccggtgaaggatttgatgttgccctttcaaagcattccattgagcttccaagggttgcatttggccttggaattccaagcctgtttgttttggataatgagcatgcaatggctgccaataagctgacccttccattatgcagcaaaattattgttccaaacattatagatatgtggaaactaatggagtatggggctaatcctaatgatataattagatataacggaacctctgagcttatgcacttcaataactttgtattcaatgagaatatctttgaggatttgggattggatttgcctcttcaaagaaccatacttatgaggcctgagccatctcttgcgtcctatttgaatacagactgcagaaaatcagttttatcccctgttgtagatgtcttaaaggagtatgcaaatattcttattcttcctaggtttaaggaacaggctgagatatttgaaggaataaagaatgtgacaatccttaagcctccggtagacacttcaagcataattaaggcatgtgaccttgtaattggagctggaggaacaatgaatagggaagctgcaatacttcagacacctgttatctcatgctatcctggagacacattgtctgtagaccagttttatgtgaataatggtcttatgtataggactacagatttagaggacattactaaacaggcacttagctttattgtaaatccacataagcctattgactttaaaacagatgatctctttgatttgattgtgaaaaatacttatgagctgggcggttctaagaaataa

SEQ ID NO: 1263 - DNA, 762 bp, Methanobrevibacter ruminantium
atgcataaagttgctgatgttgaagtagcaaagaacattatggatgccaatgcaaaattggcacataagaatttacatttattggaagaccacgatatcttttgtgtagactttgtaggagcaatcggatctggtaaaacagctcttattgaagagattattgaaaatgttgatgaaaaaatcggtgtaatcgctggggatgtaatcagcaagtttgatgcaggcagaattgaatctcacaatgttcctgtagtcggattgaacaccggcaaggaatgtcacttggatgcccacttggtgggtcacggattaggtgacttgcctcttgatgatattgattatctattcattgaaaatgtgggaaaccttatctgtcctgtcgactttgaattaggctcacatatgagagttgtggttgtaagcgttactgaaggtgacgacactgtagagaaacaccctcttatcttccaaaactctgaccttgttataatcaataagattgacttggcagaagctgttggagctagcgttgataagatggtatgtgatgcaaaacgtcttaatcctgatgttaaggttattacttcaagcttaaaagaaggaaaaggtttagatgaagtaattgctgctattgaagattgcaaggctcatgtagctgaacatcatcaccatcatgaccatgagcatgagcatgaccacagtcacgaccatgagcacagtcatggccatgaccatagtcacagtcatgaacattcccattaa

SEQ ID NO: 1264 - DNA, 375 bp, Methanobrevibacter ruminantium
atgcacgaattagctatggctcaaggaattttaaatgcagtgctggaaactgcagaggctaacaatgcaattgaggtaactgaaatagttattgaaattggcaaattggctatgcttaatccggaacaattgaaatttatgttaggtgtcttatgttccgagacaatcgcagagaatgctgaacttattgtagaggatattgatgttgaaatcaagtgccacaactgtgactttgaaggagtcgctaatgttgatgacagcgatcattatgctcctatgattttatgtccaaaatgcgaaagtcatagggtggaagtcaaaaacggcaaggatgtaaccgttagaaacattagtattgaaaaagaggacgaataa

SEQ ID NO: 1265 - DNA, 921 bp, Methanobrevibacter ruminantium
atgattattggtggttcagcatcacaaaaactagcggctaatgttgcaaaggaattaggggatgttttatgtcctatagaaactaaaaaattccctgacggtgagagatatatcagaattaaatcagaagtggataaggaagttacaattatccaatccactggttttcctcaagatgaaaacttggttgaacttttatttttaatcaggactgtcaaggacttaggtgcagagcatgttaaagtggttgtgccttatttaggatatggcagacaggaattaagatttaaagatggggaagctatttccgctcaattggtagctaacctaattgaggaatcaggtgctgatgagttcatttcaatcaatctccatgaggacagcgttagagacttcttcaacattccaactgcaaatctttcagcaatgcctcctattgcagaatatattgcaaacactgtggaaaatccaataattattgctccggataagggcgctttaggatttgcagaagagatcgctgaaatcttaggatgcaattgcacttatatgagcaaagtcagattaggtcctgataaggtggaaactactattgtagacattcacagcgattttgacagcgaagatttggctaaagtaaagaaagactctaaggtaaatatagattctgtaaaggataaggaagcaatcatcattgacgacatcatagcaaccggaggaacaatcgtcaatgcaattggcatattaaaggagcacggcgctaaatcagtagatgtctattgtgttcacccagttcttgtaaacgatgctgtattgaagatatctgcagctggagctcgtgaattggcaagtacagataccttaaaatcagatgtcagttcaatatccgttgctaagatcattgctgatgtcttaagataa

SEQ ID NO: 1266 - DNA, 1104 bp, Methanobrevibacter ruminantium
atgttattgatagctcaaaatcattttcaacttatacttgaagtaggtttgattttacttgctactatgatattcgtaatcaatttggttcctttatcattaagtgtggtaacattcctctcattattcctatctggaggatttacaattctatttggagccgacttggctttcctggtattatcatttggtcagcatgaatttactcaccctttcggtcctattgccctattggctattgtaaccgcattagcgtcgcttaaggttatggaagggtcgggtgttgatatatcaaggcttaaaaatatcgtatatgtttttcttatagcaataaccgtattcggtggagcaatgcacagatcattcctattgctatggttcatcggtctgttcataggttatactatcatttccaaatcctttaggcaaaagtctatccttacaatcagaaggattttaatgtttttccttgcagctttagttgcattcggtttgcttgagcttgtttccaggattttaagcatggaagttttctctccattgttaaggatttcaagacttgctcagaactctttggcaagtctaaaattggtaattggaaatactcaattgataggtcacgatcctgcttcatcctattggtctgacagtactggatttgcagatggttatattagcttgccaatgcaattcattttgatgtttggcttgccattcccattgttctttggtcttttggtaaccaagaaggatacaatcgactatatgcttccaggtatcttcggttatgcatatgactttggatatttgacattcgttatattgcttttattagtcttatttacaatcataataggcctgcttgttcttcgcgaatacagacttaaaagagaaaagaacaataagaaatatttaggtaaggaagttcttttaattggttcccttactggatttattgctcaagcgatcattggtttgttcctctttaacaggacaataaacggtatggcgctgctcacattcctgttcttaggctctttggtcttggctcatgttgtgactattagacgtgatagcaatgaagttttaagccaacaaatttaa

SEQ ID NO: 1267 - DNA, 480 bp, Methanobrevibacter ruminantium
atggtaaatataaaaactgttgcattagctgttatagcaatcatagttgttttattggctatatttgctgtttccaatgtagtgattttagctcaggatgatactgaagggggaattcctggagttgatatggctgctttatggagtttgaatggtggtttccaatggatatatcctggaagctcttttgaccctgaaggccgtactcttcacaatatctatatgcttgacgacccttatggcgaagttaagacaatcatgcagtacacatataatgtggatcctcatattctggttataataaacgaccaggctgctgcccatatatttggggacaatatattggatacaatccgtcagcatgattgggtcgaaggccattcccgtggagatgccgttggaatgagcataacctctgtaaatcctttgccgataattccagacattttaatgggaaatattaagataatgttcatctaa

SEQ ID NO: 1268 - DNA, 1641 bp, Methanobrevibacter ruminantium
atgactaaatgtttaatgattcaaggaacagcatcaaatgctggaaaaagtttgattgttgcagcactttgcagaatatacacaaaaagaggatacaaggttgctccattcaagtcacagaatatgtctttaaattcatacactacaaaggaaaataaggaaatagccattgcacaggttttgcaggcaaaggctgcaaatatagagcctacagtagatatgaacccaattctcctaaagccaaagggagaatcatgctcacaagttatcatacaaggagaagcagttggaaacaaggacttctttagaaaatatgataagacaaaggccacccaaagggatatagacaataatctgatggatgatgaggactatagaatcattgcaaaggaagctgtaatagactcattaaacaatctcaaggaagattatgacataatcattatggaaggtgcaggatctcctgcagaaatcaacctaagggaaggagaccttgcaaatatgggagctgcagagattgcagatgcaaatgtacttcttgtaggtgacattgacaagggaggagtctttgcatcaatagctggaacattcctattgcttgacgatgcagaccgctcaagatttaagggagtcattataaacaagttcagaggaaagcaggaattattatgctctggaatcgaaaggctcgaagaaatcattcaggtcccagtccttggaattgttccttatgctgaaaacctccagctaccagaagaggactctgcatccttaaaggagcacaactggacaaaggaatttaagaataatgatgatcacataataattggagttgtaaagcttccaaagattgccaacttcacagacatagacccatttgacacagaagatgatgttgaagtgagaatgattgaagtccataattacaaagacaaaatcaaggacattgatgcattgatcttaccgggtacccgtaactccactgaagacattatggaacttgaaaagaccggtttggcacaagagataaggaaactgtcaaatgaatccaagattccaatcatcggaatctgcggaggataccagatattgggaaacaagatctatgataaaaaccataaggaatccaaacttgatgaagttgaaggattaggtcttttagacattgaaagtgagtttataagggaaagcaaggtcgtaaagcaaagcataggtagaatagaaataaatgataatatcactggtctaaataattccgatgaaaataatatcttttatgaaatattctctaagatcaatggggaaactgtaagcggctatgagttacatgaaggcactacaaatcttataagcgccaagccattatttaaaatagaaaagggaattggaaataatgacaatgaccaatttgatggtgcttacagcaagaatgtatttggaacctatttccatggaatatttaataattataatcttagaagagagtttttaaaccatttaagaaaaaataagggtttggatgaaaaaactggtgaagatccatatgaaacaagcgttgaaaattctcttgaaaaattagcaaatattgtagaagaagctcttgatatggattatattgataaattggtttttgatgaataa

SEQ ID NO: 1269 - DNA, 1161 bp, Methanobrevibacter ruminantium
atgagagatgttgcgattattggagcttcccaaacaaaatttggagagttatgggatgtttcatttagagaattaatttcacaagctggtcttggagctattgaagacgctaacctaagcggtgcagacttggaagccatgtttgttggaaacatgtctgcaggtctttttgtaggtcaagagcacattgcctcacttatttcagacagcatgggaatgaaccctgttccatgtacaagagttgaagctgcttgtgcatctggaggattggcacttagacaaggaatcatggctgtagcttccggataccatgatgttgtggtagctgcaggtgtggaaaagatgactgatgtggtggatgcaactccggctattgccacagcatccgatcaggaatgggaagcacagcaaggagccactttcccatcattatacgccatgattgctcaaagacatatgtatgaatatggaaccacaagggaacaattggctatgatgtctgtagttaatcataagaacgcttcaaacaaccctaatgctcaattcccatttgaagttactgtagataaggtattaaattcatctcctgttgcagatcctttaacattgcttgactgttcccctgtatcagacggtgcagcagctatcgttatctgtgcagcagaaaaggctaaggaatacactgacacccctatctatgtaagggcatctgcacagtcttccggaaccattgcgcttcatagcagaaaggacatcactaccttggatgcaaccattgcagcttccagaaaagcttatgatatggcaggagtcactgtaaaggatattgatgcaactgaagtccatgactgtttctcaatcaatggattgcttgcaattgaagaccttggatttgctaagaaaggagaaggcggcaaagtattggaagaaggtcagactaatattgatggtgattgtccgattaacccatctggtggtttaaaggcaagaggccatcctcttggagccactggtattgctcaagctgctgaaattgtatggcaattaagaggagaagcaggcaaacgtcaagtggatggtgctgaaatcggtatgactcataatgttggtggtaccggcggtacttgtgctgttcatatatttggcagagaccttaactaa

SEQ ID NO: 1270 - DNA, 1041 bp, Methanobrevibacter ruminantium
atggcaggaattgtaggatatggggctaatgtgccttcatatagaataaaagtagaagaaattgcaaaagtttggggagataacccagaatcaatttccaatggtttaattgttaatgaaaagtcagttccatcttctgatgaagacactgctactattgcagttagctctgcaagatatgcattaagaagagcacaaattgacccacaagatattggagcggtttatgtaggttctgaatcccacccttatgcagtaaagccaactgcaaccatcgtagctgaagcaatcggtgcaactccggatatgactgcagctgacttggagtttgcttgtaaggcaggtactgcaggtattcaagcggtaatgggtttagtggattctggcatgataaaatacggtttggctataggtgccgatacctctcaaggagctcctggagatgctttggaatacactgcatctgccggtggcgctgcttacatcatcggaaataaggacacaatagcagactttggaaccacttacagtttcactactgacactcctgatttctacagaagggaaggtcagccttatccaagtcatggaggaagatttacaggtgaccctgcttacttcaagcatgtcttaggagcagcaaaaggattgcttgaaaagacagattctaaagttgaagattatgattatgctattttccaccagcctaacggtaagttttacctaagggcagctaagaaattaggattcactccagagcaatataaggatgggctcttgactcctaatgttggaaatacctattctggtgcagttcctttagccctttccaatgtattggacaaggcagagcctggagataagatatttattgtatcatatggttcaggtgcaggaagtgacggatttacattgactgtaaacgacagaattgatgaagttaggaatttagctcctacaactgaagagatcctctctaaaaagatttatgttgactatgcagtttatgctaaattcaaaggaaaacttagaatggcatag

SEQ ID NO: 1271 - DNA, 669 bp, Methanobrevibacter ruminantium
atgtctgatgaaaagatggaaagagtggaagataatgaattattgattaatgcacgtaagcctgaaggagaattaggtgatcaattattggatagaatgaataagagtcacgaatctcttgcacaatggggcgtaagtcatttggatatctctaaagatgatatcattttagatattggatgcggcggaggagtcaacgttgaaagattccttaaaatgactgaaaacaaggtttatggtttggattactcagaagtcgctgtagaaaagtctaaaaaacttaatcaaaaagcaatcgaagaaggcagatgtgaagtcattcaaggctctgtatctgaattgccttttgatgatgaaatattcgacattgtaacaggctttgaaacagtttatttctggccagattttgtcaatgacttaaaagaagtcagaagggtgttaaaggaagatggaataatatttatctgcaatgaagcaattcctagagatggggacgctcgtcaagaggagcttaaagaacttttggatatgaatatttattcagatgatgagttggaccaatcattaaggcaagcaggattctcagatttaattatttttgataagagcagttcaaaagttgaatccaaggacgtaagtggttggatttgtgcaatagctaaaaaatag

SEQ ID NO: 1272 - DNA, 468 bp, Methanobrevibacter ruminantium
atgacttttggaaacgataaggaaaatatttttgtaaaaaatgtagttgattatggtgatttaagtaaatctgataggagttctaaccttggcaggttttttcccaatcgtcagtcccctaaatctgattttgattctgttccatcttcaattgatgagaagataatcaatatcttgacttttaaggatgaaggtgattcaaatggttctaataatgatggaacttctgacgattctgtggatggtgtggattattctctctttgatgaagaattagaatacatctgcagcttaggcttcaatccatttgaggaaggggggataaatagggattccttggaagagcatttcaatccatatcttgaaaatcatccagaggagcttgctttcctttctgtctttgaggattttactttagtccagatgaactttagcgatatgattaaggaggtctattttgaggaatag

SEQ ID NO: 1273 - DNA, 1611 bp, Methanobrevibacter ruminantium
atggcacaaggtcaacctatttttattttacctgaaggaaccaacagattattaggtagagatgctcaaagaaccaatatcttagcaggtaaagtattagcagaaactgtaagaaccactttaggtccaaaaggtatggacaaaatgttagtggacggactcggagacattgtagtaaccaacgacggagttactatcttaaaggaaatggatattgaacatcctgcagctaaaatgctcgttgaagttgcaaaaacccaagaagacgaagtaggagacggaaccacaactgcagtaatcattgcaggagaactccttaagaaatccgaaaccttattggatatggacattcacccaactatcattgctatgggttacagacaagctgctgaaaaggctcaagaaatcttagatgacattgcaatcgaagacatttcccgtgaaatgttagttaaagtagctatgactgcaatgactggtaaaggaactgaaaaagctcgtgaacctttagcaaacttaatcgtagacgctgtacagcaagttgctgatgacggcgtagttgaaaccgatcacattaaaatcgagaagaaagacggtgcagtagttgaagaatccactttaatccaaggtgtaatcgtagacaaggaaaaagtacaccctggtatgccttctgaattaaaagacgctaaagttgttttaatcaactccccactcgaagtcaaggaaactgaagttgacgctgaaattagaatcaccgaccctgctcaaatgcaagcattcattgaacaagaagagcaaatggtcagagacatggttaacaaagttgcagactctggcgcaactgttttattcgcacaaaaaggtatcgatgacttagcacaacactacttagctaaagcaggaatcatggctgtaagaagagtcaaaaaatctgacattgaaaaattagctaaagcaactggtgctactgttgtatccaacttagatgacttaactgaagctgacttaggaagcgctggctctgtaatccagaaaaagatttccggtgatgacatgatctttgtagaagaatgtcaagaacctaaagcagtaacattactcgttagaggaagtaccaaacacatcgtagctgaaatcgacagagctgtagatgacgcaatcggtgtagttgctgctactgtagaagacggtcaagttgtagctggtggaggagctcctgaaatcgctatggctaaaaaacttaaagaatacgctcaatcaatcagcggaagagaacaattagctgtaactgcatttgcagaatccttagaaattgttcctaagaccttagctgaaaacgctggtttagacagcatcgactcccttgtggacttaagagctgctcatgaaaaatccccttacatgggattaaacgtattcactggcgatgttactgacatgaaagaagaaggtgttgtagaacctaaacgtgtcaaaaaacaagctatccaatctgcttcagaagctgctgaaatgattttaagaatcgatgatgtaatcgcttccagcggaaccagtgcaggcgacatgccaatggacccaggtatgggcggcatgcctcctatgatgtaa

SEQ ID NO: 1274 - DNA, 1017 bp, Methanobrevibacter ruminantium
atggtagaaagggcaaatattaatccggcaatgatgctatgggctagaaagcgtgcaggatacataaatggctttgaggaagacttgcctaaagacatcaaatcaaaatataagtcttgggaaagtggagaggaaaagcctacttggacacagcttagaaaggcaagcaagaagttttgccttcctagtgcattcttctttttggagaaggtccctgaagatgatgattttccaaaaatgattaattatagaaagttagacgctgatgatatttttgaaaacaactccccaagcctaattaaacaaataagaaaatcccaaagccgaagggaacattatcttgatttattgtatgaattagaggaaaacattccatcatttgaaatatatgaaggctccttaaataaaaagcatgtctcaaattacattagggaaaaattgggaatctctttagagactcaaaagacatggataagaaagaacaagtcaaaagacagcaggcattataatttcttaaataaatggaaggaaatcataacacgaaagattggggttctaatctttgaaagcgaaggagttgcccttaatgaaatgagaggattatgcatattccataaggaagttcctataatcctattgaatggaaaggatagtgtaaatggaaggatattttccctcttccatgaattgacccatcttctattaggccaaagtgcaatctgcggagatgatgagaatattgatgaagagatcttctacaatgcagttgcaggtgagtttcttgttccaaatgaagatttatgcaaaaatacaaatgcagataatatggatactatttccaatggcgccggtggaaattatttgaataatcagataaaatacaacggagagccttactgtgcagttgttttagaggcttatgaaaagggaataatcaatggtggagaattttccagattcactaatctaaataagaaattcattccatttatgtttaatagatatctattttcttaa

SEQ ID NO: 1275 - DNA, 276 bp, Methanobrevibacter ruminantium
atggaagaattcagacagcaattagtggataaggtagtgttttcattggttaatacaaaacaaatcagcaatgatgatttggacaaaagaaataacagcatttcacttgatgttagaaaattaatcattggcagagttttggacaaggtcaattccaatataaattacgaaggagaaaacttaagttatgctcaaataattgataagcaagctaaaaaaatagttaattacttgataaatggagaaaaatatactggctttagtttaagatggtga

SEQ ID NO: 1276 - DNA, 696 bp, Methanobrevibacter ruminantium
atgaaaatactgattgagggatacaacaaatcaatccataagagagacaatcaaattctaatcatggaaaaggagggggaattggaaaaaatcaatataaaaaagattgatgatataacaattatcggaaaaggatccatcacatttgatgccttgagactaatctctgaaaataatgtccggctaatgtctatagactactttggaaagataaactatactcttgagtatccgagcaatgaaaacatattcctaagaaagcagcaatataaaacaagtgaaaaccacaaaggtctgattattgcacgggaaatgataatgtctaagatgattaatcaaaaatcgacaattaagacccttaataaaaacaaaaaattagaaaatgttaagatttttgaaagaaacatcaatgaagcaattaaacaaattggcagtttacggtttggagaaaggacagacattgaaaaatcaaaaatgaagatgatgggaattgaaggaagcgcctcagtggactattggcttgctgtaaatgaacttctgcctaaagagataggtttcttctcaagaaataacaggcatcctaatgatattacaaatgcaagccttaactatgcctatgcaatacttgcaagcgaagtaaacaaggcgcttgtcataaatgggcttgattcatattgcggttttcctgcattttga

SEQ ID NO: 1277 - DNA, 276 bp, Methanobrevibacter ruminantium
atgaaggtcttagtttcatttgaaatcaaattcaaaaccaacaaggaaaagattatatccattctaaagcattttggctttagaaggatgcaagaaaacttatattttggggatgtcgaatatgatgaactatatgctatgcagtccgatattatggagaacattcgagaatatgacagcatactgacaattcccatctgcaaatcctgctatctgaagctgaatgtatttggaagaaatctaagctttaaggacgaattatacaaaatattttaa

SEQ ID NO: 1278 - DNA, 165 bp, Methanobrevibacter ruminantium
gtggaaatagatgactattttgacattttcggtccaagcggccacgccagtatgatgtacccgggtgaccttgctggtggtgcagagaatgttgccaattgccgttgctgggtacggtacactaatgagagaccaagcaacctaaaaccatatggaaccatataa

SEQ ID NO: 1279 - DNA, 810 bp, Methanobrevibacter ruminantium
ttgaatcagctgaaagaggaagtcgactctcgaatgaaatccattgaagacaatgcaagcgaaaagaccaagcaaaagcttcaaaagaaacagaaaaagatcgatgacatatcagaagctgacatagacgaacagatagaaacactggaaaaggaaaacaagaagcttaagcgctaccaaagaatcttagatgccctgcaagagaaaatggagattgattccggaagggtcatgggcttaactgacggaatattctcaattgtaatgactcttctaatctttggaataacattgcctagcaccgaaatcctaactgatgccggactttcaagtttcattagttccatactgccaaatattggagtcacacttgtaagtttcatcttgcttgcctcattctggatttaccatcatgaatttattaaattaaaatgcttaaacttggtttacctatggcttagcatgttctatttagcgacagtctgcttcattccatttacaacaacccttattggaacatatcctgaattccgcttatcaaccaatatttttggaataaatatattgctagttattatattcttcctattgatgcttaattatgcatctaaaagaggattccttgatgaagaggtaattgagaaagataagaaatatgtccatcacacattatatataatcctaggattggcagtgattattaaccttcttgactttagtgtgaatgaaaacttcatttacttgttcttcctagtgcctattatctctacaataagggatgtacgtttcaaattaaaaaataccgagtaa

SEQ ID NO: 1280 - DNA, 2061 bp, Methanobrevibacter ruminantium
atggcaaatgataatgaaagacttcaacaattggtaagatcatcccttttggaaaacaacaaattgaaaatggaaattgtcaagcttaaggagaatgaaaactctcttaagtctgataaggaatttgatgaacttaaaaaggaatatgaagcatccttaagtgaaaaagaccaggaaatccttgacttgaaggactctcaccaaagcgaccttgatgaattgaagcttaaatatgatgatgatttaaagactaaagaaaatgaaatatctgcccttaagattcagcataagcaggatttggaaaataaatctacagagatttccaatattaaagttaagcacaatgatgaattgaagcttaaggatagcgaaatcgaccagttgaagcaaaagcatgatgaggaattgagattaaaggataatgaaatcatagatattgaatatgattttgataataagctaaagcttaaggatagcgaaataaactctcttaaggagcagtttaaccaggaccttaagagcaagagcctagagcttgcagatttccttgaaaagtttgatgaggacatcaagtccaaaaatgatgagattgatcaaatcaaagaggattacaataaggaaatcatatctaaggatatggaaatagaaagccttaccaattcattgaatgccaatattgaagttttaaacaaatcaaaggacctcctttcatcaaaggatgaaacaatcgacaagctaaatgacaaggtcaaggagctatctgatatgaacgattccctttcaaacatgaaggaatcctttgatgctgaacttactaattttaaaaccctagagttaggggagcttaacctaaagctaaggaatgccttaaatgacataacctctaaggacaatgagattcaatccatctcaaatgacctaaagattgcaaataatgacatcgttgacttgaagcgtcagcttaacgagtcaaaaacaaatgcaaatgaattgaatcttaagctggcaactgcacttagttcactcgatgacaagaatattgaaatacaggcattaaacaataggatcgcttcccagaatgagaatatcattgaccttaagaacaatcttgtaaataaggacaatcttgttgcccttcaaagggagcttgattcaagggatgttgcaataagggaaaaggatgttcagatacagttgcttaaggacaagtctgtatcaagggaagagtatgccaaggtcaagaatgagctctctaagaaggacttgcagatcaagcgcctcaatgaggtcaaggatctcttctttgaactttcagacaatagctttatggatagtcagtcctcatctgttgttaacaagacatcttcagatgataagtcattgatggagcttaataatatcaagaaagagctagagcttgcgaaagaaaacaaggtcaagttcaagatagttgaagagaatcttcttgatgatgaaaaggcaagtgccgatttagataaaaaggtaaaattggatgagagcaagctaaatacagatttagaggaattggtaaattcagagatagataacttcgatgatcttgttaagagtagggatgcaaaagctgaagaatctaagtccactgatgcatccagttctaaaggagattatacctcttctcagactaatcttgctggtttagaatcttccaaagctccacaatcagataatgcagagattcaaaagcttaaggaagagttagaatcctataaaaaacaagaggcagaatataaaaagcaacaagaggagctaaacaaatataaggacgtttatgaaaagcttacttctcctcagctaaagaacttaaactctatccaatcccaaatctattatcttcttccggatgaggcaatggacactctttcaatcaaggattatcttaatgaggttgcattcaagaacctttcatttggaaatacaaagaatatcctaaagagtctagagagaaagggatatgtggaagttgttaaaaaggaaaacgacatattcttctggaaaaagcttcctatacctgcagaataa

SEQ ID NO: 1281 - DNA, 156 bp, Methanobrevibacter ruminantium
atgatttatatgatgaatctgagagaatcattgactcatatgaggagcaatggactgcctctcttaaatcaaatgaaggtaaatctgtctgtggattattataataaatatattttaacacataaaaaaacttatttttctaaatattattcataa

SEQ ID NO: 1282 - DNA, 642 bp, Methanobrevibacter ruminantium
atggctatggatttgacagatattggaattgaagaaggacagaaatatgaagggatttacactaccatgagcaaggacggtgtaaaaaatgcagcgccaataggaattgtatgcaaaggcaaggacaaacttggatgcagattatttgtcggtaccaaaaccctcaaaaacattatggaaaccaggaaatatgttgtaaatataacctttgatcctataaattttgtaaattcaaccatcggaaacttggatattgaagagtttacagatgatgaggacattgcaatattaaaaaatgcggaagcatatgtcatttgtgaggtcacagacattaggaaaatggatccgattaaggaccatataacatcaaacggggaagcttatatcataagcagtgatgttgtcaaaatcgtcaaaaacaatccatgtgcaaaggctttaaacaggggagtattcgcacttctggaatgccttacaaactatacccgacttgaccttgtaagcaaagagcagcaggattatttcatcggaaggttcaatgaaaacaatcgcatgattaagagggtttcaggacctgatacgataaaagccatggagattcttaaaaacagcatgatagaaaagggttttgatgttgaatag

SEQ ID NO: 1283 - DNA, 1071 bp, Methanobrevibacter ruminantium
atgtcacgtaattttaaatatcttgatgatttgattctaagaaaggataaaaaaatagttttggattttgatatagaattaactgaggatgaggagcttgaatattgggatggaattaaattagataaagatgttcttattgatggtaaaggccataggattgatgcatgtgggaaagcaagaatatttgattgttccggcaaacatatcagacttaaaaacataatattgaaaaatggaaaagcaataaatggcggggcaataaagatttctaaggactctaatttggaaattatagaatccaaatttatttataacattgcaaatggaacatgcaatgaaggaaatggcggagcaatattcaataaaggaaatttaaaactattgaaatccacatttgagaataatatggctaaaggagagggtggagcaataagaaattacggtaagttaaatattgcagaatcaatatttaataaaaacaaagcaaaaagaggcgccgcaataatcaatcgtaatgatttgacaatatccaaaaccatatttgatgataacactgcagaatggtatggtggagcaatatttcataattggggccaagcaagcattttggaatctgaattcattaacaattcagttacagaagatcatggcaatggtggggccatatgcaattggatgcgatctcaattgaacataaccaaatcctcttttaagcaaaacatttcaggatctgctggagcaatttacaatgctagtgattgtaagttgaatataagccagtctgcctttaaagaaaattcagctagatatgctggtgcaatagttaattatggcaaggcaagcattcaaaaatccgtatttggggcaaataaatcaaataagtttgaaggtggtgcaatcttcaattattctgaagggaacctcattatttcacaatctgtgtttgaatcaaacatatccgaaagggttggcggagcaatatattcagaaaatgataattctttaaaattgaataattgtaaatttaaacacaacaagccagataattttaatgtaggttctaaataa

SEQ ID NO: 1284 - DNA, 966 bp, Methanobrevibacter ruminantium
atgaagcatagattaaatttagataataaagacccaaattatattttgttgaaagaaatatttaaaattatggattctagaaaatccaaaagtatattagcatcctatggatttaaaaacttaaatagaacaatatttacttttaaaattatatttataagtatgttctttggaattgacattccattcattttaaacgagcttaaatccaaaaaagaacttcgcaaatactttaatatttctgaagttttgactgcagatcaagtttataaaattttttcagaaataaactctgaaaaacttataaaatgtttaaacagaatcttaaactcaagaaatatggtcaaaaggagaggaaaaaagactttcattgtcgatgcgactccagtggacttggatatcaatttccgcagaaataaaaagagcaaagaacatctcagaaaattgaatctcaaatggagttattcttcctctaaaggctattatattggatttaaagcgactgttgtgatggattacgattctatgaatcctgtttgcattttaatccattctggagctccaaatgatgcaggactttttgaagagattttagaaaaccttcaaaaaagacgaataatcagaaaaggagatacattaatctttgataaaggatattacggctataaaaactaccaaataggaattggcaagtataaaatcgttcctttcatttttccgaaagaaaaattcaacagaacaagacttgatgatattttaacctatccattagccgtatttaacaaaacaaagaaaataatggaagaaaaaagattatacaacaaattaaaaaaggaattattagaaaaattagattcatgggagaaatttaaaccaataaggggcaaaatcgaagatttttttcaaattattgaaacaaggcttgaatatgagagaaatccacaaatatactccaaaatcagttga

SEQ ID NO: 1285 - DNA, 303 bp, Methanobrevibacter ruminantium
atgtcacaagaaagatataaacacattcgcgaaagtctttttgattatatcaatgcatttttaatcaacaagtatgatgaattatattattttaatatgtacgaatccgctgaaaatatgaattgggatgtagaatacatattcaaattaaaatattcattaacattccatgaaaaaaagaatctagagattagaataagaaaagacttgaagaaatttttaaaagaaaaatttgaaatgaacatttatgaacttgctattttaattattctagaggataatgaattgcattccaaaatttag

SEQ ID NO: 1286 - DNA, 240 bp, Methanobrevibacter ruminantium
atgttttatattgaaggagaaaatataaaatatgaaattttaccatataaaaaagggaaaaaagtaattatttaccttaaaaaaactgaaaacggatttgttagaaaaaacaaatgttttggaacacattatttagaacagatttttgattataacaataaattattaaaagaaacaatatatgaaaatccaaattttgtagacttaacaaattttccaattgacctagattacgattaa

SEQ ID NO: 1287 - DNA, 150 bp, Methanobrevibacter ruminantium
atgaatttggaggtttttaagatggctagaatattaattccaaattatgaattcgttaaaaattggtctgaagatgaattaaacgattttttaaccacacctgcaggtatcccacatgaacttatgcatatagttcgtaaagttgtttaa

SEQ ID NO: 1288 - DNA, 735 bp, Methanobrevibacter ruminantium
atggaatgttatcatttgcttcgtaaagagaattattctttagtaaggaaaaaaatagagaattttttagaaaaatatcctctaaaaatatctgaagagaattatttttattttaataataaatttgaagaaaatttttattttatcttttttattcactcaaaatatgtgaatgtttcccaaaaagaagatgtattgaaaaattataaaatcttaaaatatgactatccatttattttagctgcttatggagaaacattaatcgaatttgatgagttttctaaagcaaaatactttttagaattagctaataaaataagtccatttgatattgggattttaagacaattactaagaatttactgtatagaattagatagggagaaaattgaagaaatttttaattatgcattagacattgtttatgatgaatattaccttttttatatttatgagtttttatcagaatattatttacaaataaatcaaatagaaattggtaatttattatctcaaattgctaaagaagagtcatttaatgtagctgaaaagcactacataaaagatttatttaataaatatgatataaatttggggtttaatgaagaattaatttctcatatggaatatattgtgaatcttttaaataaaaaaggggacttcactgaatcttatcttttaaatcaggattgtgctgatttaaaaaggtttaatagaaaatttaaatattattga

SEQ ID NO: 1289 - DNA, 405 bp, Methanobrevibacter ruminantium
atgtcaaatattgaaaaaatcaattcagaaataaaagattatgtcaattatgtccaaaaaggaggtaaattagaacctttttttgaagatatttgtttagtaactactgaattagttggatttagaaaaatcagtaatttcgaagatcttttttcacaatttaaaaagggagattatttagcattatttagggatacacaaaatgaattagatgaattagctattgttgttaaatggaataatttaatgataggttatgttcctagaaaacacattcctatattgtctagtttaatggattctggaaaagaaatctatgctataattgatgatttaatattagatgaactatttaaagatcttttttttgagacagtcaaaataaaaatctttttaaaagagtaa

SEQ ID NO: 1290 - DNA, 759 bp, Methanobrevibacter ruminantium
atgtcaatgattgttcattcagagtataaaaaattaaaggaccatttatatgatttagtttatgaatatgaagatttaataaatcatatctgtccaaatatagaaatggaatatctccttaaatttggaatatatgaatatgaattatataagaaagagttagaattaaataaacttaaatttaagttaaaattacttcaaactgaaattaatcatcaaaatgaattagatttaaacgaaatagataaaaaagttatagataaatatacggagtatgcaaataatcttaaaaactctatgaatgaacttgaaaacattataaaacataaagataactattttcaattagatgaagaagatgaaaaagaacttaaaaggatttataaaatacttataaaaaaattacatcctgatttaaattttcatcaagaaaattttaaaaaagaattatttatcaaagttactaatgcatataaaaatggtgatttggaggaattaaaagcattatatgctatgctacctgatgaagatattgaagaaaaatccagtttaaatgaattaaaagaattaatacattcatttgaaataaagattgaaaaaattaaaaatgaatatccttataataagttagatctactttcaaatgaaaaagaaattggggagtataaaattaatattcaatatttaatagattcatgcaatgaggaaatagaagaatatagtaataagataaatgaaattattgaaaatcagcattaa

SEQ ID NO: 1291 - DNA, 1050 bp, Methanobrevibacter ruminantium
atggtaaaagtaggtgtacttggtgcaactggaatggtaggtcaaagatttatccaattattggctgatcatcctgattttgaaatagctgctcttgcagcatcctcaagatctgcaggcaaaaaatatgaagacgctaccacttggtatatgaatgatgaaatgccggaatctgtaagggacattaaagtaattgaaactgaccctgcacatatggataaggatgtggaaattgtattctcctcacttcctgctgattttgctgcaaaagtcgagccagaatatgcaaaggattttgtagtggcttcaaatgctagtgcaatgcgtatgaaaaaggacatacctttagtcattccagaagtcaacccacaattcttggacatgattgaagcacaacagaaaaacaacaactgggacggtttcattgtaacaaaccctaactgttcaaccattgctttgactttaactttaaaaccgatttatgacaacttcaacattaatagaatctatgtttcaaccatgcaagctgtttcaggagcaggctataatggtgttccttcaatggctatcttagacaacttggttccatacattggcggtgaagaagagaaaatggaaagtgaaactttgcatcttttaggttcccttgatggtgatgaagttgttcctgcaaacttttctctaagcgcatcatgccacagagtgcctgtcattgacggtcacactgaagcggtatttgtagagttggatgaagaggcagacattgacaagatcaaaaagaccatggctgacttcagaggacttccacaggaattaggtcttcattctgctccagaacaacctgttatcgtaaaagaagaagatgacagacctcaaccaagaatggacagaatggcttatggcggtatggctgcaaccgttggtaggctcagaaaagatcaagcatttgataacagcttcaaatatgttcttgtaggacataatacaattagaggcgctgctggtgcttctattttgaatgctgaattgattaataaacaaatattataa

SEQ ID NO: 1292 - DNA, 819 bp, Methanobrevibacter ruminantium
atgataaaagttgctgtaactggagcctctggaagaatgggctctggaattataagaaaaatctctgaacaagatgatatggaagtagtggctgctatcgaaatgccaaacactcctttagctggtgtagacgctggtgaaaaagcaggcattggcaaaatcggagtgccaattgtaggttcagaggatttggaaaaagctttggaagaatctggagctgaagtattagttgatttcactatcgctcctgctgctgttgaaactattaaaagagctgccgattgcggagtaaaccttgttgttggaaccaccggatttactgaagagcaagctcaaggaaatgcagatgtaatcaaggaaaaaaacatcaaagcagtaatttcctctaacttctccattggagtaaatgtattcttcaaagttctaaaggacttgactcctattttaaatgactttgacattgaaatcattgaagctcaccacaaccaaaaggcagacgctccttctggaactgctatgactgcatttgaagttgttgcaggtgctttaggaagaaacccagaagaagttggcgtttatggtagacaaggtcaagtaggcaaaagaaccaaagaggaaatcggtatgcatgcagtccgtggaggagacattgtaggagaccacactgtattgtatgtcggtgatggtgaaagacttgaagtaaaacacatggcacataccagggaagtgttcattgccggtgttatcagagccttaagattcgtaggttccgcagaacctggaaaagtaaatgatatgactgatgttttaggaatttaa

SEQ ID NO: 1293 - DNA, 894 bp, Methanobrevibacter ruminantium
atgcgttttgaaggaacagctgttgctatggtaactcctttccatgaggacggatccatagacgaagaaggatacagacaaaatattaactggttgattgacaacgatgtagacggtttggttgctgtaggaactacaggagaatctgctaccttgacccatgatgaacacagaaaagttcttgacatcttgattgatgaggttgacggcagagtcaccacaatagccggtaccggaagcaatgcaacaagtgaagcattggacttgactaaatatgcagatgatgcaggggcagacatggctcttctaatcactccatactataacaaaccacaacaacatggagtaattgagcattatacccaaattgcaaactctgtagacattgacttgattgcttacaatgtcccatcccgtaccagccttgacatggctcctcaaaccattgtcgagcttgcaaaagtggataacattgctgcattgaaagaggcttcatctgatgttgataaagcatcaaaaaccatgaaactcttaagggacgaaggtttggaagatgaaatcgtaatcctctccggtagtgatgaattgacccttcctcttatgtcaatcggtgcaagaggtgtaatcagtgcttctgcaaacatcgatcctagaaccatggttcaaatggtaaacaacattttggatggaaactatgacaaggctatggaattgcattaccaacaatatgacttaatcaaagccttattcattgaaaccagcccagcacctgcaaaagaagcattgaacatgatgggaatgcctgcaggtccattaagattgcctttagttcctatgttagaggaaaacaaagcaatcctaagaaaagcattggaagatgctggaatattatag

SEQ ID NO: 1294 - DNA, 1218 bp, Methanobrevibacter ruminantium
atgggattaattgtagccaaatttggcggtacttcgattggaaatggtaaaaggattaggaaagctgcacaatctgttgttaatgagtatatggatggcaagaaggttgtcgttgttgtttcagctatcaataagactactgatgaattagtggctattgctgatgagtccattggaaaagaagttaccgaaaagcaattggcggaaattttatccctgggtgagagaaccagcataagagtattttcctcagtccttgaatccttgggagtgaaatccgaatacattgacccaagccatgaattatggccagtcataactgatgacaactatggaaaggctcaaatcgactttgaaagaactgaagagcaagctcaaggtcttttatcacttttggagcaaggtatcattccagtggtatgcggattcttaggaagaactgaaaatggggaagtgacaaccctcggaagaggcggaagcgatgtcactgcattccttttaggccactgccttaaagcagataatgtaatcattgttaccgatgttgacggagtcatgtcaactgacccaaggaagatagatgaggctgaaaagcttgattacatttcagttgaagagatgagggatttagctacacacggcgctcaagtattgcatccacatgccttaagatttaaagatcctgaaataaaagcaaagattatcagttttgaaaaaggagacttatcagaccctggaacagagattgtcggcccttttgaagattcaatgggcaaaaaagtatgcctacaccatgagcctatttctgtagtggctgtagtgggagaggacttgcttaatcaaataggacttcttgcaaagatgaccagcttagttgctgatgcaaacatcaacatctacggcatctcagcaggccagaactcaatcacattgttcctcgataaggaggaagcggatgacgcttatcatttattgcatgatttggtcattgcagaggataacttaagctccatctccttaggaagggacattgcaatgctcaccatgatcaatcctgattttattgaaactccaggagtaatcactgaaattaccaatcctctaaaggaaaatcatattaatattgttgaaatttcatcatcccagactgcaattgttttattcatcaattgggaagatggaaaggcagcatatgatcttataaaggaagttttataa

SEQ ID NO: 1295 - DNA, 198 bp, Methanobrevibacter ruminantium
atgggaaatattagaacttcatttgtaaaacgtatatctaaagaattaattgaaactcacaaaggtaaatttaccaccgattttgaagaaaacaagattttagtagctgaatactctaccgtaagcactaaacatttaagaaacaaaattgctggttacattaccagattagtcagacaagaagcaaacaaagcttaa

SEQ ID NO: 1296 - DNA, 324 bp, Methanobrevibacter ruminantium
gtggacgaaaaggaattgatgagtatatatgaaactgaagaagaagctcgcaatgttcttttaaagtctagaaaaagaatcgatgaaattgataatgatttagttaacttaattagtgaaagaacttcacttgctaaggatatagtttcagctaaggtttttttaggcatggaaatttatgacaaatccagagaagatgaagtccatgccaaggtaagtaaattagctcaagaaaaaaatatagatgatgatattcttagcgatattatgaacatgctaacaattttaagtaaaaataaacagagagaatttttggaggaatga

SEQ ID NO: 1297 - DNA, 870 bp, Methanobrevibacter ruminantium
atgcattacataaacgccaagacaatattatcaagcaaaaacggaatgaacctatataggggatgctcccatggctgcatctactgcgattcaagaagcaagatatacaatatgaaccatgactttgaagacattgaagtaaaggaaaacggaatcagactccttaagaatgccttaaagagaaaaagggaaaaggtcatgattggaacaggatcaatgacagacccatacattcctcttgagagcaatctaaagtttatgagagaatcattggaactcatttacaaatacggccatggatttacctgcataaccaaatcagacctcatccttagagacctggacctaatcaagaaaataaatgaaaatacaaaggcagttgttcagatgaccctgacaacagctgatgatgagctatgcaagatacttgaacctaacgtctgcacaacaaaggaaagagtcaatgtcctaaagaccttaaacgaaaacaatatccctacaatcgtttggctatgcccaatcctaccttatataaacgatacagaggaaaacattaatcaaatattggattactgcattgatgcaaatgtaaaaggaattttatgctttgggatgggaatgaccctaagagaaggaaacagagaatatttttataaaaaactagatgagcatttccctggactaaaagaaagatatagaaggacttataggaatagctatgggataaaaagccctaataataaaaaactaatgaagatattcctccaaaggactgatgaacatggcattatgaacaatatagaggatatatttgaatatcttcatgagtttccaagccatgagagcacaaagcagactactttgatgtaa

SEQ ID NO: 1298 - DNA, 918 bp, Methanobrevibacter ruminantium
gtgattgatttggcaaaaatagtaaagtctccaggttctgctacagttataaatgcaatatcaaccggttttggttctgcatttggaattgatttgaatataacttgtgaagcggaattctcttcacaaggcattgactgttcatctgacttgggagtggaccccaatttaatgaacatatgtgtaaaaagtgttttaagtcattataatattggaaaagacttgtctcaggatgatcttttaaatgatttggattttggaaatggtgaaggaattaaaattagaacaaaatccaatcttcctttaggctctggcctttcaagtagcagtgccttatctaattctgttgttatggcaactgcaggcttgatttcagatgaatttttcttaaagcctttaagcgattttgaaatgattaatcttggaattgacgcatctcttgaggctggagtaaccataaccggagcttttgatgatgcttctgcatccttttttggaggacttaccataactgataatatggaaaggaagattttgcatcaggagaaattgcctgaatatgatattttggtttttatgcctgataaggagtcattaagcggttcatctgatgtaaataggatgaaattggtagggtcatatgttaagatggcttttgaagaggctatgaataagaggtatcttaaggcattgactttgaatggtcttttgtatggaactgcacttaattttgataataatattgccttggatgcccttagtgcaggggctttagcttctggattatctggaacaggatcctcttttgttgctattgttgaagaggatacaattgatgatgttaaggatgcttgggcttcatttgatggaaatgttattgaaacaaaagtaaataatgaaggaactaggtttatttag

SEQ ID NO: 1299 - DNA, 252 bp, Methanobrevibacter ruminantium
atggtatataaagtagaagtatttacttccccaacctgccctcattgtccaggagctgtaagactcgtagaaaaagcaaaagaagaattaggagatgctcttgatgtaaccatttacaatacagcagaagctgaagctatggaaattgctagaaaataccacatcatgtatgttcctacaatcattattgatggtgaaatcaaattccaaggagctcctagctacgatgaattaatggcagaattaaaataa

SEQ ID NO: 1300 - DNA, 471 bp, Methanobrevibacter ruminantium
atgggagaaaaagaatttactcatttaacagaaagtggagttcatatggttgaagttggtgcaaaagcccaacagagaagaactgcaatagctagcggaaaaatccatcttcaaaaagaaacaatcagaatgatagaaaatgccgaaatcaagaagggaaatgtattaactacagcccaaatcgctggaattcaagcagttaaaaagacatcagaccttatccctctttgccatccgttgaatcttagtggaatagacatagaatttgaagttgaagaagaggaaatcactgcaatctgcgaatgcagattaactggccaaactggagtggaaatggaagccataacaggagtaagcgtagcccttcttacaatatgggatatgacaaaagctgtagaaaaagatgaaaacggacagtatcctaatacaagaatttcagacattaaagtccttaaaaaagaaaaaatataa

SEQ ID NO: 1301 - DNA, 2073 bp, Methanobrevibacter ruminantium
atgaaaaacattcccactaatattaaacaaataataaatgattgttatccatacattaaagagttcaatcccgcccaaaaggctgtaattgaatctggataccttgaaaatgataagaattacatcatagccattccaactgcaagcggtaagactgtgcttggagtcatggctgcacttcaatcaatcctatctggaggaaaggcagtatacgctgcccctctcatatccatacagaatgagaaggtcaaggaattcaagaaatttgaagagcatgggatttcagttggaaagcatccatcatcctctgacttgtcaatcatggtctttgaatcatttgatgtcctgacacgattttcctgggatgtattaagagatgttgacacaataattatcgacgaattccatatgattggagaatattccagggggcctacaatcgaatgtgcaataacaagggctaaaatcataaatccaaacttaagaatcattgcattatctgcaacattggaaaatatgtctgaaattgaaaattggcttgatgctacagttatagaacacgattataggccagttccattgaataaagacgtattggatacagaaatgttcaacactaaaaataaaaatgatgtagtggtaaaagttattgaaaaagcaattgaagatgattcacaggcattaagcttcgtatcaacaagaaggttcacagaaagccttgcaaactatgttgctgaaaagctaaagaaaaaaaccacagatgaacaaaagaaaaggtttaaggaagttgcagacaagattcttgaagttccagagaaaaaaggctcaagacctacctccacctgcttgaaacttgctgaaagctgtgagaacggtgcagttttccaccatgcaggactcttttccgaacagaaggaaatcattgaagaggaatttagaaatggaaacatcctaatgattgcagcaacaccaagtttgatgtatggagttaacctcccttccaaatatgttgttatacgagattacactagatggacctcccaaggacctcaagcgattccagtatttgactacgagcagatgtccggaagagctggaaggccacaatacgacaatgcaggatattcctatttgattgcaaaatcaatggaggaagcttcaaccctggaagagcgatacatctatggagacatagagcctacaaactccaaactgattgaaaataaggatgcagtattcaggcaaatcatagcccaagtggcttccaccatatcaaagacacctgaagacttagaagatttctttaagaaaacattctatggctatcagatgacaaataacagttcaatgagctttttcgcagaggaaagcctaaaattcgaaatacagaatgcattggaatttctgcttcaaaatcagatattgcaggctacaccaagtggacttaaaacaacagcacttggaaacttaatagccaaatccaactatacagtggaaactgcagtaaaggttaaggaatatgcgaacttggttgaccaattcagtgcagaggaacttatctatcatttagcgcagactcctgatatgcctctcatttcatttaagggcagacgctctaaagacccagtgcgagaaaagcttgctaattatggcctatttgcattggagatagcaaatccagaggcaactgccgtgtcccttatcgaatggatcgatgagagaaacgaatatgagatagaaaatgcctataatgtctatgcgtcatctacaagacgggctgcatatgaagcgtccctacttgtcagattcactaaaaacacattggaagttcttggaaaatacaattattcaaaggatttggacttcctatcagcaagactctattacggagtaaaggaggacataattcctcttgtgattggagtaaaacgcttaggaagaaaacgtgcaagagcattggtaaacacattcggagaggatttaagacctgtttcagaaaatgaacttcaaaaagtagatggaatcggacctaaattagctaaaagcataagaaactttgcagacaattattga

SEQ ID NO: 1302 - DNA, 303 bp, Methanobrevibacter ruminantium
atgagtttttgtgacattcgtggtgaaactatagatatcggcgcttttattagatacactggaacaggtaccataagcaaagttgttgatttaaaggaagaagataaacagcaatgggttaaattggatgaacctgctttatggtatgctgcagattctttagaagtggtcgatgaaaaagatctcattaatgttgagactgtggatagagatactcttgaaaaagttaaagacattaaagaaggctacgaagaacttaatgctaatttaaatgatattcaaggctgtgaaggtggaggttaa

SEQ ID NO: 1303 - DNA, 456 bp, Methanobrevibacter ruminantium
atgaaaattaaacaactattaggtatgttagttttagacgataacgcaaacgaaattggtaaaattattgacgcagattttgaacctgaaactggtgcaattacaaaaattgtagtcagccttaagaaaaatttcctcacttccgaccaattggatgtagagtataatgatgtaaaaagcattggagattacgtattattgaaaattacaattgataaggaaactaaaataaaagaagctgaagaagctaagaaagctgaaaaagaagctaagaaagaagctaaaaaggctgaaagagaagccaaaaaagcagctaaagaagctgaaaaagaagaagcagtagctgaacaaatcgaaaaacaagtggaagttgttgaagctgaaattgttgacgatgctgaagaagctgaggaagcagtagaagctgaagaaactaccgatgttaaagtagaatag

SEQ ID NO: 1304 - DNA, 1707 bp, Methanobrevibacter ruminantium
atggataaagcatgcagaatcatcatagaagacattatgaatggaaaaataactactcgacgtgaattggaagtagaaaaaagacagctatgcagagatagaaaattaaaaaagttcatgagcaattcagttatcctagagcatgcaagccttgaagagaaaaagatcgtatcaaacctattaaggaaaaagccaactagaactatctctggagtggctatagtggctgtcatgtgccatccacaccaatgtcctcatggaagatgtttctattgccctgaaagtgatattgcacctccaagttataccggagaagagcctgctgcattaaggggcagaatgttcaagttccacccttatgtacaatgctataaccgattaaagcaacttcataaggtaggccatcctatcgacaaggtggaacttatcatcatgggaggaacattcccttcaaaggatatctgctatcaggaatggttcgtttcacaatgtctaaaggctatgtgcgattttggaattatccttgaaaacatcagccaaatcgatgatatcgaatcaataaagagagaaggccttttaaaataccatccttattcaaacaatgaattgaagacttatccccctaacgactatgtcctaatagatgacattcaaaggataaatgaaaattcaaaggtcagatgcattggaatgacctttgagactcgtccagactactgtaaagagccccatgtagatagaatgcttgacatgggagttacaagagtagaattaggagttcagacaatctataatcacatctacgaaaagataaaaagaggccataaggtagaggatgtgattgaggcaaacagaatcctaagggattccggagtaaaggtagccatgcatatgatgccagggctatttccacttgcaagggagaatccaagaatagaacaatgtccagaacaggacctaaagatgtttaaggaaatcttcaacaatgaaaactttaagccagatatgcttaaaatctatccttgccttgtaactgaaggaagcgaacttcacaagctttataaggaaggcaaatacaggccttacactgatgaagaggctgtagaattgatagttcaaatcaagaagatccttcccaaatgggttagaaccatgagaatccaaagggacattccatctaccttgattgaagcaggagtcaagaaatcaaaccttggcgaattggtctataaccgacttgaagaggaaaaaataaactgccaatgcataagatgcagggaaataggccataagaaaacagaacaggactattcaattgatgattacagattattccaagaagattacactgcagtgggaggtaaggaacacttcctatccatagaagataagaatgaggaaagcttagcaggattcttaaggcttagaatgcctacagaacaagcccatagagaagagattagagacaatactgcaatagtaagagaactccatgtctatgggaacatgattaagataggccataagggaaacgccataggtcagcataccggatttggagaaagacttcttaagaaagctgaagagataagcatcgaccaaaacaaggaagagcttttaataatcagtggtatcggagcacgaaactattatcgtaagtttggttatgaacgtaaaggtccttatatggctaaaaaactaatctaa

SEQ ID NO: 1305 - DNA, 723 bp, Methanobrevibacter ruminantium
atgattacagcagaagaattagctcaatatatcgaatttactaatttagataatactgcaactgaagaacaaatgaaagcattctttgataaggcaaaagaatataacttttatgcagtagtagtccttccacactatgttaaattagcaaaagaagaattaaaagacactgatatgaaagttgtaactgttgtcgacttcccattaggtgctggaaccactgaaagcaaagttgcagaggcaaaagatgcaatcaaaaacggcgccgatgagattgacatgatggcaaacatccctgcaatcaaggagcacaactttaaggcagttaaagaagacatcattgcagttaaagaggcagttggagatcatatcctaaaagtcatcattgaaaatgcccttcttactgttgatgaaaaggcaggagcttctgcaatgtgtgaagcgggaggtgcagactttgtcaagacctcaagcggattcaatggaaatgaacatttctatgctttaatggaaagcttaagaatcatgaaaaagaacgctccacataaggaaatcaaggcagctggcggaattaacaattataaattagtaaataatgtcattgcagcaggagttactaaaatcggaacttcctcaggacacattattatggaccagttcaatcatgtgatggacaatcaaaaggtaagtccagaacagaaaacaggcccaaggcttatttag

SEQ ID NO: 1306 - DNA, 201 bp, Methanobrevibacter ruminantium
atgagtgaattaccaatcgcacctgtcggtcgtatcttaaaaaatgctggcgcacaaagaattagcgatgatgcaaaagttgcattagctgaagctttagaagaaaaaggtgacgaattagctaaaaaagcagttaatttcgcacgccacgctggtagaaaaaccgtaaaagctgaagatatcaaattagcaattaaataa

SEQ ID NO: 1307 - DNA, 1287 bp, Methanobrevibacter ruminantium
gtggataatatgaaagtatttatagaaacctatggatgtacatttaatcaagcggattctgaaattatggcagggatattgaatgaaaacaatatcgggcttgtctccactgaagaggaggctgatgccattattgtaaacacctgctatgtaaaattgcctactgaaagcaaggtaataaacagaatcaaaaaccttcaaaagcagtaccctgataagaagattatcgttggaggatgcatggttgaagtggatcctaaaaagcttgaggcaatcggacctaattgctcatggattggtcctcaccaattaaacaagactgcagatgtagtcaaatctacaatcggcggtgaaattgttagggaatttggtttttccgatgaacctaaagtctgcgttcctaaaatacgaaaagatccatacattcatgttatccaaatatgtgagggctgcttaggtgcttgcacatattgctgcactagatttgcccgcggccatttaaacagctatcctataaaggatattgtggaggaagcaagattggccattgaagatggctgcgttgagattgagcttactgcacaggacacttcagcatttggtaaggatacaggcgaaaagctctctgatttaattaaggaagttgcaagcttagatggggactttagagttcgtgttggaatgatgcaccctagaaacattggaaatgatttggataatcttattgaagcatttaagatggaaaaagtatatgatttcattcatttgcctatacagtctggcagtgacaaggtcttaagggaaatgggaagaaaccatactgtagatgattataagaatattgtctatagcttcaaacaggctattccagatattactatagccactgacatcattatcggatatccgacagagactgaagaggattttatgaagacagcagagcttattagagaaatcaaattcaatcttattcatctctccaaatatcagcatagggagggagccatatcatcttccctggataatattccttttgatgatatgaaaagaagatcaaagtatttatctgagattaagtttgaaatgcttgaagaggaaaataagttcttgcaggatagggagatggatgctttggttgtggaaaagggctctaaaggaggattcattgcaaagaccaattcatatattcctgttgtggttcaggatgtgaacttaggagagtttattaaggttcatattgataagacaactggaacctatctcattgggcataaaatcgattga

SEQ ID NO: 1308 - DNA, 633 bp, Methanobrevibacter ruminantium
atggtatgtccagtttgtgggtctgatgatgcaatcgtattaaaaaataaactaatcgacgctaaatctaaggaaattcgcgagcttttacttaagtgtggcgaatgcggctctgtatataaggaaagattaactcaagataagccaaaaccattcagattgattatcagcgagcatgaagacacccataaggtgtcaattgacttgtatcctgatgaagaacttcgtgttggagattttttgatgtctgaacttggagaagtgaagatcacttccttagagcttccagatgaaaagcgtgttcaaaaagctattgccagtgaagtaaagactatttgggcatcttctgaagagattcctgcacgttttggtgtttcaattgaccttcatggaaaggtcgcttcattcaaatgcgaaacagaccgtgactttaagatagcggtagatgacattattaaaattgacaagtatgtggcaagagttcatgtgataaagactgaagagagaaagactactaaaggttatgcaaaagcaagagtaattaagagagtttatgcaaaacctgttaaattcaatcatttcgattatgatttaagtaaatttattgtttcttttaagccattgaataagtag

SEQ ID NO: 1309 - DNA, 486 bp, Methanobrevibacter ruminantium
atggctgaaattaaaggaaaagtttggaattttggagataacattgacactgatgtaattatccctggaagatacttaagaacattcaatcctaatgacttagcccttcatgtccttgaaggggaaagacctgattttacaaaaaacgttgaaaagggagatgtcattctagctggtgaaaacttcggatgtggttcctctagagagcaagctccagtagccatcaaggcagcaggagttgatgtcataattgcaaagtcatttgcccgtatcttctatagaaatgcaatcaacataggacttcctgttgttgttgcagacattgaagcagatgatggtgatattgtttcagttgatttggaaaatggaattatcatcaatgagactaaagacactaaagttgaattccaagcttttaaagaattcatggtaaatatattatctgatggtggtctagttaaacattatcttaaaactaaagaataa

SEQ ID NO: 1310 - DNA, 981 bp, Methanobrevibacter ruminantium
atgattattagagcaccttcaagactccatatgtctttaattgatttaaatggatcttataagagaattgatggtggtataggtcttgcacttaaagaccctcaatttgtattgcaaagtgaagaaacaaatgaaaaaggatacactttagagtttgcagattctatttctgaagattcaagggaagaatgtattgaaaagattccaaaagctgctgaaaagatagcagaactttgtgatattgaatcaggattccactttaaggttttagaagcatatcctcctcactctggattaggctctggaactcaaatttcagtctgtaccgctcacttgatgactgagactgttggtcaaaaatataccagcagggaattaagtacaatggtaggcagaggaggaacctctggtatcggaacttttgcccacgacttaggtggtttcattgttgacggtggacacagcttagaggaaaaacctggattcttgccatcttccgcttcaaaggcaaaacctgctacattaatagcaaggtacgatttccctgaagaatgggatattttgcttgcacttccggaagttaaagagcatatgcatgaccaacaggaagtaaatgttttccaaacctattgtcctattccaaaaacagaggttgaacaagtttcccacttgattctaatgaaccttcttcctttcttgcttgaaaaggacattgtcaactttggttgggcaatcaaggagcttcaaaaagttggtttcaataagcttgaacacagtttggatgctagtttcttgcctactatggaagcgattgatgaagccggtgcttatggtactggtatcagttcattcggtcctaccctttacactgtctttgataagaacaataaagacatagttaaagcagcaggtgagatcgtaggtgaagaccgtgtaaaagttgtaaaagctcaaaaccacggttatgttttagaaaaataa

SEQ ID NO: 1311 - DNA, 1530 bp, Methanobrevibacter ruminantium
atgttcattaagaaaacaactagtttatgtcctcactgccttaagcctttagaagctgaggtttaccaagaggatggaaaggtctggattgaaaaggaatgtccagaacatggtgtctttaaaaatacttattggagtgatgcagagttatatgacagggttgaccaagttgattcaatcactcaggatttagaaaaccctatggttaataaggttgcaaaatgtcctcaaaactgtggtatctgttctgaacatgaatcctacactgttttaggattgattgacgttacaaacagatgtaatctaaaatgtcctatctgttttgcaaatgcagcaacctctaaaaagctctttgagcctactcaagaagagattcgtcagatgcttagaaacttaagaggagaaaagcctgttcctacccctgcgattcaatacgctggcggggagcctactgtaagaaaagacttgcctgacttgattagaatggcaagggaagaaggattttcacatactcaaattgctacaaatggtattagaattgctaagaaggaaggctatgctcaagaattaaaggatgcaggattaaacactgtttacttgcaatttgacggtgtcactgaagagccttatcttgtagcaagaaacaaaaacctcttggatgtcaaattggaagccattgaaaaatgtagagaggtcggattaggtgttgtaattgtacctactgttgttaaaggagtaaatgaccaacaggtgggagacatcatcagatttgcaattcaaaacattgacattattcacggcgtaaacttccagccagtctcattctctggaaggactccatctgaccaggtggaagagcaaagaatcacaatccctgacttcttgaatttggttgaggagcagacagacggccaaatatcaaaggacgatttctattctgcaacttctgttcagccagtatcaaaattcatcggtgctttaagaaatgaagagccaccagtaactctaaactgccaccagcactgtggttcagcaacctatatatttatggataatgataagatcattcctattacacgtttcatggatattgataagttcctaacattcctcaataaatatactgaaaagttagaggatggtggatttgctataaaatcaagagtattggctagcgctgctaaaaaccttcctaaggttttaaatgaggatgaagctcctacaggattggatatgaagagaatattattggacatcttcaaaacccagtcttatgatgctttaggtgaattccacattaattcattgcttatttcttgcatgcactttatggatccttttaactttgacacagacagagttaaggactgtgttattcactatgcagttccagacggaagggttatcccattctgtactatgaactccatctataggcaaggaatagaagatgagttctccactccattaaatcagaaaatgactgaatttaatgataagactggagaagaagaggaagatgctgattag

SEQ ID NO: 1312 - DNA, 303 bp, Methanobrevibacter ruminantium
atgaaattaagtgaatggattataataaataagataccgaacaataagatcttgactattctcgaagaatatgaaaatattgaagcaattgagtttaacgaccctgaagatgtaaaagcggaagtggaagagcatgggcttcgatatgttgcccataagtatggagtcaatgaaaaagcgctaaaggaatatggctggagatttaaaaaacgagacgccaaaggcaaaaaacgagaggaaactcctattataaaaacagatgaacaaaaaccattggtagatatctttggtgatgaagagtag

SEQ ID NO: 1313 - DNA, 1023 bp, Methanobrevibacter ruminantium
gtgaaagtagcaggatttgacatcggtggtgcaaacactgacttagcaattattgattttgaaaatgatgaaattaaggaaatcaaaacagatttcgagtatcttcctatgtggtcagacaataaccgacttggaaatgttttaattgacttaatagaaaagatatgtcccctagaagaaatcgatgcagttggaatatccatgactgcagagcttgtggatgcatttgaaacaaagactgaaggtgtcttggatattgcaaccacttgtgaaaagctatttgaatgtcctgttgcttatattggcgttgataaagtcctatctcttgcagaacttgtacaaaaccctattgaagttgcagctgcaaactggattgcaacctctcaaatcattgctgaaattgaaaaggactgcatatttgtagatacaggaagcacaaccacagacattatcccaatcaaggatgggcgtgaatgtgctaagggcagaaccgattttgaacgctcagcaactggagagcttgtctatacaggcacattaagaaccaatcttacaagctttgtcgattcagttccactgaatggaaaccaatatagggtagcttccgagctatttgcttcaactgcagatgtctataatgttttaggcctaatctctgaagatgatttcacttgcgctacctgtgacggtgcaggcaagtcaaaggaagactctgcaagaagaatatcaagaatcctatgtgcagacttggatatcctatctaaagaggatattttagaaattgccgattatattcataaggaacaggtcaagcagattgcttcaggccttaaagatgtttcagatagggaaggattaactaaagttgttgtgactggtttgggcaaggatattttatgtgctgaggcagctcgactccttggtcttgaagttaagtccatgggagattattacactgatgatgagtgtactgttgctccagctatcggtacagcaatcatgatgaagaattatctaaaatag

SEQ ID NO: 1314 - DNA, 1167 bp, Methanobrevibacter ruminantium
atggatttaaaagatgtaacagatgattctatattagtattcgaattattcacagcctctggtatagaagacttgtcaatagtttcagaagctgtagagcttataagatcacttgtaaatgatttaaaagatgaagacacttatgttctaattgcagagccattcaaaaacatattcgatgactttgatttcgatgtaaaaacaataacaatagataatctagaggaatggcttgaggaaaatgcttatatatttgatagggcaatgttcattgcagctgaaaacgacatgaacctctacaatcttacaaagctattggaaaacaaggctgtaaaggtttatggctctgactcatatgcagtcaaattatgttctgacaagtatgaaacctttgattatttaatcaaccgtgtaaatcagccaatgacctataatattcttctaaataaaaagacatattggaaaagggctatccaaatcttctttgataagatcaatggagactatggggatggaagcgataatggtgcagttccaatcatgcaaaagcctaaggacattccagtattggataattcagatagggatgaggttaaaaagtacaagcttattgcaaagccacgctttggagtggactgtgaaagcctaaagatcatctcatcaaaaagggatattgacgagcttgaagaaatctatcctgaaggttccagattcattgtgcaggagttcatcccaggggatgtttgcagtgtcactttaataagcgatggcaagaacgccattccaatcagtcttaataaacagattgttgaaatcgatgagaatggaggaaaatatcttggaggatatgttccatatgagcatgaaatgaaagaaaaagcttttgaagttgctaaaaaggcttgtgaatcaatccctggaataaaaggatgtgtaggtgttgatttgattatagcagatgatgtctatttgattgaaatcaattctagattcacaacttcctatgttggactttccaaggttgcaaatataaatattggaaagacaattgtagatttgattgataagaagatatctattgaagagcttggtgaaattgaatacaaggataaggtaagtttctacaaggatgaaaatggaattttagatataaaaattggtgaatag

SEQ ID NO: 1315 - DNA, 678 bp, Methanobrevibacter ruminantium
atgaaccaagaactaataataaacaataaggaatatagaaagacagagcccttagaatctttgaatatgtttaaaggacaattatatgaaaccattgtcaccacccaaagcaatgagcatattaaaaatgcagcccctattggagttatctgtaaagattcaaatcatatagtcattcatttggacaattgcgtccatacacacagaaacattatagaaaatggagaattgattgtaaacattacaaaagatccacttatttttacatattcaaccattggagagttggatgatgaatattttgatgaattcaatggcttccctttaattaaggattctcttggatttttcaaggcccatgtaataaagaaaataaacaagaaaagagaaaatgacttcaatgatggaatcggccatgtagtcacctgtgaagtggaggacatttttattagggagtataatgagattgttcctctgaatagggctatgaatgcagttattgaaagccttgtctattattgcagatttgatgcaaagtacaagcatatgcaaaaagagatttggacccatatgaaagagctgaatagagttgctcaaaaggtgggcaatgagaaagaaaagaaatcaatgaaggccatcctagataaaatgagagaaaatcatgattatttggactaa

SEQ ID NO: 1316 - DNA, 465 bp, Methanobrevibacter ruminantium
atggaagatgtatctgaatttaaaggaattaacggacaattggtaagctttaaaaatgaagttgaaggagcagataaaatcacttttataggctctcctggtgtttgcaccccatttgcagagctattgtcctatgctgtaagaaataaggaaaatcatttcattcccttgcttgacattgatgacgctcatcagtttgagtttaagccatacggcatggttctaaaggatgaagtttcaaatcctcgtgatgctgatgttgttgtcttgttaggaggccttacaatgcctaaatatgaagtggcctttgatgacttgaatgcattgattggtgatgtcttaaaagaagatggtaagatcgttggtgtatgctttatggacatgtttgctaaggcaggttggttggataaggttgattttgactctgtcattgatgcaagcatattaggtgttgttaaaaagtaa

SEQ ID NO: 1317 - DNA, 807 bp, Methanobrevibacter ruminantium
atggcagataaggataagatctttgaagataatgcttatgatgattctgaatacatttataatgacacctatgagggctctagaaatgattatgatgtagaatatgatgaatcagaagattatgaatatgaagaacctctaattagcctgtttgacattgtaaaggagtatgataagggaaaggttatcgctttaaacaaggtaaacctagacatctatgaaggggaattcgtatcaattataggtccttcaggttcaggtaaatcaactcttttaaacatgctaggggcattggatgttcctacaagcggggaaatattcattgatggattaaacattggaaaggaaaaggatttaagtgatttcagaagagaaacaatcggttttgttttccaacttcataatctgattccaaatctctctgtatgggataatgtacagattccattggtaggaacaggacttcctgaaaaggaaatgaaaaagagagcaaatgagatgattgatgcagtaggattgtctgataagaaaaagcaaaagcctaataagctttccggaggagagcgtcaaagggtggctattgcacgtgcacttgtaaataagccatcaatcattttagctgatgagccaacaggttcccttgatacaaaaacaggttctatggttttaaatctcttaagggcaatgcatgatgtttataatgttaccttgatagttgttactcacgatatggaagttgctagaatggctgataggatgattacaatcaaagatggccagatagtcaaagatgttgataatttttaa

SEQ ID NO: 1318 - DNA, 1137 bp, Methanobrevibacter ruminantium
atgagatttataagcttaatcataaaaaatccatttaggaataagactagaagcttcctatccattgtaggaattgcaatcggaattgccaccatagttgctttgggccttattacaacaggtatggaacagtccgttcaaacaacaatgaacgaaggtgctgcagagataactgtaaccaatataacctcaattggtgcagggactattgattccagtctggtggatgagttaaagaacataactaatgtttcacggactgcggggattttgtctgccacagatcaaaactttgttgatatggcctcatcgaacgatatgtcttctatggaatcctctacaaggctttatggaataaatcgggcagaccttgaccttgaaggaataaaagacataaatggaagcttttttgaagaaggcactaagcaggccataattggcaagcaatatgctcaaatgaataatatgtctattggagataatatttccgctttaggagaggaatttgaaattgtaggggtttttgaaaccggtggagtccttgcagatagtggagtttatgtttccttagaaaccttggatgaggtaacaggtgctgaaggaaaggtaaatcaggttatagtcaagacagatgaaggagtaaacgacactgttgtggcagatgcgatagaggataaatatgagaatctgacaacaataaccagcgaagagatgtctcagatgctggataatgttatcggtattcttgatgctgtttccgttgctgtttccgctcttgcaattattgtaggtgcaataggaatcgtaaatacaatggtcatgtctgtttatgagagaactaaggaaataggtgttttaaagtctgtaggatggaaaagcagaaagattctaaagatgattattggagaaaccttggttttaacaatcctttcaggtattgtaggctcagcattcggtattctcattgcagaggtcggtgtcaggctgatgggagatacagattttgctttgggatacagtccaagcactttcatcatggcatttggaataaccattgttgttggattgattggaggaatttatcctgcttataaggcaagtaaattagctcctacagaagcattgaggtatgaatag

SEQ ID NO: 1319 - DNA, 873 bp, Methanobrevibacter ruminantium
atgaaacgaactgctttaaagattgcttatatcggcacccattttcatggatttcaaagacagccggatgtaaggactgtagaagaggaattaatttatcatcttaggaaactggaatatatagatgatttaaaggcttcccgatttaggatagctggaagaaccgatgcaggtgtccatagcttgggaaatgtgataagctttcaaagcgaaaaggaagttcgtgtcaatcagataaataatagcctgccagatgatattcaaataatcgcttgggctccagttcgatttggattcaagccaagatttgcaaagaggcgctggtatagatatattctctttgaagaggacttggatattgatcttctaaggaaaacagcagaagtctttaaggggacccatgactttaccaatttcacaaaaagaaagcagaagaccactgttagaaccattgaagatataagaatcaccaagccaatcattgatgaagaagacaagaacaaaaaaagtgattttgctcatctaaacaaaagctacagccctatctttgttgatatctatggagaaagcttcttatggaacatggttcgaaagatgatgagaatattcttggatgtaaattatggcaagctcactctagatgatgtggaaagactcctaaatccagaagaaggcgagccaagggcttatatcaaggtggttgatgcagagaatcttattcttatggatatagaatatgaggggataagattcagatatgatgactatgcatgcgaaaggtttaggagatatttgattgataatttgtttgaattgcagaagacatattcgataactgagtctatgttgaactgcttagacgatttaatttaa

SEQ ID NO: 1320 - DNA, 897 bp, Methanobrevibacter ruminantium
atgagaaaagagaaagaatcaaaagaatccattagcatttatgataattataaaatagatatggaacttaaacacactgacaagcagtattattttatcttttataaaagaaggctttttctaataaataacaaaattccgttagttaaagacttaatatcacttaatattaatgattctgatgtgaaaaactccatttacattggacaattccattctaaggactgctttgcagttgaattggatgaagaatttgactgtgaacattatattaaagccaatgatgattcccaattcattgaattgtattttgtttttgatattgacgaagagacataccttgtggcaggcagagccatacaaataatcgattgggaaaacactcaccaatactgcggaagatgcggagcaaaaacagtaacttccgatattgaaatggcaaaggtatgtcctgaatgtggatttacttcttttacaaggatttgccctgcaataatcacttccatcattaaaaaagatgagtctgagcttgaccaagagggaagacctataaataaggttttaatggcaagacactcctatcacacagctccaagatatgcattgattgcaggatttctggaagctggagaatctgtagaggaagcggttaaaagggaggttatggaagaggtaggaattgaagtgaaggacattgaatactttggaagccaatcctggccatttccaaactcattgatgatcggttgcatatgcaaatacaagtctggtgaaatcaaggtagatgaaaatgaaatcctaaaagcaaaatggtttaaaaaagaagatattgaaagaccggcatcggagatttctatattttcaaaattactcaagaatttcattgaaaactactaa

SEQ ID NO: 1321 - DNA, 615 bp, Methanobrevibacter ruminantium
atggaacttatagcaaagaatatttcatttaaatacccatcagctaaagactacctattaaaggatgtaagtattgaattagacaataagaagattgtaggtttgattggagatagtggtagtggaaaatcaacattatgtaaaatcttatccggttatatcactaaatatgagggtgaagtaacatttgatggtcagccattccataaaaaaggatttaaaccagttcaattaatttatcaacatccagaaaaggttatgaatcctaaatggaaaatggatcaggttttatctgaatcttgggatgttgatgatgccacattatctgaattcggtattcagaagtcctggcttaccagattcccacaggaattgtctggtggagaacttcaaaggttttcagtggtaaggtcccttaatcctaatacaaagttcctaatagcagatgaaatgactacaatgcttgatgcaattacacaggcacaaatcatagattctgttttaaaaatagtaaaggaacgtaaaatgggattcttattggtaagtcacgatatggatttggtagaaactgtctgtgatgaaaaaatatactttaaagatcttaataaggcttaa

SEQ ID NO: 1322 - DNA, 1341 bp, Methanobrevibacter ruminantium
atggataaattattggatgttgaaaatgtttcaatttcatttatacaatacacaaagggattaaatcaaagggatttaaaagttataactgatttgacattagatatatctgaaggtgaaattttagcagtattaggttcaagcggttctggaaaaagtttgcttgcccatgcaatatttggaattttgcctgaaaatgcaagacttaatggaaaaatcaaatttaaaggcaaggaattgtctcaagcagataaggaagaaatcagaggtaaaggaatagtgcttgtgcctcagtctgttaacttcttggatcccttaatgaagatatcagatattgcaatagggcactgtgatagcgaagaggagaaaaaggaaaagaaaataaagcaaagagaaattttcgaacattataatttaggtcctgaagtggatgagatgtatcctttccaattgtctggaggaatggcaaggagagttctagtttcaactgcacttcttgcagaccctgaccttgttgtagcggatgagcctactcctggacttgatgagaagactgtagaagagacattgaatcactttaagcatatgaaagatgatggaataggtgttcttttaataacacacgatattcatgctgcattagaggttgcagacaggataggaatattctattcaggatatgtaattgagattgcacttaaggaagacttctcaggagatggggaaaacttattgcatccatatacaaaggccctctacaaggcactccctgcaaatggatttgaagtcattaagggacatcagccattgcatggggagatagtcaaaggctgtccttactatgacagatgtgactggagatttgacagatgtaaggaagagcgtcctgaattgatggacattggtcttaagaagattagatgctttaaatatgatggtgtcactgaagatatgattaaggacggtgctattgaggagactgctgaagccaatatcgaagatgctgctaatgaagtagttgaaaaagctgctgaacttgtggatgaatccaacattgaagaaagcgctgaagctgttgaaggtgctgaagaggctgttagtgaaactgaagatgcaattgaggaagaagtagctgaagctgttgaaggtgctgaagaagctgttgaaggtgctgaagaagcagttgaggtcccagaagaagcagtagaagaaggcactgaagaagcagttgaggaatcttctgaagaagcagttgaggaatcttctgaagaagcagttgaggaatcttctgaagaaacagttgaggaatcttctgaagaggcagtagaagaaggtgcataa

SEQ ID NO: 1323 - DNA, 507 bp, Methanobrevibacter ruminantium
atggatataaaaatcaaagaaatagaaaacgatgagtctcaaataaagtctgttcaagagtttttatatgctcaaataaaaatagaatatggtattggtccaatgcctgaatttcattatgatattgatggattgaaagactattacatattgcctaaaagaaatgccttctttgcagcatatgatggggataagatagttgcaacagcaggtgttagggcatatgataaggattatgaattctttaaaggtcaatacaatgaagagaatacagcaagcatttggagactgatggtagatgagcagtatcgaagaaatggacttgcacgcattcttgttaaaaaaatagaagagtttgcaaaggaagaaggatataaagaaatttatttaaacactcatagatatctggaagcggctttgccattttggaactctcttggttatactgtaactatagaagaagatgactatgatgaaacaaatcatatgataaaggttttagtttag

SEQ ID NO: 1324 - DNA, 693 bp, Methanobrevibacter ruminantium
atgtccttatcaatagaactggaaaaatacctgaaaggcaatggcgcaatagaagtaggatatgcagacatcaccaatttcactccaaagaaaggattgaacacaggagtagtctttttcatcacctaccctaaggaagtgatacgaaacatggcgaatgctccaacattagagtacctttatgaattgattgatctaaacaccagactggatgcccttggaatgatctgtgaggagtttcttataaataaaggatataaggcatatgcacagacaaaaaagagattaggaggaaactttggagagttcaattcatttgagcttccacataagaccatagctacaagagcaggcatgggatggattggaaagtcagcactctttacaacattcaagtacggatccgctttaagattatgctcagtgctgacagatgcccctttagagataggagagccaataattaagtccagatgcggaaagtgcatgatatgtaaggaggcatgtcctggaggagcaataagcggaagaaactgggattatactcttaaaagaaatgatttttatgatgataagaagtgtgagaagtatgcgcttatagtctctgaggagaatctgggaaaacctgatacagtctgtggcaaatgtatttatgcctgccctcatactcagaagtatgtgaaaagaacttga

SEQ ID NO: 1325 - DNA, 561 bp, Methanobrevibacter ruminantium
atgaatgttaatattaaagagttaggaaacgacccagaggaaataaaaaatgttcaaaactttttatttcacatgataaaacttgaatttggctatgattatgtcccagagtggcatcaggacattgtgaatatggaggactattatataaatccagaacgcaatgcatttttcgttgcttattccgaaagcggtgaaattattgctacaataggtctgagggcttatgataagaattttgaaaaatttgaaggcatatattccaatgacactacatcaagcatttggagactttttgtcgataggagatacagacgttgcggtttggcttctaaaatgtttagcgtagctgaaaactttgcaaaagacagggactataaaaatatttatttgcatactcataggacattagagggggctcttcagttttggatgaaaatgggctttatcattaccttggatgaaggtgatgagcttgaaactgtccatatggaaaaattcattcaaaaattaaagatttcaccacaagcaggtatcttaacttatgcaattaagttataa

SEQ ID NO: 1326 - DNA, 726 bp, Methanobrevibacter ruminantium
atgcttacttttattcaaatggaatttttaaaattaaaaagatcaaaaatatttttattaagcgttcttatggctgtgcttccagcccttctgatgtacatagcaacatttgcttttgatgaagtccaggcctttgacgctctatttaccaatgtaaacatgtatatgtctgtattgtttgctgttcttatctttgcaatcattatggcatatctctttggaagggaatacaatgaacataccttaaagatgatgcttaccattccaatttcaaggggaaagttcctgatgtctaaatatctcatgttccttatttggattttgattctaacagttattacaagcctatcaactatgatatttggttttgctgcaggactaagcggatttactgtaaacttgctaattaacagctttgcacagcttctatttgcaaatctattgctctttttgacattctctccgtttgtatttatttcattgtttgttacaaatatggtgcctgctatggttggcggagctagtctaactcttgttaatatgcttgtttacggacaaacctgggctccatatgtcccttgggtatgtccttatcttattgcatctggagagatagcagaatatggaataaatatgctattgccttatggattggtttttgctactttcatagttggaatagtcatttcttatctttactttactaaaaaggacgttcctctttag

SEQ ID NO: 1327 - DNA, 1068 bp, Methanobrevibacter ruminantium
atgagtcaactcattaactattattttattattaaaggtgattttgtgactgattacgttatagagacaacaaatctatcaaaaaagtattcaaaaaaatatgttgtcgattctattgatatgcatgttgaaaggggaaagatctatggtcttttaggcaaaaacggagccggcaagaccactaccatgtgcatgcttttaaacctggttgctccaagtgatggagatatccttctatttggaatgaatccaaaggagcattccaaggaagtctattcaaacataggatctatcatagagactcctggattctatgagaatctgactgcatatgaaaatctggagatagtttctaagctgagaggcaagtataatcctctaatcattaagatggttcttgagatggtcaatcttgaccatgagaagacaaagaaattcaaggactattcattggggatgaagcagagattgggaattgcagctgcaatcatgcataaccctgagcttctcattcttgatgagcctataaacggtcttgatccattcggtatcaaggagataagagaccttcttaaaaggctatcaagggagtatggagttaccattctcatatcaagccatatcttaagcgagatagaaaacattgcagatgtcataggatttatggatgaaggatgtttgattgatgagataacaaaagaagagcttcatacaagactgaataagtttgtagagtttgaggtttcagacattgaccttgctgttgatcttctaaaggacacaggatttgaggaaaacggtgactttacatttgcaagaaacattggcaattatattgaagatatgaattctcttaaatcttttgagtctgatggatatgtgaattctgaagatggctttgaatctagtgaaaatgccatcggaggaaccatccatttattgaccaatcttgatttaagagaccaattcaataagctatttgtaagctctggaatcgatgttagaaaggtaaatctatgtgaagagaacttggaagagttttttacaaggattgtttcttctgcttaa

SEQ ID NO: 1328 - DNA, 756 bp, Methanobrevibacter ruminantium
atgaagaatgagaaaacagaaaatgaaaataataaaaatacttcctcaccactagtcaaatacctgttccaaacaagatttttcctttttggattaactaaaaagtcaaagacaataaaaaagatatttaacaaagtcttttttgaagacaatgaacttttcattcttccaaataaaagcacagtgaacaaaagcaacaccaaaatcactgcaaacattgaaattaaggagagctttcaaaaggatgactctgagtttctgccaagtgaaatccttaaggaaataataaaagaagcaaataatatctttattatgaataaatgcatttgcagaagctcttcaaactgcaaagactatccccacgactttggatgtatctttttaggtcctgcaagcaagaaaatatcttcaaaatatggcaaagcagccacagtcgaggaagcattggaacatgttgatatggcagacaagctaggattaagccatttgattggaagaaataaattcgatagccttttgatgaatgtgggaccaaaagaggaattgcttacaatttgccattgctgtccatgctgctgcctatggaaaatcattccagatttggatgatgaaatcagcaataagataaaaagacttgaagatgtggaagtaaatgcattagatgacaagtgcaagatgtgtaaaaaatgtttagaggaaaatgtctgcatttctaatgcaataagtcttgaagatgataagataactattgattaa

SEQ ID NO: 1329 - DNA, 120 bp, Methanobrevibacter ruminantium
gtgggctgtggccattgtgttcaagcatgcaaatttgatgcaatccgattaaactatagcagaaaatctgtagattctgttattaatagaattgaagaattagtcgactataaaaattaa

SEQ ID NO: 1330 - DNA, 741 bp, Methanobrevibacter ruminantium
atgtcatttcaagataataaaatgttaattatgcctgctgtagacattagaggtggaaaatgcgtacagctagtgcaaggaaaacctggaagcgagcaagtagtcatagaaaacccagagaaggttgctaaaaaatgggaagatgcaggggctgaagtggtccatgtaatcgaccttgacggagcccttgaaagcgttacaaatatagaaacaatcaaaaagatactgaatgaagtttctgttcccattcagcttggaggaggcataagaagcatagaatatgcagaggagctattgaatcttgatattgatagattgataataggcactatgggaataaagaaccctgagataataagcaaattatctaacgagtatggcagcgaaagggtgatgatctctcttgacagcaaagacaataaggtagtcataaaaggctggcaggaaaagatagacaagtctgcaagtgaaataagcaaggagtttcaagaactgggagccggaagcatattgtttacaaatgttgatgttgagggcctgcttggaggattctatgtagacccagtaatagaccttgtagactctgtagatattccagttgtctattctggaggagtgacaagcctagatgacctaaaacaattgcagacaacaggtgcaaaaggagttgtaattggttctgcattgtataaggataaaataaagctagaagatgctttgaaatatcaaaacattgaataa

SEQ ID NO: 1331 - DNA, 453 bp, Methanobrevibacter ruminantium
atgaaagtaatggcaacaggagcatttgacatattgcatccaggacatggattgtatcttgaaaaggcaaaggaattaggtggagaagatgcagtccttgcagttgtaatagctagagactcaacagttaaaaagaaaaaaagaattcctgttattgatgaaaaccaaagattagaaatgatcaagtacctaaagccagttgatgaggcatatataggccatgatggagacatgtttgaaatcgtagaggaaatcaagcctgacataatcgcaatcggattcgaccaaggccatgatgtaaacaagcttcaggaagagctggataaaaggggaataaaggccaaggcaatgagggttgaagcccataggattgcagatttggacagtacttgtaaaatcatcaagaagatacgtaattcagactttgaagaggattatgtaaactgtgactag

SEQ ID NO: 1332 - DNA, 1017 bp, Methanobrevibacter ruminantium
atggtaagtatagcaattgtaggcggaagcggatacacaggaggggaattaatcagaattctttctgctcaccctgaagcagagatagtggacattacttcaagacagtttgaaggaactccagtccacaaggtccatccacatatcagaggaacagatttagtatttagaaacaagaagccaagcgaattggatgcagacatcatatttacagcaactcctcatggagcttctatgaagatagtacctgatctcattgaaaccggagctaaggtcattgacctaagcggagactacagattcaatgacattgacgtttatgaaaaatggtatggaatcgaacatacctcagacctaaaaggagttttcggacttccagagattcacagggaagaaatcaagaaaaccacactccttgcaaacccaggatgctttgtaactggagctatcctttcaggatacccattgtcaaaggcaaaacttgcagagagaatgatattcgattccaagactggagtaagcggagctggagtaaatccaacaacttccacacactatccaaacattggagacaatgtaaacccatataaggtaacaagccataggcatatgcctgaaatccaacaggagcttggtgcgttctctgatgttaagatatcattcactccacatcttgtgccagtgataagaggaatattgaccacaaatcactgtttcctagttgacggtgcagacatcacaagcgaagaggtattggatatctataaggaaacctataagggagagccattcatacagattttagaggatggggagattccaagactcagcagcgtaagaggatccaactatgctcaaataggatgctttgaaattgatgaaaccggcagacttgtcatcatttcagccattgacaaccttgtcaaaggggcatcaggccaagcggtccataacatgaacataatgtgcggatttgatgagaagactggattggacttctttggaatgcacccataa

SEQ ID NO: 1333 - DNA, 489 bp, Methanobrevibacter ruminantium
atgaacagaataattctatactattcagagggaggaactactcagcaggttgcagaaacattagcaattaacctaagatgcgacatctgcagaataagagatttgaaaagtagggacggctataaaaacagattgttttcaacctttgatgcattcagagaatccaagacagaaatctatcctcctagattagacttaagcgagtatgacaccatctatataggaactccaatctgggccaacaatccaacccctgcaataattaccttgattgacaggtataacttccttggaaaggacgtagtcctctttacaacatccaccaactctgaaggagaaaacacatttaataaaatggatatgaaattaagggcaagaggagcaagagtagttcaggaattcaatatcaaaaccaaggacaagagcttggaaatgattagcgaagatactgaaaaagccataaaaaacttagatttagaattatattaa

SEQ ID NO: 1334 - DNA, 1158 bp, Methanobrevibacter ruminantium
atgtttgacaaaattatggaaaatcataaagccttaattgccatacctattatacttgcacttttatcacttgctcttatctcctttaatggaatagaacaaggagttgaacttaaaggaggatcacttgctgaactgcaactgacaggttcaacaagcgtaaatgaccttgaaagtcaattaactaaagaattgaatacaaacaacataaaagtgacaagcaatggcgaaaataaggttactgtagaactggaaaataatgttaattcaagtacattttcaaaggccatagatggaaaggcaaaggtgatcagctataatgagataggtcctgttttatctgaagaggcaatgggacaaatatatatcgctatgctatttgcatttttatttatggcagttactgtttttattgtatttagagagcctgtaccttcagtagctattatcctagcagcattatgtgatatactcattgctcttggaggtatgtccattcttcacatacccttgtcaattgcatctgtaggtgcattattaatgcttattgggtacagtgtggatacagatattcttcttactacaagacttcttaaaagaagggaaggaactgttgatgaaagagctagaaacgctatgcacacaggtttgaccatgtcctgtgcagctatcgctgcaatgggaattctttacatagtcactgtaattatcatgcctgaagcaactaccttaagcaatatttcagcagttctggttattggattaattggagatattctttcaacctggcttatgaaccttggaatcttgaagacttatattgattggagacagtctaaaaagcaagataagtttaatatagatgctcctaagtctaatgagtctaaatccaaatctaaagaagaagatggcaagtctgaatccaaatcatttaaggacagatttaaaaggtccaaggatgatgattctaaagattctgaatctgaagactcttctaaagattctgaatctaaagactcttccaatgacatagacagttcagaagaagaaaaatcttcaggtaaagataaaaaatcttccaagaagactaaatccaataaaaaaggaaacaaacgtaaaactaaaaaaagcaaaaagaaagggaaaggaggtaaatag

SEQ ID NO: 1335 - DNA, 1242 bp, Methanobrevibacter ruminantium
atggttatagttgtaggaactggtgccggaggagcaataattgccatgaagcttgcaaaggcaaatattccagttacaataattgaaagaggcccatatatagcaagcaaagacgcatatgaaacatatgacatgaaatattatgacaagagatttgaaagcgaacaaagcctagaccttcttaagaccacctgtgtaggaggatctacaatagtggcagcaggaaacggcgtaagggttcttgaagaggaattcaaggacctaggcatagaccttagcaaggaatacgaaacaatagaagagctaatcggcgtccatcaaatggatgacgaccatataggtgaaggaacaaggctatttttggaatctgcaaaggaatgcggattcgatgcaatcaagatgcctaaattcatcagggatgaggactgcaagccatgcggcaaatgttcattcggatgtcctagagatgcaaaatggagcggaaaggactttatagacatagcaatcgaaaacggagcagagcttattgaaaacgcagaagtcactaagatacttactgcccacaaatcagcaagcggtgtcgaatacatacaggatggccaagttaagaccatcgaatcagaccttgttatccttgcagccggtgcaatcgatacagcagtcatccttcaaaagactggaatagacgctggaaacaagctattctttgatccattcataagcgttggaggagtcttaaaagacataaaatacaacacagaggtacagatgaacggacttgcaataggaaatgaatatatccttgccccacatttctcctcattcatttcaaaatatatcaaagaaacataccctgaagttgaggataaggacattttaagcattatggttaaggttcaagatgatatggtaggatctgtagacattgatggaaatgttaagaaattcaatacaataggcgatataagaaggcttggacaaggagctgcagctgcaggctcaatccttcaaaaggcaggagtcgatgcaacaaccatgacttcaacagtattcaggggagcccatccaggaggaacagcagcaattggagaggttgttgataagaatctgaaaacagaaatcgatggcctttaccttggagatgcaagcgttattcctatctctccaggcaagccacctattttgcttatccttgcattagcggaaagattagcaaaccatttaattgaagaggttatttaa

SEQ ID NO: 1336 - DNA, 462 bp, Methanobrevibacter ruminantium
atgactaaggtagagttaaaggttaagccaattgaaaacggcactgtgattgaccatattccagcaaataaggcgcttcaggtattaaagattctagggcttccaaagaaaggaaccaatgttacacttgctatgaatgtccattccagattaggatataaggatattgtcaagtttgaaaatagggaattggctcatactgaaatagataagatatcattgattgcacctgatgcaaccatcaatataatcagggattatgagattgtatctaaaaataaggtaagaaaggtaaatgagttgaatggaataatcaaatgcaccaatcctaaatgcatatcaaatactgaagagcctctagagactaagttttatcttgttgactctaatccgattacagtaaggtgccattattgtgaaagattggttcagtatgatgagatatataatcagtttgaatag

SEQ ID NO: 1337 - DNA, 6768 bp, Methanobrevibacter ruminantium
atgaaattaaataaattcttcattatcagcataatattgattatatttctatcaattagtgcaataagtgcagaaaatactgataatgcactctcaacagatacacactcaaatgacaatgtactctcaacagattcacgatcaaatgagaatgcactcacaaacgagaacacactcttaacagatacacactcaaatgagaatgcactcacaacagacccactcacaaaggagaacacacattcttataaggattcagaaaagtctctttcatcagatgcttttaataagaccatttatgtaaataaaaccggaagcgatgagggagatggaagcgaagcaaatccttacgctacactaaaaaagtccatttcacaacttgatgactctgacaatgctgtcatctacatcggtccaggcaattacacaggtgaaaataattctgccttggagataaacttagaccataaagatcatgacggatcccttagcattattggagattcaaatggaggaactgtttttgatggggaaaacttaaatccaataataatatcaatcagtgaggattcaatagtgaccttaataaatatcacattcactcacggcaaaaataatatgggctctgccattagaagttctggaaatctcactattgacaattgcatattcacggaaaactatgcaacaaatcttgctgcactttatgttgataaacatagccctttaacagtaatgaactcaaaatttttagaaaatagggccaaacaatgtgcagatatctatttttcacaaaactcagaaataattttattaaataatctctttgaaggttcaactgcagaatattcctatgcctatagcccatccgtatccctgcaaacaggaaaaagtttagtcaaaggaaatacttttaagaatctgacaggcgcttattataaaggtgcattgtatattgcctataacaatgggataaatatagccaacattactgataatacattcatcaactgtaattatacagggacagatggagcaatcctatttttccaaaatgcctatttgaagaacaataaattcatagactgccattcttccactgcatttctatactccaacactgagtttaatgcatacctaagttttgaagatgcagaaattgatggcaccaccttctttttaaaagccaatgtaaccgacgacatgggaaataaagttaaaaatgcaaaggtcatattttacttgaatggagaaaatgtgggttctgctagttctgataataacggcgtagcaatgataagcattaaaaaattgctggaaaatggagaatatgtaatttcaggtactcagtcatactctgaaatcaatccttttggggtaaacgtaaaaaatgcaactgcaagagttaattacgaccacagctctcttgaagtgtgggtatcaactgatggagatgatggctctggcaacggcagtgaagacaatccattcaagactcttagaaaagcattggattatggaacagcatctgctgtcaatttgactgtgcacgttaaaaacggaatttacaatggggatgacaatagagatttgtcctattccactctcggcaaaatcaccatcgttggagaatcctactccaatgtagtgattgatggagaaaatataacaaagagcatatttgctttctcttcaaccttagacgttacactgattaatctgaccttaatcaactgtccttccactcttataaacgcatacacattaagcatgatggacaacattgtcataaattcaggtaccatacgtgcccaaacaggtaacaatggagtaacaattgataatttaagagtaatcaacggtacagatcaggccataactggctataatctgagattaaccaattccagatttgaaaattgtgatggtctcactcacaccggtttaatatggctatccaccaataataataaggtcacctatttagaaaacaataccttttttaataatacaattgcaggatccgccggcggcggcgccgcatactatatccaaagtgacttaataagcatcaataacactttcgactcaaattggattacggaaagtaggggagaaaatgttgcttatgcagggggcagacatataatttccatcaatgacaaattcatcaataacgaggttcccaaatatgttgcccaatatcgaagcattggaaacgaagaatgtgaaataattgtggaaaacattactttcatcaacaacaaggcatctggaaatggtgcaggtttagcgaccactggagccatagtcaaaggagggaaattcatcaataacagcgcctctggaaacggcggcgcaatatatctcttaaatcatgacaatacaagttcatattgtcaaatgagccttgaagatgtcatttttgaaaacaattcagccacttgcggaaaggacattttcatcgaagggagttctggaaacaatatatttacctatttaaataatctgacaatagttgccaatgatttgaatgtaactagtttgtctgataatttaaccgtcagcgtatttcacccttccggcgccataatcggaggaggggaaataagtttctatcttgatggtgaatacattggaaaatccactctggtcaatcaaaatgcaagtttagaatatgtaggatttaaaaacaataccatatacgaattcacaagcatttatgaatacgcctctttaaatgacacttacattgacggcatagtttccaccaaaatcccttacgccttggaaaacattgaactttatgtatccgatggcagtggcgatgatgaaaatggaaacggcagcataagcaatccatttaaatcaatttccaaggcattgagcgaaggatatcaaaaatcaacaaatattacagtgcatattttggaaggcacttatacaggaagtttaaacagcaatttaagaattccaacaactgttaacatattgcttatcggcgaaggggcagccaagaccataataagtgacagctcctcagactatttcattacagcattaaaaggcaaatgcgaattaagaatatcccagatgacattgaatagggcggcccgtgacacacaatcagccatctatattgaagaggaatccaatgtggccattgacaatgtcacattcattggcggccaaggaaattacggcggagccatcaatactgcaggaaacctttccataagaaattcatatttccatgacaatggatatgcagatagaactttacgtgcaaatgcctattacggaggagccatttgcaatgacggcaccctaatcattgacaatacaatatttgaaagcgaccatgcaggcagactaagtgaaattgcgaatcaaggcacattatacatgaacaattcaaaagtgattgacagcataaacgcatatagcataaacatggatttggttgctatcggcgcttatggtggccaaaagggcgaaattacaatagaaaatagccaattcatagttagctccaagaccatcaatgaattgaatgacagaatctatgatcctacaagggcattgacctgcttgggcattggttcatgccaacatgcaatcctcatcaactccacattcattggcgaaggggcagtattctccccttatgtatttggcggaattaactcaaataatcttgcaagtggaggatgtaccatgattccaggagatttggaagtctacaattcaacatttagaaatgtccaagctgtaaatataatatattcaagaacagataatgtgagatatcactcccaaagggtctttgaaggatgcctattcgataatgtcgaatatataatagctgttttgaatacaggcaatttttcagttgagatgcatgactgcgttattttatcagatgatcttgctaaaataggatttggaagtgaaaaaaccatgaaaatggacatttccaataactggtggtcctccaacgatggaagctatgacaatgccaccctaggaactaccaattacatttcaaattgtgttgtaaaactcaaggaaataagttcagagactgttcatcctgaaagctatctgatcctaactctaaattcaagcaatagaaccggtctgctacaggatgcaatcctggcattcaaggcatacgacggcgaaaacataagcgattacgatggagctttatatcctcgaaatttcgaaatgtctgccataaatgccactttagatgacctggagggcacaataattaacaaggccatcaatccatttgagggtgtagaaaacagcggatattacattgaagccattgtagacaatcaaaaggtcaatctgacagtccatgacagcctatctatcggcaacgcatacattttagctgagaacatttcaatcaactacaatgaaacacaaataaatgtcactgttttggaagagaacggcaaaagagcggatggaggaaacgtttcattgaaattgcatgataaaacctatatatccgaaatcattaacggcactgccatattcgatatagatgtccttcctaaaggggattacctattaaattattcattaaatcgtcctaaggtttatcacagcatttccaactcatcaaatttaactgtcattccatttaaaataaatgcttacgccaatgccagcaatatcaaagtgggagaggatgcaattgtcatagcctatctagataaggatgccggaggcaacgtcactttaggtgaggaaatccaaaaagtcaatgatggaactgccactttcatcatttccaatttggccaaaggggattacacttaccaactaagttattccggagatgaaaaatacgataatgaaacattccatgtttcattctctgttaacttgaaggatgctagcatcagcgttgagaatgacactttggacttgtttgttggctccaatgaaaccattgttgccactatctctccaataggacttgccgtaaattacagttgcagcaatgaatctgtagcaatggttgatgaaaatggtgtcgtcagtgcagttggtgcgggaatggctgtaattaccttgactgtcggtgatgatgtaacttatagcaaaaactctagctctgtcactgtcattgtcagtaaaatcccaaccatcattgagatagttaatgataccattagcttagaagtcacagacagccttgattccattgcaagtttaaatccagaggagggaggcaatttaaactatgcaataagcgatgacttgattgctaagattgacaatggccaaattactgcattaagtgaaggcagtgccattataaccgtttcatttgatggcaatgacaagtatacaaaagctcaaaacaaaagcatcaagattattgttaatcttaaagaggccagcgttagcgcattcagcaatattgacttgctggtgggtgaaaatgataccctttctccaaaaacctcccctgaaggattagatgtgagatatgaatctaacgatacatctgttgtgcttgttgataatggccaagccattgctgttggcgagggcaatgccaccattacattgactgtcggcggcgatggagtatatgcagaaaatacaacaacagtgaaagtcagcgtaagcagaatagctaccatgattgaaattgaaaaagataccattgaattaaaagtcaatgaggaatccccaatcggagctatattggagccggatgttggcaatttaacttacagcataagtgatgaaagcattgctaaagttgaaaacggcaagataattgctttagctgaaggaaatgcaagcctaagcatttcatttgcaggagatgaaagatacattggaacaaatgcaagtgtggagattagagtaaataagataaacacaatattgactgaaacagacataacaacaacctacaaagaggagggctaccttatagcaacactgaaagacagccaaaataatccaataagcggagctgtactgactgttgacttggatggaatcaaaaactatacaactgattccaatgggcaaatcaagatagcgacaaataatctgattccagacacttatactgcaagaatcagctttgcaggcaatgaaaactacagctcatctaatggaaatgcaagtgttaccgttaaaaggataggtacaaagcttaatttcaatgacatgaacactaccgcctttgattccaatatagaaggaagaataggagaatatttctatttccaattagttgactgcgatggaaatccactagccaacaaaaaagttatcataggattcaatggagtcaaatacaataggcaaaccaatgaaacaggatgggcaaagatacagatcaacttgaaatatgccaattcttacacctttgcaatagcattcctaggagatgacaactatagcggatcattcaactttgcagtaatacgcgttagccaacagacccctaaattaactgcaagtagcaagacctataagtcaagcgcaaagaccaagacactgactgccacactcaaatcctctagcggaaaagccattgcaggtaaaaaaataagctttagactaaatggtaaagtctatacagcaaataccaattcattgggagtggctactgtaaaggtctctttaaacaagaagggaacctatagctttacagcgcaattcagtggtgacagcacctataagaaggttactaaaactgcaaagctaacaataaaatag

SEQ ID NO: 1338 - DNA, 1371 bp, Methanobrevibacter ruminantium
atggaagaacacatagacttatttaaaagcatactaaacaagatagaagataaagtggattatgcagacataagggctggaactggaaacaacacaagcataaccatgaaagacaatcagattcaagacattaacacaggactgtcaactgttgcaagaataagagtattaaacaatggagcttggggctttgcaacaaccaatgacttttccaaacttgaagagataagcgaaaaagccataaagatatcaaactcactgaaaggagacatcactcttgcagaatgcgacatcatagaggatgctgttgcaattgaacagaagataaagctaagcgatgtaagcatagaagagaaaaaggaaataatacaagatgcaaacaaggcaagcaatgttggcaatgtaataagcacaactgtaagatatggggatgcagagtcaaagactgcatttctaagcagcgaaggaagctgcatactaacagacaatgcaagggtcagcctatcacttaatgcagttgcatcaaatggggagcttatccaattccatcatgacagcttaggcggagtcaagggatttgaagtattgaagaatgcagatatcgaatcctttggaagaaaagttggagaaaaggccactgaacttctagatgccaagccagcaccatcaggaagatttacaatcattgcagacaatagcttaacaggagtatttatccacgaggcagtaggccatgccgtagaggcagaccttgtgcttcaggatgattccatacttcatgaccagatgaataaaaagataggttcagatattgttaatatctatgacgactcaagcaataaggatggattcggctattatccatatgatgttgaaggggttaaaacaagaaagaaccagatagtcaaggatggagatctaatttcatacctatcatcaagggaaagtgcaggtaagcttgacattccgcttacaggtaatgcacgttcatcaatcagcgatcagcctattgtaagaatgagcaatacctatctccagccaggagacttaagctttgatgagcttattgaagacattaaggacggaatatatcttaaaggctcaaggggaggtcaagtggatacaggaaaaggaatcttccaattcaatgcttccgaagcatataagatagaaaacggagagttaaaggaccacttcagagacgtttccttatctggaaacatacttgaaaccttaaaatgtgttgatgcaataggatctgactttaagctaagcgttggattctgtggcaaaggtggacagactgcaccagttggagatggaggtcctcatactaggatattgaatgcaatggtaggtggaagtagttaa

SEQ ID NO: 1339 - DNA, 558 bp, Methanobrevibacter ruminantium
atgttaagtgaagacgacggcaaatatttacttgaattagcaaaagatgcaattgaaacctatgtaaaagagcatgataagattgatgtgccttcagattgtccagaacatcttagggaaaagcttggagtatttgtaaccctaaacaagaacaacaacctaaggggatgcataggctatccagaacctatctttccattggttgaagcgactatagagtctgcaatatctgctgcagtaagagatcctcgttttccagaagttggtgaaagcgaacttgacagtcttgaatatgaaataacagtactcactaagccagagcttattgaagtggataagcctatagattatttggataatataataattggagaggatgggcttattgtagagaaaggattctatagaggattattattgccgcaggtagcacctgaacacaatatggataaggaagaatttttatcacatacttgtcttaaggcaggtttaaggccagatacatggttaaataaggatacaaaggtgtttaagttccaagggcaaatatttaaataa

SEQ ID NO: 1340 - DNA, 1056 bp, Methanobrevibacter ruminantium
atgatgttaccaactataccaactccagatgagttattggataaaggatttagaagaggaaagaaggcagctgatttaagaagaggagaaaagatgcctaagcgcctgaaagggaagcgaattgaagagaccagagttatcactgcctgtcaggtaatcaaggaccgtcttaagatgattcttgatcggactcctgaaattgaagagcttccggaattctatcaggattatatagacattacagttggggttgacgactttaagcaagctctcggtgcagtcaactgggcttacggaatcatcacacagcttgaaaaggaatatggggcaaagattaggaaagctccttctgaacgtgccaccggtcttcgaaagcaagcctatggccgtatatcatctgttgtacataagattgaaaaggaccttgactttttggactttgcaaagcaaagccttagaaacatgcctactgtagactttgatgcaataagcattgtaattgcaggatttccaaatgttggaaagtcaacattactaacccacattacagatgctgagcctcaagttgcaaactatccatttacaaccaaaggtattcagattgggcattttgaaaaaagatggcagcactatcaaatcattgacactcccggtcttctagacaggcctattggagacatgaatgatattgagcttaatgctatggtggctcttgagcatctggctgatgcaatactctttatctttgatgcatctgaaacatgtggatatgcccttgagaatcagtacaatcttctggaggaaatcaagaatgtctttgatgcccctatcatatatttatttaataagatggacatttcagactatgatggagcaaggcatgactatgttcaggagtatattgataagactgagaatccattgcttatctctgcagctgaaggtgaaggattggaagagatcattcagttaattcagcaggttgaaaaaagagagatagctgaagaagatgaagatgaatatgaagatgatgaaaactattttgatttgacttaa

SEQ ID NO: 1341 - DNA, 594 bp, Methanobrevibacter ruminantium
atggctgaagatatgagcgaaaatattgaaaccaaatctgactttaaagacaaagctgaagaattcaaagcaaaagctgaagcaagaactgaagctaacaaagaaaaatgggatgaaacctacaacaaaggtaaagacgtagcaggaaaagttggtgaaaacctatcaaaaaccattgatgacaccatcattgcaatgaaagctatgcaaaagaactttgatgacaaataccaatcctataaggaaacctctgcaaccaacaaaatcagcgttgaccttgcagaaactaaagacttctactacttacaagcttacctagcaggtgtagctaaagaagacatctcaattgaagcaactgacagttccatctccatcaacgcagaacttaaaaacattctctgcagcattgaagaagatgaagaaaacccagcaaacctaattatcactggagtaaaaactggagttgctgaaaggaccattaaattaggagctgaaatagttaaagaggaaatttctgcaaaacaagacaatggtatattatttataaccattcctaaaaaagaaattcctacaactaaaattgatatagaataa

SEQ ID NO: 1342 - DNA, 204 bp, Methanobrevibacter ruminantium
atggcaattcctaaagctcctgttaataggattattaaagatgctggtgctgaaagagtaagtgctgaagcagtagatgcattagtagcatacttagaagaagacgcagctgctatctctaaaaaagcaattgaatatgcaaaaatcgctaaaagacaaactgtaaaagctgacgatattgcattagctattaaaaacgaataa

SEQ ID NO: 1343 - DNA, 672 bp, Methanobrevibacter ruminantium
atggaattttatatcataaacggcgggccaagaaagaaatacaacactgcagagcttcttaaaaaagcatctgaaggaattaaggatgagttaaaggacattgatgaggatgtaaacattcatcaaatccatttatatgacttgaactttaagggatgcaaatcctgcttccattgcaaaagaataggaggcaaatactatgcacaatgtccaattaaggatgaccttttggaattgcttcctaaggttcagaattcagatggaataatctttggcagccctatctactttggtgaaatcacaggagagttaaggtcctttttagaaagattccttttttcaatacttgtttatggaggagagtccaatgctcctaaaagaatgcctatggcaatgatctataccatgaatgttacagaagagggatttaatcttttctatggagataagtttgatatcttggaaaatgccatggctaatttaatctcaaagccatattccttaaaggtctatgacacttttcagttttcagactattccaaatatgagaactatgcctttgatccagaacttaaggccaaacgaaaagaagagcattttccaatagatcttgataatgcttataatttaggcaaaaaaatagctcaagatagtttaaaactcaatgaatag

SEQ ID NO: 1344 - DNA, 1011 bp, Methanobrevibacter ruminantium
atgagatataagatgtatgatgaaatgatggagcagccggaggctttaagaagaacatttgcctctgaaagtgaaaacatggcaaatatatctaaaatcgctggaagcgttgagaccatttatctaatcggttgcggaagttccatttcaacatgttactccgttagggatgcattggcatctgtcagtgacttaagaatagaagtgtttacaggttatgaattcgtttacaataaaaaactaaatgatggcgaaaactcattattcattgcaacttcccaatctggggaaactgcagatacattgactgctttaaaaagagcaaatgaatttaatattgatacagtttcaatttccaatgagccagagagctccatgattaaggaagccaaatatcctattgtaactttaggaaatactgaaactgcaattttaggaactaaaacctatataacccaattggcttgcctttatcagatattgttccctgcatcaggatatgaaaagacagatgagattatggaacaattagccaacatgccagacttggttcaagagctattggaatcaactgaagaggacaataaaaacttagcagaagaactaaaggatgaagaaggattctattgcttaggaagtggagtcaattacggccttgcatataaattggctatgaccatgcttatggaaggagctataaagcatgcttgcccattatattccgcagaatacagacacggactaattgaaagggcagaggaaggagttcctttaatcttcttggatgcagatcttgaatcagatgagctaaccaaaagagcaatagcaaatgcaagggatgaattgaaggcaaattgcataatctataatttaagggattatgctgatataaacccattgcttgcaccatttgtctttgtagtgcctttagaatggtttgtctattatttggcacacttcaatggagaagatccaggtagtaccagacatattggtaaggttagatattaa

SEQ ID NO: 1345 - DNA, 546 bp, Methanobrevibacter ruminantium
atgaatgttgatttaagcaaggcatcaatgaatgtaggacagcaatacgaagcgattctcactacaataaacaatgaaggcaagacaaatgcagctcctttcggagtgaggataatagaagaagataaagtcatgctaaagatatttgaaggtggaaacacaattaaaaacataaaggataacggagaatttattgtaaacataacaaatgaccctatcatgttttcatatgccacaaccacaagcatccccgatgaatatttaagtagaataaactatgatgaccatgaatttgcacatataagcaatgcagatgcttattttatctgtaaagtctatagcattaaggaaggaatgagaaaggataatattaaagatagtgaagcgaatgtgattaaggcagatgttcttgaacttaaaataaatagcccttgcgttaggccaatgaatagaggaatccatgcacttatggagtctcttgttaactattcaagaataaatattgttgataaagatacacaggactttttttatagaaagatttaa

SEQ ID NO: 1346 - DNA, 1875 bp, Methanobrevibacter ruminantium
atggatgaaaaaactattgactatgagggaaacataatcacagtaagcgcagaaggacttgatgaggatatcgaaataggagatatcaccattacagatgcagaacctccagagggagacctagtcataactgcaaggatccttgaagttgaaataaaggaagtctatcctgctgaaattgtcatagaaaacggtctttttaaggatgccattccaataatcactgatgatgactcactacttgatttagattatgatggagttctaattccaggattcatagattcccattgccatattgaaagttccaagctatccccatctaattttgcaaaggttgcattgacccatggaaccacttcagttgtagctgaccctcatgagatagcaaatgttcttggaatagatggtgtaaggttcatgattgaagatggaaataaagttccatttgacttttattatggggctccatcctgtgttccagcaactccatttgaaagttcaggagccattattgacagcaaggacgttgcagagcttttaagccatgatgagatagttgcccttggggaaatgatgaatttcccaggtgtattggctgaggatgaagaggttatagctaaaatcaaggcagctcatgactttggaaagccaattgacggccatgccccacttctttcaggagatgacttaaaaaagtatatctcatatggaatatcaacagatcacgaatgcagcaattttgctgaagccgctgaaaagaaaagagcaggcatgaagattatggttcgtgaaggctcatctgcaaaggatatggataatctttttgatgcagatgaaaggtttaactatatcatagaggaagagatgagaggaaacattattgcagatagtactgatgaggcaatggcagttcctccatttgactttttggtatgtgatgatgtcgatgcaagggacctatccaaaggccatttgaataaattggttaaaaaggcaatttccatgggaatcaatcctaaggaagcaattgcaatggccacatttaaccctgcagagcattatggattaaactgtggatcaatagacccgggaaagatagctaattttgtattggtcgatgacttgaaaaaccttaacatttccaaggtctgggttcatggagagcttgtagttgacgatggagaggttctctttgatgtggaagctcctgaaataatcaataattttgatttagatgaagtcaagccttcagactttgacgctacaatggaaatgggttatgtaagctctttaatggatgagacaaccaatgtatttgttattgaagcatatgatggcgagctaataactggaaaactggaagaaagccttcttataaaaaataaggtaattcagccagacattgataaggacattataaaaatcgctgtaatcaacagatatggcggtaacaatatcaccaatggattcataaaaggatttaacattaaaaaaggagcaatagccacaacagtttcacatgactcccataatattgttgcaataggcacaaattcagaggaaatggcagatgctgtaaatctgattaggcagcatcaaggaggccttgcagtggtatgcaaggaagatggcattcaagacatacttgaccttccgattgcaggtcttatgtctgataaggatgcagagtatgtggcatctaagttagtcgagctctttaatctggtccgtggattgggatgcactttgacttccccattcatgacattgtcatttatggcattgcttgttattccagcattcaagataagtgacttaggattgtttgactttgaaaaattcgatttcattgatttaatacacaatatttaa

SEQ ID NO: 1347 - DNA, 1218 bp, Methanobrevibacter ruminantium
atgtataaaagagaaatagaactgtccggtcatatcattgattctttaactcttcctaaaaccatggacattatcatggataatggtggagactttgatatactggaatttgatataggaaagcgtaaatctgacactagtaaagctaagattatggtttcagctgaatctcccgatattttaaattctatacttgatgaacttaattttattggagtttctatatctgaaatcgaagaggttaatttagtcccttctccaaaggataaagtagctcctgaaggcttttattcaacaagccatcatgttactcatatttattacaaaggcaaatggattttagtggataaaatcgaaatggattgtctgattgtcattgatgaagagaatgagacagcatcctgcaagccaattgcagaccttaagaaaggagacctaattgtagttggaagagaaggggtaaagattacacctcctcaaaggtcaagaggaaagcaaggggtatttgagtttatgaacagtgatgtatcctctgaaaagccaatgatgagcatcataaacgatgttgcaactgaaataaagaatgtcaaggctaatggcggaaagatagctcttgtaggaggtccagctattgtccatactggatctgcaccaatcgttgcaaagctaattaaggaaggcattattgatgttatctttgctggaaatgcattggctacccacgatattgaatgcgatcagtttggaacttcccttggtgtaaagatagaaaccggagaggtagtagctcacggtcacactcaccatatgagggcaatcaacaggatcaataagtcaggctcaatcaaggcagctgtagaggatggaaccttaaagagtggaataatgtatgaatgcattaaaaatgatgttccatttgttcttgcagggtcaattcgtgatgacggaccacttccagatgttattacagacactgcagagagtcagaagcttatgcgtcattatgctcaagaggttgatatggtcattatgatttcaacaatgctccattcaattgcaactggtaacttgctcccttcaagagttaagagtatttgtgtagatattaatccatctacagtaacaaagcttgcagataggggaagcgctcaagttgtgggaattgtgacagacgtaggggctttcttgcctgttttatataatgcattacatgattaa

SEQ ID NO: 1348 - DNA, 615 bp, Methanobrevibacter ruminantium
atgaaaaaaggtgaaaaaaggaaacaagagctattaaagatagcttatgatatgtttcttacaaggggatacgagaataccagcgttgacgaaatcatagaaaaggcacagatagccaaaggcacatactactaccatttccaaagcaaagagcagatgctcgaagaagtcatagatatgatgattgatagtgagatcgaaactgcaaagcagattatcggaatggatatttctgtacctcaaaaaatagtggggataattgcatcaatgaaacctaccgaagtagaacagcctataaaggacactcttttccagccggagaatgtgttgatgcaccataaggtccgaaagcaattgattgatgttcttactccacttttatccgaagttatacaagagggagtggatgaagggatctttgaatgcgacaatatccctgaacgtgttaagatgctccttatcatcagcgatggtacctttaatgagggcacatttagcgagcgagatatttcagtatttatagacatgactgaaaagcttcttggagcagagaacggaactatgagcttcatttatgatctaattgacaagagtgagatggagggggcccagtga

SEQ ID NO: 1349 - DNA, 210 bp, Methanobrevibacter ruminantium
atgggtcttattttattttttttatcatattttttactatttttattttcacaaatccatcactccttttatgatatcattattattgctagtcctatatgccatagtaaatctcaagggatatatttatatatgatgatgtttaaattattattaaaaaacaaaaaccgaccaatagtcgaaaaattatttagaagaatattgggctaa

SEQ ID NO: 1350 - DNA, 975 bp, Methanobrevibacter ruminantium
atgcttttcaatacttatgaaccgggcaaatttgctttttcacatgaatctgttgattattatgatttaattaactcagaagataatttaaatggttcttctgatttttcaaagtcaaaaaaatggggaataatcggagttccttttgacagcacctgttcttatcaccatgggtcccgttatgctcctacaatcataagagaagcctcttttggccttgaacaatacaacagcgaattcgataagcttttagatggcgaattttatgactgcggtgacttgaatgttgttcatggaaactgcaaaaggacttgtgaaatcctggaagattctgtaaatgacttgattgaagcaaacatcaagcctatcattatagggggagagcatagtgtcactttaggttcagttaatgcattatctgctttagaagataaaaacaatttaaatgacatcactgtcattcatttggatgctcatagagacatcattgatgaatatatcggtgaaaagtattcacatgccaccattatgaaaagaatctatgatttggagcctaaggaactgattcaaataggaataagatcattctctgaggaagaaagggattttgtagaggataaggaaaatataatcagtttttatgcaaaggacattaagaatcagaatattcatctaaacgaagacgtttccacatttgaagacttattgtctaaattggattcaatcgaaggtaaagtctacatttcaattgatatggatgtatttgacccttcagttgctccatctgttggaaatccaactcctaatggtctgtttttagctgatgttcaagctatctttgaagcactaagctttaatgaagagatagatattattggatttgacttggtagagcttgcaagcgacagattgggagatattagtggagtccttgcagctaaagttatttatgactttttgactctctttgcttga

SEQ ID NO: 1351 - DNA, 408 bp, Methanobrevibacter ruminantium
atgtcaacaaaagttgtagaacttaaaaccgtaaaagtcggaaaatatattgttttagatggtgaagcttctaaagtaactagcttaactacttcatctccgggtaaacacggagctgcaaaagcaagattagaagctgtcggtatttttgatggtcaaaaaagaagtttagtaaaacctgtagacactaaagttgaagtacctattcttgataagagagtcggtcaaattttagctgttatgggcgatcaagttcaaatcatggacttagaaagctatgaaacctttgaattacctatacctgctgaattcgaagatgaaatcagaggcgctgtaggtactgacttaggtgtagaatatatcattgctttaggcaatatgaaaatcatgagaactaaaaaagtataa

SEQ ID NO: 1352 - DNA, 462 bp, Methanobrevibacter ruminantium
atgagaattgctattgtttccggaaatgcagaaggccctacagaattaaatgcttttgataatgctttatatgaagcaaaaataggtgatgtaaacctaattaaagtatcaagcatgttagaagctaatacaaaaatagaaaaattgcctaaattaaaagcagggtctatggtgaattgtgtcttatcaagcatagtttcatctaatcctggcgaaaacttaactgcatgtgtggcagtagcaatcggagatgaattagggtgcgctgttgaagttgatggaattgacaaagatccagaagacttaaaggatgaggcaaccaagatggtcaaatatatgatggataaaagaaatgtaaaaatcaatgagctgattgttgaagaggctcatcacacagttaaaaacattggatctgcaattgcagcagtcatttacattacagacgacatcttagaagaataa

SEQ ID NO: 1353 - DNA, 1866 bp, Methanobrevibacter ruminantium
atgaatcaagacgatatacaaatttgtaaagagatagcaactacagttttcaaaaatgtagagaatctccttgatggccaagtaggaaacccaaaagcaggagaatttgttaagataggcgcagacggaacccctacttcacatatcgacatcatagcagaagatgaagtaatcaaacttctaaaagacgctgattttgaatcttaccttatcagcgaagaaatcggagaactacgacttgggaaagggaaacaacaatctgtaagcctctctgaagaattgcttaacaacactccggaaaataaaaaagaagaagaagaaatacctcgctatattttcttaatcgatccccttgacggaacaagcaatgctgttaaaaacatcccagcatacggaatgtccattgcagttgcaaatgttccaatcggaagggaagcaacccttgaggacgtccaacttggattcgtaaaaaactactcaaacggtaacttctatgaagcagtcaaaggaaatggagcaaaggaaaacggtcaaccattgactccaagcaaagaaaccgatataaccaaaatcaccttaggaggattcacaaaaagcaaaaccctctctgtttccaaactagtggacactgcaagaaggatgagagtactcggttctgtagtattggaattggcatatattgcaaacggaaaatatgatgcattccttgacttaaggggaagtagaatcatcgatattgcagcatccaaacttattgtagaggaagcaggagcaatcgtcacaaataaatacggagaaaagctaaacaacagactaagcatctatgaaaaggcagttgtagtaagcgctggaaatgaagatctccacaaacaaatcattaaaatcataaacaacgatgaattggataaggtaacaagcgttgctatagtcagcagagtggatgagtataaatcagtcttattctcacttaaaatctttgaaacattgattgaaaagaatattgaaaccgtccttgagacctcccttgctgaaaagcttgaggaaataaaggaagacccagagcttcacaagatcattgcaaaaacaatgaacgagacccctgaaatcgcaatgcatattgaaagcctgaatttcaactatgagtttatggattatgccaagcaattgaatgaacttagaacagacattgcaatcattctaggaggagacggaacactccttagaacccaaaaccaattgacaaaggaaatccctatctttggaatcaatatgggcactgtaggtttccttaccgaaattgaagtggaaaacaccttcaaggcccttgatgcaatcctagatggagaatggtctaaggagaaaaggacacagcttatcatatcccacgaaaacgagtctttccgtgcattaaacgaagtcgttataatgactgcaagacctgcaaagatgctccattatgaagtttcagtggacggggaagttgtagaggagctaagagcagacggacttatcatttcaaccccaagtggttcaactgcatattcaatgtctgccggaggcccaattgttgaccctaaagtgggagcattcatcattattccaatctgcccatacaagcttggagtaagaccatttgtagtgtccgatacaagtgagattagaatcaagcttttaagacagggcaaaaaggcaatctttgtaatggatggacagattcaaaaagaagtaaactatttagaggagcttgtaatcaaaaagtctgaaaaagacgtttactttatgagaatcaataagaagtacttctataagaaggttaaggataaattaaatgaaggcggacttgaatccattaatagagttctataa

SEQ ID NO: 1354 - DNA, 1635 bp, Methanobrevibacter ruminantium
atgaatgtatttttagttgatttaacccatggaggagtaaaaatatcctctgaactttcaaaatccaaaagatttgaaaaggtatttgcatacgacttatacagcacattaaaagaggaagacgagcatcttttaaaaacctatgatgtgaccatattaaaggatttcgactcatttaaagaggaattaaaagaaaacagcaaagaacttttaaaatcagaaaaggaaaaagaaaataattctaaagacttaataatcaacccaattcactcttcattaaacattaaagacttattaaatcaaatcactgaagaaattaatccaaacaatgatttaacccatctctacgaaataattaaccaccaccaagctacaaaacttgttctagaaaactggaaagaagaaactaaaaaacatgacataaaaactatcgaaataacaggagtaaaaggaaagacaagtacagctttccttctaaaagagatatttttagaaaataatcaaaacacacttctactatccagtttaggagcatatctatttagaaaaaaccaagataaagaaatggaacttattttacaaaagaatatcagcataacccctgcaaacataataaacacaatacagcttgcaaaaaagatagcaaacccaaaatgcagttatttcccaaaatgcgctgcaaacaaaaacaagcaagaggaaaatgaactgtttgaagaatataacaataacccataccacaatctaaactatgatattgctatttttgaaaactcattaggagtatgtggccttggagatattggaatacttacaaatcttgttgagaattatccaatagctaaaggatcatccaatgcaatggaagctaaaagacaggtattcgattgctcattagtaatcatagaatatgaaactctaaatgaattctacaaaggggaatcagaggaatataaggataaaatcaatagcttttcattaaataacaataaggcaaatgtattttgtaaaaatatagattttgatatagacaatactcaaataaaaatcacatatcaagatttcaaaacaagaaataagaatacaataaatggagaattcactcttaattgcttcgcaccaggaccgcatcatgttttaaatatcctaacagctgtttcaactgcattggcattggaaatagatgaaaaaaccattatagctggaatatctaaattcaacggcatcgatggaagaacacaggttaaaacagttgaaaattcaataataatagaggaaataaacccgggaattaatacaaaagccatagaaagctcaataaatatgataaaagatatagataattattatatcattatcggaggaaaatatggagttacctgcgaagaaatagatgaggaaaaactatccaattatttgaacaattaccttacagataacccaaatacaaagctaatactaactgatgaagttggtaaaagtctaaaagagaaattagatttattgaatgataaagatgaatacgaaataatgtttattgagaattatgaagaagctagagatcttgccataaatgaaaataaaaatatattatttatttatagatccaattattcacaagtttctaaacgttga

SEQ ID NO: 1355 - DNA, 870 bp, Methanobrevibacter ruminantium
atgattgttggaactagaggaagtaaattagcacttgtacaaacagattacataagacaatgtttatacaatatcaccggagaagaagtggaaaagaatattataaagacaaaaggggataagattacaaactcccaattatataatatggattccaaaggactttttacaagagaactggacaatgctcttctagatgaagaagtagactttgcagttcacagtctaaaggatgttcctaccgaattgaatgaagatttggagattgtagcagtccctataagagaaagccctaacgaagtgcttatttctaactacagctggagcgagcttgaagaaggctccacccttggtacaagcagccttagaagagaagcattctgcaaacaccataataaggactttgaacttaagccgatcagaggaaatgttgaaaccagaatagaaaaggtcatggatgggcaagtggatgcaacaatcatggcagaagccggtttaaatagattaggacttcaaaaatacataaaggccaagtttccaaccgattatatcatgcctgcagcaggtcaaggcgccttagcggtaatgacccgaaaagactcagagcacaaggaaacaatcagaaagctaaatcactatttttcccatcaggaagtcttagctgaaaagaccatcctagaagagattggagtaggatgtcaatggcctattggagcaatatctggaattaaaaacaaccaattggaactaaaatccatccttcttgataagaatggagagatcctttaccaaaaaacccttagcggaagcattagagaggctaaggagatgggtgttcaaataggtaaggaaatgattgagtttatctaa

SEQ ID NO: 1356 - DNA, 948 bp, Methanobrevibacter ruminantium
ttgagaactataaatgttggagttataggtgtaggagcaatgggatataaccatgctcgagtatattcaaaattggaaaatgccaatctggtagcggtggctgatgtagtaaagccgacccttgataaggtatgcaaaaagtacaatacaaaaggatactctgaaattgaagacttattgaaaaaccctgaaattgaagctgtaagcgtatgtgtgcctacaactttccaccacgaagttgttatgcaagcaataaaatacggaaagcacgttttagttgaaaagccaattgcttttacagctgaagaagctcaggaaatgattgatgcagcaaaggaagctggagtaaagcttgcaacaggacacgtagaaagattcaatcctgctgtgcagaaagctaaggaactgattaaaaatgaagtaattggtgacttggtagcaatctcagctaaaagggtaggtcctttcccaccaagaataaaggatgtaggagttgcaattgaccttgcaattcacgacttggatgttatgaacttcctaattgaagagcctgtaaaacaggtctatgctacaatgagcagcagattggatcaatctgactttgaagaccatgcagaaatcatggtaagctttgaagaggacattacaggaatccttgaagtaaactggttaactccatataaacgaagacaaatcgagattaccggaactgatggaataatcacagtagattatatcgaccaaagcattgaagtctatggtaaatttgctcaagacattcaaataaagccggtagaacctttaagcgaagagctaaattcattcctaactaagattggaaatgatgaaactccagagattactggtgaagatggtcttaaagcacttaagatggtgcttgcagctaataaatcatctaaagaacacagcccaatcaattttagataa

SEQ ID NO: 1357 - DNA, 615 bp, Methanobrevibacter ruminantium
atgaatcaagaactcattaacagagctcaagaacttagaaaccacggatttaccactggtgaaatagctgatgagcttaatgtatcaatggatactgcaagatggttgactttacagaaaacagaagagcctgtggaaacagaagctcctgtagacattgcaattaactggaacagcttaggaggaagcgcaaccagactcagatatgtttcagctgccttaagtgacattgcattaaagcatggtgacattgaccttgttgtaggaatcgcaaccagcggaattccatttgcaacaatcatggcagatgtaattgaagaattaaccggaacaactacctgcgtatctattttccaccctaaaaaacacagaaccaatccaaccaacagcgacgaaggagcaataagcagcaatttcggaactgtggaaggaaaaagaatagttgttgtggatgatgtaaccaccagcggtgacacaataaaagatgtaatcaaagtggttaaggatcatggcggaaatcctatcgtagttactgttttgattgacaaatccggacttgaagaagtggacggagtcccaatcgaatcattaatcaaagtaagtcaattaaggtaa

SEQ ID NO: 1358 - DNA, 807 bp, Methanobrevibacter ruminantium
atggaatttaatattgtaaaagagttaaatggtcaatttgaccctattgtactaattaaaactgatgaaaagccagaagatgctttggcccctaagcctggaagaggaggctgtgttatgtcttttgttgcacagtccattgcaaagcgaaaggtcactgccttcggccgtgaaaacatcacctgcggaggggtatcagcaggatttggatggggaactggatttaagacagataaggacaaggaatttcaagctacttttctatctcttggccttgattctgcaaaggataaggatgcttttcttgaaagattgagctatttgccaaagcctactcaagagatgtttaaaaaaggagagaggatattttcagactttgacactgcatatgaaaacatacagaataggcctttgtatgatgagggagaatatgttgtttttaagccaattgagcttcttgaagagggggaaactccagattcagttatctttacagcaaatactatggaactgtctgctatcctacagttgaatggttcatttagggctgaaagtgctcacataatgacccctcaagcttctgcatgtcaggctattggcgcatttacttttgaacaagaagactctgataatcctatccctgtattaagccctctagactttgcagcaagggctcatatgagaaggttgattccagatgattatatgaatctgtcaatgccttggaaattgtttttaaagttggaagaactaagtaaaaatagcgtttttcaaacccatttctgggatgattttgggaataaataa

SEQ ID NO: 1359 - DNA, 1422 bp, Methanobrevibacter ruminantium
atgattgaaaataacatttgtttattaacagacagctataagctcacccaccactatctacacccaaagggtacagagaaaatctactcctatcttgagagcagaacaggtgctgagtttaacaagactattttttacggactgcaatacatccttaaaaaatacctagaaggcaatgtagttagcgaagagaaagtattggaagcagaaagaatcgtagacgctcacattgctccaggcattttcaatacagatgattggatgtatatagctcaggaattagatggaaagctcccagttaaaatcaaggcagttgctgaaggttccccagtaaacgtaggcaatgtattgatgacagttgaaaatacagacaagcgtgcttattggctgccaaactatcttgaatcactgcttcttcaggtatggtatccatcaaccattgcaacactctctgctgaggttaaaaagctatgcaatttctatctggatgttacaggctcctcaaaggacaatcttaactttatgttgcatgactttggctaccgtggtgcaagctcaacagaatcatcaagattagcaggatctgcacacctattaagcttttcaggcacagacaccgttccatcccttgcaatcccagttaactattacaatacaaatgagatccaaggattttcagttcaggcaacagaacatagcgtaatgacagcaatgggtccagagggcgaaatggaacaggccatcaatgttgtaagaaacgcccatgatggcattctatcaattgtaatagacagctacaactataagaacttccttgaaaacgcctgtatcaaaggacacaagctaaacgaagaaatcaacgaattcctaaagagaactgaaggaaacaagattgtattcagaccagacagtggagagccaatctcaacaacaatagactgtcttgagataattgaaagaggattcggtacccacaatacagacaaaggatacaagatcttcaatgaaaacataggccttctctggggtgacggtttagactatcaaaagataagagacatcctatttggaataaaagctcaaggatgggcagctgaaaacctcatattcggtatgggtggcggattgcacacagcagtaaacagagacactcaaagaaatgcattcaagtgttctgcccagcttagagatggtgaatggatagacatattcaaaaagccattggacacaagcaaaaagtccaaaaaaggaagattcaagttaataagaaacgataagtttgaatacagcactgttccaatagaaactgaaggcaaagatcaattaagaaccgtattcaaagatggtgaactattgattgatgatagctttgaagaaattaaaaagagaacagaaacttataatatgtttcctattaaataa

SEQ ID NO: 1360 - DNA, 420 bp, Methanobrevibacter ruminantium
atggaagaaaacaattacatcgtcttcaaaaaacaatacggcaacattaaacgccctaggaccaaggaagtctcaataaatcaaaacggagtcaaaatttacgaaaaggaccaatcaatgattataaacatagttcttccaatagaagactcaatgaaagtataccaattctttgaagaattcaacttaggtgaagacatacaatttaatatcagcaatactggagactttgaatgcgtattccgaggaatttcttcagtcattgataaagacagttactcttcattctcaattacagtccaagagaaatatcaaaggccagatcagctccaagtggaagcagactgcaatcaagttgatgaatatggcaatccaattcagcaatgcataggctgtgggcttcacagagacgaaatatga

SEQ ID NO: 1361 - DNA, 939 bp, Methanobrevibacter ruminantium
atgattgacgaaatttatgactactacgaaaaacgtctaagcacttccaattctatcctcaagatgagaggaattgacgaagaaataaataaacttcccttagggattaatttagatattgcaaacatcttaagcacaatcgacatatatgactacgatgaaaagaaagcagccaaaaagatcaaggaagcttatgttgaagtcttcaaggaaggaatatatttgggaattggctttggcaagatcttaaagttcaactatgcaaagtcacatcctgaaaactatgtggaatgtctcgaagaggattatcaacattttaccttctatgactttaagatagaggttctaaagaagatcattcctccgataaaggttaagaaatttacccaagagaggcatcctaaagagataaactacagaaacgaaagctttgaagacatccgctcatacacctgcataaatgtcgagacccaatgggaagacaaatttgactttgaagtgaatcctgatgcaaaggaaatggaagattatatccgccaaagggaggtgaaatcatatgaggataatgaggaattaaagaaatgtgttgatgacttgaagatgggaattcaaaatatcctattccagaagttctttgaagcattggaggtggatttggaaaaggcagagaatggctgtgaaaacaatctgcgctttgatgaggagactgcaaaggacgtcttcatttcccctgtattctccaatctggaaggagagtttaaaatcagagagcttgtcaataaatatcttattcatgtattcaatgaaggaaagatcatcggccttttaaatggcataaagatagttctagaggacattcaaaatgacaggctagactatgaagagatgaattcaatgagctctagagaaagctttctatacattaaggagggtttatag

SEQ ID NO: 1362 - DNA, 846 bp, Methanobrevibacter ruminantium
atgataaatgaaattgtaaacggctataaaaaccagcaaaaggtctatttaagttccataataaaaacactgaacttagatattccagacgttttaagtgtctatccaaaatcaaaccacgatttagataagatatttaaagaaatcaagctaatagacaaggacgaaaacatcctggaacctctagaggaattctacatagacaccttaaaaagaggaatattaagttccatacctcttggaaagagcttcatggtaaagctccatagggatgatgaggaacattttaacgaagttttaaggatgaacagcggattgttcttaaattacgttcctaaaatcagttcccttgaagatttggaaaaatgcactccaaaatatggggaaagagattactataaaatgaaggaagaagaacaagtcattgtcatagttgaaggaatactacgatccttttgtgaattcacaactgataacaacctaatggttgactaccattttgaggaattgtttgatgttttggatattgatctaaagttggctaaaaaaagatgcaataagagaatcaaattaggtaataaatccaaaataggaatcatctctgcaatctacaagaacaagaacggcaaattcagagtgactgacttggtcaaggagcactgccaaacaatctttgaagagggtatgagacttggaataagaaatgggataaaaatagtcatggatgatgttcattcaaaaagaattgatcctgatgactttagcaccatggaattaaatgaactttcagcctatttctataaggaaataaatgaagaattagaacagctcgctaggaactgttaa

SEQ ID NO: 1363 - DNA, 1224 bp, Methanobrevibacter ruminantium
atgcaaaaagacaattctaatcagaataatgatttaaagcaggggattagtgattctaatcaagagaaggatttaaaccataagaccaataattctaatcaaaataaggattttaataatagaattagcaattataatcaagaaatgggttttaaaaataaatccaataattctaaacaagaaaatgattcgaaaaacgatttagattccaataaaaacataaatccttttaagcaaaaggatgatgattttgataaggccttagataaaaactacctagaagagtataatactcagtactactacagcattagccagtgcacttcattggataatagctcacaaggtcgtttagtttcaaacatccttcttaatttgatagagtctcttgaaaactatcttttaaagatagctagaattgattatattaacagttattttgattgggattttcatttattaaacagctcatttgaaaatgcattctgcatgcctggtggcaaggtattggtttactctggcatattgtcaattgccgataatgaggaaaggattgcatatatattggctcatgagatggctcatgcattgcttaatcatccaagggattatattattgttaaggataaagaatataataatgttcttttatttaagccatttagtcttaatcaggagtttgaggctgatagattagctatgatgatacttaaatgggcagattatgatattggcaatattccttcattctgccagttccttaggggaaactataataagtttaactatttttccacacatcccttaagtgatgataggcttatgaatatggaaagtctgattgctgagataaataatctaaaggacgattgctttgcacctattataaagaatgataggtctaatgcccttatttatacaaagagatatgctggttctcagtataatgataaagataatgagattgaggataggccaaaggtattttgcactaattgcggatactatgaggattccgatgcagtcttctgttctaattgcggttctagaatggatgataagtctagatgtgatagatgtggggctctaatcgatccaggggatgtcttttgtacaaattgtggcaatgtattggtagatgattataaatgttttaactgtggtcataaaataaaacctggtgatgtattctgtgtaaactgtggaataaagcttattaggtag

SEQ ID NO: 1364 - DNA, 399 bp, Methanobrevibacter ruminantium
atggcaacttttagttcaatagaagaggcaagagagttttttaagggagataagtttgcaactaacattggagttcaattggatgagcttgaagatgactcctgtgtatgcagcttagagctatgtgatgattttagaaatgcctatggtgctgtaatgggtggagcaatattcactcttggagattttgcatttgcagttttatctaatcaattgcacagacctactgtaggattgcaggtaagcattaattatttaagtggagcaaaaggagaaaagctcattgctaaggcacattataaaaagaatggaagaactacttctgtaatcaatgtggatataattgatgatactggaagagagatagcacagtttgttggaactggatataagatgtga

SEQ ID NO: 1365 - DNA, 1008 bp, Methanobrevibacter ruminantium
atgaaggacatatttgatgaatgccagtttggcgagtttaaattaaaaagcagaattatcagaactggcggatgggaaagagacacagaagacggaggctttttaaagccaaaagtctttgacagatatgaaaagatggctggaaatgaggtcggcttaatagtctctgaaatgtttgcacttgaccctaaggaccgtttttatccatactgtgcaaacatgaactataagggattcattaaggattataaacaggttacaaacctatcacatcactttgaggttcctattttaggccagcttgctttcttcttttttgatgatggaacaaaccagaaggcagagccaaatgacataagccttgaaggaataagaaagcttcaggcagaggtggttatggctgccaagaagttttcatttgcaggctttgatggaattcaaataaacatggctcataacttttatcttgcaagattcatcaatccttattttaaccagagaaccgatgattatggtggaagcactgaaaaaagaatgagaatagttgtagagattataaagcttataaaaaagatggtaggatgtcatgtaagctttagaatcaatgctgttgatggaagaaaaggtggaatgactcttgatgaaagctttaagatagcaaagattcttgctgaagccggtgcagatagcgttcagattacagctagaacaatctcctttaagtttggagagactggagaccacgcattcctttcctatgccgatagaatggcaaaggaattggatattccagtaatattagggggcaccttgcgagatatgaaaacaatgaatgagatcttgaatgagacagatattgaattcttatcacttgcaaagccttttgtagctcaacaagacttcttgagcgaatggaaggaaaatggtgatggagtttccagatgcagggcttgcaataattgttatggtaaaaaggagagtaattgtttccagtttggtgatgaatga

SEQ ID NO: 1366 - DNA, 576 bp, Methanobrevibacter ruminantium
atgttagaactagataaacttttggatatctttaatgctggagatacattggttatggatgaggaagctacagatgcttgcaattactatagtgccgaagcacagaagattacttgcgaattaaattatcaatataatgactttgataaaagaagagaattgttctccaaactcatcaatcaggagctggatgatgaattcagggtttttacacccttctttacagattttggtaaaaacatacatctgggaaagaatgtcttcatcaatgcaggatgcaagttccaggatcagggaggaatatatattggagatgatgtgcttataggccataatgtggttatggctaccttaaatcatgatgaaaatcctaataatcgtgctaatttgattgcagctccaataaggattggaaataaggtttggataggttcaaatgcaaccattcttccaggagttagcattggtgatggagcaatcattgcagcagctgcagtggttacaaaggatgtagaggaaaactccatagttgctggagttccagctaagtttattaggaaggttaaaacggattaa

SEQ ID NO: 1367 - DNA, 336 bp, Methanobrevibacter ruminantium
atggcgattccaaaagcacctgtaaaaaggattatgaaagaagagggcgctgaaagagtaagtgctgaggcagtagatgcattagtagattacttagaaactgatgcagatgccattgctagaaaagcaattgactatgcaaaacttgcaaaaagacaaacagtaaaagcagaagatattgcattagctattggccgcccagaaacttctgaatccactgctgagaatccacacaaccttttagaagtggttcaaaaagtattagatgctgcagcagacggaaaaggctttgaagaaatcattaaatcatttatgaaactagaaaaaaaagaataa

SEQ ID NO: 1368 - DNA, 1335 bp, Methanobrevibacter ruminantium
atgtcctatgtagatgaagtaattgacttaattgttaaagaaaaccctgatgaacctgagtttcatcaagctgtaaaagaagtattagaatctttaagagtcgtaatcgaagaaaacgaagaacaatacagaaaagacgcacttttagaaagattagttaacccagaaagacaaatcaaattcagagtcccttgggtagacgacaacggacaagtgcaagtaaacaccggttaccgtgtacagttcaacagtgcaatcggaccttacaaaggcggtcttcgtttccacccttccgtaaatgtaggtatcattaagttcttaggattcgaacaaatcttcaaaaactccttaaccggccttccaattggcggaggtaaaggaggatccaactttgatcctaaaggaaaatctgacagagaagtaatggcattctgtcaaagtttcatgactgaactctgcaaatacattggtgctgacactgacgttcctgctggagatataggtgtaggtggtagggaaatcggttacttattcggtcaatacaaaagaatccaaggattatacgaaggagttctcactggtaaaggattaactttcggcggatctttagcaagaactgaagcaactggatatggtttattatacttcgctaacgcaatgcttaaggcaaacggcgaaaccttagaaggtaaaaccgtaattatgtctggtgcaggaaatgtagctatctatgctatcgaaaaggcttaccaacttggagctaaacctgtaacctgttccgattccaccggttggatttacgaccctgaaggaatcgatgtagaattattaaaagaaatcaaagaagtaagacgtgaaagattaactgcatatgctgaagcaagaccatctgctgaataccacgaaggtaaaggcgtatggaccgtaaaagctgacgttgcattcccatgtgctacccaaaacgaattagacattgatgacgctaaaaccttagttgaaaacggtgtcattgctgtagctgaaggtgcaaacatgccaaccaccttggaagcaaccgaatacttaattgaaaacggtgttttattctcaccaggtaaagcttccaacgcaggtggagtagctacttccgctcttgaaatgagtcaaaactctcaaagattatcttggacctttgaagaagttgattccagactccaaacaatcatggaagatatctttgcaaatgtagatgcagctgctaaagaatacggatttgagaaaaactatgtagttggagcaaacattgctggattcttaaaagtagttgacgcaatgaacgctcaaggaatcgtatag

SEQ ID NO: 1369 - DNA, 549 bp, Methanobrevibacter ruminantium
atgaaaatactaatctcaaatttaaagggaaaggaacttgtggaaatagctatgaaaaaccagatagacaagctaatttcagtctactcaaactataacgaaacaagcctccttgatcagtacatgactaaagaaaacataaagataagtacaacaaatgcaattgatgcctgcaagcagcttacagacataattcgccatcaagacacagatgatgagatctatgttgcaagcgatggaaactttttaggatcaatgctgaactttgttgcaaataaggaagctgcagactatatattctattccttcaacaatcagattatccaaatgcctagattaagcataaatctatctgaaacaaaaatgaaaattctaaagagtctgaatgaaacagagcagactgcaattcttattggaaagaatataggaatctctagagccatggtctataagcatataaacagccttatggaagatggcctggtggggcagactaagcagtatgaaaagtactatctaacaaatgcaggaaagatgctgattatctaa

SEQ ID NO: 1370 - DNA, 240 bp, Methanobrevibacter ruminantium
atggctgaagataaacaagaacctttaagtccgattgaagagattaaaaaagaatatcttgaaaagatagactactttggaaatagaagaagcaaatatgctctttataaaaagttcagcaaaaaatacaacttaaaccgcagagtctttattcatatcctgaacgaggctcatgaagatgttggaagcccaaaaagatatgaattgagaagacaaacccctaaagactataaaagataa

SEQ ID NO: 1371 - DNA, 840 bp, Methanobrevibacter ruminantium
atgcttattgtttattgtttaaacttttatatggtgttttttatgttttatttagtgggattaggtttatttgatgaaaaagacatttccttaaagggaattgaaactttaaaaaaagttgataaggtttatgctgaatttttcacttcacgcttgtttggatctaacttcgaatccattgaagagactattggaaaagagattattgttcttgataggactcaagttgaagaggaatctgtttttttaaaggaagctaaggaaattgatgttgctctcattacagggggagaccctttgattgcaaccacccactcagactttttagttgaatgcgcaagggatggaaccgactttgaagtgattcacggttcaagcatactatcttccgcacctgcaatttcagggcttcaggcctataagtttggaaaggtgacaaccattccattcccagaccttgagtacaactatttccctaagtccccttatatggctattgaagagaacttgaaaaatgatatgcatactttggttcttttagatattcaagctcataaggataagtatatgacaatcaatgaaggattagaaaacctaatgacaatcaaggacaatcttgaaagggaagggatgattgatgagaacagcttggcaattggaattgctagggtaggatccaaggacaatgtagtaaaggcaggatacattaaggatcttttggattatgatttcggaggccctcttcattgcattgtgattccatctaaattgcatattgtggaagctgaatatttggttcatgttgcagatggtcctaaagagattttagatgatttatag

SEQ ID NO: 1372 - DNA, 1461 bp, Methanobrevibacter ruminantium
atgattttgaatcattacattttaagtggaataaatgaaaagattggtgaaatggaggaggaatttcagttgatgctacttgcttcggaaattgtcgattgttgttttaatttctttgaaattgaacgaaaaacttcaaaagtcggcaggcctcattttgagattaagaatatgataaaactgatattttatggctacattaataaaataacgagttctgtagtcttggctcataatgccaagtataattttctctacagttttatttcgcatggctgcgaaccaagcgaccggacaataagggattatcgcaagaatttcatgagcatattccaattaataatgagctttacactaattgcaacatataaattgggtttgagtgattttaagtacattgcaattgacggtacgataaaacaagcttataactctccctttaacataattaaggaaaaagacatccggttattaattaagcattatatggttgaggaattaacaaaaaatgagattaaaaagcttagaaaaacagcgaagaaatttttgaaggataaaacgaaaacagacgaagaaaaagtggatattctttttgaatggtggcgtttgctggatttttctggacaaagttctctgggtttgaatgatcatgatgcgagatggatgaaaattaaggataaaggacagatttatccaaaattttcatataatcttcaattagggacagatactgagtctaagttgatttgcggagttaacgtagtccaaaacccaacagaccattatcaaatacccgctttaatgaatcaaatcataagcaatttaaatcttaaaccaacaaaaattagcgcagatactatttatttaacgcttgcaaacttaaattacttggataacttaggaataactgccttaattccaacatctcagcaaaatcgagagaattctggcgaaaagccaaacaatcgttttgctataggttattttgtttttgatgaatataaaaatgttttcatttgtcctgaaggacaggaattgacacttgatggaatttatcaggcacacccggaaaaaggaggaggaaacaagctaaaagcagtctattctaacttcaatgcttgcaataattgcataaataagggagtatgtttcaaaacagggcatagatcaataacaagatatgttcatgagcttgcttataaaactgagcggataatatcttcagaaaaaggcattgaagaatataaattgcgttctagtactgtagagtcacataatgggactttcaaaagggtttatctttatgattttattccaataaccggtttaaaaagagtacagggattgatgtttgccattgtagcttcatataacttaataagattcttaaatcttattaaagaaaataatatgagtttacaatctgttattaattcaataagatacatatcatcgagttaa

SEQ ID NO: 1373 - DNA, 1098 bp, Methanobrevibacter ruminantium
atgttaaccataaaaattccagtgcaaaatatagaagcaacaagacaaatagtgctaaaacataagattcttgactatgactataagatcaaggtggaaaacggctttggccatataccgattagagaggaaacagaagacgaaatactctctaaagtcatagaagaatgtaaagaagaaataataaaacaaaatagcgattatactatcgaagtagtcgatttaaaccaaaatgaagaacttgaaactgtcaaaagatatccaagaagcataactgagctccttaaggacaagctaagcgatgaggagatagaggaattaaagaaatcctttgatataattggtgatgtggttattgtagaaattccagaggagcttgaagcacataagaaggaaattggagaggccacacttcagttcacaaaacgaaagacagtatatatgaaaagaagcgctgttgaaggaataacaagaacaagacagcttgaactgattgcaggtgaggacaatcctataaccatccataaggaacatggaacaagacttaaactagatgtgaagaatgtctatttctcaccaagacttgctacagagagaaaaagagttcaagaggaaacaaaagatggcgaagagattcttgatatgtttgcaggaatcggaccatttcctattgttatagcaagagaaaagaatgtggatatcactgctgttgacattaatgaatatgcaatcaagtatctcaatgagaatattaagttaaataaattgcagcctaatgcccatatcactgcaatatgtggagatacaaggatagttgcagataatgaattgaagggacgaaaatttgataggattatcatgaatcttccaggattagcgccggatttcttagatttggctgtctccatgtgtaaggacggaggagtcattcattactatgaattctcagagggtttttcacagggaattgaaagggcccagatagcttgtgaaaaacaaaataaggaagttgagatacttaatacaagaaaagtaaagtcaaccagccctggaatgtggcatgtagttattgattgtaaagttagtgataaaaaatag

SEQ ID NO: 1374 - DNA, 891 bp, Methanobrevibacter ruminantium
atgactaaaaaagacataacttgtggaggagaccataaaggtgcaagatttgcacacattacaaaagtgcatccatgctataatgaaaagctccacgataaggttggaagggtccacgttccaatcgcacctaaatgtaatatcggatgcaatttctgcataaggtcaatcaatactgatgaggacaggccaggtgtagcaggatccatcatggatgcagatgctgcagtggaacatgtattgaatgtgacaaaggacagcgcaatcactgttgtaggggttgcaggtcctggagactcattggctaatgaagccacatttgagttctttgaaaagatcaacaaggtaaagccagacctaatcaaatgtatgagtacaaacggtcttttgcttcctaaatatgctgaaagaatagcagagttaggtgtaaacactgttacagtaactgtaaatgcagtggacccagagatattaaaggaaatcaacggattcattttctatgaaggcaaggtctataagggacttgaagcagctgaaatcctttccaaaaaccagcttgaaggaattaaaaagataactgaccttggagttgttgtaaaggtaaatatcgttctcatcccagggcttaatgacgagcacattccagagatagcaagaacagtcaaggaatgcggtgcagaccttgtgaatgtccttcctcttattccattgaataagatggctgactatccaagacctggatgcatggagattgaaaaggctagaggggaagttgaagagtaccttccagtatttagggcatgcacccaatgcagagcagacgcttatggaattcctggaaagaaacatgaggatcatcatattggaaatgctccacagtctcacttctag

SEQ ID NO: 1375 - DNA, 567 bp, Methanobrevibacter ruminantium
atgtatattgaatcaaatgatccggaaggagcaaaggtctacgacatgattataagacagatctttcaggatttggtcctgccaccttccattgatgacatgaaggcttatgtaaatccaaatgaggtctgtttcataattgcaatcaagatgagaaagacttcacagcacattaccttgaaggaagtggctaatgtcgactataacgctgaagatgacactacagtggtaatcattgacaatgaaaactatcttccaaacattctaaaaaggctttgggaaatcaatggccgtgaaaatgttcaccagccaagcagatatgtcattcacttgcctggagagaagaatgtctctgatttggttgtagacgaccctcatgaaaatctaaagagaagaatttatgatgcagtctttaggatagtccctgaaggatttaagataatgaaagacatgtctgaaggagacattgtctgcattgttgccacagatgaattgattaaggatgaatgggttgaaaaggctaaaggatatatggtggaattgaacactccaaagacttgggattaa

SEQ ID NO: 1376 - DNA, 1236 bp, Methanobrevibacter ruminantium
atggtacagattgcacttgtttcctgcggtaccgaatacagtggtatccaaaaggaaatcgaaaaggcagctcttaagtttggagctgaaattatccttcctgaaattgatttggattatattaatgaagcttatgaaaaattcggattctctgctcaaagctcaagcttaaagcttatgattgcaagggcaatgtccattgtagaaggcagatgcaagcctgatgcagtattcattgcaacctgcttcagatgtgctgaaggagcattggtgagaaacgaagtgagacgtttcatacagaacaacacccgtattccagtggttacatactcattcactgaaaggacaaaggctgatgaattgttcatccgtatggaagcattggcaactacagttacaagaagaagcattcttgctcgtgaaaagcaagaaggacttactcttggtctcgactcaggttcaacaaccacaaaggcagttcttatggaaaacaacaaggtcattggaaccggttggacttcaaccaaggatataatagaatctgctaagactgcagctgcagaggcctttgacaatacagattacaactgggatgatgttgacggaataggaaccacaggatatggtaggttcaccatgggtcgggaatttggcgcagagcttatacaggaagaattgtctgtaaacgcaaaaggtgcagtatatcttgcagactgccagaaaggggaagctacagtgctggacataggcggtatggataacaaggttattacagtaaacaatggtattccagacaatttcaccatgggcggtatctgtgcaggtgcttccggaagattccttgacatgacctcaagaagattggatgtggacattacagagcttggtcctcttgcagtgcaaggagactggagaaaggctatgcttaactcctactgtattgtattcggtattcaggaccttgttacaaccttagctgcaggaggctcaaaggcagatgtagcagctgctgcatgtcactctgtatccgagcaagtatatgaacagcaattacaggaaatcgacattcgtgaacctttgattcaagtagggggaaccagtcttatttcaggacttgtagaagctgtcagtgaaactttaggtggtatagaggtaattgtccctgagtattcccagcatattggagctgtaggtgcggcattgcttgtatctggtatgggcaaaaggcatgaataa

SEQ ID NO: 1377 - DNA, 507 bp, Methanobrevibacter ruminantium
atggtaaaagtagctatttatccaccaaattcattgattttagctgacttgattgagagaaaaggtcatgctcctttagctcttcaaaaacaaataagacaaaagataaaagacccggagattgattcacctccaatgaacattacagaggaagacccaataaacggattgaagtatgcagctattgaagtcccttcaggggttaggggaagaatgtccatcatcggacctcttatagatgctgcagaggctgcaatcattgttgacggcgctccatttggctttggctgtgtaggatgtgcaagaacaaacgaactgtccattttctgcttgcgtaaaaaggacatacctgtacttgaagtggtctatcctgacgatgaggatgggaccgtgcttatggtaaatcaaatcatggaattcttggattccttgcctggcggcggaggagacatggaaggagacaatgacgttttaggcgaacagattggaactaaaggaggaaaataa

SEQ ID NO: 1378 - DNA, 507 bp, Methanobrevibacter ruminantium
atgcctgcaaatttatgtataactccagatttaggtaaggaggacatggatccggaagtttctacaaggatgatcattttaagttccaaggcaaatgtaagcgaaagcgaagtcgtcaacttcctgcatatgcttaacttgccacttacaataaaatggacttgctatggggcaatgatcagcggcaaggacaaatatgtcagacaagcgattagagagcttcgcaaattggatccttacggaatctttacaaaggaaagaggttttgctccaggtgacccaagaagatgcagaggccacaggtatgggccaagggaaggattccaccaaatggagaaggaattcagaattcttgactatgttggagaggccttgaaaaatccaagagatgtggaaatcgagaagaaagaacctgtttctgttgattactttaaagaagttttagataaggctttagaagaatctgaaggttcttcaaaagaaaaaagtgaggacgataacaaatag

SEQ ID NO: 1379 - DNA, 1569 bp, Methanobrevibacter ruminantium
atgaaaagaggcaagcctatgctaataaaaattaatggagaagatgtggatattcctgaaggatctaccatcaaggacgctatagagctttccaatgcgccttataagaaaggaagcattgtctgccttatcaagggagaaagcgaaatacaaagcaatgtccttaagtataagataaagactcctaagggaagtattctcattgaattggaagtttctgaaaaatcaaagcctttgactgatttcttcaaggaaaactattctctcttcagctccaacaatgttcgttgggaaacctctaatgaagtggccataggtccggtagagtctaattttgaaccgtctcatgatgagttcaggtattttgacaatgatgtcttaataagcctctccggtttttccaaggaggccacacatataatctttgtaaaggacgatcactcaaatgtatatggagttccaaaatacagcgacagaggagtctttgcaaggattatcggaggaagaagaacattgttctcacttaccgatgatgatgagatattgtcaatcgagcctgtgattgagagaagcacagtcaccgacagtacaggaggctcaaatcttgaggaagttcttgaagagggaaatcagctattcacctacgctcttttagagccaaatgcaaagtctccagcatcagttgagcatctgttctcattgattagaaacaacaaaatacaggttgactttgaatctaactcatttttaggtttctatgaattaaatggtcttactaaggatgctgaagagataagtgaacgtaagagaggaacagtaaccttaagaagcgaaggaaacggaaaaggaagagtctatgtctatagggaggacagggtcagagctgaaacccataccaatcttgctacagtcaagcaaggtatggaactctttgataccgctaaaaagggagacttcattactgtattaagcgatcctgaaagaatcatgcttatgatgctaactcaaaaggaagcagaggaaaaaatgcaatctttaggaataaagcatgttcgtgacggaaaccttgatgacgatgcgattgttgtgattcagacacctgaaaataccattgacattctggaaaataaggaagtcaccaccttcggacttgcaagcgatgaattggttaagatcaaattgactgacaaggctccaagaaccagatggtatcttgagaaaatcagtggattggcagaaaagcctgtaggcacattgaaggtctactttgcagttcccgacatgaacatgttcatgttcaatggggatactgacgaatccaagggactcattccagagaatatccctacagatattgtaaaggccggtgagatagctgtaaccaatatgtcaaggaagaacttaggtcttattggtataaggacaatcgatactgatgagttcggacctactggtgaggcattctcagctacaaacattgtaggtgaggttgttggaaacattgaaggcttgaacaagcttaaggatggaagcactctttatatttatgaggtttacgatgaggaataa

SEQ ID NO: 1380 - DNA, 684 bp, Methanobrevibacter ruminantium
atgagtttattggaagttaagaatcttaagaaaagctttggagacaatgtggtcttgaaggatatctccttttccgttgaaaagggtgaggtattgtcaatcataggtccatccggatccggtaagtccacattgctaagatgcataacagaccttgagacagaggacagcggtgagatcaattttgacggaacctttggattggtgttccagaacttcaatcttttcccacatcattctgtaatgaagaatattaccaatgcacctctaaaggttcaaaagagagacaaggctgaagtttacgagcatgcaagagaccttctaaagaaaatggggctttctgataaggaagatgcatacccttcagaattgtctggtggtcaacagcaaagagtatccattgcaagggctctttgcatgaagccggatatattgttctttgacgagcctacctctgcacttgaccctgagcttacaggagagatattagctgtaataaaggacttggcagctgagcatatgactatggtgattgttacccacgagatgaactttgctagaaatgtttctgatacaattatcttcatggatgagggtgtcattgtggaagagggctcacctgaagaggtattctcatctgacaatcaaagaatgaaagagttcttaggcaagttttatgaataa

SEQ ID NO: 1381 - DNA, 978 bp, Methanobrevibacter ruminantium
atgaattttaatgagcttgttaaatcacttcaagagtttattggtgtaagtaggaaaaattcaatagaaaaggttacaaaggctttaagcgaaacttataatatctctggagatgttcttcttgactttggagacgatgcatctgcaatcgatattggaaatggtcaggttgttctacttgccgccgatggaatctggggacagttaatgagtgtcaatccttattgggcaggctactgctctgttcttgttaatgttaacgacattgctgcaatgggaggtaggcctatcgccatggtaaatacattatccattaatgatgatgaaatctatgatggggttcttcagggaattgtagacggctgccgcaagttcaatgttccaatggttggagggcaccttcaccctgatgccgaattcaattcattggatgtggcaattgcgggaattgctaaaaaggattctctaattacttccgctggtgctaatgtaggagataaggttattgtagccattgacactgacggcaggcagcatcctcagtttgtcttgaattgggacaccacatatgaaaaggatgcaaagctggttcaagatcagatttctgttatgcaggagatagctgaagctcatttgccaactgctggaaaggacattagcaatcctggaacccttggaactttggaaatgttgcttgaggcatctggtgttggagcatttgtagagcttgagaggattcctagaaatcctgatgtctcttgggaggaatggctgatggcttatcctggagctgcctttgtaatgactgccaaggaggaaaactgtcaggagattattgatagacttagtccttactcctttgaagttgcagtggttggagatgtgattgaggataagatgcttgttttaaaatcaggtgatgaggaagctgttctatttgatcaaaggaagaatcctgttcttgtcttaggcaattaa

SEQ ID NO: 1382 - DNA, 633 bp, Methanobrevibacter ruminantium
atgacattgctgggccatcacattcatgataagcttttcctctctaaggacaccttggagattccttttgatgaggaggcagactctcctgagaactttaagtcaatcatgtttaatgtattcaagtcttatgtcattgagagcattaaggaagtcgttccaagctttgttgaaaaggaccacgaatataatgtggtcaatagctatgaaggattcgttgaagaggactatgaatttgaagacttggatgactttattcaagagctggagtatggcagctatgagggctctaatgagatttatgtggatgaggacggctctttagttgaagaggtctatattgaggatggtgaagttcctttagaggaagtttatattgaatatgatgatgttcctgtagaggagatctttgtggagcatgattctgatgatgatatttatgtagagcatgagtctgttgaggagatttttgttgagcatgatgacggctctatagatgagattattgttgagcatgagcctaatgaaaatattgtttatgaggatgctcctgtagaagagatttttgttgagcatgagcctaatgaagagattgtttatgaggatgctccattagaagagattttttgttga

SEQ ID NO: 1383 - DNA, 1242 bp, Methanobrevibacter ruminantium
atggaaattggagttgttgtacatggccccggaatcatagattctggctgggctataaaaattattgatattttatctaattatggaaatgtccattgtcgtttaggcggaactatgggcaggactgcagttattgacgctgctttagaggatgccatagacatatccttaaaattactccctagccaatctttggaactcttcaatagggaaggtgttgatataatcttcctattgaattatggaaagtcccctgaaactggcagagtctttggatataaggttttcaaccattactttaagcagatttcaaatgaggattatcttgctaccaatcataagcctttatatgatgcaagcgttcctgtaattcaaattgaacgtcctggagaagaggacggctcaataatcagctggaatacagaattgaatgagcagctaagcaaaagccgtaaaggcagattcaaattgggattgggaaagaagaatatggtggaatcattatcctttaactttgaagaattattcgatcatttaaaaacttccttaaatttagtagaagtcacaccagaggaagtcgtatccaattatttctccaataatcaggaaaggaaagatgaagaggacattgagaaaatattacgttcatatgatgattatgacatcagccattacacctaccgtaagattcatggagtaagccctgatgagaacatcttcataaacggcatagttgtaggctattccaatggagattccattgtcttggttgcccgtgacggattgattgccgacattataaatggaactattaagtatcacggacttgaaaagctaggtcctgttgatctggagagggtcatagttaaaacaggtcttcttagaaagtctgatgatgtaaatccgagagtcttatcaaataaggacatttcacttaaggatacagaaaggcatatctattcaggtgagatttcagaagatgactattcctttaaggttgcttatgtggatcatgcagcttatgacatctataagttcaaggactttgatttggttgttacaataggggatgatacttcccttgtggcctcagatattctttatcgttttgatattccaataattggaataaccgatggagacttggataaggtcgttgaaaacggatttgtaaatgagaagtcaacaatcattgaagtggcttcaggctttgatgacattgctgggccatcacattcatga

SEQ ID NO: 1384 - DNA, 507 bp, Methanobrevibacter ruminantium
atgagtgatttatattatgtcttagatgcatctgcatttataaatggatttgaaccgaaatcagattttaacattacagtttctgaaataactgatgaggttaaagacttaaaatcacgactaatattaaatcaagccatagatgatggtaaaattataattcaagaggcccaaaaggagttcttggataaattagatgaaaccattgccaaatctggtgatgacttaaggttatcaggtcctgataaaaagctattggctgttgctttggctttattggatgaaggcaaagagattaaggtcttaactgatgactattctatgcaaaatgttttaaaaatccttgatattccctatgaaagcattataactgaaggaataaaaggagtttataattggaaaaagacctgtgaaggctgtaaaaaggagtatcctgcagattatccatttgatgactgtgagatatgcgggtctaaagtatttaaacgaagaattaaaacttactaa

SEQ ID NO: 1385 - DNA, 519 bp, Methanobrevibacter ruminantium
atgaaaagtgaaacaatggaattacataagaagaaagctccaataaaggtttcatgtggaattataacacttagtgacagattctcaaatgacaaagagggaaaggaaaaagacttatccggaaaatacttgattgatgaattaagcaaaaaatacgatgttgacgattacacaatcattcccgatgaaaaggacatattaaaagacaccatagaatcaatgatagataatggaatagatgtaataatcacaacaggtggaacaggccttgaatcaagggacataaccattgaaactgtagaacctttatttgaaaaggaaatgaaaggatttggtgaaatattcagagcaatttcatatgaagaattaggggcgggatcccttttatcaagggcaacagcaggagtttataaaaagacactcatattctgcatgccaggatctcctaatgcagtaaaaacaggaatgaaaatattctatgaagaattagggcatcttaaaaaacatgcacaaaaatag

SEQ ID NO: 1386 - DNA, 531 bp, Methanobrevibacter ruminantium
atgtgcatggtatctaaagaatatttaattgaaattcttaaggaaaacaaagtatttgaacaaggggaattcactcttgcttcaggaaagaaaagcaactattatgtcaatatgaaaagagctataacagagcctgaaatcttgtctacaattgcaaagctaatcaatgaaaagattgatgatgatacagataagattgcaggacctgctttaggagccgttcctattgcaactgctgtttctttggaatctaaaaaaccgctccttatgattagaaaagagaaaaaaggctatggaacttctaaattaatcgaaggagatttgaatgaaggggataaggtaatccttgttgaagacgttactacaactggaggttctttactaaaggccattaatgcaatagttgataatggtggagtagttcaaaaagcttttgttgttgtagacagggaagaaggtgcaatggagacctttgcaaatgagggaattacattagaacctttaatttccgttagcgaattttttgaataa

SEQ ID NO: 1387 - DNA, 285 bp, Methanobrevibacter ruminantium
atgagaattgcaaaggaattaattggtaaagaagtcttaggaactgatgtaaccgttatgggaaaagtcgttgatgttgatattgatgttgaggataatattattgaatcaatcattgtctctaaaggaggtattcaggaaagcttaaacatttctaaaagcgaattggtcattccttttgatatgataagcaaaatcggtgataagattcttttaaaagatgcattcggagaagacctagatcaaatggctgatgagattcaagatttgaaaaaccaattataa

SEQ ID NO: 1388 - DNA, 1650 bp, Methanobrevibacter ruminantium
atgaattactttttactaggaattgtttttatcgtttacttccttatggtaggttacgtaggttacctagcatggaaaagaacaaattcctctgaagactttttggttgcaggtagagaaactcacccatacattatggcattaagttacggggctacttttatctctacggcagctattgtcggttttggaggagtggcaggtaaatatggtatgggtatactatggcttgcattcttaaatattcttgtagggatattcattgcatttgtattcttcggtaaaagaactcgtaagatgggtaagaatcttaactccctaaccttccctgagtttttaggccgcagattcgatagtaaattcatacaatactttagtggagttttaatcttctgtgctatgccgatttatgcggcagtggttcttatcggtgcagcaagatttatggaaagttctttaatgcttgactttaatctggcccttttcatattggctgtcgtaatttgtggatatgtgcttttcggcggtttgaagggtgttatgtatactgacgcattgcaaggaacaatcatgtttatcggaatgttgattcttcttgtattcatctattgggtattgggcggtgttactgaagcaaacactgcacttacaaacatggctcacctatatcctcctgatgccttggcagaaggtggtacaggctggacaagcttccctaaactgggaagcccattctggtggactctcgtaaccactatcatcatgggtgtaggtattggagcattagctcagccacagcttgcagtaaggttcatgactgtaaaatccaataaggaattgcacaggtccctcttgattggagctgtcttcattgctgttatgaccggtaccgcttatatcgtaggttcattatgtaacgtatacttctatcagaacttcggtcagattgcaattgactatgtaggtggaaatatggattcaatcatccctacattcatctcaactgcacttcctgaatggtttgtatacatattcctcttgtccttgcttgcagcggcaatgtcaaccctttcctcacagtatcacactcaaggtactgcattaggtcacgatattgtagacgcatttaaaaacagaggaactacccgcgaatatactgatgaggagattttggaaggctcttcaaaagaggaaactagaataggatttatttcagttagccaattaggtattttgattgctgtagtgttgtctttaatcattggtcttattttgcctggaggtattgtagctcttggtacatctctctttatgggattatgtgcagcagcattccttccggtctattgtgcagccttattctggaaacgtgcaacaagaaaaggggcaattgcaggtcttttatccggtacattcacaagtcttttcttgcttgtatttgtatataagaaaactgctgttggccttggaatctgtaaggccttaactggtatggacatgctgattaatgtaatgccttggtattcaattgatgtgatggtatttgcaatacctgtttctgtaatatttacagttgttgtaagcttgctttcacctccgatggatgaaaaagtaattaaaaggtcatttgagggactttctgaagaataa

SEQ ID NO: 1389 - DNA, 1302 bp, Methanobrevibacter ruminantium
atgatttggaatcagaatgcagaatgtatggataaggaagaaaaagaagaaatgcaacttgccttactccaaaaacaagtaaagagagtttatgaaaaggtacccttctatagggaaaagtttgataaagcaggatttcatccagatgacttaaaaacccttgatgacattaccaaaataccatttacaaccaaagcggatttaagagaagcatatccatttggattattcgcagtaagcgatgatgagattatagaaattcacagtacctcaggaacaaccggaacacctgtcgtctccggatacacacaaaaggatattgacatttggggagagtgcactgcaagggccattgcaatggctggcggagataaaaactcaaaaatccaaaattcctatggatacggattgtttaccggaggattcggtatagaccacggtgctaaagtaatgggagccactgtaataccaatgtcttctggaaacactgcaagacaattgaagatcatggaagacttccaaagcgacattctcacctgcactccatcctatgcaatgtatttggcagaatcccttgaaaaggaaggatacactgcagatgacatcagcttgcacggaggaatcttcggagctgaaatgtggactgaagagatgaggcgtagcctagaggaaaaattaggaatcactgcacataacatttacggacttactgaattgatgggtccaggagttgctgcagagtgcaaatatcagacagggcttcatattcaagaggatcatttctatccagaaatcattgaccctgaaaccgaagaaatattagaagacggcaaaagaggagaattggtcttgaccaaccttacaagagaaggaatgccggtcatcagattcaggacaaaggatatgaccgcacttagaagggatgaatgtccttgcggaagaaccactgtaagaatggatagaatcactggaagaagcgacgacatgctaaaaatcaaaggagtcatggtttacccatcacaaatcgaaacagctatcctacagattgaaggattgactgcaaactatcagattcatgtatcaagacctcatacccttgatgagatagaggtaaaagtggaaacctcacctgaagtattctcagatgagatgaaaaagatagaagaatttgaaagaagaattgccaaaaagattcaaagcgctattggcataagcgtggatgtgactttagtagagcctgaatccttgccaagaagcgaaggaaaagcaattagagtaattgatgagaggaactttgattaa

SEQ ID NO: 1390 - DNA, 432 bp, Methanobrevibacter ruminantium
atgagcgtaaaacaactttccgtatttcttgaaaacaaagagggaaaattaaaaaaagcagttaatgcaatgtcccaggctggagttaacatcagagccctttccattgcagacagctccaaatatggaattttaagattaatcgtttcagacaacgaattagctataaaagccttaaaggaagaaaactttacagttaaagaaactgaagttattgttgtaggagtaaaggacgaaccaaacggattgaacacaatgcttgaaatccttgaaaaagagcatattaatgtggaatacctttatgcattcgtcagctccaagactgatgaagctattgttgttgttaagattggaaactatgaagacggtttaaaagcacttgaaaatgctaatgcaaacctcttatccaaagaagatttagctgaattataa

SEQ ID NO: 1391 - DNA, 279 bp, Methanobrevibacter ruminantium
atgccttttaaaatcgatagtgctattgttaaaaaagatatggactccggcaaatatgatttggtggatcctgaaggaaaattctcacaagcggatgctttaatggtcattaatagtgatgatttcattactgtacaacttataataaatgctattttaagaaatgactttaaagcatggaaagatgtaaaatgggaaggtggagacagtcttaaatcccttttagttaaattaggatatggtaaagaagaaatagttgaaatgttaaaggaattttaa

SEQ ID NO: 1392 - DNA, 3177 bp, Methanobrevibacter ruminantium
atgcctgttgataaggatattaataaagtgcttataattggttctgggcctattcagattggacaagctgctgagtttgactactccggttcacaagcttgtaaatcacttagggaagagggtttggaaactgttctagttaacagcaatccagctaccattcaaactgatatggatatggccgatacagtttatacagagcctttaactgcagagctagtagctcaaattattgaaaaagagaatattgatgcgatactacctaccatgggaggacagaccggtttaaacattgcaactgaacttggaaaattaggtcttttggaaggaataaaggtcataggttctgacgttcaaacaattgcagatgtggaagacagagacctctttgctaactttatggataggctagatgagcctattcctaaatgtcatgcagtggaatctgttgaaggggctttagaagctgtcgaagaaatcggataccctgtcatcgtacgtcctgcattcactttaggaggtaccggtggaggaatagcccacaataaggaagagcttattgaggtaaccacccacggtcttgacatgagttacatcaaccaagtattgattgacgaatccgttttaggatggaaggaaatcgaatttgaggtaatgagagacaagaacgacacctgtattatcgtatgtaacatggaaaatgtggaccctatgggaattcacactggagacagtatagtggttgctcctattcaaaacctgaatgatgaggtctgtcagcgcctaagagacgcttccattaagattatcagaaaccttggaatcaatggtggatgtaatatccaatttgcattgaaccctgaaaccaacgaatacaagattattgaagttaacccacgtgtaagccgaagtagtgcgctagcatccaaggctaccggttatcctattgcaaagatctcctccaaggttgcacttggacttacattggatgagattcaaaacgacattacaaaagagactcctgcttcctttgagccatccattgattatatcgttgtaaaaatcccaagatggccgtttgacaagttcaaaggaatcgacagaaagattggagttcagatgaaggcaacaggagaggtaatggctataggaagaacctatgaagaggccattcaaaaggctatccgttcattggatatcggccttcatggattcgagtatcttgaatacactgaagacaaccttgcaaaccctaccgatgaaaggctcttccatatgtactctgcaatcaaggacggaagaagcgtagaggagcttgcagagctctctaagatggatgcattcttcctatacaagattgaaaacatagttgagtttgaaaatcaggttacaaaagaggctcttgaagatgaagaattcttgcttaaggctaaaaaattaggattctccaatttcacacttgcaaagcttgcaggaattgaagaagaggatgttaaagcacttcttgataaatttgatattaagccatcctataagatggtagatacctgtgctgctgagtttgaagctaaaaccccttattattacagcagctatgacaaaggaaatgagcttgtaaagtctgacaatagaaagattttgattatcggcgcaggtccaatcagaatcggtcagggaattgagttcgattactgttgtgtacattcttcccttgccttaaaggaccaaggaatagaaacaattcttgtaaacaacaaccctgaaactgtaagtactgactatgacgtttcagatgacttgttcttcgaacctttaacctatgaggatattatgggaatcattgaacaggtagagccagagggtgtcatcgttcagttcggaggtcaaacatcaatcaatctctctgttcctcttgcaaaggctggagtcaagatattaggtactccatatgaaagcattgatagggttgaagacagggaaagattcactgaagtattgaatgacttgcatattcatcaggccccttatggattggccaattcatttgatgaggcaaaagaggcagcagaaagaataggcttcccagttcttgttcgtccgtcctatgttatcggcggaagggcgatggaaatcgtctatggtgtagatgagcttgaggaatatatgaaagaggctgtaaaggtctctccagagcatcctattcttgtggacaagttccttgaagatgctgtagagcttgatgtagaccttttatgcgacggggaagacgtattcattgcaggtattatggagcacattgaagaggctggtgtccactcaggagactctgcttgtgtaatacctcctcaaaccattccagagcatttgcttgaagtaatcagagaaaatacaagaaaattggctttggaattagatgtcattgggctcatgaacattcaatatgctgttaaattggatgaggaaagagtttacatcattgaagctaacccaagggcgagcagaaccgttccatttgtaagtaaggcaattggtgttcctcttgcaaaggttgcaacctccttgatgatgggcaagacccttaaggactttaatttaaccaaggaaatcaagatcaatcacgtagctgttaaggaatctgttttcccattcttaaagcttacagaatctgacagtgtcttaggtcctgaaatgaaatccacaggagaaagtattggtattgatgaaaacttcggccttgctttctataagtcacagctttcagcgggaatggacttgcctaaggaaggaaacctcttcatcagtgtaagggaacaggatcagcctaagattcagccgattgcagagaaggctcatgctttaggatttaatataatggctaccaagggtacagccaattcaatatttgatgttcctattacaagggtcaagaaggtttcccaaggacagcctaacattaaggaagcaattttagatggaaaggttgatatgattattaacactcctcatggtgaacaggcttctaaggacggctatacaatcagacgtttagctgtagagcttggaattccttatgtgactaccttagcaggagcaagagctgctttaaatgcaattgcagctgttaaggaaaatgatttaaaagttaagtcattaaatgagcacattgctaatatttaa

SEQ ID NO: 1393 - DNA, 1080 bp, Methanobrevibacter ruminantium
atgggaaatgaagcaaaattagctttggaagatggaactgtcctaaaaggtaaagcctttggttatgaaactacgactgtaggtgagcttgctttttcaactggcatgtccggttatacagaaagcctaacagacccttcctttaagggacaaatattaatgagcacatatcctttggaaggaaattatggtgtaagcgaagattggtatcaatctgacagtgttcatgtagaaggatttgtagtaagggaagcatgtaagaaattatccaatttcggaactaaaaagaccttggatgactttttaaaggaattcaaagtatctggaatcgaagatattgatacaagggacttgactttaaaaatccgtgagaaaggttcattaaaggcagcccttgccactgaagagattgatgatgatgaacttgttgcaaaggcacgtgaacatacaagcatcactgaattggatttggttccattggtttcaactccagagattaaggcttttggagactttgacaagactgtagctattattgactgtggagttaaaaggaatatcattaaatgtttccttgaaaacaatattggcgttgcccttttcccatatgatacagattatcaaacaattcttgattatggagttgatgggcttatggtctcttcaggccctggaaaccctgagagattaaccagcacaattgaaaatgtggaaaaattgcttaacagattccctgtattcggaatttgcatgggtcagcaagtaatcgctaaggcatttggcgcaacaacatataaaatgaaatttggtcacagaggagcaaatcagccagttaaggacttaaacactggaaaagtgtttatcacttcacaaaaccatggattctgtattgatcctgaatctttagctggaagtgacttggaactcaatcaaataaacttaaatgacggcactcctgaaggatttttgcataaggaattgcctttaaggaccattcagtatcacccggaatccggtcctggacctaatgatactaaggtcttgtttgaagagtttggccaaatgattagggagtactag

SEQ ID NO: 1394 - DNA, 750 bp, Methanobrevibacter ruminantium
atgtctcattttgataactctgattttaataaggatttagatgtgaataatcaatatgatccagtaaaaggcaatgataaagcattcaatggcaaatattcacttaatttttcaatctctcataatgatcctaatttctctaatcttgcaatgtcttctagtataatctctgaaaccactcttgaagaagattgcattcttttaaaaaagaaatccttgcttaagcgaaagtctttaggctctcaaaagatttattatagggaaattcttgaattggacttgattaagtccactctatcatctttatatagttccataaggatagtttattctaaaaacggatattctaagagggtcttgtctttaagcagttctgatggatttgctgtaaggtggttttatgatgccttggttgtgaagtattcctatgtcaagtctggtttggataaaaagtatgattttaattcaaatgagtctgattggatagaagcgaatgaatctaataaaaatactagtttatctggtgatttaactaattctaatgatttaaatgattcttctattaaagaagatgatttgaataattctaatggctccaattctggcgatgaatctcataattctctttcttctaaacagtctaaattgtctgattttgtctctcaaatgaataaggagctttcagaggaagaaactagaagcttaaaaaagaaaatgaaatttgagagatgttctagcggagaatactaa

SEQ ID NO: 1395 - DNA, 231 bp, Methanobrevibacter ruminantium
atgaatcaattttgtccaaaatgtggtgcaaagcttttagacccttatgcaaagttttgtagtcaatgcggcactaatcttactgaaaagaaagaaataaacattgatgaattgcctgaagaaagaattgacttaagagaagggatgacaaacaccaataaaggaatgtacagatacacaaaatggggaagacgaaagaaaaaacctgtaaattgggatatggaaaagtaa

SEQ ID NO: 1396 - DNA, 351 bp, Methanobrevibacter ruminantium
atgagatcattagaggaaattggagctaaaatagaagaattaaatgataaaattgcaggaatcagagcagaagatgaggaaaatctaacaaatgaacttaaagtcattcttgcaggttccgaattgcagtcaatcatattaacaagcacattaacaagcaaagaacagcaagttcgagacttgcttgataaatttgtacaaagaggggatgagcttaacgaaagatacgaagaggcatctatagaagatgatgcagctgcaaaaaatcaattgcatgctatgatttggaccaatgacataagaattgacaccctcaaatgggttcttgaagaagaagatgttggaatttaa

SEQ ID NO: 1397 - DNA, 930 bp, Methanobrevibacter ruminantium
atgacttctcaaactagcgaaaaagaaaatcaagagttaatagatagtttaaacaatgaaatagactatctgaaagagattctaactagcaagatctttgaagaagagcatcttttaaacttcacctgccgtgacattgaaacagattatgccttgaaatttggagtttataaatacaaaataaaaggatataaacttaaaattaaaaaaacaaaaagaacaattgaattaatcaaaaaaatggtcaatagacaagagataaatctattcaataaaaaactagaggaaatgcagccaaatcaagcaaaaatcaatgaaaccaagataaataaacctcgattgaatatgaaggaaatcgaagaccatattgaaaatgaattcaaagaagaggacattgaactcgaaacagagactgcaagaacaaacatccttatcgaagagcatagaaataatctggatagaagagtgcctgttagagaaatagatgctctttataaggaatgcattagaaaaatgcatcctgatttattattcaatccaacagaatatgaggaaagcctatttttcaatgcaaaggaagcttatgaggatagagatttcgaggaattggaagcaacatacaaccttatacacacccataagattgaagagactcctcaaacagttgaagagatggaaagattcatagaacatttggaaatccatataaaactagaagaaagagagatttccaatataatcaactccaaaccatatactcaacagaaattccttctaaaccaaaaaaaggtaaatgattatagagaaggattagtcaaatcccttttagaggttgaaaaagagtatattaaatgtaaaagagagttaactgatttgaaatcaaaaaataacttaagctacaaattagatttaactaaaaaggacaattaa

SEQ ID NO: 1398 - DNA, 447 bp, Methanobrevibacter ruminantium
atgcttattcgcgaatttcttccatctgatctggctagagtttatcaaattgaggtagaatccttttcaacaccttatgatattcctattcttaagcaattatatgatattggtgcaggatttcttgtagcaactgaaaatggtcaggttgttgcttatattattttctggcttaaagaggaaaacttaggtcatattatcgctttagctgtagatagaaagtttaggggtcaacatatagcaactaggttgcttatgatggctgttactgttcttagaaattgtagcgttcctaaaattaccttggaggttaaggctcaaaatactcctgcaattagcttctatgaaaaattcggctttaaaatagagaggaaagttccaaattactatgaagatggatctgatgcctatgtgatgtacttttatacagattccattaaaaattag

SEQ ID NO: 1399 - DNA, 414 bp, Methanobrevibacter ruminantium
atgtgggatgacttagaagaatacattgagaatctatctaatgattatagctcaaagaacaatagaaaaacaaagattgtagagattggagttggaaaattccaaacaatatctgaccatttaagggaaaatgaaaacatagagcttataatgaccgacatagaccctgcaaatgagaatgtcgttaaagatgatgtgtttaatccaaatatggacatctacaaaggtgcagacataatattttcaatcagacctccaggcgaaatacaagaagccattatgaaaatcagagatgaaatagattgcactttaataattaaacctttatttaatgaagatttaaatataaaagccaaaggaatgaaattgaaaaattataatagggcttcattttacatttatcaaaaggaataa

SEQ ID NO: 1400 - DNA, 309 bp, Methanobrevibacter ruminantium
atgaatcaagcaagaattaagcttactggaactgatcctgaaaaacttaactatgtttgtgaccaattaaagaaaatctctgaaagaactggtgtagatatttccggtcctattccattacctaccaaaaaattagttgttcctactagaaaatctccagatggagaaggaaaagctacttgggaaaaatgggagctccgtattcacaaacgtttagtcggtattggtgctgacgaaagagctatgagacaagttatgaaagttaacgttccagataacgtaagtattgaaattgaacttaaaaactaa

SEQ ID NO: 1401 - DNA, 1242 bp, Methanobrevibacter ruminantium
atggcaaaagaaaaagaacatttaaatttagcatttattggacacgttgaccacggtaaatccactttagtaggacacttattattaaaagctggtgctatcgctgaacaacaattagatgaaggtgaagacaaattcagatttgttatggacaaattaggagaagaaagagaaagaggagtaaccattgacttagctcaccaaaaattctccaccaacaaatacgactacactgtagtagactgtcctggacacagagacttcgttaaaaacatgattactggtgcttcccaagctgacgcagctgtattagtagtagctgctaacgacggtgtaatgccacaaaccaaagaacacatgttcttatccatgactttaggtattaaacaattaatcatcgcaatcaacaaaatggacatggttgactacagcgaagacagatacaacgaagtaaaagacgaagtatccgacttactcagatccatcggtagagaccctgcttccactcctttcatccctatgtctgcatttgaaggagacaacatcaaagaactctctggcaacatgtcatggtacaaaggtgacgctttaatgactgctttagacaaattagtaccacctgaaaaacctgtagacttaccattaagaattcctattcaagacgtatactccatcactggtgtaggtaccgtacctgtaggaagagtagaaactggtatcatgaaacaaggagacaacgttatcttcgaacctgctggagtttccggagaagtaaaatctatcgaaatgcaccacgaaactttccctgaagctgaacctggtgacaacatcggattcaacgtaagaggtgtaggtaaaaacgatatcagaagaggagacgtagctggacacactgctgacgctccaactgtagctaaagaatttactgcacaagttgttgtattacaacaccctggcgtaatcaccgttggatacacccctgtattccactgtcacacctcacaaactgcatgtactttcttagacttaacttccaaacttgaccctgctaccggtcaacctgaagcaaccaaaccagacttcattaagactggtgacgcagctatcgtacaaatcaaaccaaccaaacctatggttatggaagaagctgctaacatcccacctatgggaagattcgctatcagagatatgggtcaaaccgtagctgctggtttatgtcttaaagttactgacaaaaaataa

SEQ ID NO: 1402 - DNA, 2208 bp, Methanobrevibacter ruminantium
atggtgatgattttgagtagacgagacaaaatgattgcaaaaatcaaagaattgatgtaccaacctaaaaatatcagaaacataggtatctgtgcacacattgaccacggtaagaccacattatccgacaacctcttggcaggtgctggaatgatttccgaagagcttgcaggagatcaaagattcttggatttcgacgaacaagaacaagctcgtggtattaccattgacgctgcaaacgtatccatggtacacgaataccatggcgatgaatatcttattaacttaatcgacactccaggtcacgttgacttcggtggagacgtaactcgtgcaatgagagctgtagacggtgcagtagtagttgtatgtgcggttgaaggtatcatgcctcaaactgaaaccgtactcagacaagctttaagagaaaaggttaaaccagtattattcattaacaaagttgacagattaatcaacgaagtaaaattaggacctgaagagttagcaaacaagttcattggaattatcaatgaagctaacaagttaatcactaaaatggctcctaaagataagaaagacgaatggcttgtaaaagtggatgacggtagtgtagcattcggttcagcataccacaactgggctatcaacattcctatgatgcaagaaaccggaatcaacttcaaagacattatcgattactgtaatgatgaaaatcaaaaagaattagctaagaaagtacctttagctgatgtattattaggtatggtagtagaacacttgccatcccctgaagtttcccaacaatacagatgtcctaacatttgggatggagacattgaaagcgaagctggtcaaactatgattaataccagccctgacggacctttagctgtaatggtaaccaacgtatctgtagataagcacgctggtgaagttgctaccggtagagtatacggaggtactgtagaacaaggtagtgaagtctacttagtaggaggtcaagcaagatccagagtacagcaagtaggtgttttcttcggtcctgaaagagttcctactgaaaaggttccagctggtaacattgtttacattaccggtgcaaaaggagctaccgctggggaaaccatctgttctcctgaaaacaagattgtagagtttgaaggaatcgaacacatctccgaacctgtagttaccgttgctgtagaagctaaaaacactaaggacttacctaagcttattgaagtgttaagacaaactgcaaaagaagacccaaccattcacgttaacattaacgaagaaaccggtgaacacttagtttcaggtatgggagagcttcacttggaagttattggtgtaagaatcaacaataagggtgtagacatcctcacttccgaacctattgttgtatacagagaaactgttgcaggaaaaactccaaaccctgtagaaggtaaatctccaaacaagcataacagattataccttgaagtttcacctttagacgattcaatatttgaagcattgcaaaacggtgacatcaaggaaggtaaaatcaaagctaaagaagaagctcaacaattcattgaccacggccttgacaaggaagaagctagaagagtatgggatgtttacaacaagtccttattcatcaacatgacccgtggtatccaatacttagatgagatcaaggagcttgtcattgaaggtttcgaatctgcacttgaagaaggtccagttgcaaacgagattgcaatgggaatgaaattcactcttgtagatgcaaagcttcacgaagacgcagttcacagaggacctgctcaaatcttgcctgctatccgtaacgctattaagggtggtatgatgatggctgacccaacattacttgaacctgttcaaaaggtattcattaacaccccaactgactatatgggatctgttactaaggaaatcctaaacagaagaggtcaaatcatcgacatgccaactgaaggtgatatggtaaatgttgaagctaaagtacctgtagctgaaatgtttggttttgctggtgagatcagatctgcaactcaaggcagatgtttatggtctactgaaaactctggattcgaaagattaccaagagaattgcaaggtcaaattgtaagagaaattagacaaagaaaaggattggctcctgaaccattcggtccggaccactacttaggataa

SEQ ID NO: 1403 - DNA, 561 bp, Methanobrevibacter ruminantium
atggctaaattatttaacaaatgggaccttgatgaagtggaagtggaagacttaggtttaaagagatacatttgccttgatgaaaccattgttcctcataccttaggaagacacgtaaaaagacaatttgcaaaatccaatgtttctatcgtagaaagattaatgaacaaaatcatgagaaccgaaagaaactccggtaaaaagaacaaagcttacaatatcgtaaaggaagctttagaaattatcaatagaagaactaaacaaaaccctgttcaagttttagtaaaggctattgaaaacacctctccacgtgaagaaactacccgtatcaaatacggtggtatcggataccaagttgctgtagacatttctccacaaagaagagtggacctttctttaggattcttaacaagaggaactttacaatccgcattcaaaaacaaaagatctgttgctgaatgtttagcaagtgaaatcatctttgcttctgaagaagatactagaagtttcgctttacagaaaaaagaagaaaaagaaagagttgcaaaagcagcacactaa

SEQ ID NO: 1404 - DNA, 426 bp, Methanobrevibacter ruminantium
atgccaggactttttgctgcaaaaaagcttaaaaagaatagacaaaattttaaatggaaagacgtagattataaaagaagagcattacgtttagatgtaaaagcagaccctctcgaaggggctcctcaagcaagaggaatcgttattgaaaaagtgggagtagaagctaagcaacctaactccgctatccgtaaatgtattcgtgtacaattaatcaaaaacggtaagcaaattactgcattcgcaccaggtgacggtgcaatcggttttatcgatgagcacgatgaagtaatgattgaaggtatcggcggaccatccggaagatccatgggagacattcctggagttcgttggaaagtaagtaaagtcaacaacgttgccttatctgaaatggtaagtggaaagattgataaacctgtaagataa

SEQ ID NO: 1405 - DNA, 405 bp, Methanobrevibacter ruminantium
atgagattcattgctctttttgagagtatgactggtgcaatggttaaggattgcattattgacgatgaaaattccaaggttacctttgttgttaaaaacggagatatgggtttagctattgctaaaggcggaactaccgtaactaaagttaaaaaggcagttggaagaggtgtggaaatcattgagtataatgaggacccagaacagttcattaagaacatcttatctccagctgaattgaagtctattaagattgttactaaaaacaatgatgaaaagatagcttttgttaataccgattcttcaaacaaaagaatagcaattggtaaaggcggaatcaacattgaaagagcaaaattattagctaaaagacaacacaacattagcaatattgttttaaaataa

SEQ ID NO: 1406 - DNA, 300 bp, Methanobrevibacter ruminantium
atgatggacgtagaaagaggaataagagtcgctgtagacacaggagatgtgaccctcggctctgaaaaatctattcaatctttaaaattaggtaaaggtaaacttgcagttgttgcagctaacagtcctaaagaaattttagaagacgttgaatattatgcaaatctctctgaaattcctttcattgtatatgaaggtactagtgtagacttaggttctgtttgtggtaaacctttcactgtagctactttaatcataaacgatccaggagattctactatcttagaagcaatggggtag

SEQ ID NO: 1407 - DNA, 1245 bp, Methanobrevibacter ruminantium
atggcaaaatatgacatttcaatgattaaagataataactattataaagaacaatgtgaacatgctgaagaatctctaaacaaaaaatggtattctgaatcaattttaacaatggcaataactcttgaagaattaactgaagaattaatcaaatataccaaaaatatttccgatggaaaattaagtcaaagagataagatatggatattaaaagataatggaatcaccaattacaatatatataactatttacgtgaagcaaacatctcaagaaacaaattagtacatggagaaatacctagaaattatagcaatactttttcaatgtataaaaactttttaaaaattgtattttggtatgatgaaaattatgtaattggaaaacttaatactaaaagtaaactaaaacaatatttaaataaagtttgtgatgattcacatatcctcaatatcatagaacaagaaattaatgatggagcaataactgaaaatcatcaaataattaaaagacataacaaagagttaattgattatgttgaatctttaaatatagaattagaaattaaagaaaaattaataaaagacatatattctggagttacaaaaaataggtcccaaatagaagaaaaaattaagagagaaaagaaagatcctataataggtgttgtaaacatagtaaatacagaaaacatgatgaaatacacaatccaatcaacagatattgacaaagaagtaaaagaaaacatggaaaaactagaaaacaacacacacgaaaacaaacaactacaagaagactacaacaaatacgggccggaatcattcactacagaaacagtaaacatatgcaaaaacgaagaacttagcaaaataacaaaagaagacgaaataatattcaatgcaaacaaatcatataataatcgaaaaaaagatattaatcctaaaataggcattgcaaacataattaatacagaaaccctaatgaaatacacaatccaatcaacagaccttgacaaagaaatcgaagaaaatataggaaaactagaaaacaacacccacgaaaataaacaactacaagaggattacaacaaatacgggccggaatcattcactatagaaacagtaaacatatgcaaaaacgaagaacttagcaaaatattaaaagaagacgaaataatattcaatgcaaacaaatcctataataacaataaaaaagaagaaaccggagaaaaaaatcataccctgtaa

SEQ ID NO: 1408 - DNA, 1755 bp, Methanobrevibacter ruminantium
ttgttagggggtattaatttgaataatgaagatattataattggtattgattttggaactacaaattctgcagcttgtatttataaagatgaaaaatttcaaataattcctagtgctatgggttatgattatttccctagtgttgttgcagtaaatgaaaatggtgaattgctagtgggacatcatgcaaaaaagcaaatggcaagtaatgctagtaattctgttgcagaatttaaattaaaaatgggtgaaaatgaaactattaaatttaatggtgaagataaacttcctcaagagattacttcttatgttttaggtcgtataaaaagagatgctgaagcttatttaggtaaacctattaataaagcagttattagcgtacctgctagttttgataatgatgctagaaatgcaactatggaagctggggaaattgctggttttgaagtcgaagctcttgttgatgaacctacagccgcatgtttgacttatagtctcacaaaaaattttttaggcaatattttagtattcgatatgggagggggcactttagacattatcattggagcctttgatggttctgaacttgttccaaaagtcactactggagctagatttggtggtcggaatattactatggctttgcgggattatcttcaaagagactttgaagaacaaaatggattaaagctagaagattatataactcctgaatatgatcctcttattgatttgtataatgctactgaaatcgctaagatagaattatccagcaccaaaactactaatgttcatatagattctattgtaatgactgataaagggcaacgtattaatttggataaaaatgtaaaccggtctgatttaaataagttatctgatgaagttgtaaaaggaagtaaagaaaaagttcttgaggcacttaaggatgctaaattaacaaaagacgatattgactttttggtttttgttggaggccctactaaaatgcctcttattagggaaagcattgaaaaacttttaggcaaatctgctgcagaaggtattgatccaatggtatgcgttgctcaaggggcatccatatataaagggggtccaattacagtaggcactattaattctttaacattgagtgttgtaattaatgaaaaagagtctgatccacttattccaaaaaacactcctcttccagcagaagttactaaagaatatcatactatgcgtgataatcaaacaagtgcaaatattcaaatcgttgagggagaatctattcttgcaaaagaaaatcatacacttcactcttttactttaaggggacttcctccaaggcctaagggcgaagtcgcaatccaagttaaattaaaagttgataaaaatggaataatgggattgtctgcaaaagaactaagcactaataaaaaattatccgcgacattcgattcaagtaaccgtatgtctagtgaagaaattaagaaggcaggtttagataatgagaatcttttaagtgattatgaagaaaagattaaacaaagaaatattattaacgatgctgaggaagttattttcgaaggaaaaaaactaatcgagaactatagtggccatatgttaatatctgataaaaatagagttaacgagaatattgaaaaacttgaaggtttgttagttattccaaaaaattttgaattaattaaattaattactaaagatcttcgaaatttaattgaaaaaattgaatctgaagatttttattattaa

SEQ ID NO: 1409 - DNA, 2052 bp, Methanobrevibacter ruminantium
gtggtaaataaaggttctaatgatgattttaattgtaataattgggagcttggccgtatttttgcccgtaagggtaattttactgaagcagatatacgttttgaggctgagttaaatcattctctttctcctaattctcttgttcttgatgaccatggccatcttttgaataggatgggtaaatatcaagatgctattgataaatttagaaatcttttaaatagtgatgaaaattatgttagcagtttatttggtattggtatttcttacattggcttaaataagttgggtgatgctttaaagtattttgaaaaagttaatgaacttgatgaagaacatgcagatgcttggtactactctgctataatttatggtaatccattttatcctaagtatgatcttaacgttgcaaaaattagatataaaaattatcaaaaatcaaaagaatcatatattaatgatcccaagtattttagtaaaccctttgataatttatcttgggaagaattgcatgattactataaatgcaatagcctatttcgtataattgaacaatctctggataaagggattcttgatgaatttttaaacttttctaatgactataaaagattgtattgttttgatgaagagggtttggacaagcaatttgatatttttagattatttgaaaatgatactcctttagcagataaaattgataaattccatgaagataaaaatattgaagacaaatttgaatctgcaggttttgaagaggatttaattgagggtttatcctttaaacttggaatgatgtctattgatgataaaaaaatgttgaatgaacttatggattattctaaaagttcacaattaagtttcaatgatattaatgatttaattcgtgaaaatgttttagacgaggatatgtctctcgatgacttttatgaaaatagggaatatatagttaaaaatcgtattaaaaaaaataattctgaatatgaaaggaatgttgaaaaaagagtaaatactgagttaaaaaaccaaattgcaattaataaaaggttaaatgataatttaattgaaaaggatgaagtgattgaaaagttaaatgataatttaattgaaaaggatgaagtgattgaaaagttaaatgaaaatttaaatgataaagaggaagtgaatcaaaaaatagaagataagttgagaaataattatgaattattatctgatgaaaatataaatcaaccagaacatcgttttgataattatgatttttcaactaaggagattaaatcttctttttctggtttaaaagaatcaatggattcatatttggaagatatggaatcttatttgaatgagtgtcaagatgtaagttctatgaatattctttcaggtattaataatcagtgttatcaagatgatttggaatatattaaaaatgaatgtggtatttccgatgttgatcttaaaactttaaaatctgcttttaaagacttttataatggtaagtttggatctgcttcttataatttcagtcttgaacgtctaagaaaaacaattggaaaaacatctgaactcaaaaaatataggtattttttaaaattaacttcaaagtctcgtgaaaagatacttgaagaagaagactttaattggcttattattaaaaatttaaagttaaaagattataaaaatgaaaaagaaaagaaaattaataaaggaaaaaaacttaaaaaagaaaaatatcctataggatggtttaatttgggcaatatttgctttgattatgcgaattcacaatctgttaaaactactgtaaaagcaggaaacaatgctatggatgcttatgagttagcatatttttgttataaatgtgccgaggatagtatttctaatcaggaagaaaactcaaagtatgagtttaattttaaggacacaaaaaacgaacaagaatttaaaaacaatgttgtgaggatgatttctaattgtgaaattaagattttgcaacaagaaattaagggcgaattaaaaaaattggataaattacaaggaaaatttaattggtga

SEQ ID NO: 1410 - DNA, 1638 bp, Methanobrevibacter ruminantium
atggtagatgctgaagcaaaacttgatgcaattaaaaaggttgaaaaagtacttaaaaagaataaaattgactttcctcaaagttatattgatgaattggcaagtgcttatatcagaagagatttgactgataaggaattgaacactttagttcttaaggtcgaagaagcttatgaacgtgctcatattgaagcaggtgaagctgtaggaactgttgcagctcaatctgtaggtgaacctggtactcagatgaccatgcgtacttttcactacgcaggggtagcggaattaaacgtaacattagggttacctaggcttattgaaattgtagatgcaaggaaaaagatttccactcctacaatggacatttacttcgaagatgagtacaagaacgacgaggaattcgtcagaaagttagcaaaccaaatcggtaaaagcacaatcaatgatattttagctgattatgacattgactacttcaattataagattgtcactgtacttgacaatgagaaaatcgagtctagaagacttgatatagatgatattattagtcgtgttcaaaagacattcaaaaagctcgaaatcattaattatggtgacgatgagcttattgaagaagaggctaaagatattgaagatgtcgattctgatgttgaagaaaccgacattgctaaggtcgataaagtggatgaaactggtatggctaaagcggattctgatgctgaggaaactggtatggctaaagctgattctgaagaagatagtgaaactattcaagtttcagatgaagaagtccaagagccttccaacatcaatcttaaaaaatcagatgaaaacattacattaatctttgaacctagcaaaagaaccatcagagaacttagacttctcggtgataaggtccgtgacttgcagattagtggtaccaaaggtatcggtaaagttattattcgtaaggacgatgctgaatgggttcttcataccgaaggttccaaccttggcgcaatctttaagattgaaggtattgacaaggtaagatccactacaaacgacattcacgagatagaagttgttttaggtattgaagcagctcgtaatgctattgtctatgagcttaaccgtaccctatctgaccaaggtttgactgtagacatcaggcacatcatgttggttgcagacatgatgacttccgaaggaactgtcaagtccattggtagacatggtatcagtggtgagaaatcaagtgttcttgctcgtgctgcattcgaagaaaccggtaagcacttgcttcacgcaagtatcagaggagaagttgatgatctcactggaatcattgaaaacattattataggtcaacctatacctcttggtacaggttctgtaagtgttacaatgaaaccagatgcatatcctattactgcaggtataactaaacgtggtaaaggtaagtctggtggtagtgcttctgaatctaaggaggttaatagtggtattgctaaaggcggtaaaggtaagtctggtggtagtgcttctgaatctaaggaggttaatagtggtattgctaaaggcggtaaaggtaagtctggtggtagtgcttctgaatctaaggaggttaatagtggtattactccctga

SEQ ID NO: 1411 - DNA, 2781 bp, Methanobrevibacter ruminantium
atgtcaccagatcaaattagggaaatgtctgttgtaaacatcaccagaccggatacctatgatgaagacggatatccaattgaaaatggtttgatggactctcgcttaggagttattgacccaagtttaaaatgcagaacttgcggtgagaaaggaggagagtgccaaggccactttggtatgattgaccttgcaagacctgtaattcatgtaggtttcggtgatgacattcataagatattacgttctacctgtaatgaatgtggacgtgtcctattggatgaagaagagattgaagagtatactgaaaagttaaatgagcttcaagaagctggagaaagcacagaagatctcataaaagaagtttacaaaatctgtaaggctaaaaaggcaaaggatgtctgccctcattgtggtgctgaacaggaagacattaaaatcgttaagccaatcggcattattgaagtacgtaaggaatacgatgaaaacggagaattgcttacagatgcaaatggaaatcctgtaacaacagattatgatttaacagcatctgaagtaagagaaaagttagagcgcattccagatgaagacgcttatgtattgggagtaaaccctgaagttgcacgtcctgaatggatggttcttactgttcttccagttcctcctgtaactgtaaggcctagtattacccttgatactggagaacgttccgaagacgatttaacccataagcttgtagatattttaagaatcaatcaaaggcttattgaaaacatggacgctggagctccacagcttattgtagaggacctctggcagttattgcaataccatgtaacaacctacttcgacaatgaggcaagcggagtacctcctgcaaggcacagaagcggaaggccacttaagaccttggctcaaaggctcaaaggtaaggaaggaagattcagaagcaacctttccggtaagcgtgtaaacttctcagcacgtactgtaatctcccctgaccctaacatcagtattaacgaagtaggtgttcctgaaatgattgcaaaagaggtaactgtacctacctatgtaaacgaatggaacattgaagatttaagggaagctatcctaaatggtcctgatgctcatcctggtgcaaattatgtaagaaaatacaatgacagaatcaaagattacaataaggtcagagtattggattccaataaggaaaccgtagctgaaatgttaacttgcggtgacattgtaatgagacatcttaaggatggagacattgttttattcaaccgtcagccttcccttcaccgtatgagtatgatggcccacgaagtaagggttcttccatacaagacctttagacttaacctttgtgtatgtcctccatacaatgcagactttgacggagacgaaatgaacatgcacgtattccagactgacgagtcccgtgcagaagctaaatcccttatgagagtacaggaacacattttatctcctcgtttcggaggacctattatcggtgctattcacgaccacattagtggagcatatcttttaacccgtgacggattcaccgtacctgaagatgacgctttccaaatgataagaaaatcccacttattgaaatgcccttatgatgaatatcttaaaagggatcttgatgagaaggaatataaacagcaaatcaaggaatacaatgaaaagctcaaacgtaaacacagagattggactggaaaagaattattcagcttactacttccaagcacccttaacatgaattacagagctgaaatctgtagaaaatgtgaggaatgtatggcagaagcttgtgaatacgattcttatgtggttattaaggacggtcaattgacccacggtgcaatagacgaagctgcatatggttctttctcaggtaaaatcttggataatatcgttaaggaatatggtccggcatacgctaaggaattccttgaccgttccactgaccttgctatctgtggaatcatgaaaacaggtattaccacaagtaccaacgatgaggaaatccctgaagaggctattgaggtaattgacgctcacttggataatgctgaacaaaaggtagataaattgattgaaacctatgagatgggcgagcttcaaccattgcctggacgtagtgcagaggaaaccctggaaatgcgtattgtgcaagttctaggggaagctagggacgcagcaggggacattgctgcaggttacctcactatgggtaagcaatccccagacgattcctatgaccatgtgatggctgtggaaaaccactctgtagttatggcaaagaccggtgcaagggcatccatgttgaaccttgctcagattaccgcttgtgtagggcagcaatctgttcgtggtggacgtattacaagaggatatcttgcaagaccgcttcctcactttagaaagcacgaattaggggctagagctaaaggatttgtacattccagctacaaagaaggtcttgaccctgtagaattcttcttccacgctatgggtggaagggaaggtcttgtagatacagcgattcgtacagcacaatccggttatatgcaaagaagacttgtaaacgcacttgaagacttgaatgtaagatcagacggattggttacagacaataagaatcaggttatccaaaccgtatttggtgaggatggaatagacccagcaaaaagtgactttggtaaagtggctaacttagacaagcttattgacgaaatgagaattaaagatgagggtaaataa

SEQ ID NO: 1412 - DNA, 1812 bp, Methanobrevibacter ruminantium
atggttaaggctaaaatttatattaacggtaaacttacaggaacttgtgatgaacctgaagagtttgttaaggaaatgcgcgctagaagaagatctggcgagattcacaatgaaatgaacattacctattatgatgaaaaccatgagatttatattttcactgaccctggaagggcaagaagacctttgattcttgttgaaaaaggtgagccattgcttaaagatgaacacattgaagcaattacaaagggagaattgaaatgggacaatctgtttgaattaggtcttttggaatatttggatgctgaagaggaagagaattcatatattgcaatgaacttaagccaattgaatgaagaccacacccacttggagattgacccatctaccatgctcggtatatgtgctggaattattccattttcagaccacaactcatctcctaggaacacaatggaagcagggatgacaaaacaggcattaggattatacgtatccaactacgcattgcgtaccgatacccgtggtcacttattgcaccaccctcaaactccactggtaaagacaagaatcattgatgcaatcaattatgatgacaggccatccggacagaacctggttgtagctcttatgtcttacgaaggatataacatggaagacgcaatgattctcaacaaatcctctctcgaaaggggaatgggaagatccagcttcttcaggtcctatgaggcatctgaaagaaggtatcctggtggacaagaggacaagtttgaaagacctgaaaaaggagttaaaggttacagatccgaagaagcttataaaaaccttgacgaagacggaatcgtaaaccctgaatcccatgttgaatcaggtgatgtattaatcggtaagacttcacctccaaggttccttggtgaaattgacgagttcggtaccgttgcagagaaaagaagagagacttctgtcactgtaaggcatggtgaaaagggtattgtagatgcagttctccttaccgaaaccgttgaagggagcaaattaactaaaataagagtaagagacacaagacaacctgaattcggtgacaagttcgcatcaagacacggtcagaaaggggttgtaggtctcatattatctcaagatgacattccatttacagaagacggagtcgttccggatatcattgtaaatcctcacgctattccatcaaggatgtctgtaggacaggtattggaaatggttgcaggtaaggccggttgtatggaaggtcaccgtatggacggtactccattcaatgacaatgttgaaggagaaatcaagagagcccttcatgacaacggattcgaatctgcaggctgtgaatcattatacaatggtgtaaccggagaacgtatcgaagctgaaatcttcgtcggcgttgcatattaccaaaaattgcaccacatgacaaccgataaggtttatgcccgttcaaccggacctgttcaagtgcttacacgtcagcctactgaaggtagagctcgtgaaggtggtctcaggtttggtgagatggaaagagactgtcttattgcacacggtgcagctcttgcacttaaggaaaggctcttggatgagtctgacaagtatgaggcagttgtatgtaatgaatgtggaatgttagcagtatatgataagaataagaacaagatgtactgtcctatatgtggagacagtgaaacttatcctgttgagatttcatatgcatttaaattgttgttagatgaacttaaaagtttatgtattttccctaaattaattcttggggacaaagcttaa

SEQ ID NO: 1413 - DNA, 1563 bp, Methanobrevibacter ruminantium
atgaataatgagacatggggtttggtagactcattctttgataagtatgatatcgtagatcatcatatcaaatcatataacgattttgtcgaaaatcgtatacagaatattattgacataactgaacctatcactattgaaaacgaaaagggaaactatactcttagaaccggcaagcttaccattgaaaagccattcaccaaggaagcggacggttctaaaagcatgatttaccctactgaagcaagacttagaaacttaaactactctgctcacatgtatttggaaatggcattgcatgacaataacagcgatgaagaggaagagcttgaaaacgtctacattggcgaattgcctctcatgctcaagtccagcatctgccacttgcatggccttagcgatgaggagcttgtaaaaagaggggaagaccctaaggatccaggaggatacttcattgtaaacggttccgaaagggctgtcgtaacaatggaagagattgctccaaacaagatcatccttgagagaatcgatgagattgaagatagacatgcaaaggcaatcgtaacctctatcaaaagcggttttagagcaagaatcactctcgaatacaaaaagccacgtaaaagcggcgtatttttaagaatctcattcccatatgttccaggagaaattccacttgtaatcttgcttagggcattgggattatccacagacggagagattatctctaaaatatccgatgacttcaacttccaaatgtacattgcagacgacttgcaggtttcagagaaggacttgaaattggattcagatttattattaagcttatccaacgaagaaagagacgaatatcttcaaaaggcagctatcaaatacataggtaatagggtagctaaaggaatgactgaagaatacagaataaaacgtgcagaagacgtaattgacagatacttgctcccacatatgggaatcgaatctgacaaacgttatgacaaggctatatacttagctgaaatgactgaaatgttgcttcaagtaattgaaggacaaagagagcctcacgacaaggaccactataccaacaaaaggttaagggtctccggtgacttgacggaagacttgttcagggtagcattctcctcccttacaagagacatgagctatcggcttgaaagaagcctctccagaggaaaagagctttcaatcaaacaggctgttcgttcagacgtattgactgaaaacatcaagcacgcaattgctacaggtaattgggtcggcggaagagcaggtgtaagccagctattggatagggtaagttacatggcaacactttcccaccttagaagggttgtatctcctcttacaagaagccaacctcactttgaagcaagggacttgcacccaacccagttcggtaagatttgccctaacgaaactccagagggacctaactgtggtttggtaaagaacttggcccttatgtgtaagatttcagaaggattcgatccggaagacatagtcaacatcataagcactatggacaatgtggatatgatagattaa

SEQ ID NO: 1414 - DNA, 249 bp, Methanobrevibacter ruminantium
ttgaaatttgatattttagaacataatgctgttccaaagcatgaaattttaacaaaatctgaaattaaaaagatttttagtaaattagattatgatgttagtcaacttccaaaaattaaaatagatgatcctgtatctaaggccattggagctaaagaaggggacgttttaaaaattactcgtgaaagtcaaaccgcaggtacttttattacctataggttagttgatggctttactgctaataaatag

SEQ ID NO: 1415 - DNA, 915 bp, Methanobrevibacter ruminantium
atgactaacgaaatcattaaagaaaatacagaaaagattgaagaaatcttaaacggtatcgaagaagcaatggaaaacgttaaggcaaaaagcccacttacccactgtatcacaaattttgtgactataaatgattgtgccaatgcggcattggcaattggcggatcacctatcatgacaaatgacagtcaggaagttgctgaaattggaaatatagcaagcgctattgtaataaacattggacaagtcagccaacttcagatcaattcaatcaaaaaaagctgcgaacatgcaaataaaacaaatacccctattgtctttgaccctgtaggagctggagtaagcaatatcagaaataccatcacaaaggaaatggtagagttctatgaacttacagcaatcagaggaaacatgtctgaaatcaaggcaatagttaatcttattgaccttgaaattaaagacaatgaaaagaaagactctgctggaaaaggtgttgatgtagcagaaagcgatataattacaagagacaacctttacacaaacggactgattgtaagagaacttgcaaaggaactggaaacagttgttatggcaagcggaccaatcgacatcatctcagatggagaatataccttcgcacttgaaaacggagatgcaatgatgcctcttattacaggcagcggatgtatgttaagcacaatcattggaacatatataggtgcaaatgagccattgattggagcaataacagcaagcgctttaatggcaattgcaggagaaaacgccgcagaagcagtcaaaaaagacaatttaggtccaggaagctttagaaatttcttgattgataacttatacaaagtaacagcagatgacatttctaaaagagctaatttgtttgaaatcgatttaaactaa

SEQ ID NO: 1416 - DNA, 660 bp, Methanobrevibacter ruminantium
atgtttaaagcaatgaaaaaagaggataaaatgaacaaaagcagtattgattattcagtttatttagttacagaccacagaggtaaaaccgatgaggaaatactaaatataattgaacaagcaataaaaggaggaacaagtgttgtccaaattcgtgaaaagactgcctccactaaagatttctacaatctagcactgaaggcaaaggaaataacagaaaaatacaatgttcctttaatagtcaacgacagaatcgacatagcccttgcagttaaaagcgatggcgttcatataggacaagacgacatgcctgcaaaggtagcaagagaaataattggagaagagatgattttaggtgtttcagcttctacagtagaagaagcaatgaaagcagaatctgatggggctgattatattggctctggagcagttttcccaactgcaacaaaagatgatgctgattccgtttcaaaagaagaattaaaagagattgttaattcaaccagcatacctgtagttgcaataggcggaataacaatagaaaatgcagaatcattaaaggacgctgaaatagatggattttctgtagtcagtgcaataatgaatgcagatgaccctaaaaaagcatctgaaatactaaaagagatttataatagataa

SEQ ID NO: 1417 - DNA, 1233 bp, Methanobrevibacter ruminantium
atggctaagttcaatactattgatgattttgatgtaaatggaaagactgtcctaatgagaattgacattaattctcctgtagaccctaattctgggattattttagatgacactcgtatgaagatccatgctgagaccattaaggaattatccttgaaaggggctaaaacagttctattggctcatcaaagtcgtccaggtaaaaatgactttactacattcaagcaacatgctgaagttttatccaaagcggtgggaatggatgtaaaatatgtggattctatcttctcatccactgcaaaagaagctatcttggctttggagcctggacagatattgcttttggaaaatgtaagattctattctgaagagcaattgaagcgttctccagaggaggaagccacatctgttcttgtcaagtccttaagtcctttgattgattatttcataaacgatgcatttgcagcggcccataggtctcaaacctctttggttgggtttacaactgtagttccttctgcggcaggcagagtcatggagaaggagctaactgtaattggaaatgctttagagaatgtgcagcacccttgtgtctttgcattggggggaatgaaagctgacgattccattatggttacagagaatgtattggaaaacggcactgcagattatgttcttgtttcagggcttgttgcaaacatatttatttgggcagcaggctatgacatcaaatccactaatgaaaacttcattgaggctagaggatacttggatatggttgataagtgcagggatcttattaaaaggttcccaggcaagatcatttatcctcaagacgttgcagttagcgttttaggagatagggctgatgtaaccattgaaaacattccagacgcttctatttttgatattggcagacaatcattgattgaatattctaagattattagagaagctaaaacaatatttgcaaatggtcctgctggtgtatttgaagatcctaagtttgcaatcggtacagaggatattattaatgcaatagcatcttccgaaggattttcaataattggtggaggacatattgcagcagcttgtgttaatttaggctatggcgataagatggatcatattagtagtggtggaggtgcttctattaatatgttagcaggtaagccgttagctgctgttcaagctttagaagcttctgcagagttatttaataataaagaataa

SEQ ID NO: 1418 - DNA, 675 bp, Methanobrevibacter ruminantium
ttgagtcttaagacacctgttgttatattaaattttaaaacttatttggaatccagcggtcaaaaggcattggatttggcaaatgctttagaaagcgctggagaagaatctggaattactatggttgctgtaccacaggccattgatatctataggattaaagaggaaacaagcattcctgttttagctcaacatattgatgcagtttcccctggaggccatactggaagcaacttattcgaaagctttgtggcaaatggtgttgacggaaccttattgaatcactctgaatgcagaatgactcttgcagatattgcagaggtcgttcaaaaaacaaagggagctgatttaatctcatgtgtttgcacaaacaatattgaaacaagtatggcagctgcaactcttgctccagattttgttgctgtagagccacctgaacttattggaactggaatacctgtttctaaggcagaccctgaagttgtagaaggaagcgtatctaaagtaaaggctattaataaggatgttcaggtcttatgcggtgctggaatctccactggtgaggatatggctgcagctattgatttaggtgctgaaggtgtgctattggcttctggaattataaaagcggaaaatcctaaagatgccttattggatttggtaagtaagatttag

SEQ ID NO: 1419 - DNA, 915 bp, Methanobrevibacter ruminantium
atgacatttactaaagaagaacaagcaaaactagaatacagtggatacagattcgtcggtgagcacgggcatgctgcggctaaaacctgtcattggactagaaaaagcataaaaaatgaaggagtgtgctataaggaacaattctatggagtaaaatcacatagatgccttcaaatgtctcctgccgtaccattctgccaccaaaaatgttccttctgttggagagacctatcccaaacccgtacagaatgggaaggagaatatgatgatcctaaaacaatcatagaaggtgcaattaaggcacagaacaatctcttatgtggttttggaggaaacaagaaagcagataggaaaaagcttgaagaaagcaaaaggcctacaaatgcagcaatctcacttgcaggagagcctacgctataccctgaaatagacgaacttataggagagttccacagacaggactttaccactttccttgtaagcaatggaatgtactgggaaaagttgggaagccttgaaaacgaacctacacagctatatgtttcattggacgcacctaatgagaaagtctataatgagctttgcaaccctcaaatagatgatggttggggcaaactaaacaaaacactagaactgatgcctagctttaagaacaatacagcaattagaatcacctcagtcaagggcaaaaacatgttcaataccgatgaatatgccgaactcatcaataaggcagaccctacctatgttgaagtaaaggcttatatgtttgtagggtcttccagaaaacgattaagtatggacaatatgcctagattccatgaggtcaatgattttgctaaagagatagctgataagacaggtagggaattaaccaaatattctgaagccagcagagttgttttattggaataa

SEQ ID NO: 1420 - DNA, 1125 bp, Methanobrevibacter ruminantium
atgaagttttttgaacatagcgcaaaaaaagtatttgaaagtgaaggtattaaaattttagaggggcatgtggtatactcccctgaagaggcaatggaagtggctaccgaattcggcaggcctatcgtattgaaatcccaagtcttggtcggtggaagaggcaaggctggaggtattaagtttgctgataaccctggtgaagctcttgaaattgctaatgaattattgaaacttgaaataaaaggggaaaaggttaaacacttgctcattgaagagaaggcaaatatcaaaaaggaattcttcttaagcgtttccaatgacagagccaacagaaggcctatcatcatggcaagtgctgaaggtggagttgaaattgaagaattggcaaagacatcacctgaaaagatcatcagatataatgtaaatcctttaaaggagttcttgccttatgaggcacgtgaaatagcccgaaagatgggtgtaggctctgaattgatttctcctcttggaagcatcatttggaagctttataatgtttatgataaatatgatgcagaagtggctgaaatcaaccctctcattttaactgacgacggcttgattgctgcagatgcaaagcttgaaatagagaatgacgctcttttccgtcatcaggatttagtaaagcaaaacagattcaagcaaaaggactttgcttttgtaaagcttgatggagacattgctgttatcggaaacggtgcagggctcactttaaccggtatggatatggttaccttattcggaggaaagccagcaactttcttggatatcggtggtggagcatctgaagagactatcaataaggctttaagtttggttttaaactatcctcctgtaaaagtagtgttcttaaatgttttaggaggtattactagagcagatgatgttgcaagaggcgtaattgcagcattggaagctaataagtgggatgtaaatattgtaatcagacttactggtactaatgaagaggaaggtcaaagactctttgatgaggcaggcattccttatgagatctcattggaagaagctgctaaaaaggcagttgaaatgtgcaatgagataaaagcaaaagaagctggcaaatag

SEQ ID NO: 1421 - DNA, 582 bp, Methanobrevibacter ruminantium
atgtttggaaagtttaaagtaaaaaaatatttttctgaattaaataaagcatattattctaatgattttaaaaaagccattaagtatgcagatattattttagaaatggataaaaataatttagaagtattaaaatacaaatacaactctttagctaatatgggagactatgaaaatgctttagtgtgtatagatgaaataattactttggaaaaatcttgtatggctttattaaacaaaggaacaacattatgttatatgaatcgcattgaagaaggttttaagcttcttgattatgttattgataattgtgaagaatatgaggcagcattcataaataaatgcaatttcttttttatgcttgaagaatttgatgaggctctatctttatcagataaaatattaaatatgcatcctgattgttcaaatgcttatgacactaaatcatttatttattataaaagagaagaatatgattcatctttaatttacgcaaataaagcattagaaaaaaatccaaataataatattgcattagagaggaaggaaagacttttatctatattaaattcaaaggattaa

SEQ ID NO: 1422 - DNA, 864 bp, Methanobrevibacter ruminantium
atggtagaagtaaaagaaagcccatataagaagtatctaagggaagatagattgccacacatattttgtccaggctgtggaaacggtacagtgatgagcgcctttttaaaaggccttgaaggaactgacattgactttgaaaatattgcaatggtttccggtatcggatgctcttcaaggattccaggttatgtcaagtgcgattcattgcacaccacccacggaagggcattaagctttgcaactggtttaaaggttggaaatcctgatttggatgttgtagtcttttccggagacggggattgcgcttccattggaggaaaccacttgattcatgctgcaagaagaaacatcaatcttacagttatctgcattaacaataatatttatggtatgactggaggtcagataagtcctacttcccctaaaggaagctttggaaccactgcaccttacggctcaagggatatgccttttaacttggccgagctggtttcagctgctggcgcaagctatgttgcaagatggaccacaacccatccgttacagctttcaaaggcaattcaaaagggtctggagaacaatggattctcattcattgaagtggtatcccaatgtccgacctatttcggccgtaagaacaagcttaaaactccattgtccatgttccaatacattaaggaaaacagcgtaaacaaaagaagagcagaaaagatggaagaagatgaattggaaggaaagatcattgtaggcgagtttgcaaacaagcctcatgatgaattgaccgatagcattaaaaaattgattgaagagaattccaatatgccactggctatcaaatctgcatttgaggagttggattaa

SEQ ID NO: 1423 - DNA, 1131 bp, Methanobrevibacter ruminantium
atggctgaagaacgttttgtacaaggaaacgaagcttgtgcattaggtgcaattgcagctaattgcagattctttgcaggttatccaattactccatctactgaaattgctgaacaaatgtctatcttgcttccaaaatatggaggcgcctttgttcaaatggaagatgaaattgcatcagttggtgccatcataggtgctagctggagtggccttaaggctatgacagctacctctggtcctggaatttcattgatgcaggaaaacataggctacggcttcattacagaaacccctatcgttataattaacgttcaaagaggttccccatctaccggacagcctacaatgtctgctcaagcggacatgatgcaagttcgctggggttcccatggggattatgagccaatcgctcttgctccttcatctgtacaggaattctttgactttacaatcaaggctttcaacttagctgaagagtacagggttcctgtaacagttcttgcagatgaggttgtaggccatatgagagaaaagctcatcattccagatgagattgaaattgttaaaaggacaagacctgaaaagccagatggccaatacttgccttttgatgctccaatggacggaaccactcctatgcctgcattcggtgacggattcaacatacatgtcacaggccttacccacgatgagagaggatatccagacaccaatgatcctgaatcccataccaaattggttgaaaggctatgcaataaggtcattatgaacagaaaggacatatgttccgttaagaaagagcaatgtgatgatgctgatattgtgattgtatcctgcggctctccatatcgttccgttggcgctgcaatgaaaaaagcaagggaagaaggaattaaggtaggatctcttaagatagatactccatggcctttcccagaggaagaaattgcagagattgccaagactgcaagcgacatcatcgttccggaaatgaatttgggacagatggttcatgaggttgaaagagctgctaaaggagaggctaatgttcatttaatcggcaagattggaggaatcctccataagcctgaagagatattggctaaaattaaggagattagcggatag

SEQ ID NO: 1424 - DNA, 207 bp, Methanobrevibacter ruminantium
atgattattatagattcaaagctttgtaaaggatgcgatatttgcatagcaacctgtcctaagaaggtctattctaaatctgacaaggtaaacaccaaaaacgtttatcttcctttccctgaacatgaggaaggatgcaccaaatgcggattatgcgaattgtcatgtcctgatcaagctatttatgttgaaaaagaggtggaataa

SEQ ID NO: 1425 - DNA, 129 bp, Methanobrevibacter ruminantium
atggatttgaatgatttaaataaaaataatttaaaacagaaaaaaaatcaccaagttttaaaagatttgaagataaataatttaattattatctttttagacttaacgcaatacataaataataattaa

SEQ ID NO: 1426 - DNA, 372 bp, Methanobrevibacter ruminantium
atgggtgcaaaagaaaaatatttctctaatatttcaaatagggaaagagctatatttgaaggagccataagcatgggggccttattccatcaatttgtaggaactcccttcaatagaaagacggctgaaagcctagaaaaggctatggaagaatcttttactttacagccttgcattgataaggtagaggtctctatagacttggatagattggataaggctatgacagagtttgaatacacttctctaagtggagacatgttggatgttaagatctattcaaaagtggatgatgtcttggctgtaattagaatagagtttattgaagagcttaattatcctttaatgtatgtggaagatattattgaataa

SEQ ID NO: 1427 - DNA, 852 bp, Methanobrevibacter ruminantium
atgattgaagagagaatacagattcttagaagagctgctcaaatctccaccgaagatcgggaggagaaggtatggtgtgtcatagcgggaaatgacagattagtcgatgatatagcctacaatgcaatcacccgccaaggacagagtccagattatcctttaggagaaaatgtttcaattacttcaaagcattcatataagaagttcgattgcatcatgcttaagggagaaaccttaaaaataagggaattgaagaataaaacccatgaagaagggggagcctctttgcaaatcaccacaacatcccttgaaaggcagccaaacttattggttgtaataggtcccgaagagagcatgaaacgttttgttggtcagacaagcagacaagaggttaagattgatatcttgctagaagatcacaccacaggatttatcaaatccgaaccgaagtcaacaaagattccaaagttcttaaaaaactttttcaatccaatcatagaatcaagcgaagtcatcctatctgttctattgatttcagttaaggatgaaggagatattgataaggtaaaaggaatcagccaagaaaacagcttatttggaattgatttaaaatcaacaattcaagataaggaaatagctaggctgaaagaaagaaaagcaagagaaaaggctaaaaaagaggaagctgaaaagaaagaaaaagaagaaaaagaaaaagccaaaaaagaatccgaaaagaaagaaaaagaagaaaaagaaaaagctaaaaaagaagaaagtaaagaagataaaaaagaaattgaaaaaggagaaactaaagaagataaaaaagaagaagataaaaaagattaa

SEQ ID NO: 1428 - DNA, 1071 bp, Methanobrevibacter ruminantium
ttgagtatttttggaaatgaagacgctattgaaattgaaccaactagagtcgtaaaaaatagtttaggtattgacttaggtaccttaaacactgtaattgcaaaaccatctggagacaaatttgacttatatcaaattccttcagtagttgcagtcaaaagagatgatcctactgctgttcttgcagttggagaagaagctaaaaaaatgttaggaagaactcctgaagacatcattgctgtaaggccacttaaaaaaggtgtaattgaaaacattgcacaggcacaagccttgctcattagagcaatggaaataggcattaacgaaggagaaactgtagaaagaatagtaatcggaattcctggagactcttctgaagttgaaaagaatgctgcagaagaaatcggtagaaaagcaggtgctgaatatgttttagtcatcagcgaaggattggctgcagctatcggtgcaggattacctattgcagaacctatgggaaccatggttttagacattggagcaggatccaccgacatcgttgtcatttcccttggaggaatcaatgacatagaaacagtaagatgcggaggagacgacatcgacaatagaatcgtcgaattgattgaagaaaaatacaatgttgcaataagcatccacgatgcagaagccgctaaaatcgaagtgggtatggtacactgcagtgaagagtttgaaaacttgaattatgaagtaatcggaaaatccttagaaaccaacagacctaaaaaggtcgttatcgattccatgctagttgcagatgcagctgaaccaatcattaaacaagtaatcggcggattaaacctcatcttagaaagattaccagctgaattaatgatgggaatctataacaacaccgttgcagtcggaggaagttccagattaagaggaatcaaagaaagaatctttgatgaatctgaaatccctattaaaatttccgatgacccaatgacagtagtagctaaaggaactgctattgttgctgccgaaccattagctttagaacctgaagtacgtttaaaagctatgaaataa

SEQ ID NO: 1429 - DNA, 240 bp, Methanobrevibacter ruminantium
atggatatgaaaacaatttatttaagtgaagaagtctataacagattatctcttttggctttagaatctgaaaattataatgatcttattgctagattgatagatgtttatgaaaatagctattttgatgaattgagtgatgctgaagctgatttttataatgaaaggattaaatattttgaaaatggggattatgaaggcattagaaaggttgatttaaaattctttggaaaaaactaa

SEQ ID NO: 1430 - DNA, 660 bp, Methanobrevibacter ruminantium
atgaacacactaggattagatgaagcaggtagaggtcccgttcttggaccaatggtagtagccggaatagtcatacctgaaaagaaagaaaagataatagaaagaatgggagtgaaggattccaaaaggattaccccaaaaagaagggctgtgctctatagaaaactaaccagaatgtttgattatgaaactgtggaaatcagtgcaaaggacattgatctattaagggcaaaaggagtaaacctcaaccagattgaaaagttggccatgatgagaatcattgcaaagcttaaggccgacaccataatcatagattcccttgacataaaggaaggaaggctagaggaagagatgcaaaattttgttggagaaggctcaaaggtaattgcagagcataaggcagatgacaaatatatagttgtaggagccgcttcaatcatagccaaaacaaaaagggatgaaataatcaaccaaatcaataaggaatacataaggtccactggaaacaaggatggaatcggttccggatacccaagcgatccaaagacaaagaacttccttaaaaactacaaatacgatgaaatgccagactttgttagaagaagctggggaactgttcaaagaataaaagaagctgaagaagctgaaaaatcattgtaa

SEQ ID NO: 1431 - DNA, 618 bp, Methanobrevibacter ruminantium
atgtatttaggaagaattatttcagcaggtaaaacagaagatggcaagccttttgtagcttatagagtttcaagcagatcttttccaaacagacaggtaaaggttcttgaagatgaagcggctatcattccaaaggaaggctttgaaaaggacatttttaaaaactcttatattgcttatgactgtataaaaactgtaggagatattgcaattatctcaaatggttcacagaccaatccgattgcagataagatatccattggtatgaatattcgtgatgcaatggcatattccttgattaccttggattatgaaaaggacgattataacactcctagaattgctgcagtggttaaaggtggagatgattttgaagcatatattggtattgtaactgacagtaagatattggttgaaaagattgatgagggtgctcaattcatttccacttatgaaaagaacagtccggaagatgttgtatattctgccgaaactccagatgatgcatgcaagtttatctttgatgaaggtgcatttgctgagtttgaaaatcctgtatgttcagttgcagcaatctttgatggaaaatggaatatttctggattaaatccagaataa

SEQ ID NO: 1432 - DNA, 765 bp, Methanobrevibacter ruminantium
atgactttagaattatttggattaaaaaaaattcctttggtaaaaaaaggagatgacattgcaaagattatagaagatgacttgaaagaggaagatatccaacttgaaaatggagacatcttgctcatagctgaaacattaatttcaaaggctgaaggaaacatcataaagatggatgatgttgaagtaagcgacaaagccatagaaatagctgaaaagtgcaaaaaagaccctaagattgtcgaaaccatccttcaggaatccaatgaaatcgttgcagtaggccctaatttcatagttacagaaaccaagcacggatttgtatgcgccaactctggaatagacgaatccaatgtagaggacggattggctaccccaatgcctgaaaaccctgacaagtctgctaaggaaatcagagaatacttagaagaaaaatatcaaaaggagatagcaatcataatcacagacacccaaggaagggcatttagagtgggagcaatcggaactgcaatcggatgctctggaatcaaccccctttgggtgagaataggagatacagatctttatggaagggctcttgaaaccacagaagtggctacagctgatgagcttgcagctgctgcatccttattaatgggacaagcagatgaaggaattcctatagttcttataagaggattcgatgcatttaatatccttagagatactgaaactggaatcaagccactccttagaccaaaagagtttgatgtgtttagaaaataa

SEQ ID NO: 1433 - DNA, 510 bp, Methanobrevibacter ruminantium
atggttgaaattaattatagttgtacaaattgtgacttttcattcctagacaaaaatctaatattctatttagacacagcaaatgaaactgaaagaatagataatttagaagagatcttgaatgataaaacagacaatttagaattaattgaaacaagcctaaataaagaaagctcagataaaatgactaaagcacttattgcaggctttctttatgaaaattattgtcctcattgcaagcagttaataaaaacctatgttccagaggataataaactatttacagaccaagagatggaaaaaatactaaaaaaggaaatttctaaaaataaacaagaaaataataattttaaaatactgttttttgattttaaaaatactctctatagagatagaagaaagattcttgaaagcaatgaatgtcctaattgcaataaggaaatgtctttagtaatttcagagaaaactccatgtccagaatgtggagaaaaactaaaagaagatttttaa

SEQ ID NO: 1434 - DNA, 906 bp, Methanobrevibacter ruminantium
atgattaccatactttccggaggcacaggaactcccaaactaatacaaggaataaaagaaatctaccctgaagaggaaatatctgtcatcgtaaatacagtggaaaacgaatacttttcaggaggatatgtagctgcagactgtgatacagttatgtacacctttgcagatatgattgacgaccaattcttctatggaattataggagatacatttaagataagaaacatcctaattgaaatgggaactacagagcttcttaaaataggagatatggatcgagcaatcaagattcaaaagacaatccttttagaggaaggaaagacccttagcgaaattgtagaacatcaaaagaacaagctaggagttaaagcaaagataatcccaatgagcgatgaggactctgaaataaaaataataacaaaagagcatggcgaactggatttccatgacttcctaatcaagcaccaatgcgaaggggaagttcttgaagtaaaatacagcgacgttaagccaagccctaatgtgattggaacaattaaagatgcagataaggtaatcataggtccatccaatccgataacctcaataaggccaataattgcaattgaaggggttgaagaggcacttaaggaaaagaaagtcattgcagtctcaccatttttaggagaagccgctttcagcggacctgctgccaaattcatgaatgcatttggatatgaggcatcatctaaaggagttgctgaattatacaaacctttcttagacacatttataatagacaatgaggataaagacaaaaaggaagaattagaaaaaataattccaaatatagtagttgcaaacacctttatgaaaacaattgaagataagatcaatcttgcaaaagtggttttagaactttaa

SEQ ID NO: 1435 - DNA, 762 bp, Methanobrevibacter ruminantium
atgatacaaatgactttgatacaaattgataattatggtccatggacagtaactccaagaccacgtactgaatctgaccttcaaattttacaagcggaactttttgcagacgtacaaagacagatagctgctaaaaaaggtttagtgttctttacaagatttgacaacttgcttgcagttacaaacggcttaaatgaagaagaccatatgagaattcaaagatcaattagaaacagatacccaatcacaataagcatgggtgtaggagctgcagagacagctcatgaggcacaaagactagcaaccatagctcttcaaaaagaaggaggagcccaatcctcaggcagaaaagaaattttagcaatcaataatcttattgaaaaccctgaagacagtttcgtacaggctgcacacattgacataaacagcgtaaccgaaacattaaccgacatagagtctgcctttgacacaagcttcatggtaaacaaggctcaacactacctcatgaccaagcttagagaaaaaggagcattattattcttcatcggtggagacaatttcatgtccccatgcaacggcttaagcgaagaggacttaacaaacatccttaaggaaatcgatgaagagataggaatcggattaaaagcaggtatcggaagagcagacaatatggaagacgccgcttatatggcagacatcggacttgaaataatccgtgaaggaaataataaagaatggattcatgtaattgaagaactttaa

SEQ ID NO: 1436 - DNA, 714 bp, Methanobrevibacter ruminantium
atggccggaataacaaatgcagaatttgcaatgaaactcataccttacggatttgacacagtcaccatcggaggatacaatacagactccgaatcaatagacgcctgtgaaaagattattgcaagaggccgaaaagagttcaattaccctaaagaggaaatctatagcgtaattgaaaatgaagttaacgcaatcaaagacagttttaatgtacaagtctctgcaaacttaagagggagcacaccagacccacttatcaaaatcagcaaaatagaaaaactggacataattgaaataaactgccattgcagacaagaggagcttgtagcagtaggatgcggacaatcaatgcttttaagaccagacttagaagattacataagagaagtggtaaaaaaatcagaatcaaaagtctcaatgaagatgagagctaacgttgaaggggtagacaatctggaaatagcaaaactggcagaagactgtggagttgactacttacacattgacgccatgaaaatgggagtaagagatgctgatttttatctaataaaagaaatagccgaaaacaccaatattttcatcattggaaacaattcaataaattcaatctctcaagcagaaaagatgctgaatgcaggagcaaatggcatttccatagctagagctgcaattagcggaaaattaaacttcgatttaaatcaaataaaaatctaa

SEQ ID NO: 1437 - DNA, 981 bp, Methanobrevibacter ruminantium
atggctggaactatgaaagcttggagaataaatgaattaggaaaacctcctgtattagaggatgtccctataccagaacctggatttggtgaaatcttaattaaaatgaaaggtgcaggaatgtgcagaactgaccttgaagttatagatgaaggtttcattacagttccatttgtcggaccattcacatttggtcacgaaaacgcaggaactgttgcaaaactcggtcctggagtagatactgttgaggttggacaaaatgtcattgtagacacattgcatgcatgtggtaaatgtcaatactgtctttcaggccgtgacaacttctgtgaagttgcaagtgcacgtggtcttaaggaagacggaggtatggcagaatatatgattgctgatgcaagggaagtcgctcctttaggtgaccttgaccctacagaatatgtggcattggctgatgcaggtctatctccatatggtgctgtacagactgcaaaaccattcattccaaacaatggtactgctgttgttatcggtgtagggggacttggattctactgctgtcaatatttagctttaacaacctctgctcgtgttattgtagtaaaccgttcagctgataagatggctaagatgacaaacttcggtgctgacgaattggttgttttagatgacaatgcatatgataagattatggaattgactgacggcaaaggtgtagatgctgtatttgactttgtaggaagagacaacactttagagcttgctgcacaaatcaccaaaggattaggtctcatttccattttaggtcttggtggaggaacacttcctgtaagctggaccacagtcaaacctggtgttatggtaagattgactcaaggtggaacaattacagacctttatgagattatggacttggcaaaagctggtaaaattacagttcaagctcaaaaatatccattcagtaaggtttttagaagctcttga

SEQ ID NO: 1438 - DNA, 258 bp, Methanobrevibacter ruminantium
atgagcaaactctctaaactgccgaatattggcaaggtattggaaaagcaattaaacgatgtaggaataaagactgatgaagacttgattgatcttggcagtaaggaagcatggctaaaaatcaaagaagtagatgacagcgcatgcttaaataggctaatggctttagaaggagccatacagaatattcgttggcataacttatctcaagaggataaggacaatctaagagagttctataattcacaaaagatataa

SEQ ID NO: 1439 - DNA, 660 bp, Methanobrevibacter ruminantium
atggttaggccaaaaatagagcgacgaattgtgaaaaaacctagctacacttgcatccaacacggcgacatatcaagagaagaggatttcgaaagcatcaagatgaatcttgatgagtttgaagcaatacgcttaggagactatcacaatatcaaacaaaaggaagctgcagaactgatgggaatatcccaaccaacatttcatagaataatcaattctgcaagaaagaagactgcaatgtctttgattgaaggaagaaaaatagaaataaacaatgaaaatttctatagcgaagataagatctacatctgcaacaattgcggattccaatggaacaatccaaaaaaggaatatgcaaactgtccagactgtaaaagtgaaaatatcgaacgaattaaggttaatttgaatgaaagtgattatataaataataatccaaataagataaaaacaaatagccaaatatgcgatattgataatacagatgttcctttaaatgaaagaaaatcatttggaggacctggaagtggtaggggaccatcaaaagcatgcgaatgtcctaattgtggccatattgcaccaaaaattaagggattcccatgcagaaacataaaatgtccagaatgtggaacccctctatgcggatcaaagcataaataa

SEQ ID NO: 1440 - DNA, 1611 bp, Methanobrevibacter ruminantium
atgtctttcataacattaaaaaacattaataagtcatttaacggagaacctgttctaaaagatataaatttaactatagaggaaggttctactttaggtattctcggtagaagcggtagtggaaagtcagttttaataaacatgctaagaggtacaaaggaatatgctccagacagtggacaagtgctctttgaccttgcaatatgtgaaaacaaaaagtgcttgcatgttgagcctgcttcaaaggctggaggaaaatgtccagaatgtggagcggaactacaagcaaaacaaatagacttctggaatgcaggaagattggaaaaggctgcaatcagaagaagaatctccatcatgcttcaaagaaactttgcattatacgacgaacagactgtaatagacaacgtattgaatgcaatgggtgacgaaggcagatatgaagaggagaatatctacaatgccattgacctattggaaatggttcaaatgagccacagggtaacccacgttgcacgtgacttaagtggaggagaaaagcaaagagtagtacttgcaagacaattggctaaaaaccctatgttgcttttagcagacgaaccaacaggtacattagaccctcaaactgctgaaaagcttcaccaaaccttgattgaaggtgtaaaagatgaaggaatcagcatggtaatcacttcccactggcctgaagttatgaatcacctagctgatgatgcaatttggctagacaatggggaaatcatagaacatggcgcccctgatacaattgtagaaaacttcctcaaaacagtgcctaaagcagaacaagtggaaaaaatagaacacaccgaagagataattaaagttcaagatattaaaaagcattattattcaattgaaagaggagttgtaaaggctgtagacggcgtaagcctaacaatcaaccaaggagaaatctatggtattgtaggtctaagcggttctggaaagaccacattgactaaaatgatgatcggcctcaccgaaccaagtgcaggagagcttgtaatcagattaggtgatgactggattgacatgaaaaagccaggtcctttaaacagaggccgtgtaactccatacttaggcttgctccaccaagaatactctctttacccacacagagatgtacttggaaacctgacagatgcaatcagcctaaacctccctgcagagtttgcaaaaatcaaggccgcacatatccttgagactgtaggatttgaaaaggacaaatccatgagcatgctcacaaaatggcctgacgaactaagtggaggagaaagacacagagtggctcttgcacaagttcttataaaagagcctaatatagtggtattggacgaacctacaggtacaatggaccctgttacaagaatcatcgttaccaattccatcctaaaggcaagagatgagttggatcaaactttcgttatcatatctcacgacatggactttgttctagatgtctgtgataaggcaagccttatgagaggaggaaaactcttaagcactggaaccccagaagaaatcgttgcagagcttacaggtgaagaaaaagcagatatgattaaggaccactag

SEQ ID NO: 1441 - DNA, 483 bp, Methanobrevibacter ruminantium
atggcatgggatgatgcaccgtcacatatttgcagaggaggagatgtaaggggactcgcattttgctgtcctccagtaaaaccttgccctgtaatgaatgcacttagagaagtgggaattactcctcaggaatttttagaaattaaacagaagtttgcaagagaaacccgattaggggaaggccctgcaacttgcttcggatcacttgtatggtgttgtaagacttcaaagccttgtcctttaagagacatgaccttaaatcaaattaaaatgactgaagatgagtatatgacacttaaaaaacagttatctgaagaaatcttaaaagcaggcaagccaaaagacaatagcgctgaagcaatggctcttgcagaaacatttaatataagcgtagaagaggctaaaaagactcttgaagactgtgataatgatttaagaatggctgtaaaattgctcaaattaaaagagcttgataacgaatag

SEQ ID NO: 1442 - DNA, 624 bp, Methanobrevibacter ruminantium
atgggacttacttccctttttttagaagtggaaaacaaaaacgtttttatcttaggcactggagaagtagccaccagaagagcacatcgctttttagacaaaggagcaaatgttattctagccggaaactcaatcgatgaagagctaagcaaaaaaggagctatcctaactcctattaaagaccttgaagagcttgtcaaatggagtgacataattgtcactgcaagcggagacgatgaattatgcgaatacatcgcatcaatcagccaaggaaagttaatcaacagagcagacaagcctgaaaagggaaatataatagcgccaacaagctttcttatagacgatatagaaatatccatctataccaatggacaaagccccttaatggctcgagagcttagaaaaaaaatccaatccataatcacagaggaagacattcttgagataaagcttcaggactatgccagaaagctcttaaaagaaaaggtagaagaccaaaagacaagaaagcaatatcttctaaagattctaaacaacacccagataaagcaatgtctaaaggaaaagaatttagataaagccaaaggacttgcagaggagatcatcaattcagaatttaattga

SEQ ID NO: 1443 - DNA, 1197 bp, Methanobrevibacter ruminantium
ttgataatcaatatacgtgtagaccacacccttgcagacatagaaactatggaaaaggtctcaaaagacctaaaggaactcttttccaacttaaaagaaaactttaacatcagtgaatatattgaaatcaatacctgtaacagatacgaatatttcctttatactaatgttgatgacgacagcctagactgtgacaacgaatatgtcataatagaatatgacgattctgcaattctccacctattcagaatgacttcagggcttgaatccatgatcatcggcgaagatcaaattctaggccagataaaagattccaaaaagaaaagcgaaaaggaaggccactgcggaaagaccttagacaccatctttacaaaggcaatacatgttggtcaagtggtaagaaacaagacaaaaatcaatcaaggctctatctcaataggctcagcagcagttgatcttgcagaagagcatcttggagatcttcaggacaagcatgttcttgtaatcggtgcaggaaagatgggaacacttgttgcaaaggcattggcagagaaaaacctaaaggcaatctttgtagcaaacagaacctattacaaagcagtgaaattagcagaggaacttgatggagaggcaatactatttgacaatctagaggaaaagctgcttaatgcagaccttgtaataagctctacaggttctccacaccctatagtcaataaggaaagacttatgaaagtatttggagatgaagtccctgaaaaaatgatatttattgatatagcaaacccaagagacattgaagatgatgtcaaggaattgggaatcgacctattcaatattgatgacttaagaggaattgccgagaagaataagaaacttcgtgagaaggaagtaatcgcagctgaaaagataattgaaaatgagtttaatttacttaaagaatcctttaatttaattgaaataaattcaatacttggtagtttaagagagtctatggaagaaataagacaacgtgaaagtcaaaagggcatagttaaactaaatgcggtagatgcgagggacataaaagtcatagataagatgactaagtcaatagttaacaagatattttatgacatctctgaaaaagttaagatatccgctaaaaacaacgaagaagatgttattaaaatgtgtgaagccatcttaaaaagatag

SEQ ID NO: 1444 - DNA, 1128 bp, Methanobrevibacter ruminantium
gtgaaatctgataataagagttcaaaaattaaaaaatcagaggtttatattaaatctagttctgattctatagataaagaggccgaagagcttatcttagagtctgcaggttatccatttaactttgcacttcttgaaggacctcatttagaaatatcagataatgtcctctttgagcaatatgcaattgaacaatggagtggaactcttgtaaagactggttcttatttatttgatcaaaagattattccagattatgcatttaaggttctgaaggtttttccagaaaattccatcatatctgaaaacacctctattgtggttgctgatgttgataaggataaacgttcctctataaagtcaaagcaatatgatgttcattttgatgatattgtaggtcaggagaatgcaaaaagcaaatccaaattgatttacaaatatcttcagaatccagacaaatttggcacttgggctcctaagaatgtcttgttctatggcgctccaggtacaggtaaaacaatgctcgcaaaggcccttgccaatgaattggacattcgcctttatcttgtcaagtcaacctcattgattggtgagcatgtgggagatgctgcaagcaggatccatgaattatttgaggctgcaagcagaaatgcaccttccttaatattcattgatgagatagatgcaattgcacttcacaggtctttccagtccttaaggggagatgttgcagagattgtaaattctcttttgactgaaatggatggaatcagcccaaatgatggtgttgtaaccattgcagctaccaataacccttctgcaatagactttgcaatccgaagccgttttgaagaggaaattgaattcaagcttccgagtgatgatgagagaagggaaataattatgcttaatcttgacactttccctcttgattatgatttagacatagagaagcttgtaaaagtgtctaaaagaatgtctggaagggatattaaggaaaagctattgaagacagcccttcacaatgcaataatcaatgataagcagacagttgatatggatgatgtcgcttttgcattgggtgtaaataaatataaagaagaagaagttaaaggaatgtttgaataa

SEQ ID NO: 1445 - DNA, 837 bp, Methanobrevibacter ruminantium
atgaaagataaggttatttttggtccagcaggtaagccaattgattttaagggaaaggcatttgaatctccagaatatttaggtccaagggggctttatgcatttgaatatcagtccacttatggcgtaaggataggggagtcatctgcaataaagcttagagagtctgcagagagaaatggggttttaatgtccatgcattgtccttattacattaatgtatgttctaaagaggaagaaaagattgatagctccatagaaagactgattcaatctgctaaggttggagaatatatgggtgcctacaggcttgttttccacccaggattctattcaaacagaaaggctgatgtctgtatggatttggctaaggaaacctataggaggctccttttaagatgtgaagaggaagggatagaggactttacctttgctccagagactacaggaaagcgttcacagttaggaaatatcgatgagataattgaaatgtgcgccagctttgaccatttcgagccaacaatcgactttgcccatgttcatgcaagagggcgcggaatattaaataagaaggacgattataactgcatattctcaaagcttgaagacaatctggacattgacaggcttcattgccatttcactacaattgaatactcccacaagggagagagaaagcaccatactctagctgaaggtgatgaatatgggcctcacattaaagatttattgctcaatctgattgaaaacgattggaaagccactataatctgtgaaactcctttgattgaccaggatgccttaagaatgaagaagctttatgacagtttgatatga

SEQ ID NO: 1446 - DNA, 1017 bp, Methanobrevibacter ruminantium
atgaaatctgtagctattaatggattcggaactataggtaaaagagtggctgatgctgtagccgctcaagatgacatgaaagttattggtgtaagcaaaaccagacctaactttgaagcaagaactgctgttgaggaaaagggatatcctttatatataggaattccagaaagagagcctctatttaaggaagcaggaatagaaattgcaggaactgttgaagacatgattcaagaggcagacattgtagttgactgtactcctggaaacatcggccctcaaaaccttgagatgtataagaaagctggcgttaaggctatttaccaaggtggagaagaccatgaactaaccggattgtcatttaactcctttgctaactatgatgattcatatggtgcagactatgcaagagtcgtatcctgtaacacaaccggtctaacccgtaccttgcacacccttaatccattggttgacattaagaaagttcgtgctgtaatggtaagaagaggatccgacccatctgaaatcaagaagggtcctatcaacgctattgtacctaaccctccaaaggtcccttcccaccacggtcctgacgttcagactgtaatgaaaggcatagatgttactacaatggctttgcttgttcctactaccttgatgcaccaacacaaccttatggttgagattggaaatgatgtaactaaggaagaagtaattgaagctcttgaaaaacgttccagagtaatggttgttgaagcagctgctggccttgactcaactgctgcacttatggaatatgctaaggatttaggaagaagcagaaatgacttgtatgagattcctgtatggaaagagtccattaatgtagtggataatgaactcttctatatgcaagctgtgcaccaagaatctgatgtggttcctgaaaacgtggatgctattcgtgcaatgcttgaaatggaatctgataatgaaaaatccattgcaaaaaccaataaagcaatgggaatcttttaa

SEQ ID NO: 1447 - DNA, 552 bp, Methanobrevibacter ruminantium
atggtttttatgattgatctagaccaattaaaaaaggaaattaatgatttaaccaaggattataagggatttgaattcaaatacatagatacagattccattgtagttgagccttggacaaggcttaaatgtcaatatggctgccctaattatggaaagacccttgtatgtcctccattcactccaaaggcagaggaatttatcggcatggtgaattcatataagactgcaattctctttcaaataagtctggcctcccttgaagatgacattggaggtataactaaggtttcggttgatatagaaaacctttgcgctcactttggctattataaggcatttggcatgggcgctgggccttgtatggtttgcaagtcaaaaggtgaagaatgcagtttggatgcctgtaaatatcctaatgaagcaaggccttccggagaggcttgtggtgtagacattcataagacaattgaaaacaatggctatgatattttaggaatcgatgaggagaataacagctatttctgttatggaatcgtcttattggaataa

SEQ ID NO: 1448 - DNA, 1086 bp, Methanobrevibacter ruminantium
atggcaaatactttttttagtaaaatagttaaatcattatgggtcttggcttcctttattccaaccctaaatggattggggtttgcttatataggcgctaaggagtttaaaaataattggattattgaaggtgtgatttacgagattccttggtttttattatttatctttgtaaataatgaggatcttggagtgttctttgcaacaataggcttattgggaatggctgtttcctttgttaggtcactctatgtctactataagcataaggacatattgatagatgacgatgccgaaagtcggataagcactgaaaagtccatcacttcattttgggttatcttttctgttataatctttttaaatgggcttggtttgatatatgtcggatttaaaagaaacgttcggcaatggatattggaaggtgctttctttgaatttttatggcttctattttttatcacccccagcaataaggccttaaacagttttatcatttcacttggatttattggtatgattctatctgtcattagaacatttatggtctactttgaagaggaaagaatggatggaggcttttacagtccaacagctgttaagaaggagccacctgctcaaaatcctattgaaaacacaatcaattcttatagtgagaacaatctttcagatgatgatatagttcctgagttcaagggatataagactcaagttgaggatttgaaagacgcttttaagactaaggaagacaatgttaataatttgttatctaagcgttttactaaagaagagcttagctatggcagattcaagtcagttgtaaatgagtttcataagacattctattctcaggcagattccactttaaccatgattaatctggctccagaatacagcgaaagagtagatgagaccataaaaaataagataggacttatggattcattgcttggtgagatgaataatcttttagaagaacttattcttaatgatggacttccagagaagtcagatgaggaaatcactgaattatttgaaaatatgcataatttgattaattctgttgacgattataataaggaatag

SEQ ID NO: 1449 - DNA, 1653 bp, Methanobrevibacter ruminantium
atggaaaataatgatttagaaaatttaagaaaacttattcaagatatcttggattttgcaaaaactcattctgatacattggatgaagattctgctcctttatggtattttgcaaagggaaaatttaacataactttagatgcccttttgctaaatgatattctatgctttttaagctttttaggattgagtgatggaaatatcagttctgatgaattgaattttataaattatgttttaaatttcaattttacaaaaagcgatttggagctttatttaaagaataatctaattgatgattatagcgaatctcttcctccttccttttttgtgttctatgaatttgataagtttgcattggaaaatggaaaactgactgaaagcattgtagattccttatttgaggttttcaatggaatcggacatctctttatagctcttgataatgagtcttctcttgaaaagaatattttagattcatttttagacaatattaaaaagcaactggctgatttgagaggcttccagtatgaacttatggttttggctttaaaaaatgatttgatagataatatgttggatactaattcaattgatggcttttctgattctaatctggacacttcttttgattctgatttagacaatcctcaattagatgattctttcttagataaggttgatgactttttctttaacaatgaatccgatgatgatttcgttagttctgttgactcttcaaatgatgatttaaatatgggtggtgatgactctttagatagtgattctcaatctaattcctcttctccaagtgattccgattctcaaaaagataataaaaagagcattcaagagagtttagataaattaaacaaattagttggtctagaagctgttaaaagtgatgtaaattccttaataaaccttattcaaattagaaaattaagagagcagcgtggaataaagcaacctgacatgtccttacatttagtgttttctggaaatcctggaactggaaagaccacagttgcaagactcctttcagatatctattgccagcttggattgctgtctaaaggccatttggtcgaaacagataggagcggtcttgtagcaggttatgtaggtcaaactgcaataaaaacccaagaggttatccaagaagccatgggaggcattctctttatagatgaagcttatgcattgtcttctgcaaagggagaaaatgattttggccaagaggcgattgataccattctaaaggctatggaagacaatcgtgatgactttattgttattgttgcaggatatcctgatctgatggatgagttcctccattcaaatccgggccttgaatcaagattcaacaagcatctttattttgaggactacaaccctcaagagctgtttgatatatttgtgtcaatggccagtgaaaccaatctaaagcttgatgaaaaggcagaggaattccttaaaggtcattttgaagacgtttataattcaagggatgataattttgcaaatggtcgttatgtgaggaatatttatgaaaaggtcttgtcaaatcaggccaataggctggtgggcatggaagatatctccgatgatgatttgaatacattaacccttgaagactttaaggatttttag

SEQ ID NO: 1450 - DNA, 261 bp, Methanobrevibacter ruminantium
atggattctgaaaatctacatagaagacttaaaaagattattggccaacttaatgccattgatcgtatgattgatgaagatattccatgtgaaaatattttaatgcagataaatgcttctaaatctgctttgcatagggtcggatatattattgtagaaggtcatttagataactgcattaaaaatgcaatggaaaaaggagacacagacgaggctttagccgatatttcatcaattttagagtattattcaaggctttaa

SEQ ID NO: 1451 - DNA, 450 bp, Methanobrevibacter ruminantium
atgtctagtgaaaaacgaaatagcaaagatcaatcctacttaggctttgaacttattgaagtggaggactactatctcctatcaaacacagaaaagctgcttgaaacagttaaaaaagactggtttaaaagcctaatggacgaaataagagaattggttggaaagcattatccagactttgtaatttacttagcctatgttgatcatggagatgacggtacaattttaggctatgtgaatgtaagggaagatgacaataagagagatgaagagtattcagaagttgctctaaacaaagaaatgcttgagatatgtgaaaaacacaaagaagataaaatattatttgtaacaattccaagaaagagaaaaagctttataaagttaaaaaaaggaagcatcagagaacatttcaaagaggctctattaaaattaggtgcaaagccactataa

SEQ ID NO: 1452 - DNA, 1089 bp, Methanobrevibacter ruminantium
atgactggtgaaagtactcatgaacacactcacaaagaacaaagaagacaatacacattcaataagcttaaggctttcggccaagagatcatagaggacattgagaagaacaaagtgccaactctaaagattccttcaagaggaactggtaacattgtttatgatgaggataaacgttactacatccttggtgatagatatggtagaaggtctctcggaaacgttaagcaaatcagaaaattaggtcagatggtctatgtagctaatttctgtaaggatttagtccaaagggacaagactgctaccatcagggagatgtattatatctctgaaggttggggtattgaattcaatacacaacaggaatccaacattgttggagaggacttggaagttgcattaggtgcaacccgtgaagacttaggattaatgcctgaagaagacggagcatctgtatatggtgatattacccttcttgacggagattatgaaatcaatgcggcaagagcaggtaaatcaggctataccatttctccaactatcgaccaggttgagttattggactgcggagcagacttcctccttgcagtggaaaccatgggaatgttccataggcttgttcaggaaaaggctcacgaaagatataactgtcttattgtaggtcttaaaggtcaggcagctcgtgctacaagaagatttatcaaaagggtcaatgaagaattgggccttccagtttatatctgtaacgacggagacccttggggattccacattgcacaggtaatcatttccggaagtgcaaagttagctcacgttaatcacgatttggctacacctgatgccaagttcattggtgtaactgcaagtgacattcaaaattatgaccttccgactgatccgcttaaggacattgacgtcttaaggttaaaggagctttctaaagacccaaggtatcagactgacttctggcagacagaaatcaaaaagatgcttaagcttggtaaaaaagcagaacagcaatctttctcaaagtatgggcttgaatatgtagtagatacatatttccctgaaaagttaggacttaactaa

SEQ ID NO: 1453 - DNA, 1800 bp, Methanobrevibacter ruminantium
ttgtctcaacaagctcaagaactctttgaaaactttaatgagttaactccatcagagttctttagaaaaaataaacagatgttaggattttcaggaaagattcgttctttaactatcgttttccacgaacttataactaacagttttgacgcagcggaagaagcaggtatcttacctgaaatcagcattaaattagatagattaggtaaggaccattatgtattgacccattcagacaatggtcctggaattcctgaagaatttgtaatgaaggtatactgtcagatgtttgcaggttccaaattcagaaacatccaatccaggggacaacaaggtttaggttgtagtggatgtgttcttttatcccaaatgaccaccggtgagtccacccatgtaacttccggatggatggaaaatggggagcttaaaggggtcaagatggaattcaagatggatgtaaagcaaaacaaaggtgacttaatcaagaaaagcgaatttacacctacaggaactggtgtatgcattaagctccactttaaggaagtatcctactctttagctgagcaaggtgcattcgaatacatccgtagaaccatgattgcaaaccctcacgctaaaatcacattcagggatcctagcgctcataaatacatctttaaaagggcagcagaaatcgttccagtactccctcaagaggtattgcctcaccctaaaggggttacagctgacgatatcattaccattgcaaagttcactgataagagaaacttcaaaagcatgctgacaagttccttgtcaagaatgtcctctaaaaaggtttcagaacttcaggagcttaccggaatagatatgaagaaacgtcctaaaaacatggaatgggcagaagctgaaaagatcgtagaagctttcggcaaaatgaaattcatggctcctccaacttcaggattgatacctatcggtgaagagcaaatagaaaagggtatgaaattgattctaaagcctgaattcattaccaccatcacaagaagccctgtaacctataagggtggtgtggctttcattgtagaggcaggtatcgcttatggaggagatgcaggaagaatcgtaaacgaacaaagaaaatcagagatcttaaggtttgcaaacagagttccattgactttcgatgcaggaagctgtgcaattacagaagcgttaaggtctattgattggagacgttacggtcttagagacttggataacactcctcttaccttgtttgtaaatattatctctactcaagttccttatttatctacaggaaaacagagcattgcccctgaacctgaaatagttcatgagataaggcaagctaccatgaaaatagcaagaagacttcaaaagcatatccgatccaaaaaggctgaaaaggaaaaggccatgagatccaagatatttgaagactatgttccagtcatcattgaagaggcagcttcacttgctgagactgaagttccagattataagcctgttcttgctaaggtaacaagaagggcattggcagaaatcatgggtgaaaaggtcgaggaagaagaagaggaagaagatttcgtcgattccttgcttgaagagcttgacgaattcggccacactgtcgataaggagcattcagcaagaaaggacagaattcaggaatctgacttggatgaagcctttatagatgatgaaaagccaagaaagagatccaaaaagtccaaaaaatcagaaggcgctgatgaaggacagtctactttatttgattcagaagaacaggaggaatga

SEQ ID NO: 1454 - DNA, 612 bp, Methanobrevibacter ruminantium
gtgaatgaattgccggaaactgactatcttagagttccatctgataggattggcgctttaatcggaacaaaaggtgaaactaaacatttgattgaaaatgcaactaatactcatttagatattgacagcgatgactgcactgtagctatttatcctggagaaaatatggaagaccctcttggagtatggaaggcaaaccatattgtaaaagctatagcacgtggctttaatccacatgttgctttaaaattaaataaagatgatacttatttggaaataatcaaattgcctttatatgttggaaagtccaaaaaggctatggcaaggtataagggcagaatcattggaaaggatggaaagacaagagagattattgtagatatggcagaagtggatatggcaatttatggaaagactgtttccttaataggcgagcttgataatgtcatggttgcaaaggaagcagttgaaatgattcttaacggatcaagacataagtctgtctatgcattccttgaaaataagaagaatgaacgtaagatgaaagaattcaaggaagtcgttggaattgaaaaggatgaaattgaattccgtgatgacttggatgactaa

SEQ ID NO: 1455 - DNA, 234 bp, Methanobrevibacter ruminantium
atgagcttattagataatattgataaaattcatacaacagagatgggtgttggaagaattcaaaggaatcttggaattgatgtggatccagttgaatattgcattttaaaaattaaggataaggacgctgtaattgaagagaagggcaaaaactattatgtaactgttgatgactgtataataacagttaataagcattcttttactataataactgctcataagaagaaatag

SEQ ID NO: 1456 - DNA, 780 bp, Methanobrevibacter ruminantium
atggatgatgaaaatccaagagtggctaaggcagatgcagaagttcaaaaactgatttcaagaaaaagaactaaagatgcagatgatagaaaggtctcaagcgagatatttgataaggcaactttgcaagtcctttataagctggcgaatcagggccatttggatgttttaaatggtgcaatcagcactggaaaggaagctaatgttttaaagggcataaaagaggatggatctatcgttgctgttaaaatctataggatagccacatctgactttaagaagatgcagtattacattgcaggagaccctagatttaatgtcagatcaagcaataaaagacaattaattaacaattgggtaaataaggaattcagaaatctgactcggctaaaggatgctggagtaaatgttccagaggcaatcacaagccttaacaacgtgcttataattgagtttattggtgatgaggatggaaatcctgcacctacagttaagaatcttcctcctcaagaccctgcccacttctatgagcaattggtggagcagatggacaggttcattaataaggctaatctgattcatggagacctctcctcttacaatattcttaattttgatgagaagcctgtaattattgacgtttcccaatctgttgtaagggatcatataattgcaaatgagttgcttgcaagggatattaagaatattagctttgaattttccaagatgggggttgacacttccattgaggatttgactaatcgattgattaaggattag

SEQ ID NO: 1457 - DNA, 321 bp, Methanobrevibacter ruminantium
atgtttaggaggcaaattttggcgaaaccacaaaataatcaacaagaatatagaagagtacgtactccaaagaagggagaaattccaggagtcgtagagcaaattatgggacatggtaaacttaaagtaagatgcgctgatggaaatatcagaatgacacgtattccaggtaaggtgaaaaagagaatctggattcgtgaaggggatgttgttcttgtaaagccatgggatttccaatccgatcaaaaggctgatgttatctggagatacacaaggactgaatccaattggcttgaaagaaaaggttatttaaaaatgtaa

SEQ ID NO: 1458 - DNA, 1215 bp, Methanobrevibacter ruminantium
atgggtgtagagtttttaaatattatagaatcagatgaagctaaagagatcataaaagaaaagttcgaagaatgttataccgctcaatctgaaatcatagacatagcagaaagtgctaatagaatcacatatagcaaaattgaaagtaagatcgattttccaccattcaaccgttcattaaaagacggatttgcaatcaaggcagaagacagctatggagttaatgaagaaaatcctaaaaagcttaaagtcattgactttcttgaagcgggatcatttacagataagaccgttgagcttggaagctgtgttgaaataagcacaggggctcctattccagatggtgcagatgctgtaataatggtggagttttcatataagtctgatgaaaatccagagcttgaagatgatgaggtggaaatcctaacaagcgtcactccttcacaggatatcggccaaaagggctcagacgttaagaaaggacaggtcatccttgatgagaatatcctattgaaccctccaaagattggagttattgcagctcaaggaatagacactgtagaggtctataaaaagccaaaagtaggaataatctcaactggaaacgaactcctaaccaaccaagaggaattaaggccgggcaaaatctatgacgtcaacagcgaaatgatcagagcgggggtaaacgcatgcggagccgaaggtgaatgccttggaatagtaagagacaattatgatgacttaaaaaacaagataaccgaatcattaaaggaatgtgacattctcttatgctctggaggaacctctgcaggggttggagacaacatccgccacatccttgatgaattgggaacagtctacattcatggaattaccgtccagcctggaaagcctaccatccttggagttgtagatggaaaaatcataataggccttcctggaaaccctgtttctgcaattgtcatatttaatgtgtttgttgcacctgcaatcaagaaattagctggattcaaacaagaggaagagcaaaaaacaataaagggaaaattggcaaaaagaatacattctcctattggcagaatgcagtaccaattggttaaagtagaaggagacagtgttattcctatatttaaagattcgggagcaatattctcacttgcaagtgcagcaggttatacaaaaaagtctcaaaaacagaacccgaatttggtttga

SEQ ID NO: 1459 - DNA, 468 bp, Methanobrevibacter ruminantium
atggagattcaagaaaagacaattgaagaccagaaagtcgctataatgaattataaaggctatcttaaagatatggagattttaatttccaaattaacaggatggattgagttagaagaaatagaaaccgtcggagacttatttgcaatattttacaacaatccaagaactgcaaaggaagatgaagtcgtttatgatgttggaatcccaatcaatccagaattagaccctgatgaaactgaagagataaggattgtaacaatcatcgaacataaagtcctatccggactccattatggttccattgacaatattcaagagacctataacattatggcagaatactctatcgaaaataaatatgacattatcggctctccaaaggaagtctacattaaaagcaaatttgatgttgaagatgaagaagacatgattactgaaatccaattgccagtaattaagatgtaa

SEQ ID NO: 1460 - DNA, 309 bp, Methanobrevibacter ruminantium
atggcagaagaagaaaaaagttctaaaaagaaatccaaaagagaattagaaaaggaacttaacagcaaagtagataagatcatagaaaagaacttcgaagattttaaatctcaagatgaacttgaagactttatccaaaaggctttcgacgataaagcttcacaatacaataaaaaaatcgaattaaaagaaaaagagttggataaaaagttcaaagcttcaagagaaaacgataataaaaaaatcgatagaaaaataagagaaatggatagaaaattaaaattaaggtataaaactatgttaaaataa

SEQ ID NO: 1461 - DNA, 1314 bp, Methanobrevibacter ruminantium
atgatttatgaaatagcagaagaggcaaaaagagaaatatcaaaatattcagacacttatgaaatttatattgacaggactgaattattggaacttgattctcaaaagactgagcttaattttgcaaaggaagatttaagcttaggagtggggattaggattatcaaggatggagcaataggatttgcattcacatctgatatggatgagattgcaaagacttgtgagaatgcttatttgaattcaaagctcaatacaaaggatgaattttattcatttgcagaatatgaaaaactccctgttgtaaaaggcacttatgataaaagatttaaggatttggatttggatgagcttacaggctcacttaaatctgtcttgaattctgttgaggattatggatgtcaggtaagctctggaggattttccgctgctgaaggtgaaaccttaataataaattcaaatggtgttgaagcctatgacaattctacaggctttgcaataggagtgtcaatcaatgcagttaaggatggtgaattgaccactgcttatgattccgattcatcctgcctttatgatttagatggtatggccttggtagaggatatttgtaatcttgcaatggactccttaggtggagaagacattgaaacttcagatagggatgttgttttagattatcatgctgccactggattattgtctacctttttaagcggattcaatgcagataatgttcaaaggggaagatccagaatcgctgataagatggatgagaagatcattaccgaaaacctttccatttatgatgattccactatcgatggtggattgaattcctctcgctgtgatgatgagggcaccgcttcaaagaggacttgtttggttgaagatggggtattaaaaggatttttatatgatatctacacagcaaataaggatggagttaaaagcagttcaaatggatttagatcatcctatttgggaactccttcagttggggcttcaaatctattgtttgactttaaaagccatagaaacttagatgacattgatgatgcatttttagttactgacgttttaggagcccatacagccaatccaattacaggagacttttcagttgaggcaagcaattcatttttagtttcaaatggtgataagaagcctattaaaaaagccatgatttctggtaatatttatgatcttttggctgatgctgaagctgttggtactgagactaaacaaagaggctctttcattattcctaagatatttttacctaatgtgagagtggttgggaataattcaaattag

SEQ ID NO: 1462 - DNA, 705 bp, Methanobrevibacter ruminantium
atggttaaaatagaagcaatagctgttgatgttgacggaacaattacggatggcagaagaagagtctgccatagtgcattggatgctcttagaaaggcagaggatgctggaattccagtgattattgcaactggaaacatttcccacttttcctatgctgtggcaacccttgtagggactactggaggccttgtttgtgaaaatgggggagttatctatcatgatggatataatgacaatcgagtgatcgtcttaggagatatctctaaagctcaaaaggcttatgattttctatttgataagtttggaaaagacattccatttaggatagtggaagattccgatgcaagggtttcagaaataactttctataagaatatgagttcagagccacttaaggagatgttgaaggactttgatgtagaggtctatgacagcggttttgcacttcatcttaccgatcctgcggtcgataagggaacagggcttgcaaaattggctaatctcgttggatataatgttgagaatattatgtgcattggagatagcgaaaatgatattgattttctccttgcaggaggatttaaggttgcagtggccaatgcatgtgatgagctaaaagagattgctgattatgtttgcgagaataagtatggtgatggagtggcagaggctattgataagtttgtttttaatcaggaatag

SEQ ID NO: 1463 - DNA, 954 bp, Methanobrevibacter ruminantium
atgatggctagtatgaaagagatggctgatgctatactaaaaagaattaatgatttagctgttcctgtaaagattatgcatgtttgtggttctcatgagcatacaatcatggaacatgggattagatccttgcttcctccggaaattgagattgttgcagggccgggatgtccggtttgtgtggttccttcaagggaaatcgacgaatgtctgcaactcgtagaaaaaggggttactgtaaccacctttggagacatgttaagagttccaggttctaatggctctcttgcagaggctaaagctgaaggtgcagatgtaagggttgtctacggtattccaaatgctgtggaaatcgctgaaaagattgataatgatgttgtattcatgtctgcaggatttgaaacaacagctcctgcaaccgcttccgagctcttgaaaaagcctcctgaaaacttttcaatcatttcatgccataggctgatccctcctgctcttgacttcttgatcaattcaggagagaccaatctaaacgctctcattcagccaggacatgtctgcaccattcttgggacagagccatttgaaaaattctctactgaatatggaattcctcaagcggtggctggatttaatcctttggatatattaatgtctgtttatatgatattaagacaaatcgatagaggagagcctagaatagacaatgagtataagagagcagttagaactgaaggaaatgtcattggaaaagagatgatggatgaggtcttccatgttgaaagcagggaatggagaggatttcctaaaatccctgattctgttttggaagtaaatgatgagttttcccagtggaatgcaagggaaaagtatgatattgaagtaaaggacgttactgaagctcctaaaggctgcatctgcggacctattcttagagggcttgcaaaaccttactga

SEQ ID NO: 1464 - DNA, 1443 bp, Methanobrevibacter ruminantium
atgagtgaatacgtgcgatttatacaaagaataggtctagtcgggattacaaacatcctaatatctcttagtagcctaatctttattccaatcattacaaaatcctttactacagccgaatacggaatgtgggctcaagtaaacactaccatcgcacttgttccaaacatagccaacctaggtcttccatacaccatggtacgattcctgtctgctgaaaaggataaggaaaaaataagagattccttctatccaatgataagcctgacattcatatcaacagtgatcatctgcctattgtttttaatatttggacaccctattgcagatgcgctctttaatggaagcatgcaggtattgtacatcacaactgcaatatccttctttgcatgcatgaacctaatgctcataacctactttagaaccttccaggaaatgaaaagatattccctattccttgttcttcaaagctatataggggtttttgtaagcatctaccttacatatgcaggatacaatatagaaacagttgttctcggtcttttaacaggctatgcagcagtattcatcatgatggcatttctcattgtaaggcatcttggattcagctttggaaaatggtcaaacctaaaggaacagcttgcctttgcccttccaaccattccaagcaatgtttcaagctgggtagttgattcaagcgacaaatatgttattggaatccttttagggtcagtggcagtgggatgctattcaccaggatatgccttaggaagcatattgctaatgttcctatctccatttgcagttcttcttccaacgattcttccagagcattatgaaaagggagatatggcagaggtagacaaatatctcagctattcaatgaaatactatcttcttctcactgtgccagcagctgtagggatgagcgtactctctaagccattgctttacataataacaaccccagagattgctcttggaggttatatggtaactccatttgtctgtctaggtgcaatattcatgggaatgtatggaataaccaataatatacttatactagagaaaaacacaatgatccttggtaaattatggataattgtagccatatccaacattgttttaaatctgattcttgtgccttatctaaatataattggagcggcaatagccacacttctctgttatatgctagcatttggagtgactgccattgcaagcagaaagacaatgagattgcctttcaatagaaaggaacttgtaaaaatacttattgcatcagcgattatgggtgcagtggtttatatgatgaatccaagtggaatagttaatgttttagtggctatattagtgggagttgtggtttattttgcaattatatttgttttaaaggcagttacaagaaaagaaataggtatatttaaagatttagtaaaataa

SEQ ID NO: 1465 - DNA, 507 bp, Methanobrevibacter ruminantium
atgatttcaaagatttttaacattaaacaaagcattaaaagggcttattatacatatagggtaaagagagtgtcaaagtcctgtggagataatctcactgtaaacaattactcctatgtcactccaaagacaagtctggcagataatgttaatttcaatggcatgaagatacaaggaactgccaatgtaagcataggaagcaatttccactctggaatcgactgtatgataatcacagacagccataactatgagggggaagcgattccttatgatgagactgtcatttcaaaggatgttgttattgaagataatgtatggattggaaatcgtgtaataattcttccaggagtctgtattggtgaaggggctataattcaggctggaagcgttgtggtaaaggacattcctaaatgtgcaattgctggaggtcatccggcaaaggtattttcttctagagataaggagcattatgaaaaattaaaagaagaaggtaagtttcattaa

SEQ ID NO: 1466 - DNA, 1371 bp, Methanobrevibacter ruminantium
atgaagaaagttattctaatagcattttattttaatcaggtaaatgaaatagcttctaagcgtttaagggctttagctaaatatttgcctcaatttggctgggaagttgttgtaatagttccagatttaggttatgaaccttcctcaaatgcagatttaagctctagaataataactactgaatatgaagacatgttttcccatatatttactaagtttaagcctggagataaaagcaagcttaatgataaatcagataatcattccacctcagacagtcaaaagctaaaggattcctcttctgtttctaatccaattgcctcaaaggcaatctctatagctggagaagtctttgcatatcctgatggaatgaagtattggtatggtcctgcttatgaagcagcttccaagatagttgaagaagaaaagatagatgccataattagctcctcttggccgattacatgccatacaatagcaaaggacatcagcgataaatataatattccttggatagctgatttaagggacttatggaatatggatccttatatttcacacacttttattagggattattttgaaaaaagattagaattgaagacatttgaaaatacggatgtattgacaactacaacagatttggctgctaaaacattagcaacattgcatcccaataatcgtatagtgcctattttatctggttacgatgaagatgactttaagtttttagagagtgttttagaggaaaataatgattctgattctagtgaagattctgtttctgctggggattctaattctagtgaaggttctgtttctgccgagaattctaattctagtgaagattctatcactacagttgattcaactgatagaaaacttaaacttatctatgcaggttccttatatggtgggaaaagagatccaacattattatttaaggccattcgccaattagaagacgaatctaaattggatagttcaaatatttccatagagttctatggagatagcggcaatctggaagagattgctcgtgaatattctctgcttgatattatcaaaatcggtggcaggatctcccacgaagaggttttaaaaaagcaattagacagtgatgttcttttactcatatcatggaataatgaaaaggagaaaatgtttattccaggtaagatctatgagtattttgctttgcaaaagccagttctatcaatagggtataaggaaggatcccttaaggacttgatagaggataccaatgtaggatatcatgtctcagatttagaatctacaaaaaaggttattttagatatttataatgaatttataagccttggcaaggtggaatttaaaatcagaaattaa

SEQ ID NO: 1467 - DNA, 1095 bp, Methanobrevibacter ruminantium
atgagtaaaattaaaattgcgattgtaggaatcggaaactgtgcaagctctcttatacaagggatttactattataaagataaaaaccctgaagatgcaattggacttatgcattggaaaataggagaatgggacccaacagacattgaagtggtagctgcttttgacattgacaaacgaaaagtgggaaaaaccattgatgaagccatctttgcaaagccaaactgcaccactgtattccaagaggaaattcctaaaagtgatgttaaagtttgcatgggacctgtccttgatggtgtaagcgaacatatggctgactttgaagaggattatacctttgtagtggcagatgaagaaccagttgacgttgttgaagtcttaaaggaaagcggtgcagaaatcttgctcagttacctgccagtaggttcagaggaagctgccagattctatgctcaatgtgcattggatgcaaatattgcttatatcaattgtatgccagtatttattgtaagtgacccagaatgggatgctaaatttagagaaaaaggaattcctattgtaggtgatgatattaaagcacaaatcggtgcaaccattactcatagaacattaagcaatctctttaaagaaagaggagttaaattagatcatacttatcagataaacaccggaggaaataccgatttcatgaacatgcttaaccgtaaacgtttagactctaaaaaggaatctaaaactgaagctgttcaagcggtccttgctgaaagaatggaccctcatgacatccatatcggcccaagcgattatgtgccatggcaaaaggacaataaggtatgtttcttaagaatggaaggcagaacctttggtgacgttcctatggaaattgagttaagattaagtgtggaagactcaccaaactctgcaggatgtgttattgatgctattcgctgctgtaaattaggtttggaaagaggaattggtggacagctaacttctatctcttcctatgttatgaaacatccacctgaacaatttacagatgatgaagctgctgcaaaagtagaggcatttatcaaaggcgaaattgaacgttaa

SEQ ID NO: 1468 - DNA, 1722 bp, Methanobrevibacter ruminantium
atgaaagtaaaaataactgaaaccgcattcagagatgctcaccaatcccttttagcaaccagaatgagaacaagagatatggttcctattgctgaagagatggataaagtaggatatcatgcaattgaagcatggggcggagcaacctttgacacttgtataagatttttaaacgaagatccatgggaaagacttagaatattaaaagaaaactttaccaacactcctctacaaatgctcttaagaggtcaaaacttactcggatacaaacattatgcagatgacattgtaaccaaattcgtagagaaatcctatgagaacggtgttgacatctttagaatattcgatgctatgaacgatattagaaacatggaacaatccattaaggtagctaaggctcaaggagctcatgttcaaggaacaatcagctacacaatcagcccagttcatactgtagacaagtttgtggaatttgctaaagagcttgaagcattggaatgtgattcaatagccattaaggatatggcaggtttaatcagtcctgctgttgtctttgaattggtttcaagattaaaggaagaaactgacttgcttgtcaacttgcattcacactgtacaagcggtatcactccaatcagttattacgctgcttgtcaagccggagttgacattttagacactgcaatctctccattggcttggggtacttcacagcctcctaccgaaagtattgtagcatccctgcaaggaactgaatatgataccggattggaccttaagacattaaaccaaatcaagaaatactttgaaacccttagggcaaaatacgaaggctatattgacccaatcagtgaaagaatcgacactgacgtattgatgtatcaaatccctggaggaatgctttccaacttaatttcacaattaaaacagcaaaacgcattggacagataccaagacgtattggaagaaatgcctcgcgtaagagaggatatgggatatcctccacttgtaactccaacaagccagattgtaggtattcaagctgtaatgaatgtaatcaatggagaaagatacaaaatcgtatctaacgaagttaaagattatatgaaaggttactatggccgtgctccagcaccaatcaatgaagaaatcgccaaaaagatcattggtgatgaagagcgtatcacctgcagacctgcagacttgattgagcctgaatatgacaagttcaagaaagaggctgaagaccttaagaacttcgagaaggaagaggatgttctcacccttgcaatgttacctccagtagctaagcaattccttaacggagaaatcaaggaagaagacttcccagagaaaaaggttatagatgatggcggaatcagtgccattcctactgaatactctgtagaggttgatggtgatgtctttgatgtaaagatcatgccaaccggatacataaagattgatggagaaggcagtgagccagctccagttatcgaaggtgctattactgcatccatgcaaggtatggttcttaaaatcaaggtaaacactggagataaagtacaaaaaggctctgttgtagcagttcttgaagctatgaagatggaaaacgatatttatgccgaagaggatggtattgttgaacaaatattcgtagaagaaggagacactgttaacgcaggagataatataatggtaattaaaggattagatgaataa

SEQ ID NO: 1469 - DNA, 606 bp, Methanobrevibacter ruminantium
atggataaaagaataaattttgtatcaatctctagatttaccctccttgtggctatttttctattgataataaataagatacagtttcatgcaaagattttagattatatggccttagctttagccatatttgctataatttgtattatcatctttatcatacaatttaaaaagggattggttgagtttcctattaaagttgttgttgaaactaatgttgataaggctttggctgatggggctattactgaagagcaagcggaaaatattccaaagagggttgttcttaatgcaaacgatatctttttaaatttagtctttaatcttgcaattgccaatcattttgatctcttgcctgtagacgttcttagggagtatataccagacattcctccagctaatcttatgagattgtatgaaaagtctagagagataagtgatgatttgaatgattactttaggtctcaaaagttcttaaataaggccgatgttattacccgttctgatgagataaaaacatatttgagagagacttatccttggatggatgatgttactttggataatacttttgattacttctttttaggaattggtaatggataa

SEQ ID NO: 1470 - DNA, 1275 bp, Methanobrevibacter ruminantium
atggtttttattattgaccctcaaaatgcaggaatatctgggaatatgattattggagctcttgttgatttgggagcagatggcgaaaaggtcaagaaccttatggaagatgtggcttacgactttggagaggtagaggtttccataactaaagtcaataagtcaggtatcgaagctaacttctgcaatgttaaaacaatccatgatgaagatgaaaataatcatcatattcattttccagactttattgataagattgattcactaaaggagcttgatattgaaaacttgactgatgaaatcttggatatggctaaaaatgtctttaagcgcatagccatttctgaatctagagttcatggaaaatctttggaggaagttcattttcatgaggtcggggcagctgatgctgtggcagacgttttaggtgcaatctgcgcttattttgacttggatatggacaaggaaagggttgttggattgcctatttctgttggaggaggcactgtaaagacagcccatggaataatccctgttccggcacctgcaagcttggatattcttaaaggcttgaatgaggatgaattcaatgacttctataagggagaggcacaatgccgaggagggcctgttgaaagcgagcttgcaacacctactggttgcgcattgtatatggaattctgtgatgaattccttgagtttgctccaatgatgtctccagagagaatcgcctatggctgcggctctaaggaatttgatttccctaatgtcataagagtcataaagtcaaaggatacaaatgagaagcatagagtttgtgttattgaaaccaatatagatcatatgtctggggaagaattaggattcctatttgacttgttgcttgatgctggagcttccgatgtttctatggttccaatagtgatgaagaagaataggccagggcaattgattaaggttatctcaaagccacttcttgtagatcatctagtgaatatattatttaagcaaaccggaacattaggcattagggtttctgaaaacactcataggggaattgctgaaaggcattttgttcctttagacattaatattaatgataggatttataccattaactttaagataggtcttattggggatgagattatttcccataggccagagtatgaagaccttaaaagaatctctttagaagaggacattcctttaacagagattaaggaagttgcaaatacaatgattcgtgattttttagagaataatagagaataa

SEQ ID NO: 1471 - DNA, 837 bp, Methanobrevibacter ruminantium
atgaaagaaaaaaacaatgatgactattttgaaaagcaaaacccttccattttacgctcaattggaggattattcacattttcaaccatcctgccattaaatatctacacaacaattgatgaaatggcaaaaatgacatggttctggccagtattaaatggaattgttggtttgatagctgcaatcatcgcatttatcctatgcagatttgcacatttggacggattggtcattggagcaataatttatggattcctattaataatcaacggatataatcactttgacggattgatggactttggagatggagtaatggttcatggagatcctgaaaagaaattaaggattatgaaggacccgatgactggagttggcggaatagccacaggatttatcgtcggaactataacaattgcattatattcatcattgattgattattcctatatgataagcccagatttcattttgctaatcatagttgctgaaattgcagcaaagataggattaacaacctgttgcatcacttcaaaagcaggaaaagaaggaataggcaaatactttataaaatatatgaatattaagaactatattgttggacttataatttgcttaatcattgcatccttacttagcatgaggataggatcccagataggaattttaggaataatcggaggagcatttggaggtgctttaactgcactaattgcaaaaagacatcttaagattgcaaatggagatgttcttggaacttctaatgaactaggaaggttattttcattgcttgcgatgctaattgcaatttcaatgcattttagtgtattaatataa

SEQ ID NO: 1472 - DNA, 558 bp, Methanobrevibacter ruminantium
atgacaataaacgttttaagattagatcacagaattggaagagacacacgtattacaacccatgtatgcctaactgcaagagctttcggagcaagcaaagtatggttagcaggtgaagaggaccacagcatgatgagaagcgttagagacattgcagacagatggggaggagactttgaaatcgaatataacaattcatatatggaagtcataatgaactggagagaaaaaggtggaaagatagttcatttgaccatgtatggtgcacaggcccatgaggttgtagatgaagtgcgtgaaagctctgatgacattttaattatagtgggcggagcgaaagtgcctacaaaagtatataaaaacgcagactggaatgtttctgtaaccacacagcctcactctgaagttgcagcacttgcaattttccaacatttattgatggaaggaaaagagtttgacttggaatttaaagaccctgtatttgaggttattccaacagcccatggaaaaacagtaaatgttcataatgaaaatagaaaattaaataaaaaagaataa

SEQ ID NO: 1473 - DNA, 1122 bp, Methanobrevibacter ruminantium
atgcaaagaagaggtacaaccaatctgccactacatggaggtcatacgccacgttggctatttgatcgtatgaccaagctttcaggtgcaattactgaagtagtaattgacgaatatggtcctaatgaatttttaaacagaatctctaatccttactggtttcaggctttttcctgtgttctgggctttgattggcactcttcaggtacaaccaccacaacccttggagcgttaaagtcttcaattgaccctgaaaagcatggaatttacatctctggcggaaagggctctgcttcacgaaagacccctcaagggattgtaagggctggcgagatattcaatctaaaaagctctcatgtggataatatggtaaactccagcaaattatctgcaaaggttgataattcctgcattcaggatggctatacattatatgttcataatttcttcataaccgaaaagggagattgggctgttgtgcaacagggaatgaacactgaaacaaagtatgctaggcgctatcattggatgggggagaatgtagacagtttcctgcaagaccctcataatggaatttcctgcgataaaaaggaaaaggaagctttgaatatggcttcaaaggatagtgttgaggctcaaaagataagcgttgatttaatcaatgacaatcctaaccatttaagggactattttaaaagaaaagattcaaatcagcttcttttaactgatttcagcattagccaagagaatacccttacccttcctcctcatcatcaggtattggatatggatttgtctgataaggaatttcaagtattaaagaatgcttgggaaatacagcctgagaattatgaagagcttattttattaaatggaataggtcctaaaaagattagggcattggcattgatttctgatttggtatttggtgagcctgcaagctggaaggatcctgttaaatacacattcagtcatggaggcaaggatggatttccttatcctgtggatagggatgtctatgacaattcaattgcaactgttaaggatgctctttatcaggcaaaattagataagtatgataagatgaaggccttaaagagattggatgattttatttcttaa

SEQ ID NO: 1474 - DNA, 501 bp, Methanobrevibacter ruminantium
atgaaaagaataactactccaattagtgatgatgatattaatgatttaaaaataggggataagatttctctttcaggaaaaatgtattgtggaagagatgcagttttgcctaaattatccaaatctattgaaaatggccaagaggataagtatccatttgattttaaaggcatggcaattatgcatactgcatttagtgtagcaggtatagctccaactacaagcaataaggcagaaattgaatcttctatggaagcattatcatctgctggagttaaatttcatataggtaaaggttccttatctgatgagactaaaaaaactttggataaatataattctatttttattgtaactcctcctgttgctgcacttttaacaaataatgtaatttctaaaaagtgcgtcgcatatgaagaagaaggtatggaggccttctttgagctggaagttaaggatattccaggtattgtagcaattgctcatggaaagtctttataa

SEQ ID NO: 1475 - DNA, 1167 bp, Methanobrevibacter ruminantium
atgaataaggaacctattagcgaagaagaaatttttaaggaattggatttttaccaatctcaagattgcaaatattcagatggtagaattcttggatctatgtgtactcaagcacatcctattgctcaaaaagcttttattcaatttttagaatctaatcttggagaccctggtctttttaaaggaacaaaagccattgaagataaggttttaaaaatgattggttctttcttatccattgagaatcctgttggccacattgtaactggaggaactgaagccaatattatggccattagggctgcacgtaatattgcccgtgatgaaaaaggaataagtcaaggagaaatcatcgttcctcaatctgctcatttctcatttaaaaaggcctcagacattttaaatcttaagcttagggaaatcgttttagatgattcctatcagttggacgctagttttgtagaggatgaaatcaatgaaaacactgtagctattgtaggagttgcaggaactacagaacttggaatgattgaccctattgaagaattgtctaatattgctttggaaaataacattcacttgcatgttgatgcagcctttggaggattttccatacctttccttaaagagataggatatggccttccagaatttgacttttcattgaagggagtcaagtccataacagtggatcctcataagatggggcttgcccctattccagctgggggaatcctatttagaaatgaagagtatttagactccattagtgtaaattctccttatctaaccataaaacatcaatccacaattgtaggaacaaggatgggagcaacatctgctgccacttttgctgttatgaagtatttaggaaaggatggctatgcaagattagctaaggaatctttagataatgcaatatttttagcagagtcagttaagcagttaggttatgagttggtagtagagcctaaattgaatattgtggcattcaatcatcctaaacttgaaacagatgacttggcccaattgattgagaagagagattggaaagtctcttgctcatcttgtcctaaggcgataagagtaattttaatgaatcatattaaaagagagcatatcgttgaacttatatcagacttaaaagacatttctgaatctatttag

SEQ ID NO: 1476 - DNA, 2271 bp, Methanobrevibacter ruminantium
atgtatgttataaagtttgaagacttaggtaaagatgacatcggtattgctggtggaaaaggtgctaatttaggagaattgactcaagcaggcattcctgttcctccaggatttgtagtaacatccgaaacttataagaagttcatgatggatacaggaattttcaatagtgttatggatatattggaccaaactgatatcaacaacactaaagagctccaagaggctgctgaagaaatcaagagaatcgttatcgaaactccaattccagaagacatttccacttacatcattgaagcttacaatcaattatcccaaaaggtcggcgtagatgaagctgatgtggctattcgttcttccgctactgctgaagacttgcctgaagcttcctttgcaggtcagcaagacactttcttgcacgttcaaggaattgacaatgtaatcgaatatgtaagaaaatgttgggcttccctttttgaagcaagagctatcttctacagggaagagaacaactttgaacactctcaagtttacattgcagttgtagttcaacaaatggtcgattctgaaaaggcaggagtaatgtttaccgtaaacccatccactggtgaaaacattgccttaatcgaaggatcttggggacttggtgaatctgttgtcagtggaactgtaactcctgataactatgttgtctcaaaggaaaacaatgaattgttgaatatcactgtcagtgataagaaaaccatgtttaccaatgacgaaaatggaacctccattcaagtggacgtccctgaagataagagaaatgaaagggtcttatctgatgaggaattagaaaaattagttgaaatggctaaaagggttgaaggtcattacggcaaacctcaagacaccgaatgggctttccatggcggaaacctattcctattgcaatcaagaccaattaccactcttggagacgctgaagaaaaagcttctgaagaggatgttgacttagaagtattgattaaaggtctcggtgcaagtccaggacttgcttccggtactgtaaaggttatcttaagccttgatgagcttgacaaggttcaagaaggtgatgtgatggtcactaccatgaccactccagacatggtacctgctatgaaaagggcaaacggtatcgtaaccgatgaaggtggagtaacctgtcacgcagctatcatctcaagggaacttggaattccttgtgttgtaggtactggagatgctaccaccacattaaaggaaaacgacaaggtaactgctgacggtaagaaaggtttagtctacaaaggaatcatcaaaggagaagaacctgctgaagcagctgcagtacaagtttctgcaactcctttaatcactgtaaccgaagtaaaggctaatgtaagtatggctgaagcagctcctaaggcagcagcaactggtgctgatggtgtaggattacttagaaccgagcacatgatgttatccactggcgttcacccaagaaaattcatcttagatggcgaagaagacaaattagtggatgttatcgctgaaggcgtattgaaagttgcagatgaattctatccaaaaccagtatggtacagaactcttgacgctcctaccgatgagtttatcacccttgaaggtggagaggatgagccaagggaacacaacccaatgctcggttggagaggtatcagaagagaattggatgagcctgaaatcctaaaggctgaattcaaggctatcaaaaagcttcacgataaaggttacacaaacattggaatcatgattccattgtcacaacacccatctgagcttagaagagcaaaggaaatctgcagagaagttggcttggaacctcaagtggatgttgaattcggtatgatggttgaaattccagcggcagctattctcattgatgaatacattgcagaaggaattgactttgtaagccttggaaccaatgacttgacccaatacactcttgcagtggaccgtaacaatgaatttgttgcaaaacactacagagaagagcacccagcagtaatggcattgattgaaagaacaatcaagcactgtgcggcagcaggtgtaacatgcagtatctgcggtcaagcaggaagtgtgcctcatattgttgaaaagcttgttaagtttggaattacaagtgtttcatctaatactgatgctgttgaagaggttagaaagactgttgcaagagctgaaaagaaaatcatgctcgatgcagctagaaaacaattataa

SEQ ID NO: 1477 - DNA, 483 bp, Methanobrevibacter ruminantium
atggttcgtgcttattcaagaagagaatatattagaaaaataccaaataacagaattgttcaatatgatatgggtaatttatctgaagatttccctgtaagattatctttagctgttaaaaaaccagctcaaattagacacaatgctttagaagcagctcgtattgcttccaacagatacatgcaaagatctgctggtagattaggataccacttaaagttaagagtatatcctcacaatatcgtaagggaaaaccctatggctaccggagcaggagcggacagggttcaaagtggtatgagaaatgcattcggtaaggctatcagtgtagaagctcttgtaaagaccaatcaaaaggttatgtctattgacgtaaaccctaaaaacttcgaagatgctaaagttgctttaaaaagagctggaatgaaattacctgtttcctgtaaaattgttgtagaaaaaggtgctgaattaattaaataa

SEQ ID NO: 1478 - DNA, 237 bp, Methanobrevibacter ruminantium
atgaaaataaaatcaaatataagacttaaatataataattcaaaaaatgctgaaattgtatataaatctttagaagtggataatgagggatttttagaatctgaattaaattcagatgaaatagaatacaatatcaaaagcgacaagcttggaagttttttaaatactgcagatgatttaatagcttctgagatattaatagaggatccttttaaaaaacaacctaaaaaagattag

SEQ ID NO: 1479 - DNA, 771 bp, Methanobrevibacter ruminantium
atggcaatccaagatggtgactttgtaagagtagactttactggtagtattaaagaaactgatgaaatttttgataccacttctgaagacattgctgaagaagctggtattttagtagaaaataaaaaatatggtccaattccaatcattgtaggtggaaatcatttattacctgcaattgaagaggcaattatcggatctgaagctggtgaatctgttcatgtatcagtcactcctgaaaacggtttcggtcaaagaaaccctaatttaattcaattaattcctatgaaagagtttaaaaaacaaggcatgactcctgtaagaggcatgaaaatcagcactgaaaacggtaacggtaaaatcatttctgtaaatggcggaagagtaaaagttgatttcaaccatgatttagctggtaaaaacttagaatatgatgtaactgttgtagaactcattgaagatgatgaagaaaaaattaaaagcatgattgagttacattactcctatcctaatatggattatgataatattgaaattaaattcgatggaagcaccgtttctattaaattagatgagatcactagattcgatcaacaatcctatatggatgtaacttttgctagattcagaatttctaaagacatttgggacaatatggattacgaaaaagttcaattcgtagacgaatttgaaaaaatcgtagaagaagctcctgatgaagaagtagaagcagaagtagaaactgaagtagaagcagatgcagaagaataa

SEQ ID NO: 1480 - DNA, 1188 bp, Methanobrevibacter ruminantium
atgccttcaattgattttataagaaatattcttaaagaagataagaaaacattttgcaatgattataaaaaagctcaaaagtctttatctgatgatgatggatattctaatggctcttcacagtcaaaacagtcttatgaaaaaactaatgaagaatctacatccaatcctttaattgcagactttactgagtattctccccttcataatggtcattttcattgcatgaaaacagcaaagtctaaaattccaaacggtctttttgttgctattgttccaggtctttttgagcgaagcggtcggggattgccttatatcatgcatagaaatgtccgggcagaaatagctattgaagttggggcagatattgttgttgaaggacctccaatgggaataatgggatccggccaatattcattatgcttatgcaagatgtttcaagctttaaacacagatttcattccacgaggctataggccttttgatggctatgatgaaatcttaaaaagaatttctatgggacatggtgtagctccaaaaccttataaaatcgttgatatggatacaaaagaaactattcttgaaggaaagcttgaggaagacaattatgttatcgtttccttttccaaatctttaaaaagaataggctttgattttaaggataaatttatttttgtccctcgtattgaaggtgttagcggaactttaattcgaaaagcctgctccgaaaacaaattggaagatgtagagtcaatgcttcctccggaaacattaagaattttaaaaagagaattggataatgataatgctcctttacatgatcagcgagattatgaagtgattttaaactcagcaaacaacttgtcctatgatgagctaattaaattaaacttcttcagtgaaaaattggctaatgaatttattgaaaaacgggaaaataaggagtttgaatctatctctgaaatagaggatgctattttttatggatttagcagccattataaaaatagggttttaagcattttggaaactcaaatgagaggggatgtcatctctaattatattaatacctatccatttaatgttagggttttaaattataagaatgagacagttttaacccaatttgaggaaaaggttttaaatgatcatccttttgtaaattcaattgaattgactaatgaataa

SEQ ID NO: 1481 - DNA, 198 bp, Methanobrevibacter ruminantium
atgtctgaagaaacaaagattaaacgagtaactatacatgttgaaagtgagttagattatgaatttaggcgattagcttctcagaagtttcgatttgagccgaaatggtacagtaaggcgattaaggaagccattttgttatggattgagaataatccagaagaggactttgaagaccttcctgaagaagatacttga

SEQ ID NO: 1482 - DNA, 1254 bp, Methanobrevibacter ruminantium
atgtttgatttggtcttaaaaaacttaaagcttgtaggagagtctggagaattttatattgctattcaggatggaaagatagcaaagatgtctaaaactccaatttcagcagataacgagatggatattaaaggacaatatgtcttgccaggacttatagaccctcatgttcactttagagaccctggactcacctataaagaagattttaaaacaggttctatggcagcagccaatggaggatttacctttgttatggatatgcctaatactcttcctaaaacaaacacatacaaggcatttaaggataagttagaaatggccaattcaaagtcagttgttaatttcggccttcattcaggtcattcctcatttgaagagatggaaagaatactggaattgaatccaatgtcctttaaggtttttatggatcttgaaagtgatgaacgtcttagggagatatttaaaaacatttctaatcttgatggaaatcctattttaactgttcatgctgaaaagcaatccattgttcgagaaaatacagaaagattatctgaggacttagaacttaaggataagccaatcagctatagctatgcccgttctgccgaatctgagatagaatcaatctctcaaacgatttccctttcaaaagaatttggaaataatttgcatatatgtcatttaagcacaaaaaagggaatggaacttgcaaaggagaacaacattagctatgaattcactcctcatcatctattgtttgacaatagttattttgataagtttggcacaatcgttaagaccaatcctcctttaagggaatctaaggataaggttaatgtttcagatattgattcagattcaatgattggtacagatcatgcacctcacagcttggaggagaaaaataaaggtgtgtgggattccagtccgggaattccttctttagaaacagttctatcattattattgactgaagtgaataaatccaatctggatttcaatttaattcctaaaatatttgctgaaaatccagctaaaagattcaatctaaaaaataaaggatttattaaggaaaattatgatgcagactttgttgttgtagatttaaataaagaaggaactttcaatattgatgagttttatacaaaagcagaatattctccatttgatggaatggactatcaaggggctgctacaatgactattattggtggagaggtaattatggaggataatgaattatttatttaa

SEQ ID NO: 1483 - DNA, 1233 bp, Methanobrevibacter ruminantium
atgatagtattcaatgaagatagctgtattaaatgtggagcatgtgaaggagtctgtcctacagcagctattgaagtaggcgatcatatcgtttactgtgatacttgcagcgaagaaccaaaatgtgcagaagtctgtaccaaaggtgctttgcaagtagacgacatagctattgatgaagaaggaaacactcaagtaagattaatctttaacaaaacaaaatgtgacgaatgtggagactgtgtagacgcatgtccttctaaaactcttaaattagatccagaagattctcaactccttaaaggattctgtgtaatgtgtcaaaaatgtgtggacatctgtcctgttgacgttatcggagttcctggaattaaagaacctgcttctagagtaattgaaccagaaggcgcggtatacattgatgattgtaaaggatgtggagtatgtgttgctgaatgtcctgtagatgcaatcaccttatctgcttacggagaacctatcgaagtggatgaagacaaatgtatccaatgtggagtatgttcacaatcctgtccttggaatgcaattttcatcgctggaaacgcaaaacctgcaaaacgtagcaaagtaatgaaatcctttactttagacgctgatgcatgtattggctgtaattcctgtgttgacgcatgtcctggtgacttcattagtcctaaatctgacttgactgtagctcttcctgaagcatgtgctgcttgtggtctttgtgtaaatgtatgtcctgtagatgcaattgatttagatgttgaatatggcgcatctaaattcgattcaactgaaggaatctgttgggatggcgaaaaatgtctctatgatggaggctgtgctttaaaatgtcctactgaagctataagagtagtgactaagagaggaatggaagtaccttcccgtcagaaagatatgggcgaacaatctttcatcatgtgtgtaagatgtggtgcttgtgcaaatgtttgtcctaacgatgcattacaattagactatgttgacaaagagattgatggcgagactgtcatgagagacagaatcatattcaacccatccaaatgtgacgaatgtggagaatgtattgacgcatgtccatatgatatgttacataaagcatacaaagttaacttgccaatcgcaggtttttgtaccctttgtgaacaatgtcttgcaaaatgtacccctgaagcacttagcttaaaatag

SEQ ID NO: 1484 - DNA, 1413 bp, Methanobrevibacter ruminantium
atggaacctgtaactcgtattgaaggtcacgcaaaaattactgtacaccttgacgaagcaggaaatgtagaagacactagattacatgttatggaatttagaggattcgaaaaattcttacaaggacgtccagctgaggaagtacctcgtattgtacctagaatctgtggtatttgtgatgtacaacaccacttagcagctgctaaggctgttgaccaaatctacggatttaacgatgatgacatcttacctgctgcttacaaaatgagagaattaatgaactggggatcttacatgcactctcacgctctccacttctacttcttagcagcacctgatttagtagttcctaacggaaccagaaaaacaagaaacgttttccaaattatccaagatatgcctgaagttgcacttcaagctattaaaatcagaagaaacggtttagacatcgtatccgcaaccggtggtcgtccaattcacccaacttcctctacccctggtggtatttccaccgaattagatgaagaaactcaagctgacttattagcaaaagctaaagaaaacgtagaattagctcaagctaccattgaattagctgtacctatcttagaggaaaaaatcgacttagtcaaaaccttaggttacttcggtgacacccgtcactgtggtatcgtaactaaagatggtgactgggacgtatacaacggtaaagtaagaataaaagacaaagacggttctatctacactgaatacagaaacctcgaatacaaagatattgttgcagaacatgtaaaaccatactcctggttaaaattcccttacattaaagaattaggatacccagaaggtatttacagagttgctccattatcccgtattaacgtttgtgataagatgcctgatgcagctcctttagcacaaggtgctttagaagacttcagagacagattcggttacgcacaatacccattattattccactgggcaagattaatcgaattattagcttctgctgaaatggctgttgacgcattagaacaagacttatctggtgacaaattccctgacgcattagaaagaactgctggtgaaggtgcaggtatcgtagaagctgcacgtggtactttaatccaccactacacaactgatgacgaaggattaatcacccaagcaaacattattgtagcaactatccaaaacaaccctgctatggaaatgggtattcaacaagtagctaaagactacatcaaacctggtgtagaagtagatgataagattttcaacttaatggaaatggttatcagagctcacgacccatgtttatcttgtgctacccacactatggacagtcaaatgagattagctactgtagaagtatatgacagtgaaggaaacttaataaacaaaatctaa

SEQ ID NO: 1485 - DNA, 927 bp, Methanobrevibacter ruminantium
atggcagataaagctaaagtaggaactatgtggctcggaggatgttccggttgtcacttatccattgcggactttcacgaatctttattagatgttttagaattagcacaattcgaattctcaccagtattatgtgatactaaatacgatgaagtacctgaattagacgtactcattgtagaaggtggaatcagaaacgaagaaaacagagaattagcagaaatgttaagagaaaaagctggcctcgttattgcatatggtacttgcgcagcttacggtggtattcctggtctcggtaacttacacactgttgaagagttaacaaccgaaggttacattaactcctgcagtactgtaaacccagaaggaatcattcctaacgaagatgtaccaaccttagaaagcagagtaagacctttaggcgaagctattcaagttgacttattaattcctggttgccctccaaaatctgacgtagtagcagaagctattcttaccttattaaacggaggaactattgaattacctaccacaaacctttgtgaagtatgtcctagagaaaaaccacctgctggtctcgctatggacttcattaaaagacaatttgaaatcggtaaacctgaagacgacttatgtttaattgctcaaggtttagtatgtatgggacctgcaaccgtatccttatgtggagcacaatgcccaagtattgctatcccatgtagaggttgctacggacctactgcaaaagtaaacgatgcaggtgcaaaaatgatttctgcgattgcatctgactacggtgtaaacgaagataagaccgtagaccctgaacaagtagctgatcaattagatgacattgtaggtactttctacacttacactttaccagctgctttagtccctgctaaaatgcaaaaaggaggaaaataa

SEQ ID NO: 1486 - DNA, 426 bp, Methanobrevibacter ruminantium
atgtctgaagatgtaaaaattgtaatgttttgttgtaactggtgttcctatggtggagcagatactgcaggtactgcaagaatgcaatacccacctaacattcgtgttataagagtaatgtgttctggaagaattgaccctcagtttattttaaaagcattcagagacggtgctgacggtgtattcgtagcaggatgccacatgggtgactgccactacgatgcaggtaactataaacttgacagaagaatgagattagtttataaattagtcgaagatatgggaatcggaagagaaagagtccaccacgactggatttccgcttccgaaggagaaaaattcgctagttctgttaaaatgatggtagacagaattaaagatttaggaccttccccattaaaagcacaattagatgctgaaggatag

SEQ ID NO: 1487 - DNA, 420 bp, Methanobrevibacter ruminantium
atgagtaaatattttttggatgccaatttcataattgcaattttccgtgaaatcgaaacaaacaatgaactggcaatttccacttgtgaggagctcttgtccaaccatgaatgttatataagcaatggggtcttcaatgaaatcattacaatccttatgatgaggacaaaggatattgaattgacagtcaaagcatactactttatgaaggacaatctaactattatcaatgagttcgagataagtatgttcaatgatagggtatttgagatgtttaaaagatacaattcaaaatcatttaaagtgggatttacagactgttccattgcttttttatataaatattatggcttggattatattgttacctttgataagaactttaaggtatttgatgatgtgaatctattggatttatga

SEQ ID NO: 1488 - DNA, 246 bp, Methanobrevibacter ruminantium
atgatagatattatagcaaataccaaaatgtataaaaacaagcaaaccataattcccagtgaagttagggataggttcaatgtagatgaggacactatcattgaatggggcgtggatgagtttggagatttaagaatcactttcagaaaaaaagttactttaaaggatgttgcagggatgattaaaaaggaaaatgatgttgaaggggattggaaaattgataggggagtttatttaaatgagtaa

SEQ ID NO: 1489 - DNA, 1224 bp, Methanobrevibacter ruminantium
gtggcaaatgatgctttaagggcaaaggataaaaaggcagctttaggtactgatatagttattgaaaacttctctaaagaggaagtaaatgcttttgatgtccttgatgatattgatgacgttgacaaaaagaccaaaaggacattattgaaagttggtgttgatacagagtctgaagaaagggcagggtcattcctccagatggatcagtccaatgtattctccagttccatttccaattctgtagaggtcatgaacactggaattgcacttgaaaagtattcctggctaaaggattacatgtggaatgctgtaaagcctgatgcagacaaatacactgctcagactgcacttcgtgaagtggaggaagagtcatatagcggatactttgtaaggtcacttcctggaaccaaagaggttttcccagttcaggcatgtatgtttattgcagatcaggatgttatgcaaactgctcataacattattattgcagaggagaactctgagcttcaccttatcacaggctgtgcaacaggggaagacgtttcatcagctctccacgttggagtatctgagatgtatcttaagccaggttctaaaataacctttacaatggttcacaattgggctgaacaggttgaagtacgtcctaggactgctattcttcaagcggagaataccacttatattaataattacattttgacaagccctgtcaattcaattcaatcctatcctaccacccattgtaatggagagaatgcaagggcattgttccagagtattcaaagcggaacaaaagattcaatcattgatgtaggttcaagggctcttttaaatgctcctaacaccagcgctgagattatttcccgtgctgtagcaaatgacgaatcaagcatctattcaagaggtcacttggctggaaacgttcctaatgtaaagggacaccttgaatgtcatggattggtattggatgatggctcttcaatctatgctgtgccagagcttgaggctaatgctgcaaaccttgaaatgtctcacgaggcagctgtaggtcaaatcgatgaagaggagatttattaccttacctcaagaggacttactgaagaggaagcagcttccatgattgtaagaggtttcttaagcatggatattacaggtcttcctgatgaattggctgctgagacccaaagaatgattgatatgagtttggatggtatgtaa

SEQ ID NO: 1490 - DNA, 759 bp, Methanobrevibacter ruminantium
atgttgcttgaagtaaaagatttagttgttgaagttgaaggcaaacgcgttttaaatggcgtaaaccttgctataagagaaggagagactcatgtgctcttaggccctaatggtgccggcaaaagtacattattcttaactattttgggatttcctaaatatgaagttgttgaagggtccattatcttcaatggagaggatatcactggtttaagtactaccgaacgtgttcaaaaaggtcttggagtaagtttccaaaaccctcctgcaattcgtggggtaagcgttagggacttgcttaagttcgaatccaagcaagatccagatgaagacttgaatccaaggatgcaagagcttgcaaagaaattaaagttcagcgatgagtttttagaccgtgatgttaacagaggattctccggaggagaggttaaaaggtctgagattcttcaattgcttgctcaagagccgctatttacaatgttcgacgagccagactctggtgttgacattgagaatgttgagcttttggctggagagttgaatgtattattggataaggataaaaagcctggccaaagaaaaagagcagggcttcttatcactcacttaggttatattttaaacttcgttaaagcggacaaggcacatgtgttgatgcatggtataattgcctgttccggtgaccctgatgaaattttagaagatattagaaaagaaggatttaaaggatgtgttggctgtgcggaatgtggcaaatga

SEQ ID NO: 1491 - DNA, 270 bp, Methanobrevibacter ruminantium
atggaaaatgctgttgctaaacctaaccctcacagaagggaagaaaaattatggagtgaaattaaaaattatcaagtagctactaataatgcacgtattttaggagttcttgatgaattgattattaatgaaaaaacaggtaaaattgtggatattgccgttaaaatcgaaagtggacgtaatatccatgtaaaaggtgctaaacgtagaggagacttattattaataccttttacaaaattgagaaagttggagaattcattattgtaa

SEQ ID NO: 1492 - DNA, 633 bp, Methanobrevibacter ruminantium
atgattatagctttggtaatggctggtggaaagggtcttagactaaaatcaaatatagaaaagcctctttttccaatcaatgacaaacccttaatggattatgtcttggataatttaaaaaagtccaaatacatagaaaagacagttgttgccgtaagcccaaatggggaaaacaccaaatcctatttaaaagatgatttgaatttttctgatttccatgatgatttttacaatagcacaaaaaccgatttttatttagacaccaaaggaataggttttgtcgaagatctctctgaaatcctcacttgttttgaaaatcattcaaaagatgacatcttacttttcataaatgcagaccttcctttagtggatgaaaatataattgactacatcattgaatactatctagaccatgacaagcctgcattatccacattggtgccagtagaaatatttgaagaatatggcattccttatacctatgattttaatggaaaagtccctgcaggaatcaacatacttaggagtgaaaatgtcgttcaagaggaggaagttttaattattccaaggtatgagttagtttttaatataaatactatcgagacatctatattagccagtaaatttttatga

SEQ ID NO: 1493 - DNA, 1479 bp, Methanobrevibacter ruminantium
atgtcttttttagataaaatttttaataagggacctaagccaattattgctgaaagtcaatcaagggatttaagtattttaaaagcaggtaacaggcctcaaggcccaggtgttatggtagcacaacaggatgaatattatgtcactgcttctgtagagttaggaaacaccactaccaaatgtgttattatggctactaacctaaacaacagccaatcttatctaatcaataaaactgtgaatatgacaagggatgttagagcccctaaacctgatgaagaggtcttcggtaaaacagtttggggtattgaactttctaaagaatctgttgcagatatgattaaagacactgtattagaatcacttaaaaaagctcatgtagatatggatgaagatttagactttgtagtaagatccactggggtaactgcaggttttgccactactcaagaagtggggcaaatggtaaaagctttagcagatggctgtttggatgcaggaatatcccatacaaaaatggctccagccatgtcttcagcacatcttccaaaaagacttcaaaaatacactctcctggataatgtaatgtttgatggagcggtagtaagtgtagttccaccaaaaggtaaggaagttgtagcaaatgaaatggaaggtgaacttgtaactgcaggaatcaaattaggtgctaaatggactgaagtagactatagaaacccttgtgtatctttagactttggttccaccttagcaggacgtattgtaaacaaggatgagccttatgcaagcactgtaggtaacttcctaggtttggctggtgttatttcagactcattagctaaaggttccaagcaaatcgaccaaaagaatggtgcagcattggacctatttgatcctaaactacttaaaaaggcagatggtaagaaacaccaagaaaaagcaaaacaatatgctaaagaagctcatgagctcattaacatctgcaaggttccagaaggaatcgatagattcggtactgtcccattagacgctgcaggagcaaaggcagcaggtacatgtcttataggatgtgatgtgggaacaaatgcagacggccttgacggattggttgaaataggagcaaagatctatgaggatgaaggaattccaacactccttgccactatggaccacgtaagcgcaaacatcgtatacagagttcttgatgttgcatttgaagagaaccttatccttgacggttccattttaggagtcactggaagagctggaataactggtaagaagccagagcttattttagagtatgctcaagacaagttcaaggatgttgtatttgttgaggatggtcttgctctcggttctgcaatcatggctcgttgtatgaactccatgggaactcaaaagaaccctcttggaggaaaccaaggagaaagatgtattttaaagaagagaatgcaagctcaaggtactatagaataa

SEQ ID NO: 1494 - DNA, 882 bp, Methanobrevibacter ruminantium
atgggaggacaacctggagaataccctaccgttttagcaggaactatcttttacggcggacacaaaattattagtgatgaaaaagcaggagactttgataaagacgctgctgaaggattaattaaaacaatggaagaaatgtctgatgtaaccggaaacccttgtgttgtacaaactttcggtgctactgcagaagctatggttaaatacttagaatttgtaggggacatctgtgacaaacctttccttatcgactcaactgctgcagctgcaaagattgcaggtgtagaatacgtacaagaagcaggattagctgaaagagctgtatacaactccttaagtatggcagcagaagctggagaaatcgaagctgtagctaactctgacatcgacgcatccattctcttaggtttcaacccaatgacccctggtgtacctggtaaactcgaaatctgggaaaccggtggatctgttatcgacgaaggtattctcgaaatggcagaaagatgtggtattaccaaaccttggatggacgtagcagttactcctttaggtcaaggtgcaggtcctgcagtaagaacttcctacgctgtaaaagctaaatggggataccctgtaggttccggtattcacaacgtaccttccgcatgggattggttaagacaatacaaaaaagaacacaaagaagcatggcctgtatgtgatataggttctaacatcgtacaacaaatggctggtggagacttcgtacttttcggtcctatcgaaaactcaagactcgcattcccagcatgtggtatggcagatattatgattgctgaagcagcaagagatatcggtaccgaacctattgaagcacacccattgaacttgttattataa

SEQ ID NO: 1495 - DNA, 819 bp, Methanobrevibacter ruminantium
atgtctgctggaggaagtggagcacctgcagaaggtgctgtaaatgctaatgtaatgttagcagttggtattatcggtggattaattggtatttatgcgtcaagttttgagcctactattggaccagtcattgcatgtcttggtgcagtttgtgcaattctttggggagttcttgctattcgtagtgtagcaagttacggtttaggtactggtgtaccttctattggttacatgtctttaggtataggtgtaatcggtgcattagcaggtgtaggtataattgcagcatttaaattaaaaggattagaaatgctcggaccaatacttgcattagtatttgcaatgctcattggtttattagttgcaattgttgctaagaagattgttggaatgaaaatccctgttatggaaagatgcacagctgaaatcgctggtgctgctgctttagctgttctcggattctcctctgcaattgcaggtggatactctattgatttattattaaccgctgttgtagctcctggattcattgctctcttttacatattagttactatggctatccaacacccattcaacgcatgtttaggacctaacgaagatcaagttagaactcttaaatgtggtgcatccactgcattcttaaccatgattattactggtattctcgcaatttccgctggaggatacgcatggtttgcaattttagttgttggacttatcggctggtacgtctcatttaaaatgtttgttaatgcttcctacgaagctgcagcatctgttaaatggtccggattatggccaaaagttgaggaataa

SEQ ID NO: 1496 - DNA, 753 bp, Methanobrevibacter ruminantium
atggcacaatattatccaggaacttctcaggtagctgaaaacagaagaaaatttactaacccagatgttgagttagaagttttaagagaaatatctgatgaagatgtagtaaaattattaggtcacagagctccaggtgaagaatacaaatccgttcacccacctctcgacgaactcgatgaacctgatgacattattagagaaattgtagaacctattgacggtgcaaaagcaggagacagagtaagatacatccaatttgtagactccatgtactttgctccagctcaacctttcttaagagcaagatcctacgtatacagatacagaggaatcgataccggtaccttatccggaagacaaattatcgaagctcgtgaaagagatgtagaaagaatttctaaagaaattttagaaaacgaatactttgacactgcacgtactggaatcagaggtgcaggtgtacacggtcactctttaagactcgacgaaaacggtttaatgtttgacatgttaagaagacaagtactcaacaaagaaaccggtaacgttgaaatggtaaaagaccaaattggtcgtgaattagacgaacctgtagtattaggtgaaccattagacgaagaaactctcagagctaaaaccacaatctacagatgtgatggtgaagcttataaagacgacgaagacgctgtaactgtcttaagacaaatacacgtcactagatctcaatttggttacaacccagaatattaa

SEQ ID NO: 1497 - DNA, 1251 bp, Methanobrevibacter ruminantium
atgcaagttatagctgatcttggtggaactccggggaaggattgtagaggttattgcaagttttgctactttagaaaggtaaagccattaaccgaagctttaggatgtcagcactgccctccaaacaaggtgggatgtgagcgatgtcttgaaggagttcaggaagcaggcaagccatttcaacagccattcacagtcttaagcgaagtacaaatggctttgatgatgaaccctgttcgtgacgctaatcttaaggtcaatatcagcggtggtggtgatgtaagctgctatcctcagcttgaagagcttatcgcttcattgtaccaatggcaattgccaatccacttaggatatacaagcggaaagggaattgacgatggagatattgcaagcagattcctaaactatggcgttaatgaggttacatacaccatcttttcagttgacccggctcttagaaaacaatggatgcttgatcctactcctgaagagtccctaaaggcagcccaactctttgcagaaggggctgacttgcatgctgcagctgtaataattcctggagtcaacgatggacaggctttggtggatacctgcaataagcttgaggagtggggtgcaaaggccttgatgatgatgagatttgcaaattcctacgatcagggattgatccttggaaacgagcctgtcattgaaggagtcgttccacatgagccacttgaatttgaagagcttgtaaaggagatcaattctgaatatgatatgagagttaccggaactcctttaggggaccctactattggcgctccttttatcatagctaaggatgagtatgaggagtttttaggaatcctgcctgaagttaggggagaggcaactcttttaacctctaagattgcagctcctttcctaaagaagatctttgataagattgctcccgacaatgtaaatgtagttgcaactaaaaaggacattgcctgccttatgacaaagcaggaccttgaggctttagacttggatgagctaaaggatgctgtcattcttccgggaagagctttcattcatatattggatgctgaaagaatcctatcctctgatggaaagcaacgtttggtgggatttggccctgataccttaagtgttgacggagaattaagcagtgggatgagtgaagaagaagtcattgaacatgaattaggttcatttattgaattaatagaagctattaacttctttggtatgcgtaggttataa

SEQ ID NO: 1498 - DNA, 222 bp, Methanobrevibacter ruminantium
atgaaaattagaaaaagaataaagaaactaaaaagaataaagaaactgaaaagaataaagaaactaaaaagaataaagaaactgaaaagaataaagaaactgaaaagaataaagaaactgaaaagaataaagaaactaaaaagaataaagaaactaaaaagaataaagaaactaaaaagaataaagaaactaaaaagaataaaaaaattagaaaaagaataa

SEQ ID NO: 1499 - DNA, 915 bp, Methanobrevibacter ruminantium
atgtatgaaacattaacattcacaggtggaattcacaaaagtgaggaattaaaggaacttatagaggatttaggcggttttgtactccaatccaatatattgcagatggagcttgtcttaaacatggcagttcctattgatgatgttaagattatagaggataaggcaaatgagcttttaggagagctctctgtagctcctatggctggctctgagatagctatcgtctcccctacccttgcaagacatcaccttccacatgctgcctgtgacatctccgaataccttagacgttatggtgcaaaagacaatatgatcggtctggcccgtgggcatggaaagggaaccgctggaataagcgaaaccgaaaaggcattgattgaagagcatgacatagcaatatttgctcttggaagctttaagcagtgcattgtggataaggcttatctttataatgacattgacattccagtgattgttactggagctcctgaaattgacttggaagagcttcctggtgttgatgcatatgttccagggcttggtagaattcctcgcagattaaaaagaggggaaaacataagggctttaaagcatcttgttcaaacaattgaagaccttcttgaaaaacgtaaaaaggaattggctcaagaccctcctatagtcccttcaattctagttaaaaatgagatagaaaatcaggtccctgcaattgaaggggttttctctccaacacctgttacaagccaattaagcggcttgagggtaaaattagattatgacaattatcatgaagagattgagaatgttgtaatcggagagcaaaagctaaaagacattgcaaacattaaaaaatcacatttctatgattatatacttgtagaactcttgactgagagttctttagttgattaa

SEQ ID NO: 1500 - DNA, 1665 bp, Methanobrevibacter ruminantium
atgggtgttaatatgtatgcagaaaacaatatattggttggagctaatgagaatacagaagtttacttattatccaaattagctaatcgtcatggcttaattgccggtgcaacaggtaccggtaagacagttaccttaaaaacacttgcagaagctttcagtgacatgggagttccagttttccttgctgatatgaaaggagacgtatcaggacttgcaaagataggggaacctagctcaaagacaactgaaagaatggaaaagtacaatcttgcagataagggattcatcttcaagtcatatcctgttgaattctgggacctttacggcgagaaaggattgcctattagagttacaatctctgaaatgggtcctcagcttctatcaaaaatattgaaccttactgaagcgcaggaaggtgtcttgaacattgtattccgtgtggcagatgatgaaaatctccttctaattgacattaaggacttaaagtcaatgattaaccatgtaagcgacaatgccgaactctatgaatcaaaatacggcgcagtggctaaaaagtcagcaactacactcctcagatcattgcttgcccttgaagagcaaggaggagacatgttctttggagagcctgcacttgagcttgaagacttcatgcaatgcgacgatgaaggaaaaggaataatcaatatcttagattccgtaaagctttctaccgcacctgaactctattccacattcttgttatggatgatttccgaactctatgaaaagatgcctgaagttggtgacatggacaagccaaaattcattttcttctttgatgaggctcacctcttatttgacgatatggctccagcggtacagaagaaaattgaacaaatagtgaaacttatccgttcaaaaggagtgggactatacttcattagccaaagcccatccgacatacctgatagcgtccttgcacagcttggaaacagggtacagcatgcattacatgcctacacccctaaagagcaaaaggcagtaaagactgctgctgaaacattcagaccaaaccctgcattcgatacaaaagaagtaatttccaatttaggaactggtgaagcattggtttccgttcttgaagagaaaggtgctccaagtgtagtagagcaagtggacatactccctccacaaagctatatcggagcaatcgaagacaatttcagagcagaacttatgagcatttcgcctttaagaggcaaatataaggaagcagtcgatagggagtctgcttatgagatgctattaaataagattgataataatccaaacattcaaacagagatacctccagaagcccctattagggatattcctaatcaggccgagcaagctccaagtcagccacaagcacagcaagcccctcaacaggcacctagtcagccacaagcacagcaagcccctcaagaagaggctcctaaacagaaaggattgcttgatgatgttattggaatagctgttggaactgctgtagaccaaatgacaaaacaaaacaagactacaagatctagaaaaaccactaaacagacaactgttgagaaagcaacttcaactatggtaaatactgcagcaagagaggttacaaaaggaattattagaggattatttggaaatatgaaataa

SEQ ID NO: 1501 - DNA, 369 bp, Methanobrevibacter ruminantium
atggtggaattagatagagaagaattatacagacaactggaagaaatggaaaacgatttaagactttatcccattgaagaaggattggaagatgatataattgattatatcaatggaaaagaattaagtgataatgagaagtgggaccttgaaaacagacttgaagacttcttctatggtgccaaactcaaatgcagaaagccaacctactactttacagacggatttgagttttatgttacagaaatctatatagactttagaatattggagcacgttcgtaaatcttttcctaaattcaatcaattatctgtatcatctgaaatagaacagggattttctacattgtctgttaaattgacattataa

SEQ ID NO: 1502 - DNA, 798 bp, Methanobrevibacter ruminantium
atgaagttgaacattaataaagagacttgtactggatgtaaactctgtgagactgtctgcattagggacaatataattgttgtggataaaaaggcagtggaagtggataatggggattgttttgattgcggccactgtttagccatttgtccatcaaattctatctctttaaagggctttgatggtcaaaaagaccgtgttggcgagtacaatcctaaagagattccagtatcaagcgaggattatctgaatctgttaaagcaacgaagaagcattcgctggtttaaaaagaaaaagatagataaagaaacctttaataagctctttgaagcagcatattacagtccaagtgctcaaaatgctcaagatgttgaatttgttgtacttgataatgaattggatgaatttatgcatcttgtttatgatataatcagtgctgaagaggataaattctttagaataaagcaatttggcgagtatttgcgtggagaaggagattataagaatcaccctcttctttgggaaggccatcaaatgattttagccttttctagaaactctgccaatgccttgattgcaagtacaaggcttgagctatttgcttatacaatgggccttggaggattctattcccttttcactcttaaggcagatgagttggatcatgatagattgatggaatttttcccagggatagattcacacaagcatatgtattctgcttttgtaataggttatcctagagtgaaatacagaagaacagtgcctcataaggggattgatgtttattataggtga

SEQ ID NO: 1503 - DNA, 540 bp, Methanobrevibacter ruminantium
atgtcaatatatgattttgaagtaaaagacatcaacggaaatatggtatctcttaaggagtatgaaggacaggttttattgattgtaaattcagctacagaatgcggtttcactccacagtacaacgaattgactcagatattcgatgaattgaatgaagaaggatttacaatactagattttccttgcaatcaatttggaaaacaagctccaggaactggagaggaaattgcagaagcttgtagagcaaccttcttagtccaataccctatatttgaaaagatagaagtaaatggggaaaacgaagagccattgtacacctatctaaaatctgagcaaccatttgtagacattacaggagaagatgcagaaagattaaaaggaatccttgaaagcattaatccagattatatggacagcaatgacattaaatggaactttaccaaatttttagttgacagagaaggcaatgtagttgcaagatttgagccaactcaaagtttggatgatgtaaaagctcaaattaaagaattattataa

SEQ ID NO: 1504 - DNA, 459 bp, Methanobrevibacter ruminantium
atgagtattttagtagcttattattcaaggacaaatgttacaaaaaaggtagcggaatccattgcaaatcaattggatgcagatattgaagaaattgtccctaaagtcaagtatgacggcaagataggttatatgcgtggcggtaaggatgcaatttcagaaaagatcattgatttggattctttaaaatacaatcctgcggactatgacttgatttatttaggaactcctgtatgggctgggagggctgcaactcctgtgattagctatatcaagcaaaacgaaggcagcttcaatgatgttaagttctttgtaactgcagggggaagtggatttgaaggcaccattgaacagcttggcaaatatgtggggaaagctccattgaagactttgtctcttaccaccaagcaggttaaaagagatgaatttaaagatgaattggcttcctttattgaataa

SEQ ID NO: 1505 - DNA, 351 bp, Methanobrevibacter ruminantium
atgttatttatttactacccaagatgcagcacatgccaaaaggcaaagaaatggctagatgaaaatggattcgactatgatgagcagcatatcgttgatgacaatccagactacgaacagttaaaggcattgtatgaaaaaagcggacttcctcttaagaggttctttaatacaagtggtaaaatctatagagagatgcaattaaaagacaagttagctgatatggatgaagaagaacaattgaatcttttagctactaatggcatgcttgtaaaacgccctataattgaaactgaggatacatgtcttactggttttagacaaaaagagtgggaagagaagttaaagtaa

SEQ ID NO: 1506 - DNA, 831 bp, Methanobrevibacter ruminantium
atggattatattaggcagacagaagttatacaatggaatgacggagcttatcagaccatcaatgaggaaagtgttgaagatgaatatacctatttgtttatagattatttgcctcctcgtaagttttcaacatatccaaaggatttagaggattttgcagtgggatactgccttggtgaaggcttgattaaagattattcagatatcaaatcaatccagttggacggcacaaacattttagttacaactacactctctcatgaccctgaagaggatttggagcaggaaggaatagttcaggagaaaaaaggcaattgcgaacatgcctgtgtatgccgactattggaatatcagggggtcaattcagataatgctggaggaattcgttctgaattaaagacaatagagcctaacacctctgacttaaagattgatgcaagccaaatcattaaggatatagagcatttgactgatgaggctaagatttggcaaaggactgcaggagttcacgttgcacaattgaagtatgaggataagatcattattcgagaagacgtaagtcgtcatgttgcagtggataaggtgataggagctgcatcaagagaaggatatgacttttcaaaatgctatatttcttatagtggaagaatgcctgcagatatgctgattaaggtcattagggttggaattcctataattttatcaaatgcggcacctgcagcttcaggtattgatgtggcccaaacaggaaatataacaatgattggattcattagggataagagattcactgtttttacagctcctgaaagggttaatttagatgcttga

SEQ ID NO: 1507 - DNA, 1206 bp, Methanobrevibacter ruminantium
atgaaatacaattttgaatctataatcgatagaaaaaacaccaattcactaaaatgggacttgtttggtgatgaatatccaatgtgggttgcagatatggacttttatgcagctccattgatttacgaatctgtaaatagaaaggcaaatcatggcgtctatgcatattcatttgtaaacgaggatgtctatgattcttatattaattggtggaagaaatatggtcttgatatgaaaaaagaggaattgttgtttgcaactggagtcatgccttcaataacaagcattatccgtgcctttacagagattggagataatgtactgattcagactccagtttatcatgtcttcttttatgtcatattggataatggtagaaatgtggtggaaaatcaattgatttataatccagactctgatgatgttgaaactgcatatgtgattgattttgatgatttggagaaaatattcaaagatcctaagacaaaactgatgctattgtgtaatcctcataatcctgtagggaagatttggaaaaaggatgatttggaaagaattgctgttttagcaaagaaatatgatgttatagtagtttcagatgagattcattgtgatttgacagatccagacatgacttatattcctttcgcatctttagatgatgatctgtccaaaaatagcataacttgcatttctccaagcaagacctttaatattgcaggtcttcaaagctccgcagtattcactcaaaacaaaggtttttatgaagttttaaaaggacagcttgcaactgacttcttcagccatcccaacatattttcaatagatgccacaattgcatcatataaaagcgaagattggttaaatgagcttagagaagtcttattcaataataaaatgattgtgaaagaatttttagaggaaaatattcctgaaatcagattggtgcctgcaaatgcaacttatcttttatggctggattgcagtaaattgaataaaaatgaggatattgaatcttctaactatgaattctctaagactttatctgagtttttaagagaagaggtcggtttattcttatctccgggagtacaattcggccaaaatggagacaatttcctaagaatgaatattgcatgtcctaaggatttattgattgaaggtttaaatgcattaaaagagggaattgataaatttaagagttaa

SEQ ID NO: 1508 - DNA, 519 bp, Methanobrevibacter ruminantium
atggctgattttgaagagataattaaaataaggcgcagcatacgtgagtatgaagataaggaagttgaagatgaaaagattgaaaagatcttaagggcaggaatgcaagctcctggaagcaggcttggtgcagaaccttgggagtttcttattataaaaaataaggaagtattaactaaaattggggaaatcaagcctagggtgaccaatgctccagttgccattcttttgattgcaaacattgaaagggctttctataagactgtatggcaacaggacatgagtgcagcagctgaaaacatgcttcttgaagctgtaaaccttggcttaggaggcctttggaacggagtggctcctgatgaggaaagaatgggcaagattgcagatattgttggattgccaaaagatgataatctaaagccattctgcataataactcttggatatcctgcagaaggctgggaaaacaagtttatggataagttcgatgaatctagaatacattatgagacttattaa

SEQ ID NO: 1509 - DNA, 573 bp, Methanobrevibacter ruminantium
ttgaataagcctgttttctatgatgctgactgtttggaatgtttcctatttgttgatgccacttatattttagaagagctattttctaaaataattattccagagcaagtttataatgagattatggaggaaaacactccctcacttgtaaaaagaaattttaaaaaattaaaggagggatttgtagaaattcaagaaatgccttttggttcttcccagtaccttgcttataagtcaattgaaaagggattttggagtaaggcaggtcagatttgtgggtctggtgaatcagcagcaatggcattggcccatttgaataatggaatcatagcaagtaacaatttaagtgatgtggaggaatatattgaaagcttggacataggactcattaccagttctatgattttaactaaagcccttgaaatggaaatcatttcagaagatactgcaagttcattatatcttgcaatgatagaaaggggtatcaagttacctcaggacagtttttgggagtattttgataaactttatgaaattgattgcaaaagattcttaaagaatgattttccataa

SEQ ID NO: 1510 - DNA, 723 bp, Methanobrevibacter ruminantium
atgaatagcacagttttagctgaaatcttaagacatgaatggggcattgaaagctttgcttcagtaaacattcgttctctggtctataataatataagaaatctgactgtgctctggtttccaatgaaagccaatatcagtggctgttgctcaaagacaaatgaggacaaggtaatattcatcaacaccaaccattcaatcggtagacagaatttcacattggctcatgaattataccacttgctctatgaggatattgatgattttatcgtttgcggaatcaatatgaacacaccaagtgaaaggaatgcagatgaatttgcttcaacattattaatccctgacagtgccctatattggtttagaaataaaaatcaaattgatgattggtcagttgaggatctaatcaagtgcgagcaatactatcaagtcagccgttccacaatgcttaatcgcctaaaaagcttgaattggattagtcaagaccaatatgatgaatttggattaaatgttgttgctgaagttaatagattaggctatgagacaggtctttataagccatcccctcaagaccagaaatattcctcaattggagagcttgtgcgattgactgaaaaggcatatggtaagaaaaagataaccgggggaaaacgcaaggaaattttattaaaatgttttagaaatgatattctttatgataatgaggtgaacaagcttgaataa

SEQ ID NO: 1511 - DNA, 327 bp, Methanobrevibacter ruminantium
atgattgatgttgtagcaaaaaatctaaaagatttaaggaagaaaaacggttatactcaagaacaggtttctgattatttgggaattactcaaagcaatctttctaaaatagaaaatggagaaagaaactttaacatgactttgcttgataaattgtgtttattatacaattgctctccagaatatttgattggtgaaacagatctttatgaaaagtcaactatagcttttagaagtgatgaaaaggtggatttaaatgtggttgcaaaaatgaatgaaatcactggatttttaaagcttttaagaagtttagatggggttgattag

SEQ ID NO: 1512 - DNA, 1278 bp, Methanobrevibacter ruminantium
ttgttagatataaagctatttcgagaaaatcctgatttaatatttgactctgagaagaaaagattcagaagcactgaaaatgcagagaaagttattgaatatgacaccttatggagagaaggtgaaagcagattgaactctcttagggcagagaagaacaaattatcaaaatcattcaaacaagctaaaaaggacggaaacattgaagaggtaattgcacaatccaaggcagttgctgaagagatcaaggaattaggtcctaagattgaagagtataagcaattgcgtgaagattacagatacaaggttggaaacatcattgacgaggatgttccagtctctgacacagaagatgacaaccttattgttaggaccgttggagaattgccagactttgattttgagcctttaaatcatgttgatttgattgaaaagattgacggtgcagacattgaaactgcagcaagcattgcaggtgcaaggttctactatcttaaaagggacatcttgcatcttaacttggctttaatccagttcgcccttaacgagcttgaagagagaggctacattccacttcagactcccttctttgtaaaaggggaagttgcagcagagacatctgagcttggagagtttgaggaaaccttatacaaggtggaaaatgaagacttatacctaattgcaacagctgagcagacacttgcagcattgcatagggatgaaatcatcaatcctgaagatttgccaatgagatattgcgccctttctacctgctttagaaaggaggctggatctcatggtaaggacactttaggaatattcagggttcatcagtttgaaaagattgaacagttcattttctccactcctgaagaaagcaaaaacgagcatcacaggttattggaagttactgaggacatctataagaaattaggacttccttatcaaatcgttgccatagtttcctcagcattgaatgacaatgcagcaatcaagtacgaccttgaggcatggttccctggttcaaagacctatagggaattggtatcctgtaccaattgtggtgactatcaggcaagaaagaccaagaccagatatggtagggcaggatctggagatgcccagactttacacaccttaaacagtactgcaatagcaactgaaagaactatgtgctgtatattagaaaactatcagcaggatgatggaagcgtaaaggttccagaggttttagtgccttatatgggtggaaaaacagtaatcgaagcaagaaagtaa

SEQ ID NO: 1513 - DNA, 582 bp, Methanobrevibacter ruminantium
atgattgttgtaactactccaatgtgtaagcaaatagtggaatgggctggacttaaggaatttaaagttaacaagtttccagatgaggaagaaggggacttggctatactgctttctgaaagcaaggtcaaaatgaactctttaactcttaaattaaataccttttctcaaataagagaaagcattttaaaagtttccaattattgttttgaacatgatttaacagatcatcttcttagtgatgatgatattgacgatatcttttcatcttatgatttgaagtacgctaatttgggcgatgatgattttgataaaatcagggaatcaaactctaataagaaagttaaggtctattctgagtttctaaaggatattgttttggatattggggctcttgttgttgatgaggattattcatatgtcgtttatccggactatttaaaggacattgtagataagaatgaggactttacagactcttccattgtctttatagagatgccaagtcatggaaaggtttctaaaaatcctcttgagaggactgaagagagatattctattttaataaatagtttaatatag

SEQ ID NO: 1514 - DNA, 783 bp, Methanobrevibacter ruminantium
atgcaaattataaaaacaagcgaaacagaggccgaaaaagtgataataaatttaagccaggaaaaaagccatagcaaagacgtttcaattatggtagatgctttaagagcaagtacaaccgtaacaatagctttagactactttaaagaagtaattccagcattcactccagaggaggcaagagaactttccctaaagcataacgctgtacttgcaggtgagagaaagggagttaaattagagggctttgatattggaaactcacctggtgaaataaaggagtttgaaaccaacaagaaatccatggttcttacaacaagcaatggaataatgacaatggaaaatatgcaaaaccctaaacatgtcttagttggaggattcataaatgccaaatccgttgcaaaggcagctgtagagctagcagaggaagagattgaaatagtcatgggaggatacaaccatgaatttgcaattgaagacttccttgcagctggagaaatactcttttatatagaaaaagagctaaaagaaagaaacatgactccaaaagaaaatgatggatccaattatgaattgaaggatagggaaggctttagcgaatatgcaatatctgctatcttagcaagcagaaatctggaattaaccaatgaacaagtattaaaatccaaatctggaaagcgattaagctatttaaactactctgatgatgtagaattatgcatgaagcgaaacataactgaaaatgtaggcattttaaaagatggaaagatagttctatactga

SEQ ID NO: 1515 - DNA, 276 bp, Methanobrevibacter ruminantium
atgtatgtaatattcagatgcgattgcggaagagtgctttatgcaaagcaaggtgtaaaaacaagaaaatgcacctgtggaaaaacaatcaaagtgaaaagccgcagaatccttcaaaaagtagaaacagcaaacgatgcatcattggcagttcaaaagatgcaagaggaaatctatggaggaactgcatttaagactgctgacgagtataaggcaaataaattcataaatcagcttgatagaagaatgaaggaatatgaagatggtgacttttag

SEQ ID NO: 1516 - DNA, 1347 bp, Methanobrevibacter ruminantium
atggaaatggactcgataatcataattagtgaaatactaataatcataatattaatcgtacttaacggacttttctcccttgcagaaatcgcagttgtctctgcaagaagaatcagaatgcaaaaaattgcagatgatggagataaaagagcattactcgttttagactctatggaccacaccagtgaattcttatctactgtacaagtgggcataacctttacagcaatcatcacaggggcattaggtggaactactttttcagaacctttaggaaactaccttagccaattcataccttacagctatcagataagcttcattatcgttatccttctcacatcctactttacaatattggtaggtgagatcgtacctaaaagaatggcattgaatgaccctgaaggatatgcattgagcactgcaaagttcatgcagataagctcaataatatgcaagcctattgtaaagctccttgacagctctacaaatcttgccttaaggattgttggcccatcaccaaaagaggatgtcgttactgaagaggaagtcaagctccttatcgaagagggcattgaagacggaacaatagccgaagaggaagaggacatcatcaaaagggtattccgtttagatgaccaaaaggtagatatgataatgacccctagaaacgagatcatctggctagacctagaagatgagattgaaattaacaaggctaaaatcattgcaagtaaaaggtctattttccctgttgcagatgcggaattggatgacttcatcggtgttgttcaagctaaagacctactcagcaaaatatttgaaggagaagatgttgacattagagctaatgtcaaatctccattagtagttcctgaaaatatgctttcaatggacttgcttaaggaatttaaggaaaacagagaatatgtacatatggttcttgtagtggatgaattcggaagcgttgtaggactcatcacattaaacgaccttcttgaaggaattgtaggagacattccaggaatcgatgaagaggacgatcctaaagcggttgaaagaaaagaccatacttggctaatagacggcagattctctatagaagactttaaagacctatttgaaatcgaaaaggaaatgcctaatgaagtggaggacggatacacaaccattgcaggattcatcctttcacatgcaggtaaaatccctgaaaccggtgaaatattccatgaagacaagttcacctttgaaatcgttgacatggatggaaaccatatcgataagatcctggtaacaataaacgaagaggatagcgataaattagaccttgaaagcaaggaagactaa

SEQ ID NO: 1517 - DNA, 942 bp, Methanobrevibacter ruminantium
atggaactaattattcaaataatcttactaattataggatttgtgcttctaattaaaggtgcagatgtctttgtagacggtgcaagtaatgttgcatacaacttaaagataccaaccataattgtaggactcacaatcgtcgcatttggtacaagcgctcctgaagcagctgtttcaattacctctgcatttgccggaacaaatgcgatttcccttggaaacgttgtaggtagtaacatattcaacatattggcagttgttggtgtctctgcattgcttggaacattgacagtggataaggtattgataaaaagagatttcccatttttggttgtatcttcaataggccttcttctaatagccaccatatttggagagataagcagactctgcggtataatcttcttgataatcatcattgcttatgtctatgtccttgttcaagaggcaagacaggacaaggaagcaatgtctgaagagattgaagtaaagctttcaataccaaaagcggcaatctacattgtcataggtattgccggaatcataatcggttccgatttggttgtagactcatcaagctatattgcaagcgtattcggattaagcgatgtacttattggtcttacaattgttgctataggaacttcattgcctgagcttgtaacttctattactgcacttaaaaaaggagacaatggtattgtaattggtaatgtgcttggatcaagcatattcaacatacttttcattttaggtatcagcggagcaataatgccactcccaatagcacctgaaatggtatgggacatacttttaatgacagtgattacaatcattggcgcagcctttgcatacaccaaaaatgaagtggataaaaaagaaggtgccgttttagtagcattatttattctctatatggcatttgtcattttaagaaattaa

SEQ ID NO: 1518 - DNA, 858 bp, Methanobrevibacter ruminantium
atgagcataaacaaggaagaattcaatgaaaagatattctctagaatcaataatctaatagacgattatcaattgattaaagagggtgaaaagatagccattgccttatccggtggtaaagatagtgttttaactcttcatgcacttaaaaattataaggatagtgctgattttgactttgagcttgtggcaattttagttgatgagggaatagatggctatcgccagcatggaatagatgctgcagtaaataatgcccagcttttggagattcctcttatacaaaagtcctttaaagaagaggagggctttgcattggatgatatctattcctattttaagagcgcttgcattccttgtggggtatttaggcgcaatatcttaaataaaaccgcttatgaaataggtgccgacaagattgcaacaggacataaccttgatgatgagattcagtcatttctaatgagcttttcaaggggagacactgtaaagttctctaaattcggtccggagcttgatcagattcatgaaaaattagttccaaggataaagccattgtggaacactcctgaaaaggaagtagggatgtgggcgattctgaatggtgttgagattcatttggatgaatgtccttattctaatctgtctttaagggctaaaattaaggaatttttaaataagactgagtcaaagcatcccggcactaaggagaatgttttaaactcatttataaagacacttgatgttgagaatgtaaggactgttttaagtgagtgtgaaaggtgcggagagccaacatcaggtagggtctgtaaagcctgtgaaataaaggacataattagtgaaaatagggattaa

SEQ ID NO: 1519 - DNA, 276 bp, Methanobrevibacter ruminantium
atgggaattgaagagtcaggagtaggggaatacgtttcaaaggcagttcaaataatcgaagagagcggtttaaactaccaaataaccgctatgggaacccaaatagaaacagacaatctaaataaattatatgaagtttgtgcaaatgttcaagaagccatctttgaaatgggcgttcctagagtttatactgtactaaaaatagatgatagaagagataaggaaaataggacattgaaagagaaagtaaaaagcgttgaagatagaataaaatag

SEQ ID NO: 1520 - DNA, 474 bp, Methanobrevibacter ruminantium
atggctcctgttgttgaacaacctgtagaagaatgggacaaagacattgcaatcgacttaaccggtgtattctactgctgcaaagcattcggagaatatatggtcaaacaagaatacggtaaaatcattaacatgggttcaatccactccagagttgcattaaccggaggattaattaccggatatacctctgcaaaaggaggagtatacaaccttaccaaaacattagcagctgaatgggctccatacaacattactgtaaatgcaatcggtcctgcatacttcgaatccgaactaaccgctgatgttgttggcgatgaacaattcgacatgttaattaaagcattctgtccaatgggcagatggggtaaagaaggagaattagatggtattgcaatctacttagcatctgatgcttccagcttctgtaccggtcaattaattaacattgatggtggatggactgcaatttag

SEQ ID NO: 1521 - DNA, 1104 bp, Methanobrevibacter ruminantium
atggcagatattaaagtttctatagctagtcctataattgaagaagaagagatcaatgcagttgttgaagtaatgaagtctggtatgattgctcaaggtccaaaggtaattgagtttgaaaaggaatttgcagactttgtaggtgcaaaatacggaattgcaactaattctggaacttctgcattgcatgttgcgcttttagctgctggaattggaaaaggggatgaggtaataaccactccatttacatttgcagcaaccggtaactccatcttatacactggagctcgtcctgtttttgttgatattaatgaagacacctttaccattgacccatgtaaaatagaagaggcaataaccgataagaccaaagcaataatgcctgttcaattatatggtcaagctgctgatatggatcctataatgaaaattgcaaaagaacatgatttgattgttattgaagatgctgctcaggcacatggtgctgaatataaaggcaaaaaggttggaaatcttggtgatatggcttgctttagtttttatccaactaaaaacatgactacaagcgaaggtggaatgatcaccaccaataatgaagagtttgcagaaaacgctagaatctatagggctcacggatctgctaccaaatatcatcatgatgtattgggatacaactttagaatgactgacattggtgcagctataggtattgaacagcttaagaagatagatggattcaatgataagagaatagaaaatgcaaaataccttaatgaaggattggcagattgcgatttggttgaaactcctgttgtagaggatggatataagcatgtctaccaccaatacacagttaaggtcaaagacggcaaaagggatgccctttctgactatctgattgaaaatggcattggcaatggaatttattatccaatcccattatacgaccaggtattgtatacagatatgggatataatcaaagccttgaagtaactgataaaactgttaaggaggttttatcacttcctattcatgcaaagcttactaaatttgacttggatttaattattgaaaaggttaaaaaggcaagtaaagagttataa

SEQ ID NO: 1522 - DNA, 1218 bp, Methanobrevibacter ruminantium
atggaagaatataaagacaattttccccaagaggaattgaaaacatacactgaagatgaattaaagatcatagaagaaggtaaagtcaaaataaaatttccagactttgataaggtctcctcagatgctccagtcttctataatccaaagatggaatttaaccgagacaattccatattagccctgcaagcctatcaaaaggaagttgaccgtgaaataaacatctgtgacctttttggcggaagcggaattaggggaatcagatataaaaaggaaatagaaggagttggagaagtatctgtaaacgacatcagccctcttgcaaacgaatttacaagaataaatgcagagcttaacgatgttgaagtaaacatagaccaaaaggaagcaaacatagagcttagaacaaacatgggacttttcgatgttattgacatcgacccatttggaactccttccccatttgtagactcagcagcatacaatctgaaaagggattcattgctctgtttgactgctacagacacatcatgcctatctggaacttatccagaaccctgcattagaaaatacaatgcaaagccttataaaagcgaatactatcatgaaaatggaattagaatcattataggatttgccgccttgacacttgcaaagtatcaaaagcatatagaggtaaagatgtcccacagcacagagcattatatgagagtctaccttaagatcataaaaggttcaaaggcaactgacaaatccttaaaaaacataggatacatcagccactgcaaaaactgtctatacagaacagaatcccatggacttgcaacaagcgttcccgacatatgtcctgaatgcggtgaaaagcttgttactgccggacctctttggctaggacctattcaaaataaggaatttattgaatcaatgattgagatagcagatgaaaaggaactcaataccaaaaagaaagtattgaagctactgaattcatgcaagatggaagcagatgcacctgccacattctatgacatccataagatatgtcgaagtcttaaaatcagtgcccctaagttggatctggtttttgacaagcttaaggaaaatggattctatgctgtcaagacacattacagccctttaggaataaaaaccgatgcaagcagtagagaattgatagaaatcgttaaggaattagctgaagaagtggaaaataaataa

SEQ ID NO: 1523 - DNA, 480 bp, Methanobrevibacter ruminantium
atgtgtgcaaaagttaatgaagatattatacaactagatgaaactgacattagcatattaaaaatcataaatgatgatgttagaatttcatacagacagatctcccgcgatttaggaatttcagtaggaactgtacacaatcgtattgacaaaatgcttaagactggagtaattgaaaaatttgcacctgtcctaaaccataagaagttaggatatgcccttacaagcattattggagtaaatgtcaaaggtcaagaattagaacaatgggaacatgacatttccaaaaacaagaatgttgtaggcctttatgatgtaaccggtcagtacgatgcaatagtgattgccaaattcaaggacactgatgaattagacaccttccttaaggaattgcttaaaacaggatgcattgaaaagacaattactcaaactgtacttaacattgtaaaagaggacgtcggatctgctgacatcctttaa

SEQ ID NO: 1524 - DNA, 942 bp, Methanobrevibacter ruminantium
atggtagtttgtctcccagacacacaagatgatgcacctagaatacctatccatttaagcagagtaggtgtgacaggtgttaagaagcttttaactcttaaaaggaaagaaaaaagaccaatcatattattacctacttttgacgcttttgtagatttgccaagcgatcaaaaaggtactcatatgtctagaactcctgaagctatcagtgaagtagtagaagaagttgctcaaagctcccaaaaaggagtggaatccctttgcgcagacatagtcacaagaatgcttgaaaagcatgaatacgctaagcgtgttgaagtgagcatggtcagcgactatatgttcatgaaggactctccagtaactgacaacaggtcccaggaaatgggcaaactaatagctaacgctgtcggtatccgtgaagatgacgacacaatcagcatcagaaaaagcattggtgctgaagtcattggaatgacagtatgcccttgtgcacaggaatctgtaagggaagtggataagaacaacttactaaaattcttagatgaagaaacttgccaaaaagtattggacactgtaactttcgcttctcacaaccaaagaggagtgggaaccattcttatagaagttccagaggatgaatatgtcgatggggaaaagcttattgaaataatcgaatcatcaatgagctcacctatttcagagcttttaaaacgtcccgatgaaaatgcagtggtaatgaatgcccacaagaaccctgtttttgtagaggattgtgttagaacaatgaatgaaaaaatcgtaaaagagttttcacatcttccagacgacactcttataaccacaagacaggaaaatcaggaaagtattcacagacacaatgcttttgcagaaaaagtttccactttaggttcccttaaagaggaacttaacataaattag

SEQ ID NO: 1525 - DNA, 282 bp, Methanobrevibacter ruminantium
atgatatttatggaaaatttcgaaaatcaaaagttttgtcaatcttgtgcaatgcctatgactgaagaactctatggaaccaatgcagacggttctaaaaacgatgagtactgcatctattgctttaaggatggtgaattcacttcagatatgactatggaagaaatgatgaatttctgcattgaaaagatggtagaggttcatccggagatggacaaggaagaagcttctaaaatgatgaatgaagtatttcctatgttaaaaagatgggctaaggattaa

SEQ ID NO: 1526 - DNA, 1185 bp, Methanobrevibacter ruminantium
atgaacgtattagtttgttctatgtcagctatggctgaaactgcaggtccttatgggagagctagagctcttgttgaagctttaaaggcatctggtattgatgtagctacttgcatggcggaagacattaattataagccaatcgatgggataaaaaattattatttgaatgttcctatgcctcttggacttcctaagccaattgcaactaggacctttcctattgcacagaaattgggaatcattgaaaggaagaatgtaggaagctttgaagatgttctccattttaccggaaacattgactataagtatttgtgtgaaagtgtggctaatataagaaaggcaatcaatgacttcaatcctgacataatttactctgaatttaatatctctgcaatattggcttctaaacttgaaaataagagattatatgcaactataagctatcctacacaaactgaatatgcttctaatcccaaatatgctaaaggactaaagaagtttttaagagaaaataatcttccagatgttaattcctcattggatctttttaattgggcggataagtcatttgttccaagcatttatgaattggagccaatcgataaggataatgtgactttctgtggaacttggaagaatcttaatgaaggctctgtctttaaggaaaatgatgaaaatatggattctacagatgagaggaatgcaattttagtctatatgggaagtgggactatatctccaaacaagatgtttaaagaaatcaaagatgcatttattggaacagaatatcaagtttatattgcatctcttggacttgagaagtcagattttgataatattcatattgataagcgctgggatttctccaagcttttaaatgaatctgttctctttatcaatcatggaggtcaaaacagtgtggttgatggatttatttatggagttcctcaattgatttgtcctggaagagtctttgaacggatttataatggaaaatcagttgaaaaggttgatgcaggtaaaatattggaaattactgattttaaaggggagattatcaaatctgaaagtgaaaaaatcattaaggatgactcttttaggaataattccaaatcaatcggagataagttaaaatcactaaatggtattgatttgattatagattctatcaagaaaggctaa

SEQ ID NO: 1527 - DNA, 1344 bp, Methanobrevibacter ruminantium
atgaaaatgtataaaataaatgtttcaaatatttcacgattaaggacttatactgacggggatggtgtttcaactttaattgggtccatgggttgtcctttaagatgtgcatattgtttcaatcctttttcttgggacggttcccttgaacctaaaacttatgctgttgatgaattatatgaagaagttaaaagagacaatatctattttttatcaactggcggaggcttggtttttggtggaggggagccattgctctatcatgaatttatcaaggaatttattaagaaatataaatcaaccggttggaaattcacattggaaacatcactttcagttaaaaaggatattttaagggatattattgactatattgatttttttatagttgatacaaaggatatgaataaaaataggtatgaattatatacaaaaggagattatgaattattcttatcaaacttaaaatttcttattgataaagttggatctgatgggattagagttcgggttcctaaaattcctaagttaaataccgtagatgatgttaaaacaaattatcggactcttaaagatatgggcttttctaatatagatgtctttaattatgtggagattgctaaacacagaaaaatctctcgtgttgctctggaaaataaaaaagattttgatgaaaggctatatgaaaataagattaaatttgtagaggattatatcttatctgagattatgcttaaggttcctccgattttggattttcatataaagaaattcccaaattcctttaataaaaaatttgaattcttatttgaatacgattctatatttaatgacgacctgttctttttaaaggaagtcgttatttctaaattacaggagtgttatgattatttggatttaaaatatggcttctttgtaattttttaccctgttggttatttggaaaatagattagatgattcttgttttgatttgagtattatgaataatctagtaaaatcttttgaaggtttagatgaaattgataaggaaaaacatgcattggagttatgggaagaaaataaatgggaatatattgaatttaagtatttctgtcatgatttaaatcatttaaaaaatttttatgttaattttaaagatcatggctataaattagattcaaaatatattttatcaaatgcgtatgatgtttgtccatctgattttgtagtccatattaatcttagaaaaactggtaagacttataatatagtcgaagaagattattcaacacatcttcttgttcagaaatttgataaggatatgaatctaatttctcaaagcatttttgaaaagggaatataa

SEQ ID NO: 1528 - DNA, 270 bp, Methanobrevibacter ruminantium
atgaaaggaaaagataaatgtgagttgcttaaaaatattagacaaaaaattgcagatgaaaataatatcgagtatacggctgtagagtgtacatttcaaggagattgcactggaacttgtcctaaatgtgaatctgaacttgaatatttggataaggaacttgagaaaaaacaaaatgctggtgaaaatataaatattaagaatatattttcttcagacgattttgataaatcagaatatggtcttcttgatgaaaatatattaggttag

SEQ ID NO: 1529 - DNA, 426 bp, Methanobrevibacter ruminantium
atggtagatgaaatagacagattcgatggaaaatacctgtttttaagtaatttttatatttgtgacgttgaatatgatggaatactttatcctcacacagaggcagcatttcatgctcaaaaggtcttcgatgatgagactaaaatgaaatttactaatgtcactccaaagcaatcgaaaagattgggtcgtaaggtaaaattgcgtgaagattggaatgaagtcaaggacaatataatgtatgaagtctgtaaggctaaatttgaacagaatccagacattcgtaaattattgcttgaaactggcgatgcaaccttgattgaaggaaacacttggaatgatcaatattggggtgtttgcagaggaaagggcagaaaccagttaggaaagactttaatgagaattagagaggaattaagagaataa

SEQ ID NO: 1530 - DNA, 1533 bp, Methanobrevibacter ruminantium
atgaatgaaactaaaaaacaagtatcctggatgccattaatcctagtggcttttgcatcatttattatagctcttgatgccacattcatgaatgtatcaatatccccacttgttattgacttaaacacagatgttggaaccatacaaaccataatcagtttttataccttgattacagcttcattgatgcttataagctcaaagatgcaggatgtctttggaaagaaaaagatattcctaactggagcattggtctacggcttaggagcattcattgcctcaatcagccaaaatgcaataatgctctttatcggatggtcactattggaaggtattggcggagcattgatgacacctgctacaatatcaatcataagtggaacatatgacggccagatgcgtacaacagcccttgcaatctcaagcgcaatcgtcggaattgcagcagctatcggaccattgtttggaggtgttgtaaccacattcctatcctggagatatggatttgtatttgaactattaattattcttataatatttatcttccgcaagagaattccaaactttgcatcaactgcaagcaaaaaggatttggacattacaggatcccttctctcagccataggattaatattgcttgtcttaggagttttaatgatttcaggaaagacaatcggattaagcataggcctaatcattgcgagcataatcgtgctaattggatttggactctttgaaaagagaaggaaggcaaatggaaagatgcctttatttgatgtaagcctcttaaaggatagaaatctatcccgcggcacattgattagacttataactgcaattgcaatgggaggctcattgttttcaatatcaatctaccttcagacagttctcaagctctctgcattcaatacagggattgtcctattgcctctcacctttggaatgcttatattttcaataatggcaccgaaattcgcaatcagactaagccataaatatgcaatgataatcggtttttcaattgctattgtgggatgcctccttttaagctatcagtttacactaactacaagattcatcgatctccttccagggatgtttatctatggtgcaggacttggttttccaatggcattaagcgtagatacagcacttataaacacccctcccgaaagccaaagcagtgcatcaggatttgtaagcacaggacaaagtctgggaatgtctatgggaactgcaatcattggaatcatcctaatcgttggagcagttggaggaatgcatgatgcaataaatacctatgctccagataaggtcacaaaccaagaattccatgataatgtgcagggctactttgaaaaattaggaaatgttaatacaacagagcttaagcatgaaaacagcctaaaggaaaagattgtgagcaaggtcgtacaggatgctatgagattggtaatgtatgtgactgcattgctgcttgcaataggaggagcattgacttttaccttaaaaaaacaaaaaataaaaggataa

SEQ ID NO: 1531 - DNA, 468 bp, Methanobrevibacter ruminantium
atgtataaaaaattaatgatactggcactattttgttttatagtcattggctcagcaagtgcagcagactttaaaatcaatgatggctttaacagctcactgtctgattattctttttacaatgaagaccaaaacatgtacattaatatctgggattatgatgatgagattcttagcgaagcatatctggaaaacagcagcagctatcgcatagtttcaggagaaaacaatacatataactttgtttttgacagctataacgatatggatcatgtaatctcctatattaccaaaggatatgttgccttagactgtggagtattggaaatagctgaagttgatggcaaaaagcaaatcattttggtttctaaagagggaacaaatgtagatagcttgaaaacatgttatgatgaattaatgaaattcaatcagaacaataatatagagccaatagcagatgctatataa

SEQ ID NO: 1532 - DNA, 1938 bp, Methanobrevibacter ruminantium
atgagaattaataaatctttattaatgatctcactgcttcttatttcaattcttgctataagcgcagcaagtgctgcagatgacatggtagacgcagatattgacctagcaagttcagaaattagtgaagtaagtgtagatgatgtacaagctacagataaaaatgttttatctgatgcagatgaagtttcagtagttacacaaaacactccttacaatgaaaatgcaactattgatatcagcgtcaacggcactttagctgatgacagcaccataaaacttttcattgacggtgaagacaaaggagatttaaatctatcagcagaaggaaaagcaagttatgttattccagcaagcactctcgatgtaggaaaatatttcattgaagcagtagtacataatggaacttcctcatttggaggcagatccaccctcaacattactaaagtcactcctatcgtaagcgttagtgatgtaactgtaaaaagtggagattatataaccattccatttaatgtaactgatgacaaaggtaaagcaatccctggagatgtcattgtaacaatagtctgggaaaatgatgtaataagcaaacatattaaactaaacgacaatagctctgcaggatttaatattgctgatattattggaatatttggcggaaacagcacaggtaacggaacaggaactggaataggtgacttattcaacagaaacggaaccaacggaactggaaacggaaccggaataggtgacttattcaacagaaacggaaccaacggaactggaaacggaaccggaataggtgacttattcaacagaaacggaaccaacggaactggaaacggaacaggcatcccaggtattggcggaaacagcacaggtaacggaactggaaacggaaccggagacttcgatattgcaagcattctcgcaatgttaatgggaggaggcaataataccggcgctaaatttgcatatgtctttgaaaaaggagtctataatgtaagcgttgaatacttaagcaacagaaactacaatggagccattaacgacactgcaaaactaaccattactcctttagaagatgttttaatcaatgcaaccatcgaaactgctaaaaacatgtctgacaacacaactgtatccatccttttaaccgacggatatgaaaaaccaatagctggcggagaaatcaatgttttcctaaacggtgaagacaaaggaaaagtcactgccaatgaggaaggtaaagcaagcattgcctttagcaacttacttaaaggtgactatgaattattactcaactataaagaaaccaacaaaaccttcgacttctttgtaaatgttgaaagaatgggaaccgtcattgaatatgaagacatgaacaccacctctgtaaacgaaaaagtcgatggcagaatcggtgaatacttccaagtcactttaaaagacaacgaaggaaaagctttagctaacagattcgtccaaatcggattcaacggtaaaatctataacagaaccaccgatgataaaggacaaaccaaattgcaaatcaaccttttctacactggtgattacacctttgctgtatgttacttaggagatgacgcttataacgcatcattcattgttgcaaaaatcaaagtaagcaaacaaactccaaagattacaactaaagatgctacatacaaagcagatgccaaaaccaaaaacattaaggttacattaaaatctgcaaaagacaatgcaattaaagataaaaagatcagtgtaactgtaaacggcaaaacctacactgctaaaacagatgaaaaaggtgtagcaactgtaaacgtaagcttatctaagaaaggaacttacagctttactgcaaaatatgccggtgacagcggatacgctcaagtcagcacaaaaggtatattaaccttaaaataa

SEQ ID NO: 1533 - DNA, 246 bp, Methanobrevibacter ruminantium
ttggaacttgttatcttcaaggcagaaaacaaattagaggaaatcttcttaaatgcacagttaaaaatgcaaaaggctaaaaatgaattgattaaaaacatggaaaaagacatcgagaaagctattgaattagctgctatcgaagttgaaacccaaataatcaaagaaaacattgatattgctgtagatgccttagaagaaaccattgaagaagaaaaagcagacttagccgaaagatttgaataa

SEQ ID NO: 1534 - DNA, 462 bp, Methanobrevibacter ruminantium
atgtcagaaatattaccaaaaattacaggacaaataataggacatttcaatgcatttaaaggatcaagaccagcatttcatggtgaacacaccctcattgtaagaggaataagccgtgacaagattgaaatagaagaaatggaacctaaattagcagagcttgaagacattcttaaggcaagagaagttgatgtattatctgatgcaggtaaaaactttgtagaaaaagtagattcatatataagagatgcagaatccattgatacagccccagacagtggagggctccttagaatgaaagagcaattagaaactatgggattgcatgtggaatacaagctattcttaatgccatatgctggagcatttgtagcaatctggaaagacaaatctggatttggtccattatatgtggaagttacagcatctgaaagggaagagactgataatgatatgaaataa

SEQ ID NO: 1535 - DNA, 1092 bp, Methanobrevibacter ruminantium
atgtctaatttatccaatattgattttgaaaaccttagtcgcaacgacctaatatccattttagaatgcaaaaaggaagacattctaaaaatcatggatttagctaattccaaaagggaaaacactttcgtcacatattcaaaaaatgtctttatcccaatcacaaagatatgtaaaaatgactgtggatactgtgcattcaagcaaagcccagatgatcctgatgcaaccatattgcttgaaaaggaagagatattagccactttaaaggaagcagaaaaatatggctgcaaagaggcattgtttacaatgggagaggatgcagatgaagaacctgctgtaaaaatcaagcttgagaaattaggctatgagaatatgccagattacatttatgacatctgtaaaatgacagtagaggaaacagaccttctgccacacaccaatgctggaaacttctcatatgaagatatgaaaaagcttaaagaatacaatatctctatgggaatgatgctggaaaactcatcagaacgattgatgaatactattgcccataaaaagagtcctggaaaagatcctaaaatacgtcttgaaactatagaaaatgcaggaaaacttaatattgcatatacaactggaatacttattggaatcggtgaaacaaaagaagaaatagctgattccctacttaaaataaaggaactttgtgataagtatgggcatattcaagaggtaatcattcaaaactttacagtaagtcctggaattgaaatggaaagccatgaagagccaagccttttagatatggttagaaccgttgcagctgcacaattgctctttgatgaggatgtttcagttcaagtgccaccaaacctcaactatgaaacaagccagatattccttctttgcggaacagacgactggggaggagtttctccattaagtgaagactatgtaaatccatcctcaccatggccaacccttgaaaggcttgaaaagctaacaaacgatgcaggataccagttaaaggaaaggttagccatttatgataaatatattaatgaaaaatatattgaaaaatcctatattaattag

SEQ ID NO: 1536 - DNA, 1323 bp, Methanobrevibacter ruminantium
atgactaatgaagataataaaaatatgacaattattggagctagcagaggtctcggcaaatggatagcccaacacttaaaagaagactttaatatcaccataacaagccgaaatcaagcagaagggcaagaagtggccaatgaactaaaggttagctacaataatgacaatattgatgcaataaaggatgcaaatataattatcttcagcgtgcctatagagcatatggccaccaccataaaggaagtggctccccatgcacctaagggatcattattaatggatgttgcaagcataaagaaagagcctgctgaagcattggaaaaatacgctcctaaagatgtggagatattgccatgccatccaatgtttggtccaagagtccctacccttaaaaggcagatagtggtattgactccaattgaaaacaggtcaaatagttggacacttgtaaaggaatatctagagaaaaaggaatgcgaaatcgtcattacaagccctgatgagcatgacaaatatatgagcatcgttcaaggacttacccatttctcattcataagccttgcttcaacaataaagaagctaaacataaatgtcaagaagtcaagatcattttccagtccagtctatagcctaatgcttgatatgataagtcgtgttgtctatcaaaacccttacctttactattcaatacaaaagaacaataaggaaactgcatatgcaagagatgcattgattaaagaaagcatgcgcctatcaaaactgatagaagagggagacgaggaagactttgtaaaggccattgcagaatcagcagagcatattgatgaaatcgaagaggctttggtacgctcagataaggcaataagcatgttgaatcaaaaggcaaatatcctaacaaaattaattggagaagaagtgggattggaagatgcattctccaaaaaggcatatataggcattgttagaaaggtcagctcacagactgttacaatagagaatgaaaacaatgaagagattgaattgaagatttcatctattgacataatggataaagatgagctcttccaatggaaaaagaagaatttgaagttggaatcctttgatttaacagcaaaattcccttcaagcgctaatgaagactatttgcttaagatgtttaaaaggattgaaccagttattgatgcaaatatcatctttaaagacaaagagattgaaaaagatttaagaacttataagttccattattccctattcaataagcaagaaaaggattatgttgaaaaatacattcagggaattggtggaatcctaataaaataa

SEQ ID NO: 1537 - DNA, 771 bp, Methanobrevibacter ruminantium
ttgaagtggaaaaagataggggacattctcatcattgatgataactttgatttggacttgaatgatgagaagactttaaaagatcttgcacataggcataaggtcaaatccataatccggattgaaaagattgaaggtcaaaagagagagcctacaattgatatcttgtatggtgaggatacagaaaccattcataaggaaaacggatgcctgtttaacttggatttgtctaaagtgatgtgggctaaaggaaataataatgagcgattaagaatagccaaactagtccaaaaggatgagactgtcttggatatgtttgcaggaatcggatacttttctattcctattggggttcatagccaggcaaagcagatctattcgattgaaataaatccaaattcctatcattttctaaaaaggaatattgagttaaataaaatcaataaaaaagcaggttatgataggatgattcctattttaggggattgtgcaatagaagcacctaaatactctgcagatagggttttaatgggttatgtgaagacaactcatcacttcttgcatccggcgatggaatgcgttaaggatggtggcataattcattatcatgagaccgttccggataagctgattgaaactaggccttatgagagggttaaggaaatggcatggaactgcggtgaaagggaagttgaggttttaaatattcagcgtataaaaagatatgctccaggtgtagagcatatagttctagatgcaaggatttattaa

SEQ ID NO: 1538 - DNA, 624 bp, Methanobrevibacter ruminantium
atgagtaataaaaacacttttgaaggtactacaaccgttggtattacctgcaaagatggtgttgtatttgcaagtgaaagaagagcaagtatgggaaaccttgttgctcacaaagtagctgaaaaaatattcaaaatcgacaatcacattgcagcaaccattgcaggatctgtagcagatgcacaaaccttaatgaaagtaataagtgctgaaacttcattgtacagattaagaaatggaaaagacattagcttagaagcagctgctgctgtaagctctaacatattacactcctcaccagcatatgttcaaactcttatcggaggagtagacgacactggagcatcaatctattcattagatgctgcaggtggtatgattaaggataccttcatttctaccggttccggttccacatttgcatatggtgtgcttgaagacagattctatgaagatatcactgtagaggaagctactgaagttgccataagagcaatcaaagcagctacagaaagggataccttctctggaaacggctttttagtggcaaatgttactaaagacggatttaaaatgttagaaaaagaagaagtagacgctattattgaaaagatcaatagctag

SEQ ID NO: 1539 - DNA, 1911 bp, Methanobrevibacter ruminantium
atggcttccaatgttttagaacaaattaaagaagaaattacaaagaaacttccagaagaggttaaattagcaaatattgaatttgaaggtccggaagttgtaatatatacaaaaaatccagacatcattgcagacaatggggacctaattagaaacctcgctaaggacttaagaaaaagaatcatcatacgttcagacaagtcagttttagactcttacgaagacgcaatcaagaaggtagaggaaatcgtacctgaagatgctgaaattaacgacataaaatttgatgaagttacaaatgaaattgtcatagaggcaaccaagccaggacttgtaattggaaaatatggagttacctcaagagatatcgtaagaaacactggttgggctcctaaaatcttaagaacccctccaatgagatctgaaattatcgacagaataagaaacacccttttaaacaacagcaaagaaagaaaaaaattcctccaaacattaggtgcaagaattcaccaagggggaaaatatcctagcgactgggtaagattaactgctatgggaggatttaaggaagtaggacgttcctgcatgttgcttcaaactccaaacagtagagtattgcttgactgcggagtaaacgtagcaggccaagatgacaaaacctcattcccaatgcttggagttcctgaattttcaattcaagacttagatgctgttgtcttatctcacgctcacttggaccactgcggattcatcccttacctttaccactatggatacgaaggccctgtttactgtacaagtgcaacaagagacttgatgacattattgcaaatggattatattgatatcgctcacagagataacaatcctctcccattcaatgcaaagcatgttcaaaaggaagttaagcatacaattacattggattacggagtggttactgacatttccccagacatcaagcttacattgcataatgcaggacacatcataggatctgcaatgtgccacttccacattggagacggagcacataaccttctatacacaggagactttaaatatgaaaaaagcagacttcttgaacctgcaacaaccagattcccaagagtggaaagctgcattatggaaagtacctatggaggacatgaggatgtaaccccttcaagaaacaatgcagaaaaggaattgatgaaaaccatctacaaaacaattaaacgtggcggaaaagtattgcttccagtgtttgctgtaggaagggctcaagaattgatgattgtgcttgaagagtatatgcatcatgacataattgaaaccgtacctatacatcttgacggaatgatttgggaagcaactgcagtgcatactgcaagacctgaatacttaagcaaggaattaagagatcaaatccttcatatgagccgtaacccattcatgacagaatcattcaatcaggttcaaaacaatgcagaaagaaaggaaatcgttgaaggagagccttcaatcatattgtcaacttctggtatgatgactggaggaaactctgtagaatacttcaaatggttatgtgaagacaaaaagaacactcttatctttgtaggataccaatctgaaggttcattaggtagaaaaatccaaaaaggacataagcaattaccatttgaagatgaagacggtaagacaagggttttcaatgtagaaatggaagtcaagaccattgaaggattcagtggtcactccaatagaagacaattgatggaatttgctaaaagactacacccaagaccggataagattattacctgtcatggagacccttataagactgttgacttggcttcaagcattcatagaagctttaaagttgagacaaagactccagtcatactcgatgcagtaaggttacaataa

SEQ ID NO: 1540 - DNA, 1020 bp, Methanobrevibacter ruminantium
atggttacatattcagaatcaggtgttgacattgaccttgaagcattgactgtttctaaacttgcttcaaaattaaaaccaacattagaatacagaaatatcattactgacagtggacattttgcagctttagtagaacttggagataaggccattgcaatgagcactgatggtgtagggagtaaaatcttagtggctaaaatgatggagaaatacgataccgttggaatcgacatgattgcaatggtagttaacgacattctctgtgtaggtgctgagcctatagcattagtggactatttggcagttgaagagccagatccaaaagttgctgaagagattgcagacggattagtcaaaggagctaccgaatccaaaatcgcaataatcggaggggaaacagcatcacttccaggaattgtaaaggatttcgatttagctggaaccggaatcggctttgtagacaaggacaaaattatcactggtgcagacatccaagaaggagacatcttaatcggacttagaagtagcggaatccacagtaatggattaagccttgcaagacgtgcaatattcgaagatggaggatttactgtcgatgacaaaatgcctaattcagacaccacaatcggtgaagaattattaaagccaacccaattatatgttaaagcaatcattgaccttctaggacaaggatttaatataaaaggacttgctcatatgactggtggcggagtaaacaacctttcaagacttaaagatggaataggctttgaaatcactgattatccagaacctcaagatattttcaaattgatttaccaacaaggagttcctttagaggaaatgtataaggtcttcaatatgggaataggatttacagtaatcgcaagccctgaggaagctgatgcagtccttgaagcattaaataaaaatattgaaagttatattgttggaaaagttattggcgaagagaaaatagttgtaaaaacctttgaaggcactgaaataacttattaa

SEQ ID NO: 1541 - DNA, 990 bp, Methanobrevibacter ruminantium
atgaatattagtgttaataaagaacgagaactagtaaaagaaatattaactaaaatcggagtaaaggaaaaccaagctgatgttgtaacagaagcaacaatagactctgatttaaaaggattcacttcacacggacttggaagattcccacaatacataagaggaatcaaaagaggacatattcaaattgatggggaatatgacatagtccaagaaactgaatcaatcgcattgattgacggtaaaagtctttttggacaatacatagctcatgaagcaatgagcttagcaattgaaaaggctaaaaagacaggtattgctgcagtaggtacattcaatgctaaccactttggaataactggatattactctgatttagccattagaaatgataccatcggtattgtaatatgtaatacagaacctggagtagcacctcttggaggtaaaaaagcaattcttggtactaacccagtggctataggaattccttccgacacttatattgctgtagacatggcaacttctgtcagcgctcgtggaaaattattggaagctcaaagaaaaggtgaagagattccaccaaacactgcaatcgataaggatggaaacccaacaaccgatcctgaagctgcattagaaggttccatcttaccatttggcggagtcaaaggatatgcattaagccttatgattgaaatcatgtctggacctttagtaaacgctgcatttggtacaaaagtaaccggaactgcaggtgactataaggaaaactgtaataagggagacttattcgttgctatcgatccttccaaatttgttccaatcgaacagttcaaggcagacgttgaagaattcgttactgaaataagagaatccggtgacacattcataccaggagaccttgaagtaaaaagaattgcagaaaacgaagtcaaaggtttagacatagatgaaaaactctatgacaccttagaaaacaatttgtga

SEQ ID NO: 1542 - DNA, 393 bp, Methanobrevibacter ruminantium
atggtaaaacctgttaaaattcatgacaataatctttgggataagtttgttaaagagactgaatcctattgggctgttttaagtccaggtactgtgattgctatatttattggcgaaactgataagaattttttattgattgagagaaaagaaggaactgttgagtctaaattcaatataaataattctcttaatatgatggatactggtctctttttcacaataactgaagaggatgcatccgatttattagatgattccagtttattgactacttttattaaagaaggtaaattaggcatattctgtttagtggatgattatgcaatggctgaaaagggtcttgatactttattaagcgatttaggctttgcaccatcttgtgctatttaa

SEQ ID NO: 1543 - DNA, 1917 bp, Methanobrevibacter ruminantium
atggttaaaaggaatattgttcttttagatattgattatataactcatgacgaaaaggcagtcatccgcctatttggcaaggtaaagggaggagaatctaatgacatcatcgctatagatgactcttttgtcccttatctttacattttgcctcttgaggatatagataaatgcataaaagacataaacggtctaaaagaagaaggagaaattgaatttaccaaattggaaaaggtaaacaagaaagaccttcaagttcctaaggaatttattaagatgaccttaaaccatcctcaggatgttccaaaatacagagacaaaatttgggacttaaactctgtaaagcaattaagggagcacgacattccattttatagaagatacctgatagataatgccttagttcctatggctgaattggagcttgaaggagagcttatagactcatttgaaacagtcgattctgacgatgaatcccttgaaatacttaagctaagctgccctccaaagactgcaaacactgattttcaggaatttcgaatgatgagctttgaccttgaggttcgaaaccctcatggaatgccaaatccagatcaagatgaaatcattatgattggaatcgacagcaatgtaggtgttagaaaggtcatctcaacaaaaggggatgaatttgatgatgatgaggaaatggactttattgaaattgtggaaacagaaaaggaaatgattgaacgcttcgttcaaacggtcaaggatgccaatatcgatattataataggatataactcagataattttgacttcccttaccttagggatagggcaaagagatgggaagtggatttggatttaggtgttgacggctctggacttaaatttttaagaagaggctatgcaaactctgcagcctttagaggccttttgcatgttgatttatatttggttatgagaagatacatgtctcttgatagatataccttggaaagggtctatcttgagttctttggagaggaaaagatcgatgttcctggtgagagaatctatgaattctgggacaacggcggagatgagctgaagaatctctttaagtattccttggatgatgtggtagccaccttaaagatagctatggaaacattgcctctaaaccttgaactgacccgtatcgttcgtcagcctttctttgacgtaacccgtatgtctacaggccagcaagccgagtggtttttagttagaaaagcttatgaggttgatgaggttgttccaaacaagcctaatatgaccatgaataacattcgtgaaagaggcagcaattctggaggctatgtaaaggagcctgaaattggtttgcatgagaatcttgttcaattcgactttaagagtctgtatccaaccttgattatttcaaaaaacatctctcccgatgttttggtaactgataatatttcttataatgccaagtttgaagactttgagacaggatatgatgaaattgacagtgttttggaagagactccaagtgaggatttggatgaggaggattattatgtctgtcctgaacacttctttaagtttaaaaaggagccacaaggtttcattccatcagcaattgaagacgtattgaatgaaaggtttagggtaaagaatagaatgaagcaaaccgaagatccggtactcagaaaaagtctggatgttcagcaacaggccttgaaacgtttggcaaatacaatgtatggagtttatggatttttaagattccgttggtattcctttgaatgcgctcaggctatcactgcatggggacgtcagcatattaaaaaggccatgaaggaagctgaagactttggatttaaggccatttatgcagataccgatggattttatgcaaaatatgttcctgaaatgaaaaaagaatga

SEQ ID NO: 1544 - DNA, 810 bp, Methanobrevibacter ruminantium
atgaatgtgccacaagttttagaaattaaaagaatcatagaagaaactccttcaattaagacttttatttttgattggacaatggtaggtgaaaacattccaactccaggccagtttgtaatggtttggaatttcaatgacgaaaagccaatgtccatttcctatattgacatagctaaaggagaattgggaattacagtaaagaatgttggggaatttaccaatcagctccacagccttgaagttggagacagattaggtcttaggggaccttatggtaatggctttgacactgatttaagagacatgaaagtcttggcaattggtggaggagtaggaatggctcctattgcttcatttgctgaagaggcattgaaaaacaaggcgattgttgatgttgtatgtgcagcccagacaaaggacgagctcttatttgatgaaagattaaaggaaaaaggggcaaccgtttacacttgcactgatgacgggtcctgcggatttaagggatttgcaacccatagggctatagagctaatggctatgaaaaagtatgattgggctgttgtctgtggtcctgaagttatgatgaagccgttatacggcacattggaatcaaatatgattgatggagagtattccatggaaagatatatgaaatgtgccattggagtatgcggccaatgctgtgtggacaatacaggatggagaatctgtgttgaaggccctgtattttctacagatcagatgtctgagataattgaattcggtgagttccatagaaccgcttctggattaaaagagttttattaa

SEQ ID NO: 1545 - DNA, 1281 bp, Methanobrevibacter ruminantium
atggaatactatataacacaatttattgcaggatttattgcttttgatgaggatttgaaaatagccaattataaattatttgatgatgagaatattgtttcaaataatcttaaaattgaaaataaggaattattagaagaggagatagaattaattaatgaactgtcttctgatgattctacaatcattatagaaacaagaaaaagaagatcccaatataaagagcttgacaattatgaaaatataatagttgagactccaaataaaggtggagaacacttaagaaataatttagagagcattctattggaaattggctttttaaatgatgataaagagaatatcgatgatgtagaagaaaatataagtaatttagaagagccaaaccaagaaaaatactctgaaattacaaaaatttatgaggacatagctagcctaaaagtaaaagagtcctcacaagaagaagataaactacttattcaagcaataaacactgtagatgaccttgatgaatcaatcagcaaattagtggaacgtattcgtgattggtacaccatctacttccctgagatggacactataggaagcaatgaaacatatatcaaattaattgcagaaagcgaaaacagggaagacatcattaaaaaccataaagagcactttgatatagacttggatttcagcactggagcagacatagaagaatatgacttaattatggtaaaaagctttgcagagtctatctattcacttcaaaggtctagaaaagacttggaaaaatatatagatactaaaatggaagaaattgcacctaacttaagagatttattaggccctacacttggtgcaaagcttatcgctcacattggaagcataaaaagattagccacttatcctgcaagcaccgttcaaataatgggcgctgaaaaggccatattcagacatttgaaaactggagagagacctccaaagcacggtttgatattccagcacccaagcgtaagaggtgcgaaatggtggaatagaggaaaagtcgctagaaatctagctttaaaaattactttagccgttagaaaggatgtctttagtggagaatatgatccaaaaatagctgaagactacttgaaaaaggtagaagagatagaaaaagaaaatcctttccctaaaaagacaagcagccgaagaaagtctgaaagacagatggaaaaagataaaaagtctaaaaagtacaagggaaataagaaaaataagaagaataaaaagagaaagaaaaggaaatag

SEQ ID NO: 1546 - DNA, 651 bp, Methanobrevibacter ruminantium
atggaaatatttttaaaagatcaagacatagtcacaaggaatctaaggcctggaatcaaggtctatgatgaaaagctaatccaagaagagggtagcgaaatcgaatatcgcagctggaatcctagaaggtccaaattagctgcggcattattaaacggtttagaaagcttaaaattagaaaatgactctaaggtattatatttaggagcatctaccggtacaactgtctcacacatttcagacattgcatatgacggattgatttatgcagtggaattctcacctgtaagcatgaaaaagctaattagactctctaagcaaagaccaaacattgctccccttcttgaggatgcgaccaagccaaaaaattatttaaacaaggtcgaaaaagtggatttggtctattgtgacgttgctcaggaaaaacaaagcgaattattcatgaataatatgaaattattcctaaaggaagatggacaaggcctcattactataaaagcaagaagcatagacgttgttcagaaacctaaaaaaatcttcaaggaagaggagaaaaaattaaaagctaatggttattccattcttgaaaaaattaagttagaaccttatgaaaaagaccatattgcttttttagttgaaaaatctttctaa

SEQ ID NO: 1547 - DNA, 735 bp, Methanobrevibacter ruminantium
atgaatcaagataaaatgaagcttatgcagattttaaagaatcttgaaagagattataatgatggtctgatttccgaagagaaatacatctatctttcaaaccagtataggcataagatcgatacaattgatactagcaataggataaggactatgcaaggcaaaaagaaggtttctcctcgcccttattcaaaatatgaagatgctaattatcaaaaaagtcgtgatgaggatgaacgtttagttgaaaaatacatccacaatcctgaatcttataatattaattctagaggaaagaaaaccaaaagcggaggaactagcccgtggtatattgctttagcagttattttcttgctttttgcatttggtgctggaattagctttggaatatttagcgaaaatacaaatagtgatgtaggagatattattacagctagtgcaacaattaatgacacagcttttcctgaagtaaaacagacttataagtacaatcgtacttcaaattatactaaatactcctcaaactcttattcaagcgattattctagtggaagttcttataattcttataattcctatggcggatcaggttattcaagtggaggctctggttattctagcggaggttctggctattcaagtggaggctctggttattctagtggaggttcttcttactctagtggaggttctggctattccagtggtggttctggttcggtatcgattgattag

SEQ ID NO: 1548 - DNA, 828 bp, Methanobrevibacter ruminantium
atgataaatgataaagttgcatttttaggccctcaaggaacattttctcacgaagctgcatcactgcttagcgataatttgatttcatactgttccatacagtctgtaatggatgcagttgagcgaggggaatgcagatatgggcttgttccaattgaaaactctatagaaggtccagttagtctaactttagattcattgattcataattttgatttgaagattagaaatgagataatcattccaatcaatcataatctattggcggcctctgatatttcagtggatgaggttgaaaacgtttattcgcatgctcaagccttagggcaatgccagccttatcttgaaaggcacaatatggtcgcccattatactttaagcactgcagctgcagctaaacatgtggctgaaactggggaggatgcagctattggaactttgaaggctgcagaattatatgatttaaaggtcattgacacaaacattcaagagaattataataatgagactcgttttgtggttttggatactgaagattctccaattaccggaaatgacaagacttccatctccttttcattatttgaagataagcctggtggactttatgagttattgggttattttgccagtgaaaacattaacttgactaaaattgagtcacgtccatctaaagaaggattgggccattatattttctttgttgacttggaaggtcataggttggatgagaatattgctaaaattctaaataatttggaggacaacacttcattttttaagattttaggctcttatccagtttattctagagaactattcgattaa

SEQ ID NO: 1549 - DNA, 819 bp, Methanobrevibacter ruminantium
atgaaaatcaaaaatataatgtcagaaaatgtggtatcaattgataaaaacttaaatatctgtgactgtctaagaatgatgtataaggacaatttgtcaagaataccagttaccagtaccaatgaaaacaaaaaatctttagttggaattatctcagaaaaagatatagctaataaattaggatcagttaaatatggtaatttagctccttctcatttccatgtatctacagttatggtaaaagacttgattactgtagatgcagatgatgacttgacagatgtggctaatattctaattgaaaagaatataggtgccattcctgttttatcagatggtgaaatggttggaattgtaactaaatctgatttcatatacctttgtaaggcaaaagcttatgaaaaggtttcagttaaagatattatgacaccagatattatttcaatatctgctaatgaccgtttgattcatgcaagaaaagttatcatggactctggagtcggacgtctattattgactgaagataacgaacttgcaggaattattacttcaaaagacattgcaaaagcattggtttcatttaggaaacacactcctgaaaagcatatggcttccaagattaaggaactggttgcaggagattatatgtctacaaacgttcagacaattagtgaagatacaagtattcctgaacttgcagatgcaatgttggagactggatataatggttatcctgtagttgattcaaatgatcagattataggaatcgttactcagtcagaccttttaaaattaatttatgagatggaaactcaataa

SEQ ID NO: 1550 - DNA, 885 bp, Methanobrevibacter ruminantium
atgaatcgtggttctgttgaacatgaaagcaaagtggctgaaaatgaaggcgaaatcatgactttagctaaaaaagaagtcattagcattcctcaaaccaagacaatcaaagaagctgctgaaatgatgatagaacatgaattcagaagattgccagtgactcaacctggttcaaataaacttttaggtatcgtaacagctatggatattcttgatttccttggaggaggaagtaaatttgacataatagaaaagaaacacaatgataatttcttggctgcaatcaatgatcaagtcaaggaaattatgactcgtggagtaatttctgttggccctaaggctactattagggaaagtgtcacaaaaatgactgaaaatggtattggatctttacctatcgttgataaggaaggtaaattggtgggaattgtcactgaaagagattttgctttagcacttgcaggctccttgaccaatgaaactgttggggacctcatgattaaagatgttatcacaactacttgcggaacccctattgaaagttgttctaagattatggttagaaacaacttaagaagaattcctgtagttgaagaagacaagttagtaggtattgtaacttctactgatattttaagattcttcggtgataaggaaatgtttgcatccatgacctcaaacagtggtttggatgtattgaaaaggcaaatctctgatattgtgaaacctaatatttcagtaactgaatcttatgttaaattaggagatttatgtgatttattagctgaaaagaacattggtggtgttcctgtagtggatgataacaagcttgtaggaattatcacagaaagagatattttaaatgctgtacttagtaaaaagtag

SEQ ID NO: 1551 - DNA, 1113 bp, Methanobrevibacter ruminantium
atggctgaaataaaaaaacaagttagaacaagagatttcataattagtacagacggattattattcgcttcaacaaactacattcaccctgaagatagaatcatttcattcttaagatacattccagacgagaacggagacagagaaaaggatggaatcaaatactcaaaggtaggctcagatgaagcttatgcctatttaagggaaaaccacccggattacttatatttctgcgatgtgacaaatgttgaaatgatgggagttccaatagataaggtcgaaagaatcatcaagcctgaagagagacttaaaggtcttagggaaacctatatcccaattatcaatgaaaagctagaaaagggagaggatttggattataaggaagaacttatgagcaagctaatagatctttcagactttttccactatatggctagcattgactacaacgaccttggaatatcaggatcaatattgcctggccttcaaaaggcaggaacctcagacctagacttcgttgtattcggtcttgaaaatcatagaaatgcaatcaaggcatataaagaaaacaaggacaaaccagtatacattgaagagctagacaaggaaatcacattaaacagaatcaatgacgacttctgggactttgtctatgacaaaagaataaaggacgatagcctcaccaaagaagagtttgcttggtatgaagaaagaaagagcaatagaggccttatcagagaaacccttttcgatatcttggcaaccagaaactatgatgaaatcgaaggaacctggggagacacagtatatgaacctgaaggatttgccaaagtcaactgtacaataaaaagcgcattaggagcatttgacaatcctgcagtatatacaatcgaagatgtggaaatacttgaaggacctgacattgaaatttcagagcttgcatcattaacccacacctatgctggagaggtaatcgacggagaggaagttgttgcaagaggaaaaatagaaaaggttcttaaaaatggagagttcgagaaatatagaattcttgtaggaaccactagagaatccttgaatgaatatataaagttaagagaaagccctgtataa

SEQ ID NO: 1552 - DNA, 4497 bp, Methanobrevibacter ruminantium
atgaaatacaaaaaagaattaatattcatttgttttattatttgtatgttaagtatggctagtgtatgtgctagtgatgttaatgatacatacataaatcaaaatgatttaaaaatcgataatcaagataattgtattaattatgaaaaagtagtttatacagaggaaaacttagaaaataatttaatttcaactgaagattctttggaggatagcaattctattgaaccgtctgattcatttaaacaaaaaaattcccttaatgaaggaaattccgatgaacgtttaaatccagaaatagatgttgctttgaattcaatccatgttaacgaaactgctgaagtcaatgttacagttagaaatgctagcggatatgttttagtctcagtggatgatcaatcttttaataaagaccttactgattatcaggctagattcaatattaccggacttggctttggaaatcacaatattgcagtctattatggaggggacgataactatcttccaggatttaaattggaaactatctctgttgaaaagtaccaaacccaaataagcgagattgaaatcggtgaagtttattatggggaagatgccattattgaagtcagcgttcccaatggtgttgaaggggatatcacaatcaaaatcaatgacactctccaaacagtgattactgaagccattcatgatggaatggcattattttcagtttctggtttggctgtaggcagctattctcttgatgccacatataatggaaatgattattatgaaaacgatactgcatctgccgaatttgaagttaaaaaagcagatccgaatttaagcgtggtatcatttgaatgcactgtttatgacaatgctacaatactggcttcaatcaatgaagagattcatgacgagtttgtaaacattactgttggagatgagaaatatgaggactgtcctattgaagattatggtatgatagcatttacagggggagttctctcaaatttttcctcttaccgcattctcatagaatatgggggcaatgagaatttcgaaagcgctatgatcgaagcctttgtgactccgaaaaagatcactacctatggccttgatatcattgcccagaatatttccatcaatgatgatgaaatcatttctgttgtagttccagaccatgttgacgatgtggtcgtttgggtagacgggcaaagctatcgcaactgttcctttgaaaacaatgtggctgtctttaacgtcacaggtcttggcgagggggtttatacagttaccgctacagtcaatgacacagagtttgaccataagaactttacaagcatctttactgtaagcaaggttcttccttcaataggcatttcaatcaatgaaactgaaatatatgtgggggacaatgttaagattattgtaagccttccaatcgatgtatctgaaaatgtctccattgtctttgatgaccgtgaactttcccaaaagccagtggatggaaatgccacattctacattgattgcttaagttatggaaacaagtcagttccagcaatctattatggtgatgaaaaatacagaaccgctgttgaatctattaatttcacagtcaataaagtgccttcatttttaaatgtggctgtggagaatatttcaattagcgataatgaagtgattaatttttcattggccaatgatgcaagcggcaacattacagtgattgtcaatgatgaaacttatatcgttgctgtaagcggtggaaagggaacccttacagttccaaaattgaatcaaggagtttattctgtaaatgcaagttataatggtgatggaaaatacctcccttctctaaacaattctgaaagctttaaagtgctggtcaacagtggtcaaatggagattatcgatgagagaaacaatacagtttctgtctatctatgggatggggcaacaggaaatctaagcgttaagattgatggaaaagtctacaatgcaactgtggtcgatggctttgcccaagttgtgataagcaatgcaagctatggggctcatcatgcctatgtgctttacgaggacaatgaaagcgatttgaaattggaatccgtcgttgatgtgtttgttccaaaatatctaagccctattggcataaactcctcaattttaaaggttggggatattggatacattaatgtgacagttcctatgggggcaagtggaaacataagccttgaaattgacggcaaatcttatttaattgctattgacaatggaattgcagagtttgaagttgagaatttaactgcaggggataaaacaatatttgtcaaatattccggagataaggtctatagccaaaattcaacatctgaaagcttgacagtattcaagcaggaatcctctacccattgctctattgaagatatctctgttggagatgtggctcaaattaaaataactggtccaagtgatgttttaggtacagtgattgtaatcataaatggaagcgagtacactgcaagcatttcaaatggagagggaatattgaatgtctataatttgcagaatggagattatgacattgaattaagctatttggaaaattcaaaatatttatcctctgaatatagggacaatctaagtgtttctaaaattcaaacagccatatcctcttctaatattgtttgccaatacaattatgaaggatatttgaatgtaagcttaaaggatattaaaggcaatccaatatcctgtgcagagctttctatcgatcttgatggagtgaaaaatttagtttccgatgtcaatggtcaagtaaagattccaactaaggatttggatgcaaatgattattctgtgcttataagttttgcaggagatgaaaaataccttccttcaaatgctaccgttaatgtgactgtaaataaggatattcctcagatcattgcttcaaatctaattgcagattataaatcagatgattatctcattattggattggaggatagtcaaagcaatcctttggctggctttgatttgtctattgctttgaatggaattgatggtgattatgatgtttattcaaccgattccaatggtattgtgaaagttcctattaaggatttagctgcaaacgactatattgcatctattgtttttaagggcaatgcaaattatgatgctataaattccactgttaaggtgactgttgaaaaggccctttcctctttatttgcattagatctagttactgttcatgaatctgatgattatatgatcattgctttgaaggattcttgtggcaatcctttggtcggctttgatttgtctgttgatttgaatggaattgatggggactatagttttaatgaggtttattctaccgattccaatggtatggtgaaagtatctacaaaggacttggatgccaacacttatgatgtaaaggttaaattcgatggaaacgaaaactatacagaatcaaatatcactggaagcattattgttcgcgaagacataatcatagttcctaatgcaagcattgcctttactgccaatgatagttctgtatcagcgattctttccaatctcgatggagtccctatttccaatgcctctttggatattagtgtaaatggcgatgaatccacacttattacagatgcaaatggcagggttgcaatcaaaataaatggaaacagcactgtgattgcaagctacaaagacgaaaacaatctaagcactacaggataccttaatgtcatcgtcaaagataatataactgtagtcgaaaagaacaacaccatttatgtaaatcagactgttgaggttcctgtctatatcaatcagactgttgaggttcctgtctatatcaatcagactgttgaggttcctgtttatgttaatgtaactcctaatagaactgcaactatgattgtttataataatatgactaccgttgcagttgctaaagtggatggaagagttggagaatacttctatgttagcttgaaggatgccaaaggaaatccattggcaaataaactggttcaaataggattcaatggaagggtttatgatcgtacaacaaatgctacaggtggagttggactgcaaataaaccttggaaacgaaggcaaatacacttttgctatttgcttccttggagatgataattataccggttcctttgaagttgctctcattacagtaagcaagcacagtcctaagctcactgcacctgcaaaatcatttaaagcaagtgctaagacaaaatccttgactgctacattcaaatccagcaatggcaatccaatcagtggcaaaaagctaagttttactgtaaatggaaaaacatatactggaacaacaaacgcaaaaggagttgccactgtaaagatctctttaaataaaaaaggaacatatagttgtactgttaaatatgcaggagatacaatgtataaggcaacaactacaaagttcaatgtaaaaatagtttag

SEQ ID NO: 1553 - DNA, 939 bp, Methanobrevibacter ruminantium
atgttaagtatttcaacaattaagacatatatgttttgtcctttgaaactctattttcaaagtgaaatagatgaaatctatgacgaagaagagtattttgttccaaagaccttgaaagatctaagaattgacattcaagaccttttacacaagaacctaagacttgtaaaaaaggatatggaattaaaagaaatcgaagagacattgtcaaaaggagttttcaatcaaattgaaactaccttcgagataattgaagagctaaacgaaactaaaaaagaaaaagaaagaagagaaaagtcttcaatctataaggattcaaatatagaatttttagacgaagacagacagattctcaatgcatcccttgaagataatgatggaactcttgaagacttggataatgaagaagatgaaatcaagaagctgaaagatgaaatcatcgatgaagtaaacttaaatctaaaaatcctctcattgaaagcttcacaagctatgaagaaccttgaaaaggatggaaacgaaattcagaatttattcttccaaagttccatgtacaacactctaattagggatttgggaatagatttgattggagtcatagacaaaatcgaagtggaaaagggaaaatatttcccaattttattaaaaacttcaaatcctccatcaaaaggagtttggcagtcagatgaaatagagctaattgcaaatgcattgctggttgaaggagaattcaatacatacattactgtaggattcgtagaatatttaaaaataggcgaacgcagacctatagtcattgacacctttgcaaggaaaaagttctttaagcttttaaccaaaattaacaaaattgttgaagacggagagattcctcatgtgaaaacaagtgttaaaaagtgcagaaactgtgaatacagagagttgtgtgaaaaggcttaa

SEQ ID NO: 1554 - DNA, 660 bp, Methanobrevibacter ruminantium
atgagtagtatttcattaacaattacaactaaagaagagaaaggagttttagatgagataactgatgttctcaccagtcatggagtcaacatatcctatgttcatctttatgtcaaggaggatgtaggaactttaaatcttgaacttgaaaatatcaatgagcttgatgaacttataagggatttaaaatctaaggatttcattttggatatagaaattcatggctcattaaatgatattttcggtaaaagggttcttatctttggtggcggtgcacaggtttcccaagtagctgtaggtgctattacagaagctgataggcataatatacgtggagagcgcattagtgtagacactattcctttagttggcgaagcaaatattacagaagctgttgaagctgttagtcgtttgcctagggtaggcgtattggttcttgcaggttctctaatggggggtaagattaccgaagctgttagaaagataaaagaagaacatgaagatattattataataactttaaatatgcctggcagtgttacaaaagaagcggatttgattgttacagatcctattcaagcaggtgtaatggctgttatggcagttgctagtactgcagttttcgatgtaaaacgtttaaaaggaaataataaattctag

SEQ ID NO: 1555 - DNA, 264 bp, Methanobrevibacter ruminantium
atgaaatttgttataaggccttatcatatgatgagtcttggaggatatattgtagaatatgattttccatatagggacatcattattgtaaacaagacctctgagcacattaaattcgagattccggtatttgatgagtcttggattgaagaaaccagagcattaggtcttgaagttattcctgttcgaaaggaagacagttatttaaatatgtatagaaaagctcatgctgatttagatgcttttaaggcaaaactagattaa

SEQ ID NO: 1556 - DNA, 1176 bp, Methanobrevibacter ruminantium
atggaagaaaagaaagctaaaaagcaggagattatagaaacagagattcaaatgggtactgttcaccctgctgctttagaaccttatagggttagatttttcgtagaagacgaaatcataaaagatgctgaaatcactattggagttaaccataggggaattgagcgtgtcatggaaggtctccctgtagaaaaggctaatatgcttactgaaaagatatgtggaatctgttccaattcacatacatggaattcagtgcgaactgctgagaagggtcttggagttgaagttccagatagagcagtttatataagagtgattgtaggtgaactggaacgtttgcatagtcatttattgtatttaggtcatggttgtgaaacattggctcatgaaaccttctctatgagagtgttttacattagagaaaccattatggatcttttggcaatgattggcggaaaccgtgttcaatatggctgttcaattattggtggcgtaaggccaagatgtgaattggatgacaatagaatccaaagaatattggacggcatggaccttgtggaaaagaacgttctagactttgcaaataggtttgtaaaggacagcgttgtagcatcaaggatttctggaacaggatatattccacaggaacaggctcttaaactagcggtaagcggccctactttacgtgctacaggtgttaaaagagatttaagaacagatatgtatgaatatgataactttgattatgatataatcacccaagatacctgtgatgtacaggcacagcttcttatgagagtgtttgagatatttgaagcaataaaaatcgttcgtcaggccatcagggatttgcctgaaggcaaaatcacagacaggtcttgggaaatgattgatacagaccttattgaaagctatatagaggttccaagaggaacattgtatcactcctatgccattgaggacggaagggttcgccattgcattataagaactccttcaatgagtaatattggagcaatgcagtatgcttgtattgacaatcatataactgacggtcagttatgtatcgttcagtgcgatccatgtttcacttgctctgatagggcaatagaggtttatgatacaaattataataaattagacaagtctatattgaagtctaatattcattaa

SEQ ID NO: 1557 - DNA, 447 bp, Methanobrevibacter ruminantium
atgagtcttaaaacactttcaagatcaaaagccattcatatcatgttagtttatacaggaggatgcaatggttgtgatattgaaatcgtaaatgctgttttatctcctaaatttgatatggaacaatatggtgtattcttaacttggaatccacgtgaagcagatattctagtcgttacaggtcctgtaacctatgacaacagaaagccattggaagacatctacaatgcaattccaaatccaaagcttgttgttgcagcaggttcctgcgcattgatgggtggtgtctataagaactgtcatggagacattccttctgaagagattgaaggaccagttgagaatgttattccagtggatgctaaggttccaggttgtgctgtaagacctcaagatgttttagcaggtgtagttgcagccttgccacatttattaaatgcggattaa

SEQ ID NO: 1558 - DNA, 669 bp, Methanobrevibacter ruminantium
atgaaagatgtaataaaaattatgcttaatggaacttatacaaattttaaaagaatcctctttgcatctgacagggtaactgatatggaactccgtaatgctatccttactggaacagttgaacctgataagaaggttgatgagcaggcttgcattggctgtggaggttgtgccaatgtctgtccgactggcgcagttacaatgaagcctttgcagactcctgtaaagattaaggaaggttgggtaaagacagaagttccagagctagatccttttaaatgtgttgtatgctattggtgtcatgatttctgtccgatatattcattctttgaagaggcaggaaccattcaccctggaaatgtaggtgagataaatatagacacagctgaactgcttagcgaacctattaagatctctcaagaaaagatatcattcattgcccaatatctctctgacaagtcattgttgtctgaaaacatcgtatcagatgcagatgagattgagaatgtgggagcaggcttagaaagagtttccaagataaaggacatacaggataatattaatgagaagtatgaaaaggatgctaaaagaagttctgctttagctgatgattcaaacgagagttctagcgaatcagatgaaagttctaaaaatgagggaggtgaataa

SEQ ID NO: 1559 - DNA, 1461 bp, Methanobrevibacter ruminantium
atgtatttaacaactaataagtgtgatggacaaggagattgtataagaaattgtcctactgaagcaatacgctttgtagataataaagcctttagctgtatgtgttgtggtgcttgcttcgaagcttgtccgaatcatgccatatttaaaaataaatacggaggatatgttgtagatagggcaaaatgtaatggctgtggtgtttgtcaattcacatgtcctatagaaagcattcatattgataacggaatcgttaaaggaatctgttcacgttgtggagtttgtgaagacgtctgcagtagaaatgcaaggacagatactgataatctggttcttgacaagcaaaaagtcttgcttaactccatgaagatggttgcaaacactgtcggatatcgtgcaggggtaaagaagattgaaaatatgaagcttcctgtaaagtctgataagtctgcagatagggtttgcgtaagcacagacatggaaaaatgtgtgaaatgtggtagatgcgcatattactgcccgacccgtgccatagaggtcataattcaagatgagggattctgtgttggatgcaagatatgtgaagacctttgtccaactggcgccttaaaggatggccaatatgataaaaacctctgtacattatgtttggcttgtgttgaaaactgcataaatgatgcattaaaggttaaggactttaagattgttcgaaacataaaagacagctctatggacaatcctttatgttcaaacactaaaggaaccattgtcagttgcctcaattgcggcttatgtagggaaaagttcgacagtcctgcattgattaaaaaggaaaatgctttaagatatgacccttcacaagataaggacagtgaagagaataatgagaaacgtcttgaagcgatttacaactgtcctgtttcaacattaagcgaaaatgaggataataagctcttcggatactgtgtatcctgcggcaaatgtacccaagtatgtaatgaacaagccagaagcttccaaaccatctcttgggatggggaagtcagtgacgattgtatttcctgtggaatctgtgctgagctatgtccaaaagaggcaatcagccttaaaagaggaacaatcaatgttgatttagataagtgtattatgtgtgagacctgtggaattcactgtccaactgatgcaatacctaagacaactagcacaaaatataagatttccggcggattcaattacattgacgagaacttatgtgtaaaatgcggcttatgtaaggacatttgtggcgaagaggctatctatacagttgacatatcaaatgaagatgtaaatcttggaactaagaataaaaatctgagatttgttgtagatgatgataagtgtatttattgtggggcttgcatgaatatctgcccatctaaatcatttattttcgaaagagagtttaatagggtgaattag

SEQ ID NO: 1560 - DNA, 396 bp, Methanobrevibacter ruminantium
atgtctgataaaacaagcattagatctatattgatggtagttgcaacaataatctttgcatccagcttattcgacgccctttatggatttaaaaacttaattcagccgggaataagtttggtttatactgctattgggactcagcttgctccaaacatggttacattagttgtatttgattggagaggattcgatactttaggagaatcattgatcttagttactgcagtgcttgtcgtattgcttatctttggaaaaggtaagattttggataagaatgtaaatgcagataatgggactgcagattctaatttaacccatgaagcagatttagaaattggcgattctgatttagaacttgatggtgctgatttaaatgaaggagatgatgaataa

SEQ ID NO: 1561 - DNA, 336 bp, Methanobrevibacter ruminantium
atgactttgtatcaaaaattcttagactcagtaaaggagttaaaatcaagtttctctaaagatcctactactatgaacaatgtttcaggagcaatggcagcagaattcttaatattggttggtctaatacttgctgctttgttctttagacatatcaatattgctgcatgcatagttgtagttattctagctgcaatattgttctttacaaacatgcctcttgcaagcaagataaagtcagaacaatccgattcattggaaaaaatgttattttatgtactcattgttcttggaatccttatttctgtaatttactgggggttgaaatatgtctga

SEQ ID NO: 1562 - DNA, 1482 bp, Methanobrevibacter ruminantium
atgaattacttgattccattaatggtcgttattccaatattggctgctttaattgttaacatattaggcggaaaggacaagacagtgaaggctttctccattattgtaggacttgcaattcctataattgcaattcttgccgccattggggttcaatacttcggaggccacgatccaggtcttcttgcaaattcattgccttctaatctagttggaacccttgttgcaagctataatacaggtatcgtttatatttttgacaatatagaaagaatattcatattcctaatgggtatcgtcgcattcctttcaatatttacctactttacagagaagaaggaagtctcagggccttacctttaccttatctttatgggccttgcctctgtaattgcattgcttctatctaacgatatcttcaatatgtatgtattctttgagataaccgctttgactcaagtgggtattattgtagcctcaagcacagaggacaattatgaaatcgcattgaaatacctgattttaggttcaatcggcggaccgatgcttttattaggtgttggatttgttcttggaacaataggttcagtgaatattacagacattatatatgcaatcagcaataactttgtagatccttactctccaggacttgtaatcggatttgccttaatattgttcggatggctatattcagcaggattgccaccgttccacactataaaatcagcggtatacagtaaggcaagacctaacggttcagcaatacttcaaggattttcagtattgtgcatgcttgcatttggaattgctatgtataagatatttgcttatattccaggattcaatacagccataattgtatttgccattcttgcaatggttttaagcattgcaatgtctgcaatggaggtagactttagaagaatgatagcatttttagctgtaggtgaattaggatttatcgctttaggttttggtattggaactcaaatgtccattgcagctgcattgttccaggcagcaaatgaaatagtcattactgcaatgctatttattggattcggttcaatctattatcttacaaatacttcagatacccgcaagctaggaggattgattggagttgactcacttatgggagttatgattttgcttggcggatgcgcattggcaggtgttccaccattcaatggatttgtaagcaagctgatgcttgttcaggccgctttagaggcaggatatacagagcttgcaatccttgcagttattgtaagtgtggttatcttctttacatttgtcaaggcattccatagcgtattcctagagcctaagccaaaggacttgaagtttgtaaatgagaagattccaagggtcacagtattttcagtggctgttttgcttataatctgtttggctttaggtcttttcccgaatattgtcactgatgtatttattccatttgcaggaggattgatctaa

SEQ ID NO: 1563 - DNA, 747 bp, Methanobrevibacter ruminantium
atgactcaagaaaagaataatttagatttagatcatatttcttatgagaccggaggtttcatctctgctaataagaacatattaaataatttaaatcttacaaaaaacactaaatatatattaaaagagtcaataaaaggaactcctataatcaaacttggaactaactatcccaaggtcatgatggttgcaggaattcatggaaatgaattggctcctcagatttctgcattgaatcttatcgaccagattcatgacttggaccttttaggaactgtttatattgttccatttgcttgtccaaaggcatctatgcttaattccagatactttgacggtaaggacttaaacaggacatctcatatcgaggggtccgttggggaccttattttaaaaaaggcagttgagcttgaagtttcagccattggagactttcattcatcagccccaaattcaaatccaggtaaggaaggggtattttgcactgaagttcctactatggcaagctttagattggctgatttcatttcaaaggtgacaggctctgaaaagatagtctattcctctgctggaattccgtttaagggggctttggaggatgaagccaacctaaagggcatacctgctgtaacctgtgaggtcttatctgcaattggctatgcaaatgaaaggatttgctataggtccataattcaaatgaaggcatttttgcaatactttggattctttgataggtatatggaatag

SEQ ID NO: 1564 - DNA, 1176 bp, Methanobrevibacter ruminantium
atggaaaaagttgttcttgcattcagtggtggattagacaccaccgtatgtgtaaaattattagaagaggaatacaattacgaagtagtaactgcttgtgttgatgtaggtcaaccgcaagaggaattggaaaagtcacaaaattctgcagacaatataaatgcaggaaaacactatatcattgatgcaaaagatgaatttgcagaagaatatattgcaagaggaatcaaggcaaatgcagaatatgaaggctatccattaagcacagctcttgcaagacctttaattgcaatgaaaatcattgaagttgctgaaaaagaaggggcaactgcaattgcacacggatgtacaggtaaaggaaatgaccaattcagatttgaagcaatcatcagatccatgtctgactttaaggtcattgctcctattagagaaatgaaccttacaagaactgaagagcaagcttatgcaaaggaacatggacttaacctatcctatgataaaatctacagtattgatgaaaacctttggggaagagccattgaaggggatgttcttgaagaccctgccaatgagccacctgaagagatttatgaatggaccaagtctgctgaagatgcaaaggacactcctaccaaagttgctattgaatttgaagaaggagtccctattgcaattgacggagaaataatgggtcttgtagacctaatcaataaggctaatgagattgcaggtgaaaatggagtaggaagagttgacatcattgaaaacagaatgatcggtcttaaaagccgtgaaacctatgaagtacctggagctaaattattgattgcagctcaccaagctttagagcaattggtcttaaccactgacgagctaagattcgcacagtacatgagcggattatatgcagaccttgtctactcagcgctatggcaagaacctttaagagaagacatcgatcaagcaattgaccatatgcaaagaagagttagtggtaaagttgtaatgaagttatttaaaggctccattcaaccattaagcagagaatcacctttcagcttacacagcattgaacagataacctttgaagataaggaaactgaacagagtgaagttgaaggaatgattaaataccacggacttcaagctgcaaattaccaaaaattaaatagataa

SEQ ID NO: 1565 - DNA, 663 bp, Methanobrevibacter ruminantium
gtgccaaatacaggtagatgcaaggagcttttagttgaagatgcagttgtataccttcgacctagtgacaaccctaatagaaagactaaatattctctttattatgttgaaaacaatggtgctttagttgctatgttctctcaggaagccaataaaatcgtttttgatgcaattaataagaataaagttaaagaactttccaattattcaatcatagagtctgaaaagactattggtagttctagaatagatatttatttagcaaaccataagagcaattttaaggataatgctgattccaaatctattggagaagattctaaagaagatattatagatgaaacttatgttgaggttaaatcagttactctcataaaggatggtgttgctcaatttcctgatgctcctacagataggggtcgaaagcacttggaagaattgatttctcttaaaaaagaaggaatacgtgctgtagtgttctttttagttgaacatcctaatggaaacagtttcagaccaaattgggaaaatgatcctaagtttagtgaaaccttggtgaaggcatatgatgagggtgtagagattcttgtctataaaactagaaatgattttgagggtattgaacttgttggggactgtttagattttaatttaaataaatag

SEQ ID NO: 1566 - DNA, 1569 bp, Methanobrevibacter ruminantium
atggatccaattgatatgatggctacagattataattgtgaatatttaggcctttcaaggctttgcttgatggagaatgcaggtaaatcaatatctgatgaaatcgctattctttctacttataaatactcaagaccagttaagatagtgatttttacaggctctggcggaaatggtggagatggctttgtagcagcaaggcatcttttaaacaggggctttgaagtggatgtctatgccttaaacactgcagaccaaatcaagtctggtgatgcattggataaccttaagattttaatgaaccttgaaccgagggtctcaaggctatctgtccaattcattaaggattctgctgatttggataaaatcaagcttgacaataattccccttgcattgttctagactgcttgcttggaactggcatcaagggaaagcttagggaaaaggttagaaagacagtagaacttatcaatgcaataaatggcttaagggtggctatcgatgttccttcaggtttggatccattaactggagagatagcagacattgccgttgatgctgattataccgtttgcttccataaggtcaagactggagttaagcttgccggtgaagggaaggttggaggcataataacctgtgatattggaatccctattgaagctgaactatttgttgaaggaggagatcttcttagattaaataataggccctcctcatctcacaaaggaaacaatggtaagatcttgattgttggaggaagccttgattattacggggctcctgcaatatctgctaaggcctcaattgcaacaggagcagatttggtttatatttacactccaaaatctgcagcacttccaattaaatcattctctgaagactttattgtaaaggaagctaaaggagattatctctctattgatgatttagatgatattctagaaatggcttccaaggtagatgcagtgctaataggtccaggttctgctcaaaatgaggatacaatgaaattattcaatgttttggctatgaaaatcgataagcctttggttttagatgctgatgctctaaaattggttgatttttctttaatcaataaaaaggaagatattatcataactccacattattcagagttcaaatccttctttaagaaccagattccaagagatattgaaaggaatttggataatattgtaaatttgaatgatgatagtgattttgttaaggtgaatgataagattgatgctttgcagagcataacagcttcctttgatggatcagttattctaaagggacagtatgattttattttcaacaagaataagttaaaaatcaatagaactggaaatcctggcatgactgttggaggaactggggatgcattggcgggaattgctgtaagtctgctctcacagggattggacagttggacttctgccatattggctccttatttaaacggaaaagcaggagatttggctatggacgctcaaggatatggatttggagcacaagacctgactcaatatttgggagcggttatggctaatttgattgattaa

SEQ ID NO: 1567 - DNA, 567 bp, Methanobrevibacter ruminantium
atgaaagaatacttaagcgaaacaaaaagcatagattatatgaatccgatcatccaagaaaaggttaaagaactaaaggagcaatcctctgacgatgcagattatataaaaagagcattcctctttgtaagagatgaaattccacattcatgggacatacagacaaatacagtctcaaggacagctagtgatgtattgaaaaacaagacaggaatatgctggacaaagtcttgccttcttgcggctcttcttagggcaaatgaaattccctctggaattagctatcagctactgacaattggagaagacgacagctttggccatatgattcatgctctaaacactgtttatatggatgatttggataaatggattagaatggatgctcgtgaaaatgtaggagatgatgatgaggaatttagtttggataaggactatttagccttctcaccaagagaagaattcggagaagtagattatcaggataataatcctgatttggatgaaaaattgattaatctcttggaaaaaactgaaaatcttttggaaatggaattggatttttag

SEQ ID NO: 1568 - DNA, 1491 bp, Methanobrevibacter ruminantium
atgaaaaggaaatatattactaaagcagatttgttcatcgtactccactatcttggatacataatgcaaggattaggagttgtattaatagtcccaaccttagttgcattaatatacggagagtacgaccctattgctccttttatgattccttgttttgtatcatttgtcttaggaactgcttttagtaaaaaattcaaagactataccaagcttaggcttaagcatggtatgctaatatcatcctttgcatggctatgggcctcccttatcggagcctcaatcatggtcctttcattaggcatcccatttgtcgatgccatctttgaaaacatgtccgcatggaccggaagcggaatgactttttttgtaaacgttgaagtattgcctaaatccatcctattcttaagaagcctagaacaatggctaggtggattaggaattgtaattatctttatcggaattctaattcgagcaggtactgcagcatccagattatataaatcagaagctagagaagagaaaatcaagccaaacattacaaacaccttaagaaaagctctagaaatctatttaatctatacagcagtgggaatatttcttttcatcttggcagggcttcctatctttgatgccataaacatcacattcacaagcatctcaactggaggaatgtccattaagaatgcaaatgtgggattctaccaagacagcatagtctacctaatcagcatgtttctaatgattttaggtgcaacaagctttacaatacattataagattgtaaagacaaaaggaaaagcactttttaaagatgttcaattccaattattgattaccttaatcatagttgctggtgcattctttatagcgacaaataagatggtccctatagaagaactctttaccatagtttcagcagtgacaaccacaggggcaaatgtggttgatccccatgtgcttgcaacatggaacgggtccacattgattgttctgatggtcttgatgcttattggaggttcatcaggatctacaggaggtggattgaagctcattaggattattacagtgcttaaaggaatgaacttgactgtaactaacctagtttcacctgaaggaagagtggtaaataccagaataggtggaaaaaagataaatgaaagggaaatcaaggaagcatctgcatatatcgtgactttccttatgtttttagttttcggatggataattatgacaatgtatggatatgacccattcactgcattgtttgacgtgatttccattcaaagcaataatggtttaagtacaggaatcgtgtatggaggattgccattgcctcttaagctaacattgatattcctaatgtggataggcagattagaaatcatacctgttttagtattatttagaacattttatggtttagtcaaccctaaacgaaggattaagcaaatgaaaaaaacaaatggaaatgataaaaaaacaaactaa

SEQ ID NO: 1569 - DNA, 675 bp, Methanobrevibacter ruminantium
atgtatattgtgattatgggtggaggtcgtgtagggctatcccttgctgaccgtttgattattcatggatatgatgtaacaattattgaaaataatgacgaattatgtgatcacgcatccgaagagttagatgcaatgattatctgtggaaatggaactgatacaaaaactttagaagaggcgaacattgaagaagctgatgtttttgtagcaactacaggtaacgacgaatcaaacttattatcttgcattcttgttaaggaatataccaatggaaagatcattgcaagagtaagcaatcctgaccacgaagaggcatttaaaaaggttggaatcgataaggtaatcagtcctgagagaactgctgcaggattccttgaaaaagtcattacaagaccaaatgtggctgacttaatggcattcggtgcaggaaacgctgaaatattggatatgaccattcaaaatccaaaggtattcggaaaaaaggtttcagagttttctccaactaaggattatataataatttcaaaaaacaatgacaatcatgaattggaaatccctcagccagatgatatattaagcaatggagacaaaatttccattcttgtaaaaagaaatgcctttgaaaaagcagaaaagaaattcatgggtgcaggaggactattcggattttaa

SEQ ID NO: 1570 - DNA, 648 bp, Methanobrevibacter ruminantium
atggagaaaatcaaaaatgtctattgtatagaaggactgatggcagattctaattcttatttgattgataataatgatggtgatggggattataattatatactggttgatacaggaactggacaatctaatgcattcttattttcacaattaggtgaaattggagtcaaaccagaagatattgacttgattgtaaacacccattgtcattttgatcatgttggtggaaatgactttttcccaaatgcaaaaatagcaattcataaaaaggatgctgtggcattaagggacccagatagcgaattgacagtctcttctctctttggtgcaattgttagaaaacatgatgttgacattgaacttgaagagggagataagatagctaatttcgatgtcattttgactccaggacacacttctggaggaatatccctttgggatggagaaattctcatttgcggagataccatatttgcaaacggtggtgttggccgtatggacattggtggtagcccaattgatatgaaggactctttaatgcgtttgaaggaatttgatgttgaatacttgcttccagggcatggtccttgggtaaaaaatggtaaagagcatgtaaaaatgtcttgtttaaatatgggaataagataa

SEQ ID NO: 1571 - DNA, 339 bp, Methanobrevibacter ruminantium
atgcgggctccagcatctggaggagcaactaaaaaaccattgcctgatgttgtagctggaaatggaaagatttacttggcaattgaagtaaaaacaactactaaagataagatttatatcgatcatcctcaaattgatgcattaattgagttttcagatatttttggggcaacaccttacttgggtatgaaattcaagtataccaaatggcttttcttagcacctgaaaatatccttaagaccaaaaatgggaactataaaatagaaaaggattattgtttagaaaaagctttagaacttgatgaaatctgtggatttgatacacaggttaaattttaa

SEQ ID NO: 1572 - DNA, 1032 bp, Methanobrevibacter ruminantium
atgaactttttaaatgaaaaccattatcgtgatagcatgaatgaaatagacagcatagaaactctcgaactaatcaataaagctaacagccttagcctaaagaaaggatatacagaaataagtcttgaaagagctgtttttctatcatggtggtgcgataagggagattgcaaattctgctatatgagcacccagaaagataaaatcaaagatcctaaaaaggccagaagaagagtaaacaacatattggctgaagctgaaatgtgcagtcgcctcggttggaatatagaatttctctcaggaggatacaaatcattcaccacaagcgaaatcaaatccattgctgaaaacatccattcaataacaggggatggggtttggctaaacaccggaatcacagatgagcttgaagagtatggaaaggaaatcaaaggaatcaccggagccgtcgaagctgcaaatcctgaatttcaaagggaagtctgtccaagcaagccattgaatcaaatcagcaatatgctggataaagcaggagacctaggatttaaaaaggcaattacaatcatattaggtcttggagaaagccttgaagatgttgaatatctaaaagactatattaaagagcataagatagacagagtaatcttttattccctaaatcctcatccagagacaatctatgtaaacagttcccagccagcatctctctattatgcaaatgtggtatcaagcattcgccttgcatttccagacattgaaatcatatgcggaacatggattgacaatctggcaaacattggaatactcatcttaagcggagccaatggaataaccaaattcccattatttaagatgtttggcacaaaatatggaaaaagagttgaggaagaggtcaaatggactggaagaacattaaaaggaacctttacagataaagataagttaggtcctgaaaaaagccagataaatccggaatttgaccaatatataaaaagatacattaaagagtctttaaagaacaaataccaataa

SEQ ID NO: 1573 - DNA, 1356 bp, Methanobrevibacter ruminantium
atgatgtgtggacttgaaattcacgtacaacttgaaactgactcaaaattattctgtaactgccctacaaactatcaggaagcacctgcaaacacaaacgtttgtccggtctgcctaaaccagccaggggcaaagccatttccaaccaatgaaaaggcaattgaaaacgcattaatgatttcattaatgctaaactgtaaaatcgataagaactttacctatttcatgagaaaacactacgattatcctgatttgccttgcggatatcagaaaacctctgtgcctataggatatgaaggagaattgaatggcgtaagaatcagagaaattcacatggaagaagatccaggacaatacaaacctgacagaggtattgtagactttaaccgttcaggaattcctcttatcgaaatcgttaccgaacctgacatgcactctccagaagaagctcgtaacttcttaaaagaacttatcagagtattgcaatacagtggaggagcacgtggagaaggtactatgagagctgatgtaaacgtttccatcaacggcggaaacagggttgaaatgaaaaacatcaactccatcaaaggggcttacaaagcattgaactttgaagtcatcagacaaaagaaccttatgaaaagaggagtggaagtcaagcaggaaaccagagcataccttgaatcacaaatgattaccgtatcaatgaggatgaaagaggatgcagatgactacagattcattccagaccctgacttgccacctatgaaaataagcgacgagcaaatcgacaaggttcttgacatcatgcctgaagctccgcacaataaggtaaaaagatttgtaacagactatggcattgatgaggaatcagcaaaagtccttacctccgaacttgacttagcgcaatgctatgaagaagttgctaaggaagtagacccagtatttgctgcaaaatggatgagagacgaacttaaaagagttcttacatacaacaaacttgactttgcagacagtggaatcctagcagatgacttgattgaattattcaacatgttacaaaacaaggaaatcactaccaaagcaggtcaaagagtcattgaacaaatgccaaacagcaaacaaacccctagagaaattgcagaggaaatgggattgattggtgttgtaaaagatgatgaagttttagcagctgccaaacaagccttagaggaaaaccctaaagcagttgacgattaccacaacggtgaaaaggcttcattaaacttcttgatgggtcaagtcatgagattaaccaaaggtaaggcagaccctagagaaactgttaaaatcttaagagacttacttgaagaataa

SEQ ID NO: 1574 - DNA, 852 bp, Methanobrevibacter ruminantium
atggagggaaaaactatggagcaagaaaaagccgctgtaagagattacatgaccaaaaatgtaattacagtaaggtatgactctctcaacaatgatgttattgcattaatgaaagaaacaaagcacgacggttatcctgttgttgatgaagaaggacatattgttggaataattactgcttacgacctattgctaaaagattgggaaaccgaatatgtcaaaagcataatgtctcaggaagtaattgtagctagagaagacatgcacatcaacgatgcttccagagtaatgtttagacatggaatttcaagacttccagtcgtagataaggaaagacatgtcaaaggaatcatgacaaatacagatatcgtaagatcccatatagaacgttccactccaactaaagtcagtgcatttagagagactatggaaaagctttatgatattaaaaccactttaacaagagaacaagtcccagttgataagataaaacctactcaagacagggtttatgctgatgaacttcaaggaagaacctatgaacttgaaaaaggattggcagagccaaccatagtggtgaaaactggagacagatatattttagtggatggccaccacagagcagtggcaaccgtacaattaggattggataaaatagactcatatgtagtggactttaatcaggacattactttaggaatggaaaaaactgcagaaaagcaaggattaaagacattcaatgacattacaatcattgatgatgatcagcatcctttaattgccttgactgaaaccattaagactgcaaatcagaagcaaaaaatatctgaaataacaaaaaataaaaattag

SEQ ID NO: 1575 - DNA, 288 bp, Methanobrevibacter ruminantium
atggatgaaaaaatccttagagaagtttataatgttttagaaagtcgtagggactctcctattgattcatacacttctaatatcatgaaagacagcgataaaaaagcagaagacaagatattagaaaagatagctgaagaatgcggagaaaccattattgcttctaaaaatgatgaaaatttagtttatgagtctgttgacttaatatttcacacattgctccttttggtttacaaaggagttgaatttgatgaaatcctagaagaatttgatagaagaagaaaataa

SEQ ID NO: 1576 - DNA, 648 bp, Methanobrevibacter ruminantium
gtgtttatattgatttttagagattttgacccagagattcatgatgtctataaggtggctgaactgatctatgatgttgattatagaacatttgttcatgttttcaaatcaaaggaagaaggtgtggaagccattaaaaatagattgacttttgaatttgctgaggatagggaggatgaaaatgaacttttctatctattctttgatgatgaggatacagaagaaaaggaaatcattggaatgttcaatggaggtaaaggagttcagcattccttattcaaggatatcctagaacaatttaaacatctgaagtttagtgaggccttagggctttcaaaagtctcttttatggataattttgtcttggttgatgtaggggatgatgacttttatatttgcgaattggccatctgctccaatcagagaggaaaaggctatggaaccgaggccttggaccagttgattcagcttgcgcgtgacttgaactgtaaaagggtggttttagatgctgactttagaaacgatggggcatttaggctttatagttctaaaggatttaaggtatttaataaaaaatcatttggatttccaggcaaaaaaagaggaatgcgtaatatggaattgattctggataacgctagagaatag

SEQ ID NO: 1577 - DNA, 816 bp, Methanobrevibacter ruminantium
atgatgaaaaagattctaaaacgtttggctgaaggtgagatttcaattgaggagtgtgaaactcttcttagggcggagaatattcgtcaattggatgatatagccaatattgatatttccagaaaggataggacaggttttcctgaggccattttagcggacagcaaagattatgaagatcttttagccattgttaaaggcttctttgatgatgaatttgacctaaaggataatataatcatcacacgattgtccaaggaacgttacggcttattaagtcaggatttgtcttatcttttggataatggcattaaatttgattataaccctagagcaagaattttagttatatataaggataaattagttgattttaatccagaatatggtaagattgggattttaacagctggaacctctgacatacctattgctgaagaggctaaggtcatcgttgagcaagggggatgtgaggtcttaagctcttatgatattggagttgctggaattcatagattgtttcctaaaattgcttatatggttgaagaggacgtttctgcatttattgtctgtgctggaatggagggggcattgccttctgttgtagctggactggttgatgttcctgtaattgcagttccaacttctgtagggtatggcgttggagcagatggaaaggctgctttgtattccatgttgcagtcctgtgctcctggattgtctgttgtcaatattgataatggatttggtgcaggggtttatgctttaacaatagtgaaaaacattgctaagaaggtaaaaatgtctaaggaataa

SEQ ID NO: 1578 - DNA, 2448 bp, Methanobrevibacter ruminantium
gtggagtcaattaaagtattagtagaaggaatcgtacaaggagtgggctttagaccctttgtatatagaatagctaccgagctggaactggtaggatacgttagaaacttaggaaacgtagttgaaataatattacaaggaacagacaatcaattagctgactttatatacaaactccagaacgaacttcctccaatagctaaaataaataatttaagaactgaagatatagaaattgactccccatatactgattttacaatcaaggaaagttcagacagcttttctggaacttctgttatccctcctgaccttgcaatatgcgataagtgcctagaggaaatcaatgacccccaaaacagacgctacaaatatccattcaatgcatgcacagactgcgggcctagatttacagttattgaaaacgttccatatgaccgggacaagaccacaatggatgactttccattatgcgatgaatgtgaaatagaatataaaaatccattggacagacgttatcatgcagaagcaagctgctgtgaagtctgtggaccttcattaaaactaatgaaaaatgaaaccgaagaaggaatctctacagataaagaaggaaatgaaataaaagcaatgaaacgaacagcaatcgatacagaatccaatgacccattaaaagacactgcaaggcttcttgatgaaggaaagatatttgcaatcaaaggaattggaggaacacaccttgttgcaaacgttaaggatgaaaaagctgtaagcacattaagagaaaggttaggcagaaagaaccaagcatttgcagttatgagtccagacattgaaactgtaaggacatttgcaattgtatcagatgaagaagagaaaacattgctttccaaggaaagacctatcgtaattttaaaaaaatcaaaggattacgactttgcagagtctgtatccccaagacttcacaatattggagtgatgctaccttatgctcctttacatcatctgctctttaatgaaacagatagccctgcatacatcatgacatcagctaatgtccctggagagcctatgatgattacaaatgaggaaatccttcaaaaccttgatgaaatagccgattattacctcattcacaacagaagaatcctaaacagatgtgacgactcagttgcaagattcagaaacaacgaacttgctttcataagacgctcaagaggatacacaccagagccttatgacttaaagggaaaatacacagatatcaatccagactttgacaatctgaacattcttgcccttggacctgaattggacgtcacatttacaatattaaagaattcaaaggcatatgtatcccagcatatcggaaatacaaacaaatacagaacctatgaattccttcaagaagctataaagcatatgatgagaattaccaaaacagacagcttcgatgcaatcgcctgtgatttgcacccacaattctttacaacaagattagctaaggaatatgctgaaaaatacgactgcccattgattccagttcagcaccaccacgctcatggaatctccttattgaatgaccattatgatgataatgatttgaatgaaatgattattatcgctgcagatggagttggatatggtgctgatggcaattcttggggtggggaaatcctatacacagacataaaaggatttgaaagaatggcttcccttatgcctcaaaagatgcctggaggagacttatgtaccaaatatcctgcaagaatgatggcatctatcctatcaaaccctgaaagcgactatgagaatgagaaatacacaaaggaatacatagaggaattgcttaacaacaattacttagactcctttaaacatggatctgttgaaataaaaagcctatttagacaaatggaaaccaatcttaatgttggaataaacacaagtactggaagagttcttgattccgtttcaacagcactccatatctgtgatgagcgcagctatgaaggagaagcatccatgaaactagagtcatatgccttcgaatataaaggagaaggctctcttgatgacttcccaataattgttaaagagtatgaagatgaaaatggaaaacggttgattctagatactacagcaattctaagatacatcatagacaaaatagaagaaggagaagacctccacaagattgcagctgcaggccaaaaggcagtaagcattggacttgcaaaacttgccattgaatctgcaaaagaaaaaggaataactacaatcggagcaacaggaggagtcttctataacgaagccattacagattacatcaaaacatacatagaaaaagaaggctttgatttcattcaacacattaactcatgtcctggagacggttctgtctctttaggccaagccattgtagcaggaactaatttgaataatttttaa

SEQ ID NO: 1579 - DNA, 498 bp, Methanobrevibacter ruminantium
atgaaaagaaaagtaattatgatattggcaatattgcttgccgttggaatgacacttactgcagtaagtgcagaggacagttggagttttaacttctccagcgaagaaaactccgacggaggatcaataaactttgaaaatggaaaattgacaatacaaggtattgaatttaccattcctgacggatatgaaatggatgaatcatcaaagaaagtagctgaagacgctgaagattttgatgcaaaatattcagcatgcaaattcactaaaggcgatgatgaaattgttgtaaatgtcttctttacagatggggatttcgaaaaccttagcgcaaataatgccgaccaagtcgaaaaaaccttaaacgacattaaaggtttatacgaagaaaataaatatggcgataatactccaacattcacttatattgaagatggtaaagtcgttaaaataaatgcccctaatgatgaaatcattgaatcagtaatgggaaaataa

SEQ ID NO: 1580 - DNA, 516 bp, Methanobrevibacter ruminantium
atggaaaatgaagggcagaatcaacaaaatctaaatgatgttgatatggaagctattcttgatgttatgggatgtaagactagacgtgacatcatggatctcttaagggaagagccaagatttgttagtgaaatatctcaagagctccaaataggacagaaagctattattgaacatttaagggctatggaagatattggtattttaacttcttcaaccaaaaaggtagtgaggggccgtcctagaaagtattatgacatgcctaatgatgtgaatgtgaatattacaattaccaaaaatacatttaatgtggctatctctcaggatatgttaaatgccaatcacgttcctcaattgccttcaggtgatgaatggtctaagttgttggacattgaaaagagaattgatcaaggtcatactgaggcgattgaagagttgaaaagtcagatacgtttgtatgacaacctaaaagaaagagcagaatacattttagaaaggacttataataagtattag

SEQ ID NO: 1581 - DNA, 693 bp, Methanobrevibacter ruminantium
atggctaataaaaaagaagaagaaaaggaagaagaatctgaagatgctaaaaaaagcactaaagataagatcaagtctaaaatttcaaaatcttcagatgattcctctagtgacaatgaagaatcctctagcgataaagaggaatcttctaaggatgacgaaaaagacaaggaattagctaaattaaatgaagaccttgaaaagaaagatgaagaaataggagaacttaaatcccatatccaacgtcttcaagcagatttcgacaatttcagaaaacagaacgacaagcaaaagcaagacctaatccgctttgcaaacgaaggtcttatcgtaaagttcctggatgtctatgaagatatggaaagggctcttgaaaattcaaagactgaagaagaacttagagaaggtttagaattaatttattctaagatgaaaggcactttagaaaaggaaggagtcgaagaaatccctgcagttggagagaaattcgatccattcaagcacgaagcattgcttactgttgacagtccagatcatgaaaacaacgaaatcgttgatgagctcatgaaaggatacactctcaagggtaaagtgattaaatattctaaagtaagagtttgtaaaaaagcaaaaaaagctgaaataaataaagctgaagaagcaaaagatgatgaggataaaaaagaagaataa

SEQ ID NO: 1582 - DNA, 1896 bp, Methanobrevibacter ruminantium
atggctgatgctaaaaaagaaaaaatcattggaattgacttaggaaccagtaactctgctgcatccgtacttgtcggtggtaaacctaccgttatcccaagtgcagaaggtgcaagccaatacggtaaggcatttccaagttatgtcgcatttactgaagacggacaacaattagtcggtgaacctgcaagaagacaagcagtaaccaaccctgaaaacacaatcagtgcaatcaaaagaaaaatgggtaccgactacaaagtaactatccaaggaaaacaatacactcctcaggaaatctctgcaaagatcttgcaaaaaatcaaaaaagatgcagaatccttcttaggagaacctgtagaaaaagctgtaatcactgtaccagcttactttgacgataaccaaagaactgcaaccaaagacgcaggtaccattgcaggccttgatgtagtaagactcgtaaacgaacctaccgcagcaagccttgcatacggaattgacaaacaggatgacgacgatgacgtaaacatccttgtattcgacttaggtggaggtaccttagacgtaaccatcatggaattcggtggaggagtatttgaagtgcaatccaccagcggtgacacccaactcggtggtaccgacatggacaatgcaatcatgaaatacttggcagatgagttcaaggctgaaaccggaatcgacttaatgaacgatgatcaagcagttcaaagattaagagaagcagctgaaaaagctaaaatcgaattatccacaaccttaaccagtgaagtaaacttgcctttcatcagcatgggtgcagacggcaagccacacaaccttatcaacaacttaaccagagcaaaattagaagagttagtggatcctatagtaaacaaatgtggtcaaccaatcaaacaagcattagacgatgctaaaatgaccaaaaatgacattaacaaaatcatccttgtaggtggacctaccagaatgccagttgtacaaaaattcgtagaaaactacataggcaaacctgtagaaagaggaatcgacccaatggaatgtgtagcaatgggtgcagctatccaaggtggagtactcgctggagaaatcaaagacttagttctcttagacgttaccccattatccttaggtattgaaaccttaggtggagtatccactaccctcattgaaagaaacactacaattccagctaaaaagtctcaaatcttctcaactgcagctgacaaccagccttccgtagatattcacgtagtccaaggtgaaagaaagatggcagcggacaacaccacacttggaagattccaattagtgggaatcccacctgcaccaagaggaatgcctcaaattgaagtaaccttcgacattgacgcaaacggtatcataaacgtaaccgctcaagacaagggaactggaaaagaacaatcaatcacaatcacttcctctacaaaactctcagatgaagagattgaaaaagctgtaaaagaagcagaaatgaatgctgaagcagacaaaaagaaacaagaggaaatcgaagttagaaacaatgcagattcaatgatctacactgcagaaaagaccatcaatgaggaagaaatcaaagacaaagtctcagatgaggaaagaactaacatcgaaagattggtagctgaacttagagaattaatcagcggtgacgacatacctgcaatcaaagataagacagatgaactcactaaagtcgttcaagacatcggtgcaagaatctatcaggaagctgctgcagcccaacaagcagcacaaggtgcagctggaggagcaggccctgacccaagtgcaggaccttcaaacgatgatgatgacggcacaatcgatgctgaattcgaagaaaaagactaa

SEQ ID NO: 1583 - DNA, 1176 bp, Methanobrevibacter ruminantium
gtgagaaaattggcagagaagcgtgactattatgaagttcttggagtagatagaactgctgacgaaaaggaaatcaaaaaagcttaccgtaaattagcaagaaaataccatccggatgtagctgaagaagacaagaaggaagaagctaccgaaaaattcaaagagataagtgaagcttacgcagttttatccgacgaagagaaaagacaaagatatgaccaatttggacatgcaggtatggatggcttctctaatgaagacatatttagaaacgttaactttgaagacatcttccaaggcttcggcggtggcggaggctttgaagacattttcgatattctattcggcggaagcagcagatctcgccattataatgcaggacctcgcagaggcggcgacatctacactgaaacaacaatcactttagaggaagctgcaagcggcgttgaaaaggacatcaaaataagacatgatgtcttatgtcctgaatgtggaggtagcagagcagaacctggatctgaagttgagacatgtcccgtctgtggaggaaccggtcaaagaaagcaaatcagacaaagcctattcggacaagtaatgaatgttgtccagtgtggcgaatgtaagggaaccggtaaaataatcaaggagccatgtcacaactgtaaaggaaaaggaactgtcaaggaagacaagaccatcagcgttaaaatcccagcaggagttgaaacaggcaaccgtttaagagtttcaggagaaggccatgctggagatcttggaggaggaaacggagatctctatgtagagattaatgtaaaaccacataaagatttcgaaagagatggcgcaaacctctactatgaaaagcaaatcagctttgttcaagcaagccttggtgacactgtagacatcccaaccatagatggggcagtggaactcaaaatcccagcaggtacccaaagcggaactgttttcagattaaaggaaaaaggtatgcctcaaatgagaagaagcaccaaaggaaacctttatgttacaataactgtcgtagttcctcaaaagcttaataaagaacagcaaaagcttttaagaaaattcgcacaaataagcggagatgaaatctctgtctataaaaaaggaatttttgataaagtaagggatgctataaacaacccttag

SEQ ID NO: 1584 - DNA, 771 bp, Methanobrevibacter ruminantium
atgaaacttatgatgtatagtataaaaatgcgttcagctaaaggagggcctcatgaagagggtggaaaacacatatcaggtgcagaacgtattttaagagaagatgaaatagaagaagagctaataaatgtctatagaagagctatcacacacgaaaagggaaagccagactttatcaacctcaagatagaagccatagacgaagacaagatactctataagaagaggctaaatataattcagcacaaagtaagctcaaaggaagagggattaaagctagcaaaagaacttcttataaaaaacactgtaagcgaagaggcagctaaagaaggcatatcaagcatacaaaagctcaaggaaagcatccatggagccatgctacttgacaaggacagcggaaaaagaattgatgataaaggaattaaaggagtccgagttacaggaatagccagtgcagacataaagaaatataaagaatcccttaaaagggacggcagggaaggactgcatcttgaagaggcactaatccttgcttcaaagatagcaagctgtaaggcaatagttgccgaactttgctggtcagatgatccaagctatgtgattggatatgttggcacaaaagaaaactatcatcgcatccctatcctaaaagataagggaaatccagtagggggaagggttttctttgttgatacaagccaattaaatgacaattacaccttagaggacttaatagattatctagaaaaacaaatagtcttaatcgaataa

SEQ ID NO: 1585 - DNA, 1245 bp, Methanobrevibacter ruminantium
atgaatccaaatcttgaaatgaaactaaaggaagagttagaagagcttaaaaacaataatctaaatagaaccatagatgacttaagatttataagctctacaaaggccatagataaagatggcaaggaatttctagtatttggaactaacaactatcttggattgactcaccaaccagatgttataaatgcatctaaaaaagccagcacatatggaactggctccacaggttcaagactcacaacaggagcatcatttgaagcaagagagctagaagaaaacctatccaaattcaaatcaaccgaatcaactcttatatttaacaccggatatatggccaatctaggaattatctacacactaacaaaggaagatgacattatattcagtgaccaactaaaccatgcaagcataatagatggaacaagaatatctaaggctaaagtcagagtctataaacataaagacaccaaagatttggaaaacctaattcaaactgaaataaaagaattaaaagaaaaaaacataaactcatccaatttcttcattgtaacagatggagtattcagcatggatggtgacatagcacctcttccagagcttgtagaaatagcaaacaagtacaactgctgccttatcattgatgatgcccatgcaactggagtcattggaaaaacaggcaaaggaacagttgaatattacaaggataaaactggaatagatttaacagaatctgttgatttgcagataggcaccttaagcaaggcccttgcatcagaaggaggatttgtatgtggaaagaagacctacatagactatctcataaacaaatcaagaccattcatattctctacagcactttccccatctacaatagcaagtgccaacgctgcattaaatctattgaagaaaaatagcaatgaatatttaactaaacttcaaaataatacaaaacttatgagaaatctgctaaaagagggcggattgaatgtgattgatggagaaacaccaatcattccaattatcataggccctgcagacttaacaaacaagttttcaaaggaattagaaaaagaaggaatcttagtctctgcaataagaccgccatcagtacctaaaggagaaagcagattaagattaactgttatagccacacatacaaaagaagaaatcacttttacagccaaaaccataataaaaatctggaatgatttaaaaaaaaaactagaatatgaaaatcattaa

SEQ ID NO: 1586 - DNA, 726 bp, Methanobrevibacter ruminantium
atgttttgtggtgagaaaatggatacaattagtatgctatggcaatttggaatattggcagcagttcttgtatttggtatcaagttaggtttggctgttggtttggctaacctctcaaagaagtatctggctactgtctgtattggatatggtgcaggagtactcattcttgctcaaatttcctcctattttgctactgaaattactgagcttatctacacatataactctctgttctttattataatggctgttataatgattctagcaggtatctttacaataagggaatggaaggtctttgaaaagaatactacagctgccacttgtgctgcagtgattgccccttgtccatgctgtttcggttcaattattgtcagtatcttgttagtggctcctacagtcggtttaggtgctgtggatttaagcgtatatgtggcagcagctttggttttaactattatagttacttactttgcttcaagcatattcgttcgatatgttgataagccttatccgattgtacttggaaacttcatgttcttcttgggaatttatttcctcttgtctgcattggtcattccgaacattgcagcaatcatgaataagtcaatgggatcaatcagcatagtttcaatggaaagtttggctggctctatagttgctttagtgcttttagtagttattggcatagtattttcaagaaaaaacaatattctaagctaa

SEQ ID NO: 1587 - DNA, 5418 bp, Methanobrevibacter ruminantium
atgaaaacaaattataaaattattctaatttcaataattcttctcggtttggtcatgtcttttggagctgtctcagcagctgacctaaatacagtccagtccggtgaggtttcaggtggagttgacatagccagctcaaatcctggagtcgaaaatggagaattgacttacgaaattccagatagtgttgaaaacattcagtatgcagggctctttgttgacagctatactgcaggatcctctaatttggtatatggatccgaagcaaatatcactttgacaaaaaacggcgaaagcgaacagatagcaagtgaaagacttgttgcaagtgtgggaagtgcagacggtgaggtatatgtcattaacgaccacacaacaaaatgctttgcagactatatgatgacctataaccttacagacagacttcaggatgcaaagggaaatatcacaatcactgtaaatgccactcctatcgaaggatacacattctataataaaatcaagctgataggccttgtatttacatatgatgatggagatggagaccaattccattattgggtaaatgcaggttcatcttgggtaaagacagatagcggagagacaagcaaggctacatttaagcttggaaacgtgaattacgacccaactgtagccacccttgataactttgccctttcaagccaggatggtgtctataccttcaatggcaaggagatggatgagtccatagtcactgaaacaggggtatactattatatccatcacaagtttgacatattggataagattaagaacatgacaaacacccttgtatacactccaggggaaggctcatactcatttagaaatgttctttcagtggtaaagctggtaaagacagttccagtctatgctaaagtcaacataagctctgaatatgatgacattgtcttttcaggaacagaaaatctgcttaaggtgggcataaccaataatggtacaggctctgcatcctatctcttggatttatatgccgatgggaaaaaggtaaacagttctcaaatctcattagctgcaggaagggaagctgtaatatccttgattgacaatacaattaggccatctgcagcagacactgtaagcggtgcagataataagaagatcaattacactgtagttgttagcgataagaacactggagaggttttagatgaatccagcatcttccctaatctcctctataacggttatttaggcaagggcttggcttatcctgcagaaaagataagttcatttaagaatatcacagttaatggaggcatgatcattgagagtctaggtgattccacttatcttgatgcttcaatgactggcaaaaccgattcttggactattgatctgcctgatggcgctttcttcactgatgcatttgtctatgtgccatataatcttgataatggaaatgttcctatgttcacaagcacattcaatggggcggcagttaatcctatagcttcatatagggatcagccaaatataggagaaaatgctaaaaacggatacggattgcttgtttatgatgttggagagctcattaaggcaggtgtaaatagctttgccttatcaaaggaagcaggtattgctggagtttatccaagcaccctaattgcattttacaatctaacagattcagaccttctaacaagcgcattcatattcaatggggcagacctattatccaatgaatacaattcacttggaagagatgtttcaagcgataatatattatccatcggcgcttttgatggattggtaagtgctaagcttcatgtatttgctgccgattgccaagctggagagggagacttgactgttaatggcaaaagctataagaatgtatgggccggtacaaatagaagtgtcggcgattatgtggttgatttaggaaaatccactaatgcatcaaatgaggtgtcatttatttccacagcctcaaatattctagcccttcagcaattggctgttgttcaatataatgtcccttcagttaaggcaagtcttgtctctgaatattcaaacgctgtatttgcaggtaccaacaatgtcttgtctcttaatataacaaataacggtaaatttgattctatctatactgttgacttctatgtggatggcaaaaagcaaaacagcactgaaatttccctaaaatctggtgctaataagggattatatcttattgatgatacaataaggcctattgatgcaagcacagtaaatggggcagacaatcctaaggtcaattatacagttgtcatcattgacaaggaaaaatcaatggtattagatgagattaccataactcctagcctcttatataatggaaatctaggaaaggacttggcttatccggcagagaatatcacttcatttagaaatataactgtaagcggtggcgtgattgtcgatacattagatgattccacatatattaactctcaagcaacaaacagaacagatatttggaatgtaaatgtggctgatggcgatgtatttacagatgcctttgtttatgttccttacaattgggataagaccaacggatacatgccagtttggaatgcaagattcaatggtgttgcagtttcacctcttgtctcctatagggaccaatcaaatataggattcttcggcaagaacggatatggattggtggtctatgatgtgagcaagcttatcaaatcaggggaaaacactttcactttagaaaaagaagctggaatcactgctgtatatccaagcacccttatggcattctataatgcaactagttccaatagcttaaagaccatttatatctataatggtgcagacctattggcaaatgagaataacttcctaaacaggactgttgcatctgacagtcacttagatatctcctcttttaaggaagtaattagcgctaagctttatgtttttagtgccggtgctcaaaaaggtgaaggaaatattatatttaataataaaacatataaagatgtttggaatggtactgtaaacagtgtagatagtttcatcattgatttaggcaagtctccaagtgtgtccaatgatgtgtcctttgtctctacaggctcaaccattatggcacttcagcagctcattgttcttgactattatgtatcctctgttaaggcaaatgtgtcctctgaatattctggtgctgtatttgcaggtaccgataatgtattaaaagttgacttgaccaatgacggtcagggaggatctgtttatgtgcttgacttctatattgatggcaagattgtaaacagcacagaaattcctcttgatgcaggtaaaagcactgaaatctttttagttgatgataaaataaggcctgttgatgcaagcactgtaaatggtgcaaataatgccaaggtcaattatacaataactgtaactgataaggccagcggacttgttttatatgaggccagtctcaatcctattgtattatataatggaaatctaggaaaggacttggcttatccggcagagaatatcagcttctttgatgccataactgtaaatgggggcgtaatcattgatacattagatgattccacctatcttggagcaaaaaccaccggcagaactgatgtctggaaggttgaaattcctaaagatggaaagatagttgatggatttgtttatgtatcatacaattgggataagaccaatgggtctatgcctatttggaatgtaagtttcaatggagtatcagtttcacctgtggcccactatagagaccagtccaatatgggtacttatggcaaatatggatatggacttgtcgtttatgatgttggggagcttatcaaatcagctgaaaacaagtttaccttagaaaaagagaatggaactactgcagtttacccaagcactcttttagcattctataatcgtacagaatcaaataatagaactaccgtttatatgtacaatggtgcagacttattgtccaatgcaaataacttcttaggtagaaccgttgcaagcaatgccgctttagatttggccttgaatccaaatgatgagattaaaagctcaaggctttatgtttttgctgcaagcggccaatctggagaaggaaagctcattgtcaacaacaagacatttaacaatgtctacaatggcagtgcaaatagtgtggatgcctatattattgatttaggcaagtcccctagcgcatctaataatgtgtcatttatagctacaggctcaaccattcttgctcttcagcaattcgttgtggttgatgctatacaccagtccagtgaagagcttcaaaagatgatcaattcagctagggcaggctctacattgaatttgggaagcaacgtattcaaggatgtctcaaatgtaatcatcaataaggaccttacaataacaggcggaacaatatatgcaagagagggagagaccatcttcgttgtcaccgaccgctctgcaggaggtcctaaggaagtgaatatcactggagtcaagttcgttttagataatgcaaacacaattcttcaagcaagggctgtaaacggctccacaccaacttcaattgatgtggcttcaatcaacatcaaaaagaataatatctcttttgttgatgatgatgtggttccagaatcaataaccgttcttgaccttaagtcccaaaggtcttcaattgccccaactagaaacttgaccataagcggcaataatctaattgcaggtatctgtccattcatgtttgaagtaaccagcttcaatggaaaggactctgtagttgttccagaaggaggcaatatcccagataaaaaagcttctgtaatacattatgaagacatggttacaactgccatcaatacaaatattgaaggaagagtgggcaaatactttgaagtgaaccttacagattccaatggaaatccattgaaggataagaaggtccagataggatttaatggtgttgtatatgataggacaacaaatgccacaggaggagtcaagctccagataaaccttggatacaagggaacatacacctttgcaattgcattccttggtgatgattattataatggcagctttgttgtagctaagattaaggttaacactcaaaagacaaagatttccacttcttctaagacatataaggcaagtgctaagaccaaagccatttctgccacccttaaggatgcaagcagtaatcctataagcggtaagaagcttagtttcactgttaatggaaaaacctatagcgctacaactaattcaaaaggcactgcaactgtgaatgtaagcttaagcaagaagggaacttatagctttactgtaaagtatgctggcgatgatatgtatgctggggccacttcaagcagtaaggtggttataaaatag

SEQ ID NO: 1588 - DNA, 10356 bp, Methanobrevibacter ruminantium
atgaagaatagaaaatttttgatagttagcttaattcttattgttctaatgctggccttaggatctgcttatgccgcagatttaagtccagtgactaatggaactgtttctggaggtgtggatgtggcaactgccaatccatacgcttctcaaacaggaggccaagaaatacaatctggagaattaagctatgatgtcccggaggatgttagtgatgtccagtatgcaggactctttgtaaatgtttatggagggtctgcacagggagactatggtgcccagtccaatgtctcaataacatccaatggtgagacaagtcaaattgcaagcgaaagtttaaattatactgatggcagtggcgacggcactgtctatatagtaaatgaccacatcaccaaggtctattccgactatcagatgatttataatatcactgatagggttcaaggtgcaaccggtcaaataaagatcaatgtaacaaacaccaaacttgaaggatatgctaattttgatggcagaatcaaattaatcggtttggtctttgcttataatgacggaagcaataatagatttgattattgggtggattccggtcaggcttggtcaaatagtgcggattcagttaccaaagctaattttactgtgggaactgtaagtcctttcttaagtgctaacataagaaatattgcactttcaagcactgacggtaattattcattcaataagcaagagttaactggtggggaactcatctctgattccatgttcaaataccataagtgggatgtaactgacctcttaaaaaacaagacaaataatttaacttttaattcaaccaaatcttttaagaatgtactttctgtcttgacagttacaaagaacttagaggaaatatttgtaagtcctgacggtactggaactggtactactgcagatgatcctaccactatggataaggcagctcctgctttggctaataatggtataatccatgtattggatggtacctacacccaatccaaacgttatgacattagggcaaactactcatccattgttgcagtaaatcctggaaatgtaatattcgatggaaacaattctgttgcaaacattagagtatatggtgccaatgtaactttggacggcttgacttttacacatggtaaaggaactggagggggagtttatttcgatagcgatgcgaatggcggccttgtgacaaattgtattttcaaagacattaataataccggagctggaggagctgtttacatatccggttctaaaaatgttatgattgaaaattgtaaattcataaacaccacttccacaggtactggaggaggcgcaatctacattgctggagacaatgccaccgttaaggaatgcagctttgaaaatgctactggaaaggatggtggtgcaatccgtgtaaattctagagattttgcggttgtaagagactctaacttcactggttgtgttgcaactaccggcggagccattagttgggtaggaaaatatggaaatgtaaccaattgtacatttacagacaatcaagctactggttcaagcaatggtggaggagctatctattggcaggaaaactttggattaatcaataactgtacattcataagaaataaggctcaagtttatggaggcgctgttaattgggctgcaggtaaaatcaacggtacaatagtcaacagcatctttaaggaaaattccgctggaagagatggtggcgcatattattccgctgcaggtgcaaatgaaatgctaattatgtactgctcatttgaagacaatgaggcagatgcaaacggaggtgctatgggcttccgtgcagaccaatgctaccttcttgattgtaactttaccagcaaccatgcaaaacagaatggaagtgctgtaatgctctattccaatgtagccaatttccttggtattggaaactgtaattttgtagataactctgcagacgtattgaactattccattgttaacaatgcaggaaaattaaaattatctgaaaataacatcacaaccaatgatcttcgtgatggaatctacacaaacggttcaatattgactgacgtttatttatatctcattgtcaatgaaaccaatgatgctgcatccaatgtagtatatgcagacatcggcgatgaagtgcctattgacgtttaccttgtagatgacaacagcaatctcattaacggcataggcttaagcgtagagatcaatggaaccaacatcactgaatttgatttggatggatacacatataagacaagctacacaccaagtgaaataggtacttattatgtaactggaaactattccaaggctgagcttagcaatatcctaacaggatcaatcgttgtgggagaggaacctgtttctgctatagaaattgcttttagaggcgaatatgtaaataccacttatgcaggtgtggaaaaccttattgcagtttcattgcataacaccggatctttagatggaaactatcttgttgaattttatgtggatggcgagcttgcaggaactgaagaatctaaggtaaatgctggctacacaagcgatattaactttattgatgagaaaataagggatctaaacgaatcaactatattgggacatgacaatctacaggctaattacactgtaattgttaaggataatgaaacccaagaagttataggggaatccagctatttcccatatgtcctatacaacggttatttatctaagaaatacgaatattcagatgaattcataagctcattcagaaatgtcaccttcaatggaggctatttcattaacaccactggaagctactctggaaatagcaaccctggattgactgacatttggactcttcctgctcttggcgaaggggcaagctttgcaggagcttatgtatatgttgcatatacctgggataagacagaaaatggaccatctgactgggcctccagctttaatgatgagtccatccctattgtagctcaatatagggaccaatccaatatgggtacaagcggttcatatggatacggtcttgtggtctatgacgtttcctctttgattaaggaaggacaaaacaaatactcattaactaaaggggacacagctatatatccacgtacccttgtggcattctataatgtgactgaatcaagcactgtaaaaaccatgtacatgtataatggtgctgatttattatattacggtagctataatgttttggaaagacttgttatgacagattctgtattgaacattagtacagagggcaatgtcctcggatctaatttgtatgttttcgctgcaagcgctcaagcaggtgaaggtaacttgcttgtcaacggcgaaaaatatgaggatgtttggaacggtactaccagctctgtagaagagaaagtctttgatttgggagacaatcctcttgcatccaatgaaatctcctttgtatctaccggatctaccattttagcacttcaacaattcgttcttgttgaatatgaagcttactctgctgacgttacaatagcttctgaatataatggagcttgttatgctggtactgaaaatgcattgaaagtcaatgtaacaaatgacggtttggaaaaagccaattatttgattgaattatatgctgacggtgtaagggtcgactatgaacatgttgaaatcgatgttggcgaaagcaatgtcctaaccttaatcgacgacaccatcaggccagtgactgaagacactgtaaatggcgcagacaatcaaaaggtaaattacacagtctatgtaagtgctgctggaagtcttttagctgaaaagacaatcactcctaccatatggtataacggttacttaggcaaggactacgcttatcctaatgagacaatcagctatttcgacaccattacagttaacggtggagttatcattgaaactttaaatgataccacttatatgggcgctacagttcttaacagaactgatgtatgggagcttgatgtcccagatgatgttgaatttgcagatgcatttatctatattggatacaactgggataagaccggtgcaaacatccctgtcttgaacttaacattcaatggagaaactgttgctcctatggaaagctatagggatcaatccaacttaggcagctccggcaaatacggatacggattaatcgtttatgatgtgtctgggcttgttgaagctggagaaaatacattattaatagaaaaagagtttaacaagactgcagtttacccaagcactcttgtagcattctataaccaagaggtccctgatgtcattacaacagtttatatgtatcatggtgctgacttgttatataacagctacaacctattaggaagggacgttgaaagtaacagcgttttagaagttgaattggttgatgaccttgcatctgcagaccttttagtatttgctgcaagcgctcaagcaggtgaaggtaacttgattgtaaataatgaaacatatgagaatgtctggtctggaagcacaaacagcactaatgtatttggtgtcgatatattggacagtctcaagcaatccaatgaagtctcctttgtttcaactggaggaactatcctagcacttcaacaattcattgtcttcgaatacgatgtcacttctgctaaagctaaagtaagcacagaatattcaaattccgcatatgccggaaccgacaatgtattaaaacttgatttaaccaataacggtacagtagacactgtctatcatattgacttatatgctgatggcgacttggtagacagcatagaagctgaaatcgattgcggtgaaaacagtacactatacttgattgatgatacaatcaggccagtgactgaaaacactataaacggaaacaacaacgctaaggtaaactacacagttgtaatcagtgataatgcaaccgatgagatattggatgaaattacaataactcctgttcttgtctataacggttacttaggtaaggactacgcttatcctaatgacacaattcaattcttcgacgctatcacagtaaacggtggagtaatcattgacactttaaatgataccacctatcttggaactaaaacaaccaaccgtaccgatgtatggactgttgatgttccaaatgatgcagaattcgttgaggcctttgtctatcttgcatacaactgggataagaccaatggcacctgccctgtcttcaataccacattcaatggtgaaactgtcactcctatagctcattacagagaccaatcaaaccttggaaccagctctgcaaaatacggctatggattgcttgtctatgatgtttcagagtacatcgctgcaggcgaaaatagctttgagcttctaaaggattatgatgtcactgctgtctatccaagcactcttgtagcattctatgatgttgaagactcacctatattgacaactgcttacatgttcaatggcgctgacttattatacaatgcatataatttcttaggaagacctgttgaaagtaacagcgttttatatattgattcagttgacgatatcgatgaagcaacacttgtagtatttgctgccagcggtcaagctggagaaggtaacttgattgtaaacggtgatgaatacaccaatgtttgggaaggaacaagcaatagtgcagctgcttatatgatcaatctaactgattccatagctgaatccaataatgtgtccttcgtttccactggaggaactatcctagcccttcaacaatttgtcatagtttcagaatacgccccatacgctaaggctgacattatctctgaatataagggcgttgcatttgcaggcacaaacaatgtcttaaaggtcaatgtaacaaacgttgctgaggaagatgctgtcttcaatgtaaccctttatgctgacggcgttgaaataggcagtcaattgattgaagtaggcgcttatggcagtgccattgcaatgtttaccgatgagaagatcagaccggttacagaaaacacagtcaaaggggcagacaatgaaaaagtcaattacactgcagtcgtaagagatgttgacgaccttgttgaggatgctgaagctacaatcactccggatatcctctataacggtaacttaggcaaggacttagcatatcctgctgaggagatcacattctttgactccatcacagtaaacggtggcatttacattgaaatccaaaatgattcaagctaccttgcatctggagctaccaacagaactgacatatggaacattgaagcacctgaagacgctgatttcgtagctggatttgtatatgtggcttacaactgggataagacctctgcaggaatccctgcacttaacatcacattcaatggtgtatctgtcgctcctgttgcacattacagagaccaatccaatatgggaacctatggcaaatatggatacggacttttagtatatgatgtaagcgaccttttagaagcaggggataatgtattcaccttaacaaaagatgctaacatgactgccatctatccaagtgttttggttgcaggctacgaccaagaagtatctgacagcatgaaaaccatttacatgttcaacggcgcagacttattgtccaatgcaaacaacttcttaggaagagttgttgcatctaacagtgttttagacattgaattgcctgatgatgtaattgattgtgcacttggaatatttgcagcaagctctcaaaaaggcgaaggcaatctaatagtaaacggagaaagctttgaagatgtttggaacggatcttccaactcagtccaagcttgcgtatttaacttgacagatgatatcgaagaatccaacacagtatcatttgttgcaaccggaagcactatactagcccttcagcaattcatctttgtggaatacgagcttgtttctgttgacgctaaattaggctctgaatacaataacgttgcatttgctggaaccgacaatgtcttagaatttaacattaccaatgacggaacaattcctaccgcatacaccattgagttctatatcgatggcgaattggcagacactttagaacttgaacttgcaaacggtgaaagcgacagcctataccttgtggacccaaccatcagaccagttgatgaaaccactgtaaacggcgcagacaatgctaaagtcaactacactgttgtaatcacagacaattcaactggagatgtcttagatataatcactatcactccttctgtactctacaacggtaacttaggcaaagacttggcatatcctgctggagaaatcactttcttcgatgtaattacagtaaatggagatatcattgtcataggaatgaatgattccacttatcttggctctaagacaacaggacgtactgacgtatgggacttaaccactaatgaagatattatctttgcagccggatacctttatgttgcatacaactgggataagacccctgctggaatgcctgtatggaacaccacattcaatggcgtaactgtcactcctgttgcacattacagagaccaatccaatatgggaacctacggcaaatatggctacggacttatcgtttacgatgtatctgaccttattgtagctggtgaaaacacattcaccttagaaaaagaaaatggaaccactgcagtatatccaagtacccttgtagcattctataatatgcctgaatccagcacttatgtaactacatacctatacaatggcgcagacttattatccaatgcaaacaacttcttaggaagacttgttgcatctaacagcacattggatatcgattcatttgacaatatagtcggcgctgaccttttagtatttgcagctagcgctcaagctggagaaggtagccttgtcataaatggcgatcttgtagctgacatctggaatggcagcagcaacagcgtagatgcatatgctattgacttaggcaaaaaccctaaggcatctaatgaggtatcatttgttgcaaccggatctaccattctagcattgcaacagttcattgttgttgaatacaatgttccttcagctgaggcaagcctcgttagcgaatattctaatgttgcattcgctggaaccaacaatgtattgcaattcaacttaacaaacaacggcgctcttaacacttcttacattgtcgacttctatattgacggcaagaaggtaaacagcactcaaattgcactcaactctggcgaaagctttggccaatactttatcgatgatacaatcaggccagttgacgcaagcactgtaaacggcgcagccaatgctaaggtaaactacacagtcttagtcagcgataaggataccggacttatattggatgaagtgaccctcactccttctgtattatataacggtaacttaggcaaggacttagcacatcctccagaagaaatcgtcctatttgacacaatcactgtaaacggtgatgtgattatagatacattagatgattctacctatcttggagctaagacaaccggacgtactgatgaatggaacttaaccgttccttcagatgctgatttcgaagtggcatacctttatgttgcatacaactgggataagactgcaagtggaatgcctgaatggaacaccaccttcaatggtgtaaatgtcactcctgttgctcattacagagaccaatccaatatgggaacctatggcaaatatggatacggactttacatttatgatgtatcagacctcattaaggcaggtctaaacacattcaccttaggaaaagaaaacggaactacagcggtatatccaagtactcttgtagcattatataatgttaacgagtcaaatgtacttactaccgtttccttattcaacggtgcagacttattatccaatgcaaacaacttcttaaacagaactgttgcaagcaataatgtcttagaattagatttcactgtatttgatgaaatcctatccagccaactctatgtatttgctgcaagcgctcaagctggagaaggaaaccttattgtaaacaatgaaacattcactaatgtctggaatggaacttctaatagcgtagatgcttatattgttgatttaggaaatgaccctagcttatccaatgatgtatcatttgtagctaccggttctacaatccttgcattagagcaatttgtcgttgtaaaatccaaatatcaaaccagctctgacttgcaaaaactcatcgatgctgctgaacctggatccaccttggatttaggtgacaacgtattccaagatgttgctaatgtagtaatcgataagaacttaaccatcaaaggcggttccataatgggcaaagctggagagaccatctttgtaattccagcaaaatccgctaacggtcctgatgaggtaaacataactggcgttgactttattgtggaagatgcaaatgtaattgttcaagcaactgctgacaatggaagcagcccaacttcaatcgacactccaaacatcagaatcagtgacaacttcattgacatgatagacggaagcgttgtacctgaatcagtaactgtattgaaacttgacagcgaaagaggagtccttgcacctaccggtgaactcaaggtcactgacaacgcaattgcagctggaatcaaaccattcgagtttgatgtaactggcgtatccaacggcagcgacaccaatattccagaaggcggtaacattcctgctaaacaggcttctgtaatccactatcaagatatggaaacaactgctgttaactctaagattgaaggaagagtgggcaaatacttcgaagtcaacttgacagacacaaatggaaacccattagcaaataaatttgtccaaataggtttcaacggtgtagtatataacagaacaacaaacgaaaccggcggagtcaaactccaaatcaacttaggatacaaaggaacttacacctttgctatctcctaccttggagatgactactacaacggtagctttgttgtatctaagatcaaggtaagcacacaaaacaccaagcttactactgctgcaaaaacctataaggcaagcgctaagacaaaaacattaactgcaacactcaagtcaagcgtgtacaacaaaccaatcaacggtaagaaagtaactttcacagtaaacggcaaatcctactcagcaactacaaacgctaaaggtgtagcaactgttaaagtaagcctttcaaccaagaaaacctacagtttcacagccaaattcgctggagacgatatgtacaccaaatcaagtgttacaggtaaggtaactataaaatag

SEQ ID NO: 1589 - DNA, 930 bp, Methanobrevibacter ruminantium
atggtagatgaaattaaatcttatgaagaagctggaaaaattgtatccaaagtcagaagcgatgcatcaaaaatgatagaaaacggacttccaattcttgaccttgtagagtttgtagaaagcgaaatattaaagtcaggggcaggaatagcattcccatgcaatgtttcaataaatgaaataaccgctcactacacctctccagcaggagatacaaacaagatggtaaccggagaccttgtaaagctggacttgggagctgaagtcaatggctacattgcagactctgcagttacaatcatggttccaggagacaacttagaagagctctttgatgaggacactctagaaaagaatcaaagaatcatagatgcctcagcagcagggcttgaagctgcaataagcactgtaagggctggagttaaagtatgtgatgtgggaagagctgtagaagaggcaatagctgaatatggtctcaatccagttagaaaccttacagggcacagtcttgaacattggaatctccatgcaggaatttccgtgcctaactatgacaacaacgatccaaccatacttgaagaaggccaagcagttgcaatcgagccttttgcaacagatggtgaaggaatagttaatgactgtccttatgcttatatcttttcatttatgcaaagcaagcctttcaggatgaaaaacactcaaagaatgcttaatcatattgaaaagaactatagatacttgcctttcagtggacgctggcttacagaaagctttaatgagcgtagagtaaatacaggacttaagcaattaggagatgctatggcgatttatccttatgccgctcttaaagagagaactggagcttgggtgtcccaaaaggaacatactatgattgttgaaagtgatggttgtaaaataaccacactttaa

SEQ ID NO: 1590 - DNA, 4416 bp, Methanobrevibacter ruminantium
atgaaagtatataaaatgattttaatatccttaattttagttatcttaagcatttcttgtgtaagtgctaatgatttaactaatgatgctattcaaggcgatttaagtgatattgattattcttttactattgatgacgatttaagcaattctgataattcattagatgtttctagtgatttaaaagaaaacagttgtcttgatgaaatcgatttggataaggaatctaaccaaaatactacaaaaatattaagttcaaaccaattagactctaatttattggattcaaaccaattagaatctgatcaattgagttcaaaccaattagattctagtttactcaattcaaaccaattaaacttatcaaatacatacacagtctcccaatcaacttattcaaaatactttgataagaatggctatgtgaagacatctgtagtggctccatatgatactatagacctgtcaggcaatataatatctaaaaacttcatatttactattccatgccatataacaagctccaataatgcaaagctcacaaactgtatgattaagtttgaaaacatgactgctgacggccgttcaagtgtctcaaacctatacataagaaacagcgtcgaatggtgtcctggagtctttttagaaggatccacaaatgtggatgtctatggcaatgacatttattgtacaggggctaacggaaaccctgtccgtgtgatatactccaattattcaaacatatttggaaacaagcttgagacatactttacaggctatatgaacctttcatggaaacgtgcaggtatccttcttggagactctcactacaataacatcttttcaaacgatgtaaccataaaggactcaaatcctatctaccttacaacatacggatttgaaaagtccaatcataatacaatatacaataatactgtaagatcatctgcaatcagtgaagatagcggtttatcaaacccttcggcatgggcttatggaatacatctgatgggagattataacattgctctcaataatacgattcataatgtatataggggaatagattctgaaggaagcttcaatatccttgctggaaacataattttcaaccttacaggaggatatttcgaaggaaatgacggaacagaaggtggagactatggaattcacgcatcctatgacaatatcgttgcaaacaatacaatattcaacagcaagcttacaggctctgcaatctatctgatgcctaataatactgcctatggaaatattgtctataatataagcggccataacggccttgaattcaattattatgccgataactgtaaggtatacaataacatcattgacgtgcctgttgaaagcccgatttatgtattcggacgtatgaacaatctgctcattgaaaacaacattctaacaagtgtagattcatcaagcatccttgtaaagaagcaatccaattcaaaataccctaccgatgtcacaataagaaacaatcttatcatgggatattcaaagaccttcaatcaaagcccgattgactatagccaaatcaaaagcgatgcaaacattatctcattcaataattcaattgctgtctataatgacacatactttaattatttcgctgaaataggaaatgtaagggattattcagattggatagacttaaataacaccataaattattcagactcttataattacaatgcattggtctttgtaggaaacttttccagcataacagacaatataacaaaaacagattatataattcctttaaaggatattgtaaatagcagaatctcagatgtctatagaaatgttccttataatgagtataaatcaatgatggaaactttaaatgaaatctatactgatattgtatttaatgggccatctcctgtagatttaagaggagtagattctggaggcaattcctcagattccaatcaaactcctatggatggaaacggcagtatgaatgaatcatctgataatggttcagataattctaccaatagcagtttagacaatctggatgatgaggtaaaggattcctatgagaatttgattgataatatcaattcaactgaaaatgcgtcagatgtttatgtcataaatgacgctaattatgctctttatttcaatgaagacggtagttttagagatgatttccctattgagtttggaaatacacttagatttgctaatcttacaaataaaatgtttaaaatagacattcctttaaagattatttcagatagcgaagactctagtttgctaaattgctttatttccttggaaggtgaaagctctaatactattatttctaatttaaaatttgaattagataatttaagttcaaatatagactttatttctataaaggatggagttagtaatgttttgatttataataatacttttaaattagatattgattcctctgattctttaatagattctcctttatctgatgatgcttccttatctgcaataaggctctacggtagcgattacatttcccgaaatattttcatagaaaacaatattattgacttcaaatctaattttggccaattatatggaatatacttatctaataagatggattatttaaattcaaaaaccaatccaagcggatttattataagaaataatgtcttctcgattgattctaatggattaataaacgcaatctattcagattctgttaaaaatttactattggagaataatttatttaatttaagctcaaatggcaatttagaggattcttcattaatttatggcttagatctagttaaagtagataatttgaccatgataaacaatcaattttcaataaattccacttatttggcttgtggaatcaattcaagcgatagttctggatttaatttatctaataatcaattttcagttgattcagcttatttagcttatggcttgaatttaaaaaatacaaataattttaatttacataataatgatttttatatagattcaggcagtttcgctcatgctttagacttggatgattgcaataacttcaatattgcaaataaccttatcaatgcaagcggagcagatattaaaagaaatctaaatgcttccaatttagctgtattcatccaagatgacttaaatgataatgtcttaaagaacggatatttatacatctctgaactaaatgggtccttaaagggcaatggattatatgaaaatgattttaagtctcctattgtccatactgataattctacacgtgaccttcaaaacttaatagactttgcagttgaaggagatacagttgagctaggaaatatggtatttgctgacttggatacaattaatatttataaaaaccttacaataaatggaggaatatttgtatctggcaattggaggcctttattccacattttgcctaatgatgagttattgaatcactcatcctctgattcatacaattcttatcgttcatttgattatttaaacattcaaaatggagcttattaccttgataatgctgatttactgatattggcagaggcatgcaatggaacagacagtctttcaatccaggttccaagcttaaacatatgtgataatgagttcatgcttttagatgattctacagtggctgaatcaataaatatcttaaagctcctatcatctagagctatattggcgcctacaaatgacatatccattgaaaacaatatattagtcagcggaatgaatccgtttgtatttgaagtaagctctataatgaccggttcagatattgatattgctcatggaccattgaatcctaaaaaagcctctaagataatatttgaagatatggttacaacagccttcgattccaatgtagaaggaaggataggaaaatactttgaagtgacattaaaggatgagaatggaaatgctttatccaataaagcaattcaaataggatttaatggaagaatatataataggaccacagatgagaacggatctgcaagtcttcaaatcaatctggcctataagggaacttatacattcgctatctcatttttaggtgatgaatattataatggctcatttgaagtggctaagataactgttaaaaagcagactcctaagcttgatgtttccaatgtcacttataagtcaagcgctaagtctaaaacatggactgctaaattgactacaagctatggatccttattaaaaaataagaaggtctatatcaccatagatggaaagacttatacaacacgcacaaattctaagggaattgctagtttaaaggtaagtttatccactaaaaagacttataagtttactgttaagtttgagggtgatgatacttataattctcttactaaaactgctaaattgactattaaatag

SEQ ID NO: 1591 - DNA, 885 bp, Methanobrevibacter ruminantium
atgaatgaaaaaaatgagtccgcctttcctatacgatgtgatcccgaggatgaaatatttgttaaatgcatgtctcgaattaaagagtttccccaatatatcacaggatacgatgatatagaaggaccatatgaaagccgctttatctcttcaggatacagaaacttaaatcttgattccgtaaggataagatcagataaaagcagcataaatatagagcatcacagctcaataagccaagaggcaatgagaagaaattacgaatatgctgtaaatgtctttaatgctactggacaagcagtttatccttttatcttttacactggcgacttgcccgttgataaaataacttacatgaaccagttaaattattttcatccccaatggtttatattaaaggaaaaggatggcatgaaaagattaaataatattaaatataaaactgataatgatatagatatgcacatttttgaatttttagattacatttggcttccaaaattcaagttagaaataacaattgaggaatgcatcagggaacttgttaaattgtataacaagctttctgctgacgaatttatcttaaatttcactaaagaatgtcttgcattatgggttggaagatatataaaagaccaagatgaattaaaatacatggctaggtgtttaaatatgtccaaaatagaagaaagaccttttgaagaatcactgagaggagtaatcttcgcaagaaaactagaagaagccgaagaaaaaggtgtggaaaaaaatagaatagattttatcactaaagctttaaaacaaatgagtcctcaagaagtttccgatttgtttgatattcctatagactcaatacttagtgttcaaaatcaatattcaaaataa

SEQ ID NO: 1592 - DNA, 846 bp, Methanobrevibacter ruminantium
atggcattcggtacatataaagacgtagtatcagcaagagctactgataaagcaatccaaaaagtcgcacaagatggtggaatcgtaaccgcattattaacttacgctttagaagaaaacattattgaaggagcaattgttgctggaaacactgaagatccatggaaacctgaacctaccattgcaatgactccagaagaaatcattgcagcagcaggtaccaaatataccttctctccaaacgcaatcagactcaaagaagctgtaagacaatacggtcttgaaaaaataggaactgtaggaactccttgtcaaattatgggacttagaaaaatgcaatcctatccatttgctaccagattcgtagcagataagcttgcattgattataggtattttctgtatggaaaacttcccaagagattccttaaagaccttcattgaaggtaagatgaattcctccttagaaggcgtaaacaagatggatattggaaaaggaaaattctggattactgacgttgaaggcgaatccggacttccattaaaagaaacccacggatatgaacaagctggatgtaacatctgtctcgactatgttgcagaattagctgatgtatctactggatctgtaggttctcctgatggatggtccactgtattcaccagaaccgacagtggtgcagacatctttaccgcagctgtagaagctggagtaatcgaaaccaaaccaatggatgatgtaaaacctggtttagaattactcgaaaaattagctaacggtaagaaagacaaaggtagaaaagaaattgaaagaagagttaacatgggactcccaagtcctttctaa

SEQ ID NO: 1593 - DNA, 960 bp, Methanobrevibacter ruminantium
atgcttgcaagaattaaaaacagcattagaaaatttttaggacttgaagctaaaccggacgcagaagatgatgaagcaaaagctgagactcaagacaaattaaaacaagagattaaaaaggaagttgaagctcaatcaaagccagcagaagaggctaagaaagaggctgacgctaaagctgaagaagaagctcaagctaaaaaagaagcagaatcatctaaagcattaaaagaatcttcaactcaggaggttgaaaaagtggctgacaaaccaaaaataggatatattcacatgagtgggtgtactggagacggtatgtctttaactgaaaattacgacattctctcaaccttactcactgatatggtggacatcgtttacggaacaactttagtagacttatgggaaatgcctgaaatggatttggcattagtcgaagggtctgtctgtttacaagatgaacacagtgtaaaagaacttatggaagtaagagaaaaagcaggattagtttgcgcatttggatcttgtgcaatgactggttgtttcaccagatatgcacgtggtggacaattagcacaacctaaacacgaatcttttgtaccaatttctgacttggtaaaagtagattgtgctattcctggatgcccagcatccccagaaattattgcaaaagtagttgttgcattaatcaacggtgacatggattacttacaacctatgttagacatggcagcatgcaacttagcttgtggctgtgacttacagaccaacgtagtaagtaaggcattatgttgtggttgtggaacttgtgtattagcatgtccaaccagagctcttgaaatggtagaaggtagaccatcacacaataaaaacagatgtattaaatgtggcgcatgtactactcactgtccaagaacctggttccctgctgaacaaattaaaaaggacttaggattatag

SEQ ID NO: 1594 - DNA, 474 bp, Methanobrevibacter ruminantium
atgccttatgatgcaggaagattagttgtaggatgcggaaacgtcttatttaaagatgacggattcggtccaatggttatacatgctttagaagattactttaaggaaaacaatcttgaaatgcctaaagatacccagttcattgatgcgggaaccggagccacacatttcatattttcaatgcctgacgacaattggaagaaggtcattgtagtggatgttgtggaatggaacgcagaacctggaacactaaagatcttcagtccttatgacatgcctaaaggaaagtatgaaaacgctcatacctggcctgtagaggaacctctccacgatttggtggatatgggtatagaagttgtaatcgtcggatgtaaaccaaaagaaatcactgcaccagatgtagatatgggcttaacagagccagtggaggcagcaattcctaaagctattgaaatgatattaaatgaactttaa

SEQ ID NO: 1595 - DNA, 1158 bp, Methanobrevibacter ruminantium
atggaaattgacgatgaagggatagttaccaaaggtagatactttagtatcacacctgtcagaggcttagagaaaatggttacaggtaaagcacctgagactgcaccagttctttgtcaaagaatctgtggggtatgtccaattcctcacacattagcatctgtcgaagcgatggatgactcccttgacattgaaattccaaaagcagctgcattgttaagagaattaacaatttctgcttctaacttaaacagtcacgctattcaccatttcttggttgctcctgattttgtaccagaagatcttttcaagactgcagtagacagtgttggaaccattaggaaaaacgcacagtatgttgtagatatggtagctggtgaaggtattcacccatctgatgtaagaatcggcggtatggcaagaaacatttccgaacttgctcgtaagaaattatacgccagactcaaagcattagtccctgtagtggacaaccatgttgaattgatgactaacttaatccttgaaaaggacattcctgaaggattaggtgtaattgacgctcctgtatttgcaagtgatgtagtatacggtaaaagagacttctttgaccttgacagatttactgaaatcgtacctgaagcttggtatgacgaccctgaagtcggtaaaagggcatgtaccaccatcccattatacgatggcgtaaatgttgaaaccggtccaagggcaagagtagacaagttccaaggttacaaagaaagaggtgttgtagcacaacacttatcaagagctcgtgaaatgaaaacttacctttccagagctattgctatcttagatgaattagatactgctgctaatacccttgcagatttcgatccaagaggtaccaacaagttaggtattggtgtaatcgaagcaccaaggggaactgacgttcacatggcacaagtaaaagacggaaaaaccgctttctacagtgcattagtaccaacaacttggaacatcccaaccatgggtcctgcaactgaaggattccaccacgaatggggacctcacgttatcagagcttacgacccatgtttatcttgtgcaactcacgtaatggtagttgacgatgaagataaatctgtagtcgaaaataaaatggtgagaatttaa

SEQ ID NO: 1596 - DNA, 1194 bp, Methanobrevibacter ruminantium
atgttagttaatgcagatttacatattcacagctgtttttccatggccacatctaaagacatgctgatagagaacattgctccaaaatcccttgaaaagggcttgaaacttgttggaactggagacgcattccatcctaaatggttggatatcattaggcaaagcacagaatataagggagatggaatatactcaagaggggactgtgactttgtccttacaactgaggtggaaggcaagcataaggtacaccatgtgattatcattccagatttggatattgctcatgagctctctgctaagttagtgtcctctaataagtttatagatggcagacctaagactccacttgggggagctgagttattggagcttgttcgtgaatatgactgcatgataggacctgcccactcatttactccctggactggaatgtataagtattacgatagcatttacgactgttatgataaaaggcctgattttgttgaattaggactttctgcagatactgatatggctgattgcataaaggaattgtctgattttgtatttttatccaattctgatgcacattctccttggcctcataggttaggaagggagtttaatcagatagagatggatgatgtttccttttcatcactaaagaaggcatttaagcacaagactgtaaaagcaaattatggaatgcttcctaatttgggaaaataccatatgactgcatgcaccaaatgttataagcttgttgatcctatcattgctaaggagaataagatgatatgctcttgtggcggtcggataaagaaaggggttgactataggataagcgagatagcagactttagccagccaaagcatccgagccataggccaccttatgttcatcttatgcctcttggagagctgatcagtatggtttatgataaaggggttacaaccaagactgttcagggaatctggcaaaagatggtggataactttggtccggagattgatgtattgattaagactccccttgatgagatagaaaaaatagatagtgatgtttcccttgccattcaaggatttagagaaaaaactcttaatataactccaggtggtggaggaaagtatggggaaatctcatttagtgaggattttaataaaactgagaaaaaagagagtgtgaccactttagatagttttttttag

SEQ ID NO: 1597 - DNA, 564 bp, Methanobrevibacter ruminantium
atgagcaaaaaaagatgtccatgggcagaagatgtagaggaaatctatgtgaaataccatgatgaggagtggggagttcccacctatgacgatagggagctctttgaaatgctcgtgcttgaatcatttcaggcaggactttcatggataaccattcttaaaaaaagagataactttaaagaggcatttgataattttgatgtagttaaagtaagtgaatatgacgatgcaaaggtagaggagcttagaaacaatgcaggaatcattaggcataagggaaagatcaattctgccataaacaatgcaaatgtctttattgaaattcaaaatgagttcaaatcattctcaaactacatttggggctttacagacaataaggttctaaaggatacggaagaaaactataagacaaattctccattatccgataagatagctaaggaccttaaaaaaagaggaatgaaatttgttggaacaaccattatctactcttatttggaagcaattggagtgatagacaatcatatccatgaatgctttaaatacaaagaggaaagtgattaa

SEQ ID NO: 1598 - DNA, 477 bp, Methanobrevibacter ruminantium
atgaagtcatcagtgcttttagaggaaattaaagagaatattcaaaattatgatattgatcatataaaagaaaaccttaaaaaagaggatataaatccaatatcaaaacaggtttctgagtttaacttgaaaaattatgatgaaataatggaaacaaagatatctgaggaagatgattttgaaataagtgatgaaatgatatattcaatgaaaaatgaaatagatttgttctttaaaggatgctcacctgaaagcgaagactcctttaaaaagttcattgaatcaatttgcttatatttaagccttattgctaaaaaaccattgcatccagttggaatggattttaaaaacggcaatacagtccatgaagagattgaagatggaaatactgtttattattgcgatttaaaagaatactttggcaagcaagaaaaggattactatacttgtaaattttgcgtttgtaaaacagtttaa

SEQ ID NO: 1599 - DNA, 1008 bp, Methanobrevibacter ruminantium
atggcatttaaagacatatttaaatttaaacaaggagaaactacctttatttttgtaggcggaaaaggtggagttggaaagacatcaatttcatctgccactgctttatggctagcaaaacaaggcaagaaaacattgattgtatcaactgatcctgctcattcattatctgactcacttgagacaaagataggccattatcctgtagagatctgtgaaaatctctatgctgttgaaattgacccggacaaggctatggaagaaaagcaaagggctcttgaaagccagaaatccatggcaactgcagaccaattgttgggtcttgattttctaggtgaacagatggatttggcttctgcatcccctggagcagatgaggctgcagcatttgaagtatttttatctgtgatgacttccaatgaatatgatgttgttgtctttgatactgcgccaacaggacacacccttaggctattgtccttccctgaagtcatggactcttgggttggaaagcttatgaaggcaagatccaagttaggggctgctgcaagcgctcttaagaatatcattccatttatggatgctgaaaatgatatccaatcctctcaggagttggaagagactaaaaagcagattaatgaggcaaaggcagtattgtctgaccccgatagaactacattcaagatggttgtaattccagaggaaatgtctatttatgaatctgaaagggcaattgaggcattaaacaaatatgacattacaactgacagcataattgtaaatcaggtcatgccagatatttcagactgtgacttctgtcattcaaggtatatgcttcagcaaaaaagattggctctcattgatcaaaagttctctgaccaggtcgtagctcaagttcctttattcaaggatgaagtaaaaggtaaggaaaagcttttaaaactagctgaaatcttatatgaaggaaaagataatgatgaagttgaagcaagtgtgattcagttatag

SEQ ID NO: 1600 - DNA, 132 bp, Methanobrevibacter ruminantium
atgtttgttgaagaaataccagaagagaaattttattcaaatagaattagggatgaattcatagaagaagtagtggaaaaaatagaaaataatattcttcaaaataaatatagaaaatatttggattattaa

SEQ ID NO: 1601 - DNA, 150 bp, Methanobrevibacter ruminantium
atgttttatgaagagcgagttgaagatcaattttccacataccgcaatcgagaagaatttataagagaacttttggatgtggtagataataagataactgatgaagagatggaagatatttatcaattattggatattcctagaaactaa

SEQ ID NO: 1602 - DNA, 762 bp, Methanobrevibacter ruminantium
atgacaatttgtatatctgcaatttgtactgagaacaatgaagagcatattgtttttgctgtggatcatatgattactactggattagggcaatttgaacacagtataaataaatacaacgttcttaatgaaaatgttgttggaatgatggctggcaatgccttattgatggattatttctttgatgaagattattctgaaaatagtttttctgaaatccttgatatattcgaggaaaagtttaaggaaaagaggttaaacattattgaaaaagaaattttagatgtttattctattgatttggatttcataagagatattttaaaaggtccgattacaaatgatttccaagcggctattttaaagaaaattgcaaaaacaaaattagaatctgcaatccttttaatgggatttgagaacaataaggctagaattgctgaagtgtccgattatggaattggaaattttaatcgtattaattttcatactattggttcaggttctattcaagctcaaaacactcttatgttccaaaaacattcaaaaaaagatgatttgagaactacattgtacaatgtttacaaagcaaaaaagaatgctgaagtaatgcaaggtgtagggcaggatactgaaattggatttttgaataatggaagtatcgtaatgcttgataagaagaatatgggcattttagataatgtttatgcccttgaattgaactggggaaaggaacacaaagaagtgggtgctttagatttttaa

SEQ ID NO: 1603 - DNA, 1080 bp, Methanobrevibacter ruminantium
atgttagaaatcaaacatacaatatgcccttcatgttctgtaggatgtggattaaacattgtctccaaagacggagcagtggtaggaacctatccttacaaaagacatcctataaatgaaggaaaaaattgttctaatggtcgtggttccattttgcaatttgaaaataagatcaatgctccttcattggtacagaatggagagcttgttgaatcagatgctgattccatcattgcagcaatcaaaaaggaattggatgcaatcgatgcaagcgaactcgcaatcatctgttccgacaagaacaccaatgaggaaattgatgctattaaaaaattcgcagaagatttcggaaccgataaaatcggattttacggatataatttccctaaattttccggagaaatagcaaattataatgatatcaataacgctaaattcattttagcaattggtgacatctatggagaaaatcctttagcagctagaagaattgttttagctaaagacaaggaagcaaaattctttaacatagatgacgttgaaaaatccataactgctttaaacgctgacgaatacatccaatttagtgataaggcaacttttgctgacgctatcgcatctgtaaaaggagagcttaacgaagaagctgtaattgtcttaaacaaaattgcagatgctgaagactttaaattagttgaagatttagcaagcgaaaccggcgctaaattactccctattttaaacggtccaaacagcaaaggagctatggataaaatagacccattaaccaaagatgaaattatagacctaattgacggctcaaaagtacttattgtcgtaaacgataacttattagactatttatctgaaagtgacattaaaggaaaagcattcattgcaaatatttccaatttcgaagacgaattcaccaaattttccaacgtagtattacctggaaaagcttgggtggaaaaagaaggaactttcaccaatgctgaaggcttgacccaaagctttgctgcatctgcagacttaggtgaaggattaagcgaaattgaaatattcgagaaacttgcttaa

SEQ ID NO: 1604 - DNA, 1155 bp, Methanobrevibacter ruminantium
atgagtgaaaatttaatgcttgcaaaaagtaaagaaaatgaaataactgatagcggagcatgtgggggagctgtaagttctatttttcaatatctattaagccagggaattgtagacggagtattaactcttaacaaaggcgaagatgtatatgacggtatcccaagactcttaaccgatgctagtgaagtaatcgaaacttgcggttcattacattgtgctcctacaatggttggagatttaatttccagttttttaagcgatcaaaaaatagctgttgcagtaaaaccttgtgatgcaaaagctgttaacgaattggttaaaagacacagaatcaatcctgaaaacatcataactatcggtttaaactgtggaggaactgtaagaccagagactgcacaggaaatgatagaaaaattctatgaagttgaccctgctgacgttgtaaaagaagaaatcgataaaggtaaatttatcattgaaatggcagacggaagcgaaaagggaatcaagatcgatgacttggaagatgaaggctacggacgtcgtgacaactgtcaaagatgtgaacttaaagttccacgtaatgcagaccttgcatgtggtaactggggtagtgaacctggctggacctttgtggaagtcaataccgaaaaaggtaatgaaataatcgaaggcgctaaggctgaaggcttcattgaaaccaaagacccatccgaaaaggctcttgaaatgagaggcaaagttgaaaacatcatgatcaagatgggtaagaggaacactaaaaaacagttagaagacgaagctttaactttagaggaatgggaaaaccaatggaacaaatgtatcaaatgtttcgcatgcagagacgtttgtccaatatgctggtgtcatgaatgtgaacttgaaaagtcatactttaaggatgacggacaagctccacctgatccattaagcttccatggtgtaagattatcccatatgagtccaagctgtgtaaattgtggtcaatgtgacgatgtatgtccaatggaaattccagtatctaaactattccacaaattgcaagtgaaatatgaaggtcagactggatatgttgctggtgtcggcgatgaaaaacctccattatacagtccacaaaaagaaaacttttaa

SEQ ID NO: 1605 - DNA, 402 bp, Methanobrevibacter ruminantium
atggcagacgatattaaaatagtaggtttttgttgtaattggtgttgttacggtggtgcagatactgcaggtaccgcacgtatgcaatatcctcctaatataagaattataagagttatgtgttctggtagaatcaatccttctatggtctttaaagcatttagagaaggagctgatggtgtattcgtaggcggatgccacatcggagactgtcactacgacgctggaaactacaaatggaatagaagagcattgatgactaaagatattattgaggaatttggaattgacaaggaaagattcagattcgaatggatctcagcttccgaaggtgaaaagttccaaagaaccatgaaagaattttataataccattagtcaacttggcccaagaaacaaataa

SEQ ID NO: 1606 - DNA, 2874 bp, Methanobrevibacter ruminantium
gtgactaataatgaaatagaaaagaaatggcagaaaaaatgggctgacgctaagctatttcaatcagatccaaatgaaaaagaaaaattattcttaacagtagcttatccatacccaagtggtgcaatgcacataggccacggtagaacatacaccgtacctgatgtatttgcaagatttaaaagaatggaaggctacaatgtattattccctatggcatggcacgtaaccggtgcaccggtcataggtattgcagatagaataaagagaaaagatccatggacccttgacttgtacgaaagagtacacaaggttcctcatgacactcttccaagcctcgaagacccaattaacattgtaaaatacttcagtaatgaatatcacactgtaatggatgatatgggctattcaatcgattggagaagagaattcagaactatcgaccctacatacaagaaattcatcacatggcaagctaaaaagcttaagtcccttgggctaatcaagcaaggggagcaccctgttaaatattgccctcacgatgagaaccctgtaggcgaccacgaccttctcgaaggggaaggcgtaggtgtaaacgagcttacattgattaagtttgaagtggagcctggattatacatagtccctgcaacattcagacctgaaactatctttgcagcaaccaacgtatggctaaacccagaggttcactatattgaagttgaagtaaaaacaggtgcaaatgcaagagaaaaatggataataagcaatgaagcattcttaaatctatcaaatcaacatgatttggagattgttggagacattgaccctaagccattaatcggcaaatatgtcaaaaacccacttaacggagagccattgccaatattccctgcaagctttgtagaccctgaatatggttcaggtacagtattttcagtacctgctcacgctcctgcagactatattgcacttagagaccttaaggaaaacgaagagctaatcaaagacttcgatataaaagaagaggtagctaaagcagagccattgaatgttgttaccgtagaaggatatggagagttccctgctgttgaagttgttgaaaggatgggtatcgaaaaccaaaacgaccctaaggtacaggatgcaactgacgagctatacaaggcagagcacagcaaaggatacataagcgaccatatcgaaaaatatgcaggaaaaagagtcgcattcataagagatgaaatcaaggcagacatgattgaagcaggaagcgcagacataatgtacgactttgcagagagaccagtcatctgcagatgcggaaacaaatgtgttgtcaaggtcatggatgaccaatggttcataagatacggcgatgaggaatggactgaaaagacccaaaaggtcttagcacaagagacaattatcccagaagagatacgctcaaacttcgaatactatctcgattggcttgacgactgggcatgctccagaagggtaggtcttggaacaagagtcccttgggacgaccaatggcttattgagcctttatccgactctacaatgtacatgtcctactatacaatagccaaataccttaaggatatggaccctgaagacttaaatgaagcattctttgaaaaggtcttcttaggtgtagacagcgatgaaatcacagtccctgaagagacagtaaaccaaatccaagaggaattcaactactggtacccattagactggagattatctgcaaaggaccttgtcggaaaccacttaagcttccttatgtttacccatgcagcaatatatcctgaggaaaaatggcctaaaggaactgtagtcttcggtatgggacttcttgaaggaaataagatgtcatcctccaaaggaaacgtcattctccttgcagatgctatcgaacagtacagcgcagatgtggtaaggcttttccttatggcatcagcagaaccatggcaagactttgactggagagaaaaagaggtcagaggaacccaaagaagacttgaatggtttagagagtttgcacaaaaggtagaagacataaaaggagaaaagctagacctatccaatattgaagaagtgcctttagaacgcagcatcgacaaatggatgataaatcaattgaacatacacatcaaggaagcaactgaagcccttgaagtattccaaacaagacaagcactccaacatgctttgttcctacttaaaaaagacttagaccactatctttacagagttcaagaccttattgaagcaaaggaccctgcagtaatctatgtcttaagcacattgctcagcaattggataagattgcttgctccatttactccacacacctcagaagagctttggagcaaatatggcggtgaaggatttgtatcatttgctaaatggccagagtacaacgaagatctaatcagcaaggaaatagaaaggtccgagtcccttgttcaaaacatagtaaaagacataaacgaaatcaagaacattgtagacacagacccagaaaagatacacttataccttgctccagaatggaaatgggagctatataagatagctgatgaagttggaaaaccagacatcggccaaatcatgggcaaggccataaaggcagacatttatgataacaaaaaggaaatcgccaatgtagcaaaaagaatttcaaaagaaatgattaagacaagatacattggtaagattgatgaagagactatcttaaatgatgcaaaagacttcattgaaagtgaggtaggttcagagattgttattcatactgatgacagctatgatcctcagaataaggcaagaaatgctatgccttataagcctgctatttttatggaatga

SEQ ID NO: 1607 - DNA, 1374 bp, Methanobrevibacter ruminantium
atgaaaaaaaataaactcgaaaaaggatgtgaaaaaatgtccgcagacgataaaaaactagaccaaataattaagacaatcgaagcaaatgacataaaatttttgagattagaactcgcagacatacacggattgccaaaaagcatggcagttcctcttaaaaatgcaaatgatgtagaagacatagtaaatgacggattattatttgacggttcatctgtagcaggattagcttcaatcaatgacagtgaccttcttgcaaaaccagacataaacaccttctcaaccatcccatggagacctgaatcaaaaggtacaagcagattcatctgtgacatatacaccacagaaggaaccccttatgatggagacccaagaggaatccttaagaaaacattagaaaaagctgagaaaagaggataccaatacaatgtaggtccagaaccagaattcttcatcatcaaaaaggatgaaaacggaaactacgtccctgcagacgaagctgaatactttgacgtagagccattagaccaaggaacagacatcagaagagaaatcgtattcggattagaagagttaggtttcgatgttgaagtaagccaccacgaagtggcagcaggacagcacgaagtggacttcaaatatgcagacgctttaaaaacagcagatgcagtaattacatttaaggaagctgtaaaagcagtggctaataacttaggagttaaggctactttcatgccaaaaccattcataggaatcaacggtagtggaatgcactgtaaccaaagtctattcaaggatggagaaaacatcttctatgacccaaacactgaaactcaagtatctcaagaggctttatacttcattggaggattattaaaacacgcacaagctttatcagcaatcttatccccaacagttaactcttacaaacgtttagtcccaggttatgaagcaccatgctacatagcttacggatttaaaaacagatcaaccttgctcaggattcctgcatcccgtggattaggtacaagaatcgaatgcagatcagctgacccatcctgtaacccatacttagcattttcagcattgcttgaagctggtttagacggtatggacaataagctcgacccaggagaacctactgaagaaaacttattcgcattctccgaagaggaaattgctgaaaaaggaatttccaacttgccaacaagcttatgggaagcatatcacgcattagaagaagatgatgtaatcataggcgctcttggagataaggtattcaatcaattctacaatatcaaaagagcagaatgggatgcttacagaatccaagtattcgactatgaaagagatgaatacttaaacgtatag

SEQ ID NO: 1608 - DNA, 918 bp, Methanobrevibacter ruminantium
atgtgtggaatagcaggtgtaatatacaaagataaaaaaactcaccctgtaggagaagcattaacatcaatgcttgaatcactacaacacagaggcccagattcagcaggatatgctatctacggcagcttagattttcctgaaaattattatcaattaaatatagaagtaaaaagaagaagaggagcattagacaatttaaaatcattattaaaccaaatcagtccaatatacgaagaagaaataattaaatccgtaggagactcagatgtatataaatgcaaaatagcattagatgaattctcccttttgcaaccatggataagggaaatagacgaattagaaaatgtaagggtcatcaacggatcacattcatttgaaatgataaaggacgtcggaaaagtaaaggacattgcagaaagatttgacgttcaaagcagaatgggaacacatggaataggacatacccgttttgcaacagaaagtggcgtagaccgctatcatgcacacccatatcaaagctacatcataccagacattactgtagtgcataatggacaaatcaccaattattggaaaataagagacccattagaacgtaaaggacacacttttgaatcatttaacgatacagagtgcatcgttcactatatggcagacaagcttaatcaaggctataaattagaagaagccttagatcaagcagtgattgacttagatgggccattttcaatattggtaggaacacctaacggcataggcattgcaaaggacaagcttggccttagaccaggagttatggtagaaaccgatgaagtctttgcaatagcttcagaggaaatggcattgcatgatgtcactgattctaatgagatagaacagatagccccaggtgaaacaagagcttacaccatataa

SEQ ID NO: 1609 - DNA, 648 bp, Methanobrevibacter ruminantium
atgaaagaatacatcattaatgcaaaagatatggaagagaaagaattaaaccgtgctataaaggaacaggctgcacatcatgataaactcattattaacaatcctgaatcaagacacaatatttgcgcaggcttaagcgaagatgtagacatagaaatcaacggttctgcaggatactttgttggaaccatggtcaacggaccaaagatacacatcaacggaaacgcaggctggtttgccggagacaatatgaccaaaggggaacttatcatcgaaggcacagcgggagacggtgcaggacagggaatctatggaggaaccgtaatcgtaaaaggaagcacaggctcaagaactggagagatcatgaaaggaggaaccgtaatcattggcggaaacagcggattcatgaccggactgcttatgatgggaggaaagctcatcattcttggagatgtaaccgatgacgtcggggaatcaatcatgagaggaagcatatatgttcttggagaggtcaaaagccttggaaaaaacgcaattatggaagaaaccacagatgaagatttaaaggatcttgaagagaccctgacaaaatacggttttgaagatatagactattcaaactttaaaaagattgtaaatattcaatag

SEQ ID NO: 1610 - DNA, 1095 bp, Methanobrevibacter ruminantium
atgagtgaacataaaatagcaatggttggaacaccatgtgaaattatggcagcatcaaaactgcaagattatacagatagccctattgaggttaaattgggcttattctgcatggagaacttttcatacaaatactttgtaaatttcctaaaggaatatgacttaaagatggatgacattgaaaagttccaaattgacaaaggattcctattcctaatactaaaaacaaaggaaacagtgaaaatacctttatcagtagctaaaaggataatcaggaaaaactgcaacatatgtgttgagcttacatctgagacctctgatatctcaataggttcaataggttcagatgacggctggtcaacattgattgttagaagcgaaaaaggagaggaaatagtaaagggagcaattgagcaaagattcattgaagttgaagagctagaagaatccaaattccaactgcttaacaaacttgcccaaggcaaaataaacaggaatctggagcatatagaacaaagagaattcttagcaaggcctgtactataccaaagggaaaaggacgacgattcaataagcaaggaaatctcagaatctgacttctctgacttaaagtcaaatgtcatagacattggagcatgcgtgctctgcggagcctgcgaatatgcatgtccggataacttaataataatcgacgacaccaaacctagaatgaaaggccaatgccctccagactgccatgcatgctttgcagtatgtccaaggacattcatagaggaacacttaagaaatgacaatgaaaagccaatcggagactatataaatgtctatacagttagatcccttaagcatagccaaggtcaagacggttcaatcgtcactacaattctagactatcttttaagcaatgagattgtaacagaagcccttattgttgataagaaagacgatttagcttggaaaccttacgcaaagctaacaaaggacatagaccaagtcgtaaaatcaggaggaaccaaatattctgtatgtcctgtattcaagccactaaaagaaattaatgaggaatcatcaactacagaagagggggttaactaa

SEQ ID NO: 1611 - DNA, 1488 bp, Methanobrevibacter ruminantium
atgtcattcactgttgaaaggaaaatagaaatatgcaggcagaacaatgacaggccaggttgctgctggtatttatgtgacaatccaaacaagtcagcatgtaagaactgttatagctgctattctaactgccctcacggcgtatatgaggtaatcaatgacgaaccactcccaatacatcaggaaaactgtgtaggatgcaagatctgtgaagagatgtgtccgacacatgctatctatgtaaggcctttagtggatgagggaaggggaatatggtcaaactcaaccatggttgaaatcaagcgtaaaagccagaccggttcatataaggtccgtggatgcggacttacccgaagaataccaagctttgacgacttgagcatattgcctgcacaggtatcaaggccaccaatagactcatacagggaaacatgcaagacatcagtagtccttggagaccgttttgcagaaaacccaattgaaattgacactccaatcatgattggagcaatgtcatttggtgctttaagtaaagaggcaaagatagcattggctattggaagcagcaaagtcggttcaataacaaacaccggagaaggaggaatgcttccagaggaaaggcattatgcagacaagctcattgcacagtatgcatcaggccgtttcggtgtttcagcaagctacctgaacaatgcagaggctgttgagataaagataggccaaggcgcaaagtccggtatgggaggacaccttcttgcccataaggtaactgcagaggttgcaagggttagaaacattccggaaggaacctcagcattaagccctgcaagacacatggatatcgtaggtccggaagacttaggaatgaaaatcaatcagctaagggaaatcacagactggaaagtgccaatcatcgttaaattcgcatctggaagagtggagcaggacgtaaagattgcagcaaaggctggcgcagacataattgtagttgacggtatgcaaggaggaaccggagcaggccctgaagttgttacagagcatgcgggaatccctacaattgaagctatcgttaaggctgacgacgcccttaaggagataaacctaagaagcgaagtaagcctagttgctgccggaggaataagatccggagctgacgttgcaaaagcaatagctttaggtgccgatgctgtatatgttgctacatcagcacttatttcaataggatgtaaggtctgtcaatcctgttcagaaggaatatgtcctaaaggaattgcaacacaggacagagcccttagaagaagattggatcctataagaaaaggtcagcaagttgctaactatattgaggctatgacacaggaggttacttcattaacccaacaggcaggaaacactgacatagagaatcttgaacgtcaagaccttgtagcattgactatggaagcttctcaattgactggagtgcctatggtaagccaaagatattag

SEQ ID NO: 1612 - DNA, 2643 bp, Methanobrevibacter ruminantium
atggccgcattcgatagaatcaaatcaggaattccagggcttgatagcgctttagacaatattcgtttaggagacaacgttgtatggaatgtcacaaacctaaatgaattttcctattttgtaaatccttacataaagcaagcaaaagaggacaatagaaacttaatttacatccgttttgccaatcatcctccattaatagaaatgactgaagaagatttcagattgcttgaaatcgagcagaacaatccggaaaccgagttttccatgatagagcgtgacggaatcaagatatatctggttaatccatataaccaattcgagacattcacattggaagttcacagaatcatagaaaaggaaggcttcgatgcattctatgtcttcgactgcctaagcgaccttcaagcggtatggtcaacagacctgatgatgggaaacttctttaaggtaacctgtccattccttttccagctggacacagttgcatacttcccaatcatccgaggaaggcactcatatgatgcaatagcaaagatccgtgaaaccacacagctatttctaaacgtatactcaaactctccagaggaagtttacgtatcccctctcaaggtatggaacagatactcacagaccatgtttttagggcataagttcaaccctagaaccggctttgtcaaggtccttcaggacggtcaggaagtaagcaaatactataagaccatcaattcagacaaatacatgaacggacagaccttagacagctgggaaaggtatatgcttaaagtcagaagagaatacgaagagggaaagaatatcgacgaagagtgtgacaagatctgtgagctcatgatgacaaaggacgagaagatgctttccaaaatcaaggaatacttctcttttgaggactataccacaatctatgaccgcagagtgggaagtggacttgtaggaggtaagtcctgtggtatgcttcttgcaagaaagataattgaaaggaactgcccagagatatacaacaatatctttgagcctgacgactcattctatataggctcagaccttttctacacttacatcgtttcaaatgacctttgggaccttagggtaaagcaaaggacccctgaaggatactataaatatggaaaggaactggaggaagcccttaaaaacggaagcttttcagaccagaccaaaagggaattcataaagatgctggattatttcggacagaatccgattatcgtccgttcaagcagtttccttgaggatggatatggaaatgcatttgctggaaaatacgaatcagtattctgtgtaaacagaggctcacttgaagagagactggcagcctttgaagaggcagtgaaggtggtatattcaagtacaatgaacatttcagcccttgaatacagaaaaataaatggattggacgacactgacgaacagatggccctattggttcaaagggtttcaggatcataccatggagactatttcttcccgacagcagcaggtgtaggattctcatacagcccatattccccgcttccggacatggacaacagcaagggaatgctaaggcttgtaatgggtcttggtacaaaggctgtcgaccgtacaaaaaaggactatcctagaatcataaaccttgacaagcctgaagtgactatggcaaaggacattaaggaaaagcacagatattcacagcattatcttgatgttattgaccttaaggaaatcagcctgcatgacattccagtggatgaaggattgagcgtaattccaagatactctaaaaacatgttggtagagcatgacagagaagcggaaaggatgtttagagacagaggccaacgtagggaaatagtatttgtaaactgtgagggaatcgttaaaaacgatgcattcatagaaaccatgaaggaaatcatgagcaccctccagacagcatatgactatccagttgacatcgaatacactgtaaatgtgggagaggacaaatcattcaacataaacctattgcagtgcagacctctgcaagttatggtaaacaatgaggctattgaaatgcctgaagacaagaacgtattcttccatatcaaggaatcctctatgggaatgtccagaaagaacacaatagacacaatctgctatgtggatcctcataagtattatgaatatccttatgctcaaaaaagctctatttcaagagtaatcagcgatgtaaatgcatatctcaagagcaacaacaagacagcgattctcattgtcccaggaaggataggaacatcatctccagaacttggaatccctgtagtctttgcagacattagctacttctccgcaatcctagaggagtcatacagcgatgcaggatatatgccagagttatcctttggaagccacatgttccaggacctggtggaagcggatatatactacggtgcattgtttgaaaatgagaaaaaactggagttcaataaggacatggtctacgactatccgaacatattaaaggacataaatccaaacctcagcgaggagatttatgacatgatacaggtgatagactttgatgaaaacaaggcagagctctatcatgatatgaataaggatgaaaccttgtgtattttcaaatag

SEQ ID NO: 1613 - DNA, 1356 bp, Methanobrevibacter ruminantium
atgaataaaagtaaaaaatgtgcagaaaaagatttggctcatatatggcatcctgcctctcagatgaaggattatgaagactttccaccaattgtaatagaccatgctaagggagtccacctttatgatgtggatggaaaggaatatacagacatcatcagctcatggtggtgcaatatccttggtcattgcaatgaagaggtaagccaggcccttaaggaccaacttgatgagcttgatcatgttttatttgctaatttttcacataagactataatagagctatcagagcgtcttattaaggtcatgccaaagggattgaataggttttcctttgttgacaacggctctgcttcagttgaatgcgcattgaagatggcattccagtattgcgctcaaactggtagggctcaaaagaaaagattcatgtgctttacagatgcatatcatggagagacattaggcgcattgtctgttggagcccttgatgagtattcaagtgtttttgagccaatcatgattgatacaattaagattgaggctcctgattgctatagatgtccttatggtaagacaaggaatgattgtgattgccagtgctttgagcatgcagagagggcatttgaagagcatggccatgagacctgtgcaatgattatagagccgcttatacagggaagcgctggaatgaagatttatcctcctctttatctaaagaagcttagggaactttgcgataagcatgatgtccttcttattgcagatgagatagctacaggttttggaaggactggaaagttctttgcagttgaccatgccaatataactccagacattatgtgtgtgtccaagggactcactaatggatatatggccatggcagttgcatgcactacagatgagatttataatgctttctatggtgattatgaggataatatagcatttatgcacagtcatacttatgccggtaatccattggctgcaagcgttgcaaatgccacacttaagataatggaaagggataggattattgaaaataatcaggaaaaggccatttggcttaataaaagattccacaacacatttgatgagcatcctaatgttggcgagataagacagatgggtcttatcaatgcaatcgagcttgttgaggataaggagtctaaaaaaggatttgattcaagccttagaataggatataagatttatagggaagctttaaaggatggattgatgttaaggcctcttggcaatgttatgtattttaatcctcctcttgtcataactaaggaagagcttgatgagtctttagctatttgtaaaaaggctattgataaggtattattagactaa

SEQ ID NO: 1614 - DNA, 1599 bp, Methanobrevibacter ruminantium
atgacaaaatttatatttttaattatcttattaaaatttatgagaaaggaaattttaattgcagctattgcaatcatattaatattatgtggaggtgtatttgcagctagcaatatgcagatagcggatattgctacttttagtttgaatgcaattgatctcgaggataggggaagcttaatcgttgactctgaagatatcactgcttcaaagggctattataattcttcggcttctgatgagaatgtggttttggttaaaaattatagcttaagattaagcaattcaattgtaaataagactggagacactggaagctctggagatgatgcagacttttatgggattaattctgcagttcttgtaaattcaaatggaagtgtagaattatctgatgttgaaatagagactaattctaaaggatccaatggagtatttgtaacaaatgctgtttctgattctaattcaaattcttcatcctcttctggcagccctattgttgattccactgaacgtcatgatggaaagagtgatgctgaagagcctggtggtgttcctcctgaaaagcctgttgaggatggaccttctgtatatggcggttcttcaggaggtaaaggtgcccttagcgatggaaatcaatctatgcctgctccaggcgctagctcctctgatgtggaaggaagttcaagtgcagacatctcaaatgtccgaatcaccacacatggagacaagtcccgcggattggatgcaacctttggaggaaagattattgcttcagatgttgaaatcaatacagatggccaaagctgtgcggctcttgcaacagacagaggcgaaggtgaagtccatgtgaaaaactgcatattgaatactggagtggatgagaaaagcggaagaggctctccaatcatctattcaacaggaaacattacagctgacaattccgaaggctgtgcccatgtctcccagattgcctgcatagagggaaaaaacagcattgcgctatcaaactgtgagttctctgcaggtgcaggaggaaatagggaagataatggagaatatgttgatctaggaggagtgttcatctatcaaagcatgagcggagatgctgatgtaggaacctctctttttgatgcaaactgttgcgttttgtccatagaagaggattccgaatactataagactgctcctatgttccatgttaccaatacaaaggccattgtcaagcttgcaagcacagaacttaatttcggaagcggtgttcttttgaatgtttccggtcaaagccaatggggaactgtaggatccaatggcggtgagcttgagtttgatgcaagtgatgagattcttgatggggatgtctttgttgattccatcagttcattgaatatgagcttggcttcaaccagctttataggagctgtaaatccagacgatgactttggagagactaatcttgtcattgattcagattctgattggacattggatggagacagtcaccttagctcattggagaataatggagatatagattataatggacacactctttatgtggatggaaaggcttatacagagtctaatccatttaaatag

SEQ ID NO: 1615 - DNA, 699 bp, Methanobrevibacter ruminantium
atgtcaaaaggactattcgtactgggaactggcacagatgttggaaagacttatgtaactggcttattgttaaagtacataagagacaatggctacaatgcaagctactttaaggcagccttaagcggcgctataagggacaatgaaggcaaactgattcctggagatgctgttgaagtgataaatatggctggccttgaagaggatacagactttttggttccatacatatatgaaacagcagtttctccacatcttgcaagccaaattgaaggaaatcctgttgaactggacaaagtcaagcatgcatacgaagaagtttcaaagaagtacgattatatagtcatggaaggaagcgggggcatagtctgccctattcgctatgatgggcaaggatgcaaaagcaatatcttgcttgaagacataatcaagtgtcttgaccttaatgtccttctggttgcagacgcagggcttggaacaataaactctgtaataacaacagtggattatttgaaaaatagggatattcaagtttgcggaattcttctaaacaattttaaggacatgcctatggaaaatgataatctcaagatgattgaagagcttggtggagtggatgtcattgcaaaaatctacaaaaatgataaaaatttatcacttgatgtacagttagatgttctaatgaattattttaaataa

SEQ ID NO: 1616 - DNA, 981 bp, Methanobrevibacter ruminantium
atgtataatattatcgagcttaaggacaaagtattgaataattacaaagtcactaaagaagatgcattgaatttgcttgatgttccattagatgaactttcagatgcagcaaatgaaatcagagaattcttttgcagcaacaagtttgatgtatgcacattaatcaatgtaaaaaacggcagatgcagtgaagactgtaaattctgtgctcaatccaatcattatgatacagatatagatatatatccattcctatcaaaggaagagctagtaggtaagagcaactcccttttggatgcaggtttcaagcgaatctcttatgttgcatcaggcagaaagataagggataaggaatttgatatagttgtttctgcattagagcaattgaacaaggatagaactgatgaattccatttatgcctttcattagggcttttaagcgaagagcagataagcactcttaagaatctgaatgttgaacgaattcacaacaatcttgaaagttcaagggattatttttcaaatatatgcacaacccattcctatgatgaaaagctggataccattgatcttataaaagacaaaaatcttatggtctgcagcggaggaatatttggaatgggagagagctttgaagataggatagatcttgcaattcagttaagggatcttggagtcaagtcaattcctataaatgttttaaatccgataaagggaactcctgtagagaataataagattctttccaatgatgaggtctgcaggcttattgcaatattccgcttcataaatcccgatgcattcattagaatggctggaggaaggaccctccttggagacaatggcagaaaggcattccaatcaggtgcaaatgcagcaatacttggaaatatgctgacaacaagtggtgtggaacttgaagaagactttaaactacttgaagagcttggatttgagataacttattcaattgatgcttaa

SEQ ID NO: 1617 - DNA, 714 bp, Methanobrevibacter ruminantium
atggatgaaagaggtaagaaataccttctaaaggaagatagagaattccaaactgatttgggaattattaaaaaggaacagatggaaagggcaacaattggagatacaataatcactcatttagataaagaatttaaggtcataaagcctacagtcaacgatttcattgaccttatggaaagaagatgctccattctcattcaaaaggatataggaactgtgctggcaagaacgggattaggtgcaggagacagggtcatcgatgcaggaacaggagccggtgcaatcgcattgaactttggaaatgtggttggagataagggtcaggtttacacctatgaaatcagggaagactttgcagagattgcaaagagaaacattgacaactttggaataaagaacatagaggtaaaaaatcaggacatcaaggaaggaatcgatgaagaggagattgatcttgttttcctagaccttccaaagccatttgaaatttttgaggatgttaaaaaggcccttagattaggaggatggcttgctgtctatgccccttatattgaccaagctgaagtggcttatagaattgcaaagaagcttgatttcagagaccttacaatccttgagacattagagagggaaatggaaataaggcctcaaggaacaaggcctaagacaagaatggtgggtcatagtggctatttggttttttgctcgtaa

SEQ ID NO: 1618 - DNA, 2529 bp, Methanobrevibacter ruminantium
atggttacttatatcgaacatcctttaattaggccaaatgcagcggaagctaggatttatcagcaggttttagctgcgaatgtattgaaaaatggaaatactatgattgtagctccaaccgctttaggtaaaaccatcatagcaatactggtagctgcagacagattgcagaaattaaaaggttcaaaggtactcatacttgctccaagcaagccacttgccatacagcatgaagagaacttcaagcactttctaaacctgccttgcacatctatcactggtgccgtcaagacagatgagcgtgaaaagcgttgggatgcctcttcaatcatctgtgcaactccacagactatcgaatctgaccttctaaatgagcgctacacccttgatgatgtttccctgcttgtctttgacgaatgccaccatgccgtaggctcatattcctatgtctatcttgctcaccgctatgtaaaggagtctaataaccacctcattcttggattgaccgcttcaccaggtcatgacaagtctaaaatcaaggaagtttgtgaaaatctattcatacaggacatcaccatcaagactgaagacgatcctgatgtcaagccctacttcaatcctatccaaatcgactgggtaagggttcagttgggagaggagcttgaaaagataagggatcttgtcaacaaggcattgaaggttcgtcttaaaggccttaagtctcttggggtaatcaatacggtctctgtaacaaagcgggatgttctcaaggcaaggtcacgggttcaaagaaagataggtcagtctgtaaatcctcctaaggagtgcttccaggcaatttcaatcctatctgccgtaatcaaccttcagcattcccttgagcttcttgaaacccaaggggtagtgccattcaatgactatataaagcgccttaggaagaagaccacaaaggcagcaaagaacatccttcttgaccctaacttttcaaaggcaatctattttgctaaggaggctgaagaaaagggacttgagcatcctaagatgaataagctagttgaacttctcaaattggaattaggtgttgatgaggctcagaccagactcacttcccttagaaacgactcagactcttccatggatgagaaggtgaaggaggacagcccaaagataattgttttcacccagtttagagacaccttggacatgattcatgaaaggtgtgaaagggaaggaatcaaaagtgttaggttctttggacagggaacaagcgacggcaagaagggccttacccaaaaggagcagaagaagattatcaagtcatttaagacaggaaattatgatgttctaatctctacaagcgttgcagaggaaggaatagacatacctgcagttgaccttgtcataatgtatgagccggttccatctgaagtcaggatgattcaaagaaggggaaggacaggccgtaaatcctctggaaggatgaaagtattgatcactgaaaagacaagggatgagggctactattggaccagcatgaggcgtgaggacaagatgaagactcagcttgcaactcaagaggccatcgaagagcttaagctcaatgcagtggagaagatagaggttgaaaagtcagctaaggatcttggcaagagggaaaaggtcattatcgaagaccctagagatgatgacagcagcgacaactttgaggaagaagcaaagaatgaggacattgaagagataagccttgaaaacgacaatgaagagaagcagaaggaattgatggaaaaggaggccaagaaaaagcaatctttggaagattccattattgaagagcttgcaaagtcatcaacaagcgatgaactggtggtttatgttgactcaagggaaggaaattcaagggttataagggccttggacaccataggagtcaaagtaaaggtcaatacaatggcagttgcagactatcaggtaagcgatgatgttgcaatagaaaggaaaactgcaagcgactttgtagattccattgttgataagaggctcttcaagcaggctaaggccatgatggaagagtttaaaaagcctattcttatccttgagggagatgacttctataccggtttcataaatccaaatgcaataaggggatcaatggcttccattgcaatagattatggaatcagcataattccaacaagaacccctgaggacaccgctgcaatgattaagagaattgcaataagggaacagcaaggtgaaaagaagagcatacagataagaacagagagaaagcctcagaatctttgggagcagcagctattcataattgaatccttgccaaacataggaccagtccatgcaaagaacctccttgagcacttcggttcagtgaaggctgttctccaagctgacgaaaagcaattgcaggaagtcgatggaataggtaagaaaacagctaaaagcattaaggaagttgttgatggcaagtatttgtattttaaaaagccagagaagaatgagaaattgatttaa

SEQ ID NO: 1619 - DNA, 15201 bp, Methanobrevibacter ruminantium
atgaaatttgaaaaaataagtatgttgatatcaattgtacttatatctctcattgctttaggtgcagtaagtgcagctgacgacgtcgctgcagatgatgctgttgccccagcaactgtagatgaagttcaaacaattgataatacaataacaaatgatgatatatcatatgagtctactgacataattgttaatgatactggcgactcagctgattctaaggcaaaaaccacttcccttagtgcaaatgcagtaaacgaaggggaaactttgtcttttacacaattagctgctgatgtctcttccagtccttcaatgttgtcaggtgcttattataaatatgatccatcaaccgacactgcttttgaaaatggtatcactcttaccaatggcttaacaatcattggtggcggtgcgaccattgacggggataatcaagcaagaatattcaatatccctgaaggagttagcgttaccattatgggtgtaactctcataaacggtgctgccgatgaaggtgcagctatttataactccggcaagttaactttaatgaatgctaaagttaatgacaacacagcagtcaagtctggtggtggtatttataataatggcggtgaagtattagtaacctccagtgaatttgatggtaacgatttaactgacagaacagttaatggctatggtggagcagctatttactccaatggaggttctgtaaccataacagatacaaatgttaccaacaaccttaagaacatagttcacagaggaggaactggtacttacacaggtgacttaagtagtgctgctgttacaagtaataacgctgatttaactgtaaccaactctcgttttattgctaacagtggttcctacggtggtgcaatttactctggtgagagcacttctgcaaatttattagtaagcggatctacctttgaagacaactttgcattcaatggtggagctattgatatagttggaacttcctataccatatctgattccacattcaaaaacaataatgttaaaggaactggtagtaccaattctaactacgcaagcggtggtgcaatctgtgttcaagatgcaaataacccaggtttaatctctggatgtgactttgaagctaactccggagtagttggcggtgctgtcaattgtgaaaacactatggttttagattgtactttcactgataacactgcaaattcagcaaactctgaaacctttaatggaaaaactaataatagaggaggatttgccggtgcaatttacaatgaaggaacaatcacaatctctgattgtgaatttgatgacaatgccggaagaggcgaaggtatacgtgttaaaaatgcggaaatttctgattcttcattcacaaataccagaattgacacatgtcaaaattctaatgttcttttaactaacaacacctacaataatccagatagagatgttcaagcagcaagcggtactcaagtaactgtagatgtggcagatggtgatattcctaatgctaacactgctccttatattgtaggagatttaactttcactgatttacaagcacttattgacagtggatcaagtggtatcagattaaccggaaatgttattaaaactgctgaagaggaaactacctttgcagacggtttaaatgttgataaaaccgtaaccatttacggtgctgaaggtaaagtaatccaagctaatagtggtaaaatcttcaatgttgctgaaggaaaaaccttgacattaagaaatgctactttacaaggttctggtgaaactgctatcaccaattatggaacagtttatttatatttggctgacaataatcaattcactgactgtggagatgttttaattgataatcatggcagaaccactgaaaccggtcttaccactttcactcaattaaataatcttattggtttagtaaatggtggaacagtatatattggtgagtctaaaatcactaaagctgaagatgaaaaagaagcttataaaaatggaattgttatcgataaagaccttagcatattaggttcatacaacacttattataaatatgttaagacttccatcaatgctaacaatgatggaagaatctttactgttgctgaaggtaaatctttaagccttaaatacatcaacgtaaccaatggtgctgctgatgaaggtgcaggtgtttacgtatctgaagatgctaccttaattgcagatactgcaaactttattaaaaacaccgctgtaactaaaggtggagcaatctactctgaaggtactgttgacttaactaatgttaacattaaaaataataccatcagtaaaacagatggagttatggctgatgataacggtggtgcagctctctacaataatggaggaactgcaacattagataaggtcaatgttacagacaaccaaaaaacatatgttatcggagatatcatggatggtgtagttgtatctaaaggtgctactactattaccaattcttacttcgctaacaactctggccgttggggtggagctatcactcaaactggcaccgatcaaactttaactgttgaagacacaatatttgaagaaaacacagctatctttggtgctgctattttcgataattcccctcttgttgtaaaagattgtaaattctacaacaacagtgctatcggtcctggaagtccaggtacttcaaacagtcaaggtgctgcaatattagtaatggatgacactgcttctgcagatattagtggttctgagttcattaataacactgctgattgcggtggtgcagtaagcttagcaggtgttggatctgatagtagtattgatgattgtacctttattgacaacacagcttatgctgatggtggtgcagtatacttctggactgaaagtgctagcgtaactgtaaccgattcagaattcataagtaacactgctccatatggtggtgctattgaaaatgaaggtcttggcgatttaatagttgatggttgtgagtttactgaaaacactgcatccttaagaggaggagcaataatttcaagtggagacacaagtgtttccaattcaaagttcactgataatgaagcttcaggaaacaccaatgcaatatacctttataattctggttcatcattatccttatccaacaacgttataactggtagtgatgatgcacaaatctatgtaaaagagggtattgatgttgtaactccattgaaagttaaaatattaaacaatgaaactgtaaacattaatatggttccatatgatatcacggctactgttacagatgataaaggcaataatattgttgatttagcattcagatttacagtaggtgatgatgtagtcgatggaattagtattgatgctgcaactggtgtatacacagcaacatttactcctactcaagctggagaatttgtagtttcaaccaatcttgcaaatgctgatgaagttcaaactggaactttaaacgtctttagaactttaactgacttaaaagcaatcatagatgcaaacactaatggcactattgacttggatggtaattacgcttacaatgcagaatttgacagtgcattaacagatggtattgtaattaataaagatatcgttatcaatggaaacggattcactatctgtggtgaaaactcaacaagactcttccatgtaaccagtggtttccttaccttgaaaaatgcaaccgtttgccatggtgctgctgaaaaaggtgcaggtgtatatgtagaccatggaagtaaattatctactgattatgtaactttcactgaaaacactgctgtaaaacgtggtggagcaatctactctgaaggtatggtatacataggcaactctgtattagacagcaacaacatcactttcagatctgcaaacgatgacaacggtggagcagctgtttacaacttaaacggccaattaacaatcgaaaaatctaacattaccaataacttaaaagacattgttatccgtaacggcaatgcaggtgacttattggttggtgtagttgtaactaccggcgacactttaattaaagactcatactttgcaaacaacacaggatcttggggtggagctatcagttcattaggatacatgaacaccgatgattacacattaaccgtaaaaggcactacctttgaaggaaacaacgctaccttcggtggagcaatctttgtagaaagttccaaccttgttgtagatgactgtatctttaacgaaaacactggtgtaggtaaaggaagcgatggaacttccaacactcaaggaggagctattgttgtacaccctactggatcaaaagctactatcaccaattccaaattcaacaaaaacagcgctaatactggtggtgcagtaagcctcgctggtgtaggccaagatagccttattgaaggatgtacattcactgacaacactgcaaatgatggtggagctgtatacctctggactggtggaaatgctattgtaactgtaaaagactcttcattcagcgacaacacagctaatttcggaagcgctatttctagtgatggtactttaagcttatcccacaatgaaattgcaaatgattacaccattactccaataggtagctatgatggaacaattgtatcagcgatttatgtaaccacattgaatggcgaaactatcataactggcaatccaactcaaaatttaactgctacaattactgatgataatggaaaccctatcgtagagaaaggccttgtcttagaagtatacggcgaagaagttgaaacaagctatgataaaaccactggtattcattctgcaattcacactttcactaaaccaaactcttacagaataactgcaaaaggtttcgatcaagatcatactactccaggttatattgtttacactggaggaactttcaatgaattgcaagacttgatcaatgcagctgaagaaggagcaaccattaccttagaccacagcattgtatacgatgaagaatttgatggagtgccattccttgatggtattacagtaaataaaactgtaacaatcgttggtgctgaaggtgtggaaatctgtgctaacaatttagcaagagtattcaaagtaactgatggagcaactttaaccttaaaagatgctaccgtttgtcatggtactgctcaaaaaggtgctggtgtatatgtagatgctggcgcaagcttaattgctgataatgtaacattcactaaaaacactgctgtaaaacgtggtggagcaatctactctgaaggtatggtatacataggcaactctgtattagacagcaacaacatcactttcagatctgcaaacgatgacaacggtggagcagctgtttacaacttaaacggccaattaacaatcgaaaaatctaacattaccaataacttaaaagacattgttatccgtaacggcaatgctggtgacttattggttggtgtagttgtaaccagcggcgaaactttaattacagactcatactttgcaaacaacacaggatcttggggtggagcaatcagttcattaggatacatgaacaatgaagattacaccttaaccgtaatcggcactacctttgaaggaaacaacgctaccttcggtggagcaatctttgtagaaagttccaaccttgtagtagatgactgtacctttaacgaaaacgctggcgtaggtaaaggaagccctggaagcgcaagtactcaaggtggagctattgtagtattccctagtggtactaaagctactatcaccgattccagattcaacaaaaacagcgctaatactggtggtgcagtaagccttgctggtgtagaccaagacagccttattgaaggatgtacctttaccgaaaacactggtaatgatggcggagctgtatacctctggactcaaggagatgcaaccgtaactgtaaaagattctaccttcactggcaacactgccggctggggtaatgctatctcaactgacggtgcattaaaattagaaggaaacacaatcagttcaaccagtgcagatgttggtaactgggcgggtactattgattccaaagtatatgctcaaatcttagctaatgatacatacaactggcatatgggaggattcgtaattaacgctaccttaactgatgatatgggtaacttaattaacgaccacaacttcaactatgtaattactaaagaaggcgcaactgattctatttcagttcctgcaactttctacactagtttaggttactaccaaggcactttcactcctgctgatattggaacttacttgattagccttgattatgctgttgaagaagtaaacacttcagttgtagttgtatccagatctttaattgacttagcaaacatcattgctgctgatgaagatggcatcattgacttggacgatagctatacttacattgaagaattcgattcaagcattgtagatggtatcgtaattggtaaagatgtaactataaatggtaatggacacactatctgtggtgatgataaagcaagacttttccatgtaacagataaagctttaaccttaaataatgtaactctttgccatggtaatgctttaaacggtggtgctgtatatgttgaatcagctgctactttaaatgctaataatgcagaattcaatgaaaacactgctacttaccgtggtggagctatttggtctactggtactgttaatgtaaaagattcatctttcgacaataacaatatcacttacagagcaagaaatgtggataatggtggagctgctatctttaacaatggcactttaaatgttgaccattccaactttacaaacgatcttgtaggttatgttgtaagaactggagacactaacagccctcaattaatcgatggtattattttaagctctggtgttgctgtaatcaataattcccactttgaaaacaacagcggtacttatggtggtgctataactgctgtacctatagctagtttaggttctacagctacttccttaactgtagaaaattgtgaatttattaataacttagcatactgtggtgctggaatttcaattaatgctgacggcaacggcaaaaccacttattctattaagaattctactttcataggcaataatgctacaggtgtaggcagtactggttctacaagcgcaggtggagcaatatctatagctagagattccgaaggtaccattacagattccaaattctacaacaacaccgctaccactggtggagctattgatgtaagcgctaccagaagttcttcaaaagtgacaatcgataactgtgactttgaaaacaacactgctacagcaggagatggtggagctgtacgcattagcaaaaacaatttggaagttgctgtcaaaaattccaacttcacaaacaatgacgcaactggtgatggtgcagccatttacaacaatggcgttttaacattagaaggaaacaaagtcacttccggtgaaaccgaaatctatgtaggtcctaatggttcagttgttaactcaattgtcaaagctatattcttaggagatgcagaagacaatacaattcttgctttccttggtgatgaagtacatccatatgctactttaacagatgataatggcaatgcaatatatgatgtagacttcaacatcactgttgacggcgttgaatatgaaacatcctatgatgattcaactcaacaatatactgctacatacactatcttacatgctggagacaatattgtaagcactaactatgatgctcaaaagaccgatggtaaatatgatgttcctaaagcaaacgcaaccattgtcgtaactactgaaagcattagtgtaggagacaaggctactgtaaacatcaacttaactggtacagatggtgtcggcttaaacggaactgttaaaatcactatcaataaggcattcactgatactgtagtaactgaaaatggtattaatgtaactgaagttgaaggattagaaattggcgaatacttcgtttacgtctacttcgaaggcaactctgattataaccctgaatacaactacactctattcagagttaccggtaatgtatcctacttcaatgttaccattgaagatgtaacctatgatgatgctgcaactattaaggtaaccgttcaagatggtcctatagacgatcctgacaacggcgtaactggcattgtacttgtaacaatccaaggaaaagatgtaaactttgaaaatacctatagcgtatctgtaattgcgggtgaaggatcatacactgtagaaggccttgcacctggtaattactcatatgctgctaaattattagcagatgagctttacaatgaagcttatttagaaccacaaaacttcacagtattcgaaaacccatactctgaattagaagtaactgatgacggccctattgcatctggtgaaactgtaaacattacagctaccctcactgacttccaaggcaaccctatagaaggagctaccttagaagtatatgatactggcgtatggattgctaatattactaccaatgcagaaggtattgctgaaacttctattgataatttaggatatggtcttcacgacattactgtaatattcaatgacactgtacacgatgtccaaactgaaaccgtaactgtatctgtaactcctaagaagggtactttcacagacttgcaatacttaatcgacactgctgatggaagattagtcttgccatacgacttcgcatttgatgcagcttatgatgaacaattcttcttaacaggtgtgcttgtagacgataacattattatctctggcgctggacatatcattgacggtatgaaaaaagcaagaatcttatacatcaatgctcctaatgtcaagatattcaatgtaagctttgtcaatggtaaatctgatgtaggtgctgctatttacaccgaagctgattacttacttgtagacagctgttacttcgcaaacaacgaccctgaagctggtgctgcaatctatgctgaaagcggtgtaactgatgtagaagaaactatcttcttcaataacactgctgtaaacggcggtgccatatatgttgaatccggtgctacattaaacgttgctgattcagaatttaatcaaaacactgcaacctaccgtggtggagctatttggtctaatggtactgttaatgtaaaagattcatcatttgataaaaatgatatcacttacagagttaaaaacgatgataatggtggagctgccatctttaacaatggcactttgaatgttgtcaattccagatttacaaataaccttttaaactatgtcataagaactggagatgataatcatcctgaattagttgacggtgttattttaagctctggaaaagctaaaatcagcaattcccactttgaaaacaacagcggtacttatggttctgcaataactgctttacctataggcactgaactcagtgatttaactgtagaaaattgtgaatttataactaacttagcatactgcggtgcagctatctatgtaggtagtggtactacattattctacattaatgactgtgttttcataggcaataatgctacaggtgtcggcagtaacggatatgttgctactggtggtgctattaagatagctaagaaagctactggtataattgcagattctcaattctataacaactctgctgctaacggtggagctatagatataagtgctactagtggtaatactgcatcagtacttattgatagctgtgtctttggatataatgttgcagatcaaggtggagctatctacattgataatagaactacagtaaacctttatgactctacattatactacaatgaaggtgaagctctcaattaccacatcttcttaaatggagatgcaactcttggctttgaaggtaataacttctatacaacaatacctaccattgtagcagaagacacctacgcttacggtgaaaccataaccattaatggtacattcgattggggagtaaacaacaaacctatcaatatgatttacaccattaacggtgcacctggcactgcagaagtagttgatggcaattacacaatattaattgacaatcaaccagatgtaggtgattacactattgtaattactgcatttactgatgaaaacggaaatgtataccatgtagaaactgctcaaaaaacaattagtgttactaaagcaacccctatcttatctgttgaaggtgatgaatacttaatgcctcctagtgatgatgctactgttaccatttctcttaccgataaagatggaaacggtattaagggcactgttattgtaactgttgctggtgaaacctacttagttgaaactgatgaagatggtgacggcgagctcactattaatgacttacctgctaccacttgggccattgacgctaaattcataggcaacgataactataatgaagttgtaaacgacactgaagagattaccttcatagctgatgttgcatacttcgacataattatcgaagacggtgtttacggcgataagcttactgtcatagttgaaaacgcaactgacattgacggcaatagcttaactggaatggtcacaggcatgatttctacaggcgatgatgacatttcattcatagtatatgtgaataacggtcaaggaaccaacactaccactactgctggcggagttggtaaattcactggagatgcatacttctatgattcaatgatggaatttatgtccggccctgaagaatgcagtgcatatgtaagcccagctaatgctacattatatctagttccatgggatgcagatgatctatcatcagacattgcatatggcgataccatagaattcggcgctgccgtattcggtgtaaatctagaggaattaaacggtactgtatattacatcataaccgaattaaataaaaaaggtgaaattgcgattgtaaacggatctggtgctgtaaacctcactgatattttagatgtaggaacctacactgtcataagctacttcgtagatgacaaaggcaactacgacccagaatcatcagttaactacactaacttcaaagtggccaaagcaacccctaccttaaatgtagagaatgctcaacaagtatatgctgataccaatacaataacattcaatgttacaggcattgatgataaaggtgttaaaggtactgtaattgctattaaacctatttcagaagatgtgtctggtgcaatctacgatcctgaaaccggtcttggagaattaacattcaatggtttagttgtgggcgacaatccaattgtagtaaaattcttaagtgacgatgataactatgcaaatgcagaaaagaccattaacataactatcactcaagctacacttgcaatcgactctacaataaccactcaagaaattgtatatggcaaagatgttgaagctgatgtaaccgtaaccggcatagtccaagaagatactgtaattgcaaatgtcagtttatacgacaacgctactggagaattattagactcctttaacattgcccttggcttggaagacagcatctcattcgaagacttagaagttggcgactactactacacaatcgaatttacaagcgaattatacgctggagacaacttcacatctgaagtattcactgtaaacacagccgaaatccttgatttagattcttccaatgtagacaatgtatcctacggcgaaggaatcgacataaccgtatatgtagatggaatgattgaaggagacctcattgaagttaacttcactgtagttgacgcaacaaccggtgacgatgtattcaatggaacttacaacatcagcaacggtgatgttatcacagttcctccattagatgtaggtaaatacagctatagtgtctcattctatggagatgataaatataacactggcggtgcagattccattgctgctgtcggaagctttgaagtattggatatgtctgatgtagatgttcttgtcactgcagatgaaagcatcacttacggtgaaaaggtcactgtagaaattgatcctatcgtttctgaaggtggattacctgtaacaggtactgctaccatttatgtatatgatgatccagcatctgtagatcctgtatatgttttagctgatgtagaacttgataaagacggcgctactgcagtccttgataccatattgcctactggcgaatactggattgttgtagactttgaaagtgatgatggctactatgatggcagaggcgtaacttcaaccattgttgatttagctctagctaaattatccatagaccctatcactgttacctatggcgaaaccatccctattactgtaacagctcttggcaatggcggtgaactattaaacggaaccgttgaatttaagatttacggtccaggatttgaaggaacagtcactgtcaaaaatggtactggagtaaccaatattacagaaaggtttgatgttggaacctacactatcatagctgcatttggagatgatggtgctaattacgaaggattcaacattacttccttagaaatcactcctgctacccctatagtccgtgtaactggaagtgaagttgaatatggcgaacctagcactgtaactgtcagtgtaagtgacattgatggcatgccattatccggtaaagtaatcgtaactgttgactgggtcgttgacggtcttacccaagtaattgaccttgacgattccaatgaagcttcattcgatctcagcccatatgtccatcaaggaacatacgatgtaactgtaacctacattgcaaacggcaactacggcgaagctgtaaacgacactgaaacagttaatgtaactgcttccactaccgctacagttaacgttgaagttccagaggacgtatcatacggcgatgaactaactatcaaagtcactgctgaagacggcgctggcgaacaaatccctctagaagcagtcaatgtaactgtaaacggtgaaaccaaagaataccctgtagatgaaaacggcactgtaaaccttggcgtattgcctgcaggagataatgaaatcaccgtagctctcgatgacggtactcacaagcctacaaaaactgaagctacagccaaagttgctcctgctgaagctgttgtatttgttgacactgacaatgataacccaagctatggagatgtcgttgttgtaactgtcaatgctaccaacaaggacaaacctatagatgccgatgcatgtcttgttgtagacggctacttaatcggctactacgatcttgaagacggccaagttgaaatctctattaaagacttagcccctggcaaacatgaaatcgaggtttcagtcgcaaacggaaactactctgaaggtagttacggacgcgcaattgtcaatgtagataaagcaactcctgtaatttcagcagaaggcgaaacagtcgaatggggtgaagttgcaactgttaaagttaatgcaaccggtgcaaacggcgaaaaattaaacattcctttagtagtaagagtcatctgggaagtatctggtgtcgatgaacttattgaaattgaaaacggcactggagaagctgctttccaaatctccaactatgttgctcctggaacttacaatgtaactgtcatattcttaggaaatgatgaatattacccagtaaacaacactgaggctaagattatcttaaccgaaccaaaaactgttgaaatggaagtatccatcacccctgacgaatacggcaaagctacaaatgtaactgtaacccttaaggacgttgcaagcaaaccacttgaaggctcaactgtaaccgtaactgtagatggcaaagaatacgctaacgctacaatcggcgaagacggaaccgtaaccgtccctgtagaaggattagaagctggcaaccacactattgctgtcgacttcgatgacggtgaacactcccctgttcatgaggaagaaaacatagcaattgaaccatcaactgatgctaccgttgaagctactgtaaacgtaggcgaaaacgaaaccactgttgatgtaattgttaaggattccacaggtgaaggcataaatggtactgtaattgtctatgtagacggcgaacctgtcgctaacactacagttggcaatgacacttcaagcgtatccattggccaattagctcctggcgaccacacagttgacgttgaatttgtaaaccctaactatgctccaacaagctactccactcatgtaacagaatctacttcactcactaacatgacagttaaagtagacaagaaaaatatcctctatggtgaatcagacataactgcaaccattgaattcacctcagaaggcaaagctcttgacggtgtagttgaagtattgttaaacggtgaagcacaaaacgtaactgtaaccggcggaaaagcaactgtaaaattcagcgacttagctgcagatcactacactgttgtaagtaacttcgctggaaacgctacatacgctccttcaagcgactcagcaaacttcgtagtggaaagaaaagcaaccaagttcaactacaacgacatgaataccacagcagtcaaccctaatgttgatggaagaatcggcgaatacttctacttccaattagttgaccaagacggaaaagcccttgctaacaagagcgtatccatcggattcaacggaaaagtatacaaccgtacaaccaacgaaaccggttgggctaaactccaaatcaacttaagaatcgtattcggatacacctttgcaatctcattcttaggagacgacaactacacaggcgcattcaatgtagccttaatcaacgtaagcgctcaaactcctaagctatccacaagcagcaaggtttacaaagcctctgctaagactaagactttaactgcaaaactcttaacaagctctggaaacgtggacaaaggtaaaaaactaacatttaccgtaaacggtaaatcctactctgcaactaccaacgataaaggtgtggcatctgtaaaagtaagcatctcccagaaaggaacttacagttttaccgtcaagaacgctaaagacaatacatatgcctctgtatctaagactgcgaagttagtaattaaatag

SEQ ID NO: 1620 - DNA, 1794 bp, Methanobrevibacter ruminantium
gtgtttaaattgcaaagtttagagctctctggtatgtctgatgaagaattgaaaggtcttaacttagagggcaagacctttggcgtaattggagtatgtggcgtagttggaaaccttgttgctcgtatcattatggataacggatatgaggtaatcggtacagacatctcatctaaggaagattgcagattctattcatcctttgatgattatgatattgaaatattctttggaggccatccagatgaattctttaagcaaatagactttatagttccacctccaagcatgagtgatgatgctaaggttttagagcttgcaagagagaaggggattgatattcttcatttaggagatatttttaagcttttcaaggcaaacaaacctattttatgcattagcggcactaatggaaagaccaccacaacaactcttttaaagcatattgcatattccaatggaataagccctgccgaacacaatcttaaggggatgcagggaaacaacgaatttattccatcacttcagacaaggcttcatggggatgtggctattttggaaactggaacagacggcactcctggcggattgaagtctgtaatcgatttgacccatccaaattatggaatcttgacgaacatcacaatcgaccacctggttgaccctgatgaccataaggacggcgttgatgaaagtctaagcgcaatttcattggatattggtgacgatgaggtatcccatatcgacagaggatttcttgaatatgcgagagttaagggtgagcttatagagggaatcgaagaaaacgacggcctattgatttacaatagcgacgatcctaccattgtagggcttttggataagttgaactacagcggcaaatccattagctttggggtggaaatcgatgaattcgataattttgagttggaaatcgatgaattcgattttgattcctcatttgattctgtttcccctatcaaaatccacacaaagccatgctggtgcggcagagatattaagatatatgaaaccatctcaggcagcggattctatgaatgccagtgtggaataaagtatgaaaagcctgtttacattgcaaaggatatagatttaatgaatcgcagcttcaatcttgcatctcgagacgatgagtttgaatttaagctgacacttgatggacttcataatgtatacaatgcagttggagccataatcgctgcaaaagagtttttaggcctatccaatcaggatattcaaaaaggattgtccacattcaaaggtgtggctggccgtatggagataatcgataaaatagaagacactacaatcatggtggattatgcccataatcctgcaggggtcgagaccatattggatgccatatccaagatatatgacaagacttgtgtagttattacagtcagttcggagtcaggggttgaaggggacttcgatatacttgattcagctattggaaaagtggattatattgtccctgcttcacatgactgcaggtatgctgccgataagcttattgagttgacaaaggaaaacaggcaagaagaacttcatttaaatagtgtttatactttagatgagctttgcaagacttttgtattgacagatgaggatttaaagcaggaatccattaaaacacttggagcaagcgaagaccaggtgataggaggacttaaggaggcattgaaccttgatactgatatcattctcatcatcggagaagctgcatttaagtttgaatcagctattaaagacttctgtgatagtctttga

SEQ ID NO: 1621 - DNA, 1497 bp, Methanobrevibacter ruminantium
atgaatgttattgttgtaggagcaggaaatgcaggtcgtcctgttgcaagattattaaattatgctggccacacggttaagataacagatcccaagaacatagaagacttccatatggatgttcaaaagacattaaggcttatggaaagcgaaggagttgaattggacttaggagtattcaagccaagtcttgatggaatagacacagtctatctctctccaacagttcctgaaaactctccagcctataagatcattaaggaagctgatttagacgtattcaccaatgatgactttggcagattggcagacagcttcattgacattgacataatcggaataaccggcagcgtaggcaagaccagtaccacccatatggtgactgaaatattcagaactgcaggttatcaggtttggatctgctcatctatgactcaaaaccttgtaagcgaagtcattgtagacggaataatcaagggaattcctgaaaagtctgacattgctgttcttgagcttcctcatggaacagccggccttatggcagagcttaagcttaaggttggagcactcttaaacatatatgaggagcacctttcagagttcggtggctctatggaaagatacacccaaaggaagatgttcattgccaaaaacagcgaaaacttcattacaagcattcactgcaaggacaccgtaaaggaagcaagacctgatgcaatcttttacgcaatggttaaggacctccctgcttatgacccatccaagaaatcactcttctttgacaagatagcaaactttgaagagatagctatcggagaaggccaagtatgcaatttcattggagacagtgctaaaggcgctattgaaattggctataagtttagaaacaagtcaaatgagcttagaaaaggaagcttccagtctgagttccatatgatgagctattattatgagaatgcggtggcagcaactgctatagcaatggcatatggattaagcgtagagataatcaaggaagggcttgctaacttcaagggtctttctgtccatatggagtatattggagactacaatggtagggaagtttatattgatgcatcatatcttattgaaggtattacagtcgctcttgactttttaggagataggagtcttgttctgcttctggataactttgatacttccacttacagagataagaaggaaaccggtaagcttatgggcaaatatgctaatgtcatggttgccacaggatttaatgaggtttatcaaagggtagatcttgagcctgctcaagagctattggatgcagctgttgactcagatgcagttaaagttatagctggaaccatgcaggaaggggctgagcttgcaatcaagtattcaaagccaggagataccattcttcaccttggacctcaattgatgcaggaccctgaaggaattatggaaaagatagttacaggccttgaggaaggttgtaagaagtacaaatga

SEQ ID NO: 1622 - DNA, 972 bp, Methanobrevibacter ruminantium
atgaaacgacccaaaaaaatgtacaatccagaggacatgtttataaaaagaagcaatacataccttggaagagtaatgcatagttttcttaaactcccaggcagatatgtaaacagcagaacaaaccaatatcctgacttttttggaaaggaaagaaaaactgatgcaactatattagttgatttggaattagaaatggaagaatctgaagttctagaaagctcatatgaagtttttgtaagtgaaaaggaaactgaagagatccctcaattagcagaatgcctccacaatgaaaaaggaaaaatgattatcgacattgaagatgaaagttcaaaagtagataaacagactttagcaaaagattttgaatataattatatcattcattatgaatcaggattaccagtttattctgtcataacaacccctattccattaaaaagatgtaagacatgttacatatctggaaataccgtctttaagccaattataaaatcttatgatgaaatggatggtgaagctaaattaaaagaatttcaagaaaaatatgaaagaggagaatatttttctgatttggaagggtatgaactaatcagcatccctagaatgtatggtgaaaaaggaaatgaggtcattgaagaagtttgcatcctatttaataaaataaaaatgaaaaatggaagagtgaaaatacaattagcaagatgtttagactgccttataaacaaatatggcggaacattagaagaaataaatcgcttagaaggactgataaacatgacaaaactaataaatctagaaaaagaatatgaagatagactaagacaagaaggagaagaaaaaggaagacaaaaaggaagacaagaaggaagactagaaggaaaactagaactagcaagacaatttgttgaagaactaggtgtggataaagtttccaagatttctaaaattgaaaaaaatcttttactataa

SEQ ID NO: 1623 - DNA, 354 bp, Methanobrevibacter ruminantium
atgtatggccaaaaaggaaatgaagtcattgaagaagtttgcatcctatttaataaaataaaaatgaaaaatggaagagtgaaaatacaattagcaagatgtttagactgccttataaacaaatatggcggaacattagaagaaataaatcgcttagaaggactgataaacatgacaaaactaataaatctagaaaaagaatatgaagatagactaagacaagaaggagaagaaaaaggaagacaagaaggaaaactagaactagcaaggaaacttgttaaagaatatggtgtagatgaagttgtaagaataagtggcttaagcaaagaaaaaatattaaatgaaaaaaattag

SEQ ID NO: 1624 - DNA, 1236 bp, Methanobrevibacter ruminantium
atgtttttaactaatgaagaagaaaagatggctaatggagaatatggagagaccattagaaaaagcatggacatacttattgctttaggagacatttatggtgccgagaagttcgtagacattaagtctgcgcaggtctctggagtgtcctataagactataggtcaagccggacttgaataccttgaagaccttgcaagcacttctgaaatcatatataatgaaaatggcacaatcagcgataaaagcgggatagcaacaatctctgctacacttaatcctgctggaactgaccttgacaactgggaggactttggttttccagctgattttgctcgaaagcaagtagatatctgcaatgcatatggagctctaggaataagcacaacctgtacctgcactccatatctcattggaaatgttccaaggtttggagatcatgtttcctggtctgaatcatctgctgtggcttatgtcaattctgttattggggctcgaaccaatcgtgaaggaggtcctggggcgcttgctgcagctattgtgggaaaaactcctttatatggcttccatttagaggaaaatagaaaggccaatcttcttgttgaagtggaatcagagcttgagagagccgactttggcgctttaggctatgcagtaggtcagatagttaaagatggaattccttattttaaaatgcaaaacaaaccttatgaggtatccaatggcaatctaaaggcacttggcgcagcacttgcttcaagtggtgccgtagcactttaccatgtggaagatgtcactccggaatttgcaaatgcagctattgatgatgtggagaataagattacaatcactaaggatgatatagtaagtactagagagaaattatccactgcagatggctatgcagatttggtttgcttaggctgtccgcatgcttcccttgaagaggtaaaggaagttgctgagatagttaagggtaaaaaaattaaaaatgagctttgggtctgcacttcaattaatattaaagaggctgctaaacgtttaggctatcttgagacaattgaaaaggcaggtggtaagatctgctgtgatacatgtatggtagttgctcctatcgaacagatgggctatgaagtgattggagttaactctgcaaaggcagccaattatgtcccttcaatgtgtggattaagggtaatttataatgatatagaggatttattggactttgaatag

SEQ ID NO: 1625 - DNA, 960 bp, Methanobrevibacter ruminantium
atggatattggaaaactagttggaaatacaccaatgattaggattgattatgaatacgaaggaaaaactggcagtatttatactaaacttgaattttacaactattctggaagcataaaggataggatagcattatatatcattgaaaaagaaaaggaaagaggcaatcttaaggatggccaagcgattatagaggttactagcggtaatactggaatagcattcagtgcaatcggtgcgctatttggccatgaggttcacatattcatgcctgattgggtctctcttgagagaagaaagcttattcaaatgtatggagctgaagttcatcttgtctcaaaagaggacggaggattcaagaaggctcttgagcttgtagatgactttgcagatgaaatcggtgcatataagcctcttcagtttgacaatgaacttaatgtggaagcccaatatgaaactacaggccaagagatcattgatgatcttccagatgtaaatgcctttgtttcaggaataggaactggcggaactcttatgggaataggcaaaagattaaaggattataatccagaatctaaagtatttgcattggagccaagtacattatccattcttaaaatgggtatggatgaaggcagtcaccttattgaaggaatcggagatgatttcattccgggaatcgttgatgaggacgtaattgatgatattgtcttaatacatgactgcgatgcaatcaatatgtcaaagataattgcacagaagcttggtttaggaattggaatctcaagcggagctaacttcttggcaagcgtcataatggataatgatgacttgaagattgctacagtatttccagatgacaataagaagtacataactactaaattgtctgagccgattgatgaaaatcctgaattgatttctaataagattaatattattgattttgaagtggtctaa

SEQ ID NO: 1626 - DNA, 1299 bp, Methanobrevibacter ruminantium
atgcttaagaagcatatcgaaaatgaagacattattagattaatttctcataatgatgctgacggattgtcagcagcaggtgttatagcaaacgccattaaggaagaaggcggacagtttcacataactattgttcctagattaaagccggacgttatcagagacgtatctaaggaaaaatatgaattatatgttttctcagatatgggaagcgcttgtatcaagcagctcaatcgtcttaaatctgatgtgattgtagcagatcaccaccagccaagcgagcacgagccaaaggataatctcattcatgttaaccctcacttatttggaatcgacggaagtcgccatttaagcggagcaggctctagctatttagtggttagaaatatgaacaagaagcatttggcttatatggcgcttatcggtgcttttggtgatatgcaatgtgccaatagatttacaggcataaatcaactaatcttaaaggacggccaagaagctggaaacttggaacttcatgaggacttaaaaattgtttccaaggcccaagagcctctatacaaatcaattgcttataccttgaaccctgctttgccaggattaactggcagattggataactctcaagagctccttgagaaaatgggggtttcatatggcataagcttcttggatttggaagatgaggaaaaggatgttgttaaggatgagcttgtaaaggtcaatccacagatatttggtgacgtttacagtgttccaagcgaacatcctgttttaagggatctggaagagtattcatcaattcttgatgcctgtggaaagaacaaggagtatggcttggccttaagcataattttaggcgaaagagaaaaatctcttgacgaggctttaaaacttcaaaagagatatagggaagaccttaccaaaggttttgaatggatcagccgtgaaggcgctcagcaattgggcagtatccagtatctttatagcgaagataaagttttaaaaagcataatgggtacaatagcaggagttggaatgtcagctaagattctaagcgatgaaaaacctgtcattggcttgtccagacttcataatgatataaaagtctctggaagagcaaccagattccttgttgcacgtggagttaatttaggcaaggctttagctgatgcctctgttaactttggcggacaaggaggaggtcatgacatcgctgcaggtgctatgataccttatgaggctaaggataatttcttacatttgcttgatcagatagttgaagatcaattgcaatag

SEQ ID NO: 1627 - DNA, 399 bp, Methanobrevibacter ruminantium
atggcaagaccagattggattatgtattctaatgaagaaatcgaagaatttattgttaagtttaaaagagaaggtaaaactgcaagtcaaattggtattatcttaagagaccaatacggaattcctagcgttaaggaagtaaccggtgagaagatcactgaaatcttaagaagaaacggacatgcagatgaatatcctgaagatttaatgaacttaattagaagagcagtaaatatcagagatcatttagaagaaaacccaaaagaccttcatggtagaagaggattaactatcattgaatctagaattcgtagattaggtagatactatgcggcaaatggccaattaccagaaggatggagatacgatccaacaaaagcagcacttctcgtcaaataa

SEQ ID NO: 1628 - DNA, 558 bp, Methanobrevibacter ruminantium
atgataacatttataactgggaacgaacataaagtaatagaagcagagaatatttttcaaatttttggtgttaaactcgagcatattgatttaggttacatggaacctcaaggaacccttgaggatgtttctaaatttggtgcaaaatatgcttgccaagaattaaatagacctgtgattgtggaagatgctggtttattcataagagctttaaacggttttccaggaacttattcatcttatgtgcaagattcacttggaaatgaaaatattttaaaacttatggatggaattgacgatagatacgctgaattcaggtcagttattgggtattgcgctcccaattctgagcccaaggtctttttagggcgtgtcaaaggtcaaatcgctcatgaagaaagaggcaatctaggctttgcttttgatccgatatttttagtgccggaagagggcaagacctttggagagcttactactgaagagaaaaatcagttttcacatagaagaaactctttagagaaatttatcaattggtatgtaagccaagatgatgaataa

SEQ ID NO: 1629 - DNA, 1698 bp, Methanobrevibacter ruminantium
gtgatatctttaggaattgaaggaactgcagaaaagacggggattggaattgtagacagtgatggaaatgtattggctatggctggaaagcaattgtaccctgaagttggagggattcatccacgtgaagctgctgaacatcatgctaaatggattccacagctaattccacaggcaatggaagaggcaggccttgattataaggatattgacttaatctcattttcacaagggcctggacttggtcctgcacttagaatcgtagcaagctctgctagaagtcttgcccttagcttaggaattcctattgtgggagttaatcactgcattggccatgtggagataggaaagcttgatactggggcaaaaaaccctgtaacattatatgtaagcggtggaaacagtcaagtcattgcatatgaatctggcagataccgtatttttggagagactttagacattgcaataggaaactgtcttgatcactttggccgtgagaccggccttggacatcctggaggccctgttgttgaaaagcttgctaaagatggttcttatattgatttgccttatgttgtaaagggcatggacttttctttctctggacttttatcctctgcacttcgtgcccatgagaatggtgagagaatagaggatatttgcttttcccttcaggaaactgcatttgcaatgcttgttgaggtaacagagcgtgcactggctcatactgaaaaggatgaggttctattgtgtggaggagtttcagcaaacagcaggcttagggacatgatgaagattatggcagaagagcattatgctaagttctatatgcctgaaatgaaatattctggggacaatggtgtaatgattgcttggctaggtcaattgatgtatgataacttcggtccacttgacattaaggacactgcaatcatacaaaggttcaggactgacgaagtggatgctccttgggtagataacagaaaggaaaagttaaatcttccagaagaattaaaggcaaagggtgccgaatctgatatttttgaagcaaaatggcttggaatggacgctattgtaaagcaaagggtctctaaatcatataggataagagaaattgatgataagataagaaggcaaagaactaaaagcgaagctaaaatcctttcagatgttaaaaagacaggtataagaagccctattttgtatgatatcaatttggatgagaaatatatagttatggaaaagctaaatggacctcttgttaaggatgtgatgcataaattggattatgataaaaggaaggaattatcttatgcaattggggaaaacattagattattccatgatggagacataatccatggagatttgactggttctaatatgatcttgttaagcgatgattctaatgactctaatgatgatttctctaaatctgatgacgatttcaataatggcgttaatttagataatcttgattttgcaaacaatttagctatttttgacttcggccttggaaagtattcagatttattggaagataaggcagcagacctcttggttttaaagaaatcattccaaagcatagattatgatatagcaaatgaatgctttaattggatattggaatcttatggttccgataagataattgataatattgcagatattgaaagcaggggcagatatactcattga

SEQ ID NO: 1630 - DNA, 1065 bp, Methanobrevibacter ruminantium
atgattgaaggattaaagacatacggctcagataaaatcgtagatgaacttaaagacttaaagaatcctatttttatatgtacaatagctacaacagaaacatctaaaatcccaggacttacaggagcaggagctactccagaactgaccaaatacacacctgcaggggatgcagagcttatcctagagggagaggtcaaatgcatgaaggacataccacagaccgtcatcggagaggttgtcactccaactccttccatgattacaaaaggttcccttgccctatgcgactgtccggttatggttcttgatgccggaagcgaaataaaggcacaaactgatgtatttgacattagcgacggaaagcatggaatggacatacgcactggaaaggctgtcgaagactcagaggaactctttgaaaaaggatactctctaggagagattttatctgaaaagcatggatatatcgttgttggagaaagcttaccagcagggacaaccactgcccttggagtattagttggcctcggatatgatgcgaaaggaaaggtaagcggatgcatgaacaccaatccacatgagatgaaaaatgagcttgttgatgaaggattaaagaatgcagggattgttccaagcaaggacaataatccatttgatgttgtcaacgctgttggagatcctatgcttccagcagttgcaggacttataatgggttccagtgtgcctgtagttttagctggaggaactcagctaactgcagcttgcgcaatagttaaggcattggatgatgaattcgacttttcaaacacctgtcttgctacaacatcctttgttgtaaaggatgagactgctaatattcttgatataatcagccagatagatgatataactgtaaatgcagttaatccaaactttgaaatatccaaagttgaaggattgaagaattatactaaaggatatataaaagaaggtgcaggagctggcggagcaatgtttttagctcttcttttaggcaatgacattaatagcattagagaatccatagaggatgcatgcagttaa

SEQ ID NO: 1631 - DNA, 201 bp, Methanobrevibacter ruminantium
atggctaatgataattttcaagtaaacaagcaatttgctaaatttaaaggtaaaaatgtccttataggactaaagaattgggaagaagttgaaggaaaaattatcaccattgataactttttaaatttagtcttagatgatggaaatggtttaaaagttattaaaggtggaaaagtagcatttatttctattcaagaataa

SEQ ID NO: 1632 - DNA, 147 bp, Methanobrevibacter ruminantium
atggcaattaatcaacttgaagctacattacaagctgtaactcatacattagctaaattggaaaaagaaggatgtagtgatgaaaaattattaaaagaacttagagaagaaagagataaacttttgcatgaattaaatcttaattaa

SEQ ID NO: 1633 - DNA, 783 bp, Methanobrevibacter ruminantium
atgattcatatgaaaattttattatctaacgatgacggtgtaaacgcttctggaattcttgctgcaaagcatgcagttgaagacttgggagatgcaattattgttgcaccatctaatcagcaaagcggaattgggcatgcattaactctttttgaaccattaagagtaaataaggttattttagccgacaatgacattggatatggagtttctggaactccgactgacgctgtaacaatcgctcttttcgagcttcttgacgaatgtcctgatttggccatatctggaataaacactggtatgaacactggtaaggcagagctaaccacttccggcactttaggagctgccatcgaaacagccacattcaatattccgacaattgcagtaagccagcatgtttcagatgatgacttgaagtttgatgaaggggaaatagagatagatttttcatctagcgtcaaggtcttaagggagcttgtaaaaaagataatcaaagacggctttcctaaaggcatagacattttaaatcttaatgttcctagccatcctgattcctatgagcctgtgatttgccctttaggagataggatgtattggccggttgtagagaaaagacatgatccaagaggcagggagtattattggattaatggagatgaatatgtgggaaaccctaaagattcagatattgatattttaaatcagaatatacctacaatcactcctttgactttggacatgactcataatatggattatttaagagagtggtatggttag

SEQ ID NO: 1634 - DNA, 711 bp, Methanobrevibacter ruminantium
atgttatctattggtcaatgttacttagaatttgttaataaaatccttaaggaaggtaaagaaacctataaggacagcgatcatcatcttaaggaatatcttggtaattattactatattgatgatcctcttgacttgaaattcagagctaaatatcagcatatgactccagagcttatgttagaggaaatcaagaagggaagatatgatattgacgcctgtccaattaaaggtgatgctttatatgaatatgtaaagtcttttgaaataagagacgatcagggctttgtctatacttatcctaatcgtatccttgagcattttggtgtagatcagtttgaagttatgaaagagagaatcctaacagctacaggaagtaacagagctgttgctgtaacctacgatcctaaattggaccatgatagggaagacattccatgtctccagtttgtacagatgcttgttagggatggggaattgactatccatgtaatattccgttccaatgacatctttggagcattctactcaaatatgttcttcatatgttatatgggaataaagatgaaagaggaagtcaataaggagattatgggagagaaattgaactttggcggtatccattatcactctacctcagggcatatctataataatgatatgagggctgctaggaagttgatttctgctaataaggctgctcttaaatag

SEQ ID NO: 1635 - DNA, 924 bp, Methanobrevibacter ruminantium
atggcatttgatgaaaatggtaaagtatggatggatggggaatttgttgcattaaaagatgctaaaatcagcgttctttcccacgtaatccattatggatctgctgtatttgaaggaattagatgttacgaaactgaaaacggacctgcagtattccgtcttcaagatcatgtacacagattatttgattctgctaaaatctataagatggacattccatttactgaagaggaaatctgtgacgctatcatagaaacaatcaaagtaaacaacttaaaaagctgttacattcgtccaataacctacagaggatttggcgaattaggtgtaaacccattaaactgtcctgttgaaaccaccattgctgtatgggaatggggggcatacataggagaagaagaaatggaacaaggtgcaaacattggtatttccacctggagaaaaccagcaccaggtaccttacctgttcttgcaaaggctgcagctaactatatgaactctcagcttgcaaaccttgaagcaggtgaacacggctacgatgaagcaattcaattagactaccacggccatgttgcagaaggaagtggagaaaacatattcatagttgaaaaaggcaagatcgtaacccctgacttaggctcttccatccttcaaggaatcactagagacagcattatgaccattgctaaagacttaggatatgaagtctcccaagaaaccatctcaagagaaaggttataccttgcagatgaagtattcttcaccggaagcgctgctgaagttactccaatccgtgcaatagacaacagacaaattggaatcggatcaagaggccctgtaactaaagagttacaagaaaaatacttcgacgcagtaaacggaagaagcgaagacattcataactggttaacttatgttgaatag

SEQ ID NO: 1636 - DNA, 1002 bp, Methanobrevibacter ruminantium
atggtatatgtaggtatggatcatggaactactgggatttcatttgctataatggatgatgagaaagttcttgatgtttttaagatatctagagaagatagtaaggctggaagagtttcagctattgaagaattgtctaaacgcattgatttagaagatattgacttaatgattattacttatgctatgggagatggaataagcactattcttcctatggaaaaggttgaaaatagaggaatactctccattggaggtgccggcaaggtaactggagggggaacatctgtctatagtgagatagagaatgctaatcttccggttttaatgattccaggtttgcataaggattgtgattggcttgacccattgtttagggcagcatattcccaccatgcaagtcctgaaaaggtaagcattgtatataatgcctatcttgagacccaatgggagaatatggtagtggctgacatcagctccaatagtgttgaccttcttattgaggatggcaagatcaagggagccattgatgcctgttgcggtgcaatgggtattgttcatgggccattggaccttgaaatgattagagacattgatgagggaaaaagaactgccaatgaatgtttctcacatgcaggagctgttaagatagctaatgttgataataaggttgcattgatgaaggatgagctattggaaatgtattccaaaggggacgagagggctgttttggctattgacacaatgattatgactgtggctatggagattgcaggtcttattgcagttagcaagaatgagatagatggaattgttcttacaggttctatgggttctatgaaagagcctgttgactttgaggctggattgaataagtactttaagaataagtatgagactaggattatttcatctgaatctggagctatcggtgcagcacagatagcaagagacatcttcaatggaaaaagagatattatgggtataaaagtggactattag

SEQ ID NO: 1637 - DNA, 996 bp, Methanobrevibacter ruminantium
atgaaaatgtattatgatgacgatgttgacgctgaagttgttgcagataaaaccattgcagtaatcggatacggaagtcaaggacgtggtcaatctagaaacatggctgacagcggattgaatgttattgtcggtcttagagaaggaggttcatcctggcaaaaagctattgatgatggaatgaatgttaaaaccatagaagaagctgcagaagctgcagacatcattcacatcttacttccagatgaaacccaagaaaaagtatataaagaacaaatcgctccttatgttgaagctggaaacacaatttcattctctcacggttacaacattcactttggattaatccaacctggagaagacgtaaacattgtaatgtttgcaccaaaaggccctggttccagagtaagaaccacttatcttgaaggattcggaattcctggtcttgtcgctattgagcaagacgctactggagacgcattgcaacttgcattaggtatggcaaaggctgtaggccttaccagagcaggtgtcattgaaaccacatttaaggaagagactgaaacagacctctttggtgaacagaccgttttatgcggtggtctcactgcacttatcaaggcaggatttgaaactcttgtagaagctggataccaaccagaaatcgcttactttgaaacctgtcacgaagtcaaattgattgtagatgacatctatgaaaacggtatggctggaatgtggcatgatgtaagtaacactgctgaatatggtggattaaccagaggaaacagagttatcaccgatgcaaccaaagcagaaatgaaagcaatcttaggggaaatccaagacggcacattcaaaaaagagtttgctgatgaaaacgctactgacgcagctaacttaaaggaaatgagagctgctgaagaaagagaaaccattgaagtcgttggtaaaagattaagaattgcttgtggtttacagaaagaagatgaataa

SEQ ID NO: 1638 - DNA, 492 bp, Methanobrevibacter ruminantium
atgagggaaaagtctcatgttattagtactttggttgaacacaagccaggtgtgcttcagaaagttgcaggactgttaaacagacgtggatttaacattgacagcatcactgtcggagcatctgaagttgaaggcttggccagaatggtttttgttgtaaaaggtgatgaaaaggttctagaacaggtcatcaagcaattgcacaagcttgttgaagttgttaagattaaggaccttgatcctgaatatgttttaaaaagagagctctgtcttgttaaggtaaagacaacaaaggaaaagtctagatctgagataatcgagtatgcagacatcttcaaggcaaagatcattgatgtatgtgatgatttcattacaatggaggtcactggcaatcctgagaagattgattccttcttgagattgcttaagccttttggaattaagaagattgctcgtacagggcctactgctattgcgagagggcatcactaa

SEQ ID NO: 1639 - DNA, 1896 bp, Methanobrevibacter ruminantium
atgagaggcggagacgctattataaaagctttaatggataaaggtgttgacaccatattcggttaccctggaggaaccgttattccattctatgacatgctatatgactcagacttaagacatatacttgtcagacatgaacaatgtgcggcacatgccgctgaaggttatgcaagagcttccggcaaggttggtgtctgcttggccacttccggacctggtgcaaccaatctggtcactggtattgcaaatgcatatatggattcatctcctataattgcaattaccgggcaagtggtaagcaatctgattggaaatgatgcatttcaggaagtggacatcataggtataaccatgcctatcacaaagcattcctaccagccaaaggatgcaaatgacattccaagcattataaatacaagtattgaaattgcttcgacaggcagaaacggacctgtattgattgacgttccaaaggaagtccaagagatggaattagatgaatatgtccttggaaccattcctacccctggatataagcctagcgtaaaaggaaatgataagcaaatagctaaggcagctaaaatgcttttggaggctgaaaagcctataatattagcaggtggaggtacaatccttgcagatgcatcatctgagcttaggcaagttgcagagcttgtcaatgcgcctgttgcaacaacccttatgggtaagggagtcatcgatgagaaggatgacttgtctatcggcatgcttggaatgcatggaaagcaggtggcaaatcagtctgtaaataaaagtgactgcctgcttgcagtgggagtcagattctctgataggaccactggaaaattagagaagttcatgcctgatgctcaagtgattcatattgatatagatcctgcagagattggaaagaacgttccagttgacttgcctattgtaggggatgctaagatagtccttgccaaattggctgatgaattggccagctccagatttgctgaagagtttgatgatgatgaattgtctggctccaagattattaagggactgatggaaaatgatttggctaaggaattatacaagagcaaattagtcaaggaaattgaaagctccaagtttaaggagaattatgaattcaattatgacagttacagcccttggctcaagtcagttgttgactttaagaatgctacaatcccaagggttagctatagcgacattcctttaaagccacagcaggtaatcaaggaaatcgcaagctccattacagatgatacaatcgtaacaactgatgtaggtattcatcagatgtgggcggcacacttcttagacatttcaaagcctcgcaagttcatctcttccggaggtcttggaaccatgggattcggccttccggcagctatcggcgctaaagttgcatgtccggatgatgcagtccttgccattgtaggtgacggaggattccttatggtctcccaagagcttgcaacaatcaaggagcatgacattccggttgtaattgcaatgctcaacaacagaaagttaggtatggtatatcaatggcagaataagatgtatgataagagatactctgaaactgacatgggaaacactccagactttgttaaattggctgaaagctatggaatcaatgctgtgaaagtcgaggaagttgacaagactcaagaggtattatccaaggcacttaaggacaatgaagccattctattggacatcaccgttgagaaggatgagtttattccaatgttcccgccaggcggagctataacagaccttcttggtgagtataaatatgaaagcgatgttaagaacgttgacttagagcaaaaggaatcagaagattctcaaaccgttgaagggggaaaatag

SEQ ID NO: 1640 - DNA, 1377 bp, Methanobrevibacter ruminantium
atgatattttctaaactggaaaataatcaattgcttaaaaaactcttaaatggagaaataaaaatgaaagtattagttgttggaaccggtgcaagagaacatgcaatctgtgatgcattaaaagatgatgtagacttatacgcttatatgagcaagaacaaccctggaataagcaagatttccacctttaaaaaaggagatgaaggggaagttgacgaagttgccaaattcgcaaaggaaaatgaaatcgaattggcagttatcggacctgaagctcctcttggaaaaggaatcgtaaacgctttagaagcggttggagtcccttgtgtcggaccggcacaggaatcagcaagaattgaaactgacaagtcattcatgagaaacctatttgaaaaataccaaattaaaggatctttaacctacaaggtatttgacaactacgaagacatcagcgcattccttgatacctatgaaaaggatgttgtagtaaagcctgtaggtttaactggtggtaaaggtgtaaaaatcgtaggagaccaccttaaagataatcaagatgcaaaagcctatgcaaaagaagttatggacaatgcaatgggtggatttgcacaagtaatcatcgaagagaaagtggttggagaggagttcaccatccaagcattctgcgatggggaaaacctagctgcaatgcctgcagcacaggaccacccacatgcattcgaaaacgaccaaggattaatcaccggtggaatgggctcatactctgatgttggaggattattgcctttcctcactcaagaggactatgatgaggctgtcgacattatgaaagagaccttaaaggcaatagctaaggaaacaaccccatacaaaggaatcctatacggccagttcatgctatcaaaagacggccctaagctcattgaatacaatgcaagattcggtgaccctgaagcaatgaacgtgcttcctctcttaaagacccctatggttgacgtatgtaaggccatcgtcgacggcaagctagaagatgtcgaatttgaagacaaggcttctgtctgcaaatacatagttccagacggatacccagacactccacatgcaggagagcttattgaaattgatgaagaggctatcgaagctcttggagcaaaggtcttctatgctgcagtaagccaagaggatgacggagtccacctttcaggctcccgtgcattgggaattgtagctcaaggcgatacaatcgctgaagctgaaaagatagctgaagaagcctgtggtcttgttgaaggaaatgtctaccatagaagggacgttggtaccgaagcgttaatccaaaaacgtatagaccatatggaagcaattagaaacgaataa

SEQ ID NO: 1641 - DNA, 897 bp, Methanobrevibacter ruminantium
atgaatgaatgtgtgatctttatgtctaaacaagctaaatcaaagaatacaataatcaaaaaggccaaaaaactggaaaggcaaggtaaatacataaaggccttaaaagtctgtgacagctatttagacaacgaaagatctgaagaaacattaatccaacttaaaatagacatattagtcaatctatacaataacgacacattcatcaatgaaatcaatgaaaacaaaagcaaaattactgattttatagaaagggatgaagagatagagcttctaaagctttacaacactttagacaattatctagaattgaactctcaaaatatggctgatgagagaaaggttggaacctatctcgccggaggcctattggttgacaatttagagactatccttgttttaaatgaaatggctaaggacaataaggctgaaaataaggagccatttaaagcaaattccgacttgttagaattcatatacaatgtcaaaaagacaagctatcaatatctggaccttatcctgccaaactcacttgaactattagccaattccaattttaatattgaagcaatcatttcaaagattagacagtttttagagcctaaaaaatctacagattctaaggaagaaagcattaaagaaaatgaagaggatgattcagaccaatccgattcaaaaaacgccctaaaatcaaaagatgataccgaattaatttcagattatagcatagaagatgagatgaaaggcttaaaagaaatgattagctacttaaatgataaaaatgaatttaaaaaagccctaatttaccaaagaagacttgtaaaattagcaagagaggaaaacattagagcagaacaggaccatgattccaagcaaaagacacttagcgactactaa

SEQ ID NO: 1642 - DNA, 915 bp, Methanobrevibacter ruminantium
atgagaagtcttttatcagtctgtgatatagaagaagaagtagaaacaatactcaatattgcaagtgactttaaggcaggcaaaatcgaagaaaagccccttaaggaccaaaagctagcaatgatctttcaaaagtcctctacaagaacaagagtctcttttgaagttggaatgtatgaattaggtggaactgcactgttcttatctacaaatgatatccaattaggcagaggagagcctattaaggacaccgctaaagtcttaagcagatttgtagatgtaataatgattagggcaatcgaacatgacgatgtcatagagctcgagagagagtcagacgttccaattataaacggccttaccaatcttgagcacccatgccaagcattggcagatatgctcaccgtaaaggagcataagggtggattcgatggaaaattcgtttatgtaggtgacggaaacaatgtctgtaactcactactgcttatctgcggatgtttaggaatggatatggctatagcatgccctgatgaatataggcctaatgaagaaattaccaaaaaggctaaagaatatgctaaagctaacaattccacaataacaatcacatcagatatagaagaagcagtaagcggcgcagatgtaatctatactgacgtatgggtaagcatgggagatgaagaggaatctgaaaaaagaagagcagactttaaggactaccaagtaaatcaaaatcttattgatatggctgatgatgatgtcatattcatgcactgcttgcctgcaataagaggagaagaggttagcgctgaagtgattgacggacctcattctgttgtctacgatcaggctgaaaacagaatgcatgctcaaaaggctgttttatattacttcttaaaagaattgtataaataa

SEQ ID NO: 1643 - DNA, 984 bp, Methanobrevibacter ruminantium
atggaatttaacgaccctgcattggagcatttggtaaacaagatcacagttgcgctgaacgagaacaataaggaagatgcagcacattatatggacattatcatagataagtaccctgaagttgcaaatattttaatgaactctatcgagtttcaaaacataatggctcaaaacgaagatgttgaaggtgaagaagcatcagatgactttgcaatccagcccggaagtgctatggaacttgatgaagagaaaatcataaatgacatgaatgcaatgcttgatatagagccaaccacagctcaagaatacattcaaaagggtacagtattaacagttaccgaagaatatgaaaaggcattggaatgctttgacaaggctttagagttggacgaaaacaatctttcagcactgatatcaaagggaaacaccctagagcttatggaaaaattcgatgatgcctcaaaggtatatgatgatgttatgaacactgaagtggaagaggtctatgaccttatgagcaaaggatatatctttgaaggccaccaaagatacaatgacgccttaaaaacatatgacaaggctcttcaaaaggaaagatataacgctaacattctatttttaaagggaagctgtctaatcaagcttgaacagtaccaaaaggcaatcgacagccttgaggaagctatagaaaggtatagcgaaaacccatatgaaaccatattcgagcttgaaaacgcataccacaacaaaggagtctcattgcatgcaatcggtgaagatgacgacgctcttgaagcattcagccttgcattgggattaaacccagaatactactactcctactatgaaataggcataatccaagaggacagagaaaagtatgacagcgctttaaagaactataataaattcttagaatatgacaataccgactctgaagttgtagaggctaaagaaagagtagaagaattgttaaaagaataa

SEQ ID NO: 1644 - DNA, 1722 bp, Methanobrevibacter ruminantium
atgtattttaaaataaagactgaagctgaagaggctttaagaaaggcagtcgaccagtttgactgtgaatttgatgaggaaattaaattggagtttcctcctaatcctgaattaggtgatttggcaagtacaatttcattccaattagctaaattgcttcgcaaggctcctaatttaattgctcctgaagtggttgaaaaaatcgagcttccagagatttttgaaagggtggaagctacaggtccttatgtaaacttcttcattaatcatgacatctttgcaaagcagctattggactctgttgatgaggattatggtcaattggctgcagtagatgagaagatcatattggaacacacctctgcaaaccctaacggtccgttgcatattggtcatatcagaaactctgtaatcggagattcattaaggagattgcttacaaaggcaggatataatgtggatacccaatattatgtcaatgatatgggaaggcagttggccatgattgtatatggtatggaagagcttggattgaagcttgaggaccagccagcttccaagattgaccacaaggtgggagagctttacttcaaggtaaaccaaatgattaaggaagatgaaagcttgaacgatggcgttgatgcaactatccgcaaatatgaaggcggtccaagcgagcttgatgagaagtttgaatatgctgtcaacagctgccttgaaggtgtaaaggaaaccttgaagagaatgaatgtaaagcatgacgcctttgtatgggaaggacagttcgttagaactggcattgtagacaaccttacccaagagctttatgacattggatatgcaaggcaggaagaggttttataccttgacttaagcgaattcgacattcctaaggagctagtccttagaagggcagatggaacttccctttactctacaagggacattgcttatcacatttataagtctaaaaactgtgacaagatcattgacatattcggctctgaccataagcttgcagcaaggcaggtggagcttgcacttgagattcttgaggaaatcgagccaaacagcgataagattgaagtcattttctatgagttcattaccttgcctgaaggttccatgtccacaagaagaggagtcttcatctctgtggatgagcttatggatgaggctgttagaagggcaactgaagagattatttctcgcagaccggaccttgataaggaaactatcgataagattgctgaagagattggtatcggcgcaatcagatattacattgcaaggctctctcctgaaaagcacataacattcaagtgggatgaggccttaagctttgagagaggatgcgcttcaattcaatatgcccatgcaagagcatgcaaattgcttaagaaggctcaagaggaaaagggcattgatttagctgacttgactgttgaggatacttggtccttggatgaaaacgagaaggagcttgttaagttgattgcaaaattcccaagtcttgtggaagactctgctaagattagaagggtccatcctattgctcaatactgtcaggacttggctagcgcattcaataggttctataaggcagagcaggtaattggctctgatgtggaaaatgcaaggcttcttttggttgaaaagtctagaatcactcttaggaatgctcttgaccttttaggtgtgagtgcgcctgatatgatgtag

SEQ ID NO: 1645 - DNA, 1656 bp, Methanobrevibacter ruminantium
atgaatagcgataatataaaaaaaggagttcaaagagcacctcacagatcacttcttcgtgcttgcggacttaatgataatgattttgacaagccattcatcggaatagcaaacagctatacagacatcgtacctggtcatattcaccttagggaacttgtcgactatgtaaaggaaggaataagagaagctggagctattccatttgaatttgacaccatggccatctgtgacggaatcgccatgaaccatgacggaatgaaatactcacttgcctcaagggaaatcgttgtaagcactgtcgagagcatgaccatgggtcattgctttgacggacttgtcctcatgcctagctgtgacaaggtagttccaggaatgcttatggcagctgcaaggcttgacattccatcaatattcctaacaggaggtcctatggctccaagcacttacaaaggaaagaatgcagacctaataactgtgtttgaggctgtcggcgaactctcatcaggaaaaatcactgaagatgagctttttgaattggaatcctgtgcctgctcaggtgctggaagctgttcaggcctatttacagcaaacaccatggcctgcattaccgaaacccttggaatgagccttccatactgtgcaacaacactcgccctctcagaggaaaagaagaaattggcaatagaaacaggaaagagaattgttgaaatggtaaaggaagacttaaggccatcccagatcatgacacaggaagcctttgagaatgcaattgcaatggacatggcccttggaggaagcagcaacactgcactgcatattccagccatcgcatatgaattggaggagaagggagtccatgcagatttggacctatttgaccagataagcgataaggttgcacatattgcacttctatctccagctggccaggacactatggcagacctccataacgacggaggaatcccagctgtcttaaagacaatctcctctaaattagacacttcagtcatgacctgtacaggaaaaaccctagaagaaaacctaaaggatgcaagtgtcacaggaaatggcgttatacacactttagacgacccaatccacgaagcaggcggacttactgtactcaagggaaaccttgctcctaacggctcaatcgtaaagtctgcagcagttccagaggatcttatgcatcttaagggaccggctaaggtctacaacagcgaagaggaagctgtggaagcaatattcgaccatcagcttaaggaaggagacatccttgtaataagatgcgaaggacctaagggaggccctggaatgagggagatgcttaaccctacctcagcaattatgggaatgggaataaagaatgtaggactaatcacagacggacgcttttcaggtggaacaagaggcccttgcataggccacgtatctcctgaagcaatgagcggaggtcctattgcagcccttaaggacggagacataattgaaatagacatagcaaatggaaatttaagcgtagagctatctgatgaggaaatcaaagaaagaatagagaaagccgacctaccagaaaagaaggtaaaaggatggcttaacatctacagacgttccgtatcctcagcagacgaaggagctatcttaagatag

SEQ ID NO: 1646 - DNA, 324 bp, Methanobrevibacter ruminantium
atggatattaaaggaactccaataaatgtagaagatatgattcaatatcaaaaagactctgttgtaagcatggaaattataaaaaaagagcttggaactgtaaccctatttgcatttgaccaaggccaaggattaagcgaacatagcgctccttttgatgccatggttcaaatagtggatggagaagctgaaatcacccttgcaggtgagcctcatacagtcaaaaaaggcgaaatgataatcatgcctgctaatgtcccacatgccttgcaagcagttaacatgccgtataaaatggtcttaaccatgattaaatcagattag

SEQ ID NO: 1647 - DNA, 1299 bp, Methanobrevibacter ruminantium
atgagtgatttcaacatgttttgttatcaatgcagccaaactgccagaggcagtgcttgtacaaatgcaggagtttgcggaaagaacgcaactgttgcaagacttcaggataatttgatcttttcaatgaaaggaatatcagcttacaattatcactgtaaggagttaggagtaagcgacgaatctgtagacgaattccttacaaaagggctatacactaccctaaccaatgtcaactttgatatcggcgaccttgtccaattggcccttgattccggtgaagccaactttaaggttatgaagatgcttaaggaagcccacattgaaaacttcggtgagccagtgccagctgaagtaaaggtaggggctcaagaaggaccgggaatacttgtaaccggccacgacctaaaggcattggaagagcttttaaaacagtgcgaagggactgacgtaaaggtatacacccacagtgaaatgcttcctgcccacggataccctgagcttgcaaaatacgaatcccttgccggtcagctaggaggctcctggattgaccaaaggaaagtctttgctgattacaatgtagccatcttaggaacaaccaactgcgtattgcctcctaaagacgcttatgctgacagattattcaccatggacatagtaaagattccaggtgcacaggtaattgaggattatgacttcaagcctttgattgacaaggcaatcgaattgggaggacttgaagcggaagagctctccaccattagcacaggtttcggattaagcacaatactgtcccttgcacctaaaatcaaggaattggtacttgagggcaagataaaaagattcttccttgtagcaggatgtgacagtccaaacccaagaatgagctattacagagagtttgtagagaatgttccagaagactgcatagtattgaccttagcttgcaataagttccgcttcaacaatcttgaattgggagacattgaaggaattcctagattattggacttaggccagtgtaatgatgcaattgtagcaatcgagcttgcagtagcattatgcgagctctttgagatggagcttaatgacttgcctttaacaattgtcttaagctggatggaacagaaggctgctgcaatcctttggacattgctatatcttggaaagactgacatgttcataggaccggttcttcctgcatgggcaaatgatgacatattgaatgttttggttgaaaacttcaatctcactccaatatcaacccctaaggaggacattaaaaaggttatgggttaa

SEQ ID NO: 1648 - DNA, 795 bp, Methanobrevibacter ruminantium
atggagaatattatcgaatcattggagaagttcggccttacaaggtatgaggcaaaggcatatataggaatgacaaacatcataagcggaaaggctgaggacattgccaaggcctccgagataccgcgatcaaagatctattccacattaaaggaactggacaagaagggattcattacaataacccatacaaggccaatcgaatataaggttgtccctccaagggaagtctacaaaaggaaaaaggaggaattgattaaagagctggaagactcagaggaaaagctggatgagatatacaacagccaaatatctgaagtacaggctcctatctggcttataaaaacaagcaagaacataatcaataaagaagttgagattgtaaagaagacaagaaaatcattgaacatgagggttggattcctccttgaaggggaaggtgaggagcttatcaaggcattcaattcaattccaagaaacataccgatcaagatacttgcaagcccatactgctatataaatcaggaaaggattgatatcattgaactgtttgaaagtgcaaggcttgaaaaccttgaaatcataaaggcagacattccttttgttaagataattattagggatgaaaaggagctattcaggacaattgtaaagtttacaggaaaggaaaagtctgtattgcctgagactgctgtaggtgtattgaatcaatattcagacatctgcaagaactttgatgagcgttttgttaatcagtttaataggattaaggcaaaaaagagtagtatgaattaa

SEQ ID NO: 1649 - DNA, 777 bp, Methanobrevibacter ruminantium
ttgttaaaagcaatattcaaaggtggagacttccaatgttcacagggcaatggaacaataatattcgaattagcagacaactcctctaaattgatatttggcccagatggaagtgttgcaagtttaatatcatctgacatattggaaaataactatttgaatggaggcatggatttaggaaccttcaatttcctaaaaaactccacaataatttccaatctaaaaagcatagtaaactcatcctactatgatataaattgtttatctaattggataatatctttggtaaatgattcggatattaatttcacagcaatagtctcctatttgtctgatcctaaattagttgcaagtgttgtcggcggacttttgtttgaagcaggtatgattgctcttcctactggtttgcctggacttgccttgttggggcttggtacagtgttaacagcttatggcagtggaatgttcgatgatttaggaacagatcatccaggatatgcaaagccggaaaatcaattaaacttcggattatcaatgacactgaactttttaggcttaggtggtagtgaaggttttcttaggggagttttatacaatgaagttcaagaaaaactagtagtaggattcgtgccatctattaaagcctatggaaaaacaataattaaagagacattttatgatgataatggtgttttagcaggtgttgctaaaagttattttgataatattttgcaaaatatcttatttgacactttccttaaatggggtgtaagatga

SEQ ID NO: 1650 - DNA, 240 bp, Methanobrevibacter ruminantium
atgaatgagatagttttatttggagaggatatgaaagaagatcctcataaatacattaaagagactttggatttcccagattattatggggaaaacttggatgctctatttgactgtctaagcgaggtttataataagacaattattataaaggacagtgtattggtggatgaagatataattcagacattcgttgatgccaatgatgaaaatccagatatggacttgattttagattag

SEQ ID NO: 1651 - DNA, 1827 bp, Methanobrevibacter ruminantium
atgagagtattgcttattcactctgattatataaaatatcaagtaaaaaacaaaactccagtggctgaagagattgaagaggctaaagaatcaaatgccttcgaagaggctttggttgtctttacagctgttgaaaaggaagatgagaaaaatcctaatgcagttgtcaagaacttagttgctgaagttaaaaaaacaaatgaagaagtaaatgctgaaaggattgtattgtatccatacgctcacctttcctcatccttaagcggccctaaagtaggggttcaggtattgaaagacgctgaagctgcccttaaggaagaaggattcgaagtgttcagagttccattcggctggtataaggcatttgaactttcctgtaaaggacacccattatccgaactttcaaggaccatcggtgctgaagaggaagctgaagaagaggaagaagagaaaaaaccatccaaatggcttatctttgatgatggggaaacaatcgaacctaaggaatacaattaccaaagcaaagaccttgaaaaattagttgcatatgagctcggcgaaggggcttcagacgaaggagagcctccacatgtcaagatcatgagggaaaaggagctatgtgactatgaaatcgcatctgacataggtaacctcaaatggtatcctaagggcagattggtccgtgacttgcttgctgactatgtatacaacttcgttgtagacttaggtgcaatgcctatcgaaacccctatcttctatgaccttgcaaacgatgcaatcagggaacatgcagcaaagttcggagaaagacaatataagactgcaaccaaaaaggaccttatgctcagattcgcatgctgtttcggtgcattcagagttttaggagactctttccttacctggaaaaacttgcctgcaaaggtttatgaactctccacctacagtttcagatttgaaaaaagaggggaagttgtaggtcttaaaagattaagggcattcaccatgcctgatatgcacagcttctgtgcagacatgccacaagcattagaggaattcgacgctcaagttgacatgtgtgtccagactggagtagaccttgacgtaaactatgaggcaatcttcagggcaactgaagacttctatgaggaaaacaaggaatggatggaagcaacagcaaaaagaatcggcaagccattgcttttagaaatcttaccagaacgtaagcattactggtcctgcaaaatcgactttgcggctatcgactaccttggcagacctattgaaaaccctaccgtacagattgatgtagaaagcggtaaaagatttggcatcgaatatatcgatgaagaggaaaatcctcaaaaccctataatattgcactgctcaccgactggaagtgttgaaagggttatctgcagtttgcttgaaaacactgcaaaagaggatggaaaggctccaatgctacctacctggctctctccatcacaagtcagaatcttgcctataggagaaaagcatcttgaatatgctaaccaattggctgataagattgcagcggaaaacatccgtgtagatcttgacaacagcgatgacagggtcggtaagaaaataagaagcgcttccaaggaatgggtcccttacataattgtaattggagacaaggaagttgaaaatgatgtctactctgtaaccgttagggaaagcggtgaaaaggtagacatgactgctgaagagttaattgcagaagtcaaggcaaaaaccgaaggcatgccatttagaagacttccattacctagaaacacagcagaaagaattaattttaaataa

SEQ ID NO: 1652 - DNA, 1239 bp, Methanobrevibacter ruminantium
atggtaaaaaaagacgatacaatgtttataggtgaagctcttatcggagacggagacgaattagcacacgttgacttacttatcggcagaaaagatggtcctgtaggaaacgcttttgctaatggattaagccaattatcagttggacacactccattgctcagtgtaatcagacctaacttaatgaccaaacctgctacaatcatcatccctaaagtcactgtaggtgacttggatgatgcaagcaaaatctttggaccagcacaaaccgctgtaggaagagcagtggcagatgctgtggaagaaggaatcattcctaaaaacaaggcagaggaatgggtaattaacgcaagtgtactcattagcccagctgctgaagattacagaaaaatttaccaatacaactatgctgcaacaaagcttgcaattaaaagagcattggacggatatccagacatgaaaaaagtattatacgaaaaagatcgtggaacccacgccattatgggattcaaggctatcaagctttacgaaccaccttacttgcaagttgcacttgaccttgacaatgaagaggctatggcaagaatcatcaagcaacttcctaacagagaaagaatccttcttgaagcaggaactcctcttgttaagaaattcggtgttggaattgtcggcaaaatcagagaattggcaccaagcgcattcatcattgctgaccttaagaccttggatgtaggaagggttgaagtcaagatggcagcagatgaaaccgctgatgcagttgctatctctggtcttggtaccattgaatcaattgaaaaggcaatccacgaaaccagaaaacaaggcatctactctatccttgatatgatgaatgtagacaacttcactgaaaagctacaacaaatcaacaaggacttaatgccagacattgttctattgcacagaaatgttgaccttgaaagtaagcttagagcagaaggcaagaaccttgatgacataagtgcttggggtaatatcaaagaaattaaagaaattaccggcggccttgctgctgttgcaggaggaatcactcctgaaaaggcagaagaagcatttgaaaaaggtgcagatatcatcattgcaggcagatacatcattggctctggagacccaagaagagctgcagaagacttcttagctcatatgcctgtagatccaaaccacatgagagtggttatggaagatgacgaacaaatttaa

SEQ ID NO: 1653 - DNA, 315 bp, Methanobrevibacter ruminantium
atgggattttgtaactcatgtggaagaccaatgggaagaaatgattatggaaccaatgaagacggcagtccaaatcaagactactgcaaagactgtttccaaaatggagaatttacagaaccagatataaccataaatgaaatgattattagaaatgcagaaagaatgcttagaagaaacagagacttgcgtgaagaggaagccactggaattctatgcaatttcttgcctaacttaaaaagatggaatcctaatcctgatgatgaaatagaagatgaggatgaacctgtaagaggctacagaggaggattctaa

SEQ ID NO: 1654 - DNA, 1014 bp, Methanobrevibacter ruminantium
atggattttgtaaaaggtattgttaaaaaatatttcaggtcttataatagaaccttaaaggatggtactaaaaagacctataaaactgaacaggttcaggtaacaataccaaaatccgacaatgtctttgacgataaagaggaagtatttattttatccaagaatcaatttgatgaaattcaggataatgaggaactgatttcagcaatggaattgttcaatgccatgcaatctgaagatattaaaaatctgaattattctttggatgaagccagacaggaattatattcaaatagttctaaacttgaatcctttactttggaattggatgacagtaaattggaattggataaatccaataaaaaattactcattttaaaagaagactgttctaatttaagagatcagcttgaagaaagtaagcttaccattgttaatttgaaagaccaattggataataaaaacttcatcattgaagatttaaatgagtatgtcaattcattgaataataaggttgattcattaaatggtgaaattgataacttaaacactatcaatgcagagctaaacgataatttaaacaatttaactaatgaattgaacaataatgaattaaataacggtttaggcaatggcctaaatggatttaataatggcaatggtttgaatggtaatgggtataataatggtttagacaataatggtttgggcaatggcttaaatggcaatggatatgataacaataatctttatggatataataatggtttaaatataaacaataatcatttattgagttctacagttgatgaagatagtgaagttttaattagtgatgtaaaaagcagcgtaagttttgactattctgattatatagaactccaaagagaatatatagttttgcttagaaaatatgaagaagctcaagaaaacttatataatgaaaaagttaaagtaattcattatagaagcttacttgagaaatttaaagctttcattgcaagattagaataa

SEQ ID NO: 1655 - DNA, 17958 bp, Methanobrevibacter ruminantium
atgatatcgtttttaataattttattattaaataaaggaggacattttatcaatactaaaataattaattcgattttaattattttgatattattctgttttatatctttattggggaccgcttcggcggaagatatttatactgatgatatagcatcaattgatgcttcaaatgattttgaaagtattgaaatttctaatgaagaagtttcaactaatgctgttgaaaatctcgatgtttctgctgatgacagcgattatgttgtcaatggcagttcatcaaagaatgtattgactgcaaatgaactttctgcaacctatgatttgtctggttccagcgttcagaatatttctgatttatttaattcaggaactattcaatccggtgatgtaatatatctaggaaatcaaagcatttcctcatcatgggacgaatggacaggaaatcatttaatcaatgtaaatgtaagtaacatcattatttctggaggaagcagttcaaatcctgatggcacatcaacaattaatgctaatggtgcaaaattatttaatatacaagcatcaggggttactttaactaatattaaagttataaatgctcatggtggtaatggacctggctgtattaattttgatggctcagattgttcaataataaattgtgaatttgaaaactgtcaatatgctcaaggtggagctattcatggaacctcatctgcttcaaatttgattataacaaattgtaattttacaaataatgtaggtagatggggaggatcaggtggagctatttatttggaaggttctggctgtaaagtgactgactctagatttgagggtaacaccgctcaaaattatggggcaatttactgtgcgggtgatattaatttaaacaattgtaatttcactagcaatggccctggagctatttatggtggtggaaacactgaagtaatagattgtaattttatttcaaataccggtagctctgtcactgtaatcagtggaggttctacaaaagtaagaaattctaatttcactgataatgccggtgcttccatttacagtggaggcaatactgaaataaaagatgtaattttcaccaataatggtgcaggaagctataacaataagaatgttggttccgtttacagtggaggtgctacaactgatgttagcaactctaaattcgataataatgctggaatagcaatttatgccaatgaaaatgcatttgtagatggttgtaacattaccaacggtggtgtagctatttatagtggctcagatgccaatatttccaattccattatagaaaataacagtgctgatcaagcaatagtttacatttatgggattggaaaagtaaacaattccaatttcacaaataacaccgtttcaggccatactcatggtggagcattaagtcttattggtgacaattcagaggtctcagattctatctttgctgacaataccgcaggggcttccggtggggccatatacactaccggtgaaaatacaatgattaaaaattgtagtttcactgacaatactgttatgcaggattatggtcacgctggggctgttgatgttgttggcgttaacactaagattatagattgtaattttacaaataatagtgcgcctaatggaggagcagtttatggtggatcctatggattaagcttatccaattcagtatttgaagacaataacgcttctactggtggtgctttatatatttatcatgacgatttcgctataacaaactgtaacttcactgataatgatgcatcaagtcagggcggagctatttacattgcgtctgagtgtcacaatgagcaaatgactggatgtaatttttccggcaatactgctccaagaggttcagcaatttactgtgatggagacggcaaggttacagactgtaatttcgatgtaaaacctgatttaactgttagtggtggtaattcatctttaacagttactttaggatcagattattcaaatgtcgttgtaggtgatattgaaggtgtatccggaggatctgtgactcctttagttgatgcacaggttaccgtggaaatttttgattctcgcggtaatttagttgatagtgttaccaatgcaactgatgagaatggtaaaatcaaatatgattacagtggtctttcttatggaagctatacttatagggcttctcatatggatggagatactttaatcaccaaagaaggtactttaactaggcaagcttctttggatgttcgtactggctatccagcattaacatccacattaggccttcaaaccagcattgacggaacagctgtcgaaaatgatccttttgtcaatgaagacattacagtggaaatttttgattctcgcggtaatttagttgatagtgttaccaatgcaactgatgagaatggtcaagtctattatgactacagcaatctccaacggggaacctacacttatagggttacctcttcagatggacaaaccgaagaaggtcctttaagtatgggtgaagttgtaggggataacttttcagctattcaagctgcaattgacaatgccccatctggaggagttattttcctacagggcaagacttatctaaatgatattcaaggacagatggtaatcgataagcctattactattataggtaccgacggtactgttttggatgctcaaggaatttcaagagtatttgagattaccagtgatgcagataatgtaaatttggcaaacatgacattaaccaatggtaatgatgtctatggtggtgctatctacctgcaatcaggttgtgacgacggcacccttacagatgttgtttttgacagcaacactgctgagttagctggtggagctatttataatgcaggtggaaatagatggactatagataataccacattcactgaaaatgaagcacatggtgaaaccaattacatataccgtggtggtggtgctatttggtcttgtgatgctgaaatgatcttgtcaaataccacttttgtaaataaccaagcaccatatggaggtgctttaagaggtgcatttgacatttacgattcattgtttgacaataacactgctaccgatggtaatggtggagctattgatgtaacaactgaggaatttctttacgatactctaattcttgaatttagaaattctacattcgtaaacaatgatgctaaaggaagtcgtggagatgacagagctcaaggtggtgctattcacatctatcaccttcaagaggttaacatgtatgattgtttctgtgaaaacaacactgccgataggggaggagctgttgatttctacgaattaggaaagacttgggtagataattgtacctttgtaaacaacaacgcttcttccgaaggtggaggtcttgctattttctgtaattcaagtacattcaaggattcaaatgtttccaataacattgcaggtaccgatggaggtgctatttgggttattggacacaattccttatttaacaatgtaacttcagaaaacaacacagcatcaagaggaggttcctcttatattgaaggtgaaaacactacaatctacaattctaccttcaataacaacaatgctttatacaatgaaagccttggcagccaatcaggtattggtggtgctttagacattctcggtgacaattgtaaggttattggtgtcacttctgtaaacaacactgccgagcttggaggttccactttcattcgcggtgacaatacattggttcagaatactaatctaagcaataatacagctgtcttcaatgaaagcagaaatgagacatctggtattggtggtgcattagacgttgttggtaacaattgtcaaatcatcaacgtcacttccgataacaacaatgcttatcgtggtggatccactttcattcgtggtaatgacactgtcattagaaattccactttcgacaataacaatgctacccttagaggtggtggattgaacattgctggtgaaggatgtaccatattcaatgtagatgtttcaaataacgctgctggtgaaaacggtggaggtatctacgtaattgctgacggtaccgaattcagaaacattactgctgacaataacactgctgaacgtggtggaggcgcattcgttgaaggtaacgacatcattatcgataatggtactttcaatggaaacaaagctattttcaatgaaagtaaacctgacgaatcaggtattggaggtgctttggatatcaaaggtcatggctgtaatgtaaccaatgtagactcattcaacaacaccgcttaccgtggaggttccactttcattcgtggtgacaacacctatcttgaaaactgtaccttagacggtaacaatgctacccttagaggtggcggtttgaacattgcaggtgagaactgtaccatccacaacgttgacatttccaataacactgctgggctcatgggcggtggtatctatgtaatcgctgacggcactgtctttagaaacattactgctgacaataactctgccgaacgtggtggagctgtttttgtcgaaggtaatgacattataattgataatgctaccttcaatgacaataaagctattttcaatgagagcaggccagatgactctggtcttggtggtgcattggacattaaaggtgatggctgtaatgtaaccaatgttaattcattcaataacactgcttatcgtggaggttccactttcattcgtggtgacaacactcatgttgaaaactgtaccttggagggtaacaatgctacccttagaggtggaggtttgaacattgctggtgagaactgtactgtctacaatgtggatgtttccaataacactgctggtctcatgggcggtgctatctacgtagttgctaacggtacagagttcagaaatatcactgcaaacaacaactctgccgaacgtggtggaggtgcctttatcgaaggtaacaatgtcaccattgacaatgctacattcaataacaatagggctattttcaatgaaaccaggccagatgaatccggtcttggtggtgcattggacattaaaggtgatggctgtaatgtaacaaatgttaattccactaacaacaccgcttatcgtggcggatccacatttattcgtggtgatgacacatatgttgcaaactgtaccttggacggtaacaatgctacccttagaggtggaggattgaacattgcaggtgacagatgtattattgatgatgttgatgtatccaacaacaatgcaggccttatgggcggtggtatctatgtagtatcaaacggtactgaatttagaaacatcactgccgacaacaacactgcagaacgtggtggatctgcattcatcaacggtaccggcataacaatcagggatggtgagctcaacaacaacagagctatctacaatgagtccagacctgacgaatccggtttaggtggaggatttgacattgtaggggacaatatccttgttgatagcgttcactccaacaacaactccgcttaccgtggaggttccactttcattcgcggttcaaatgttacagtgcaaaattgtaacttggacaacaacaccgctaccgtacgtggtggaggacttaacattggcggaggtgacggatgtaaggtcatcaacgtcagtgtgtccaataacgatgccggtgaagacggtggtgcggtttacgttattggtgacttcagtttatttgacaatgtcaattcaactaacaacacagctcaaagaggaggttcctctttcattgcaggtaacaatgtgactgttataaactgtaacctggacaacaacacagcttccaatcgtggtggaggtttggatgttaacggttcaggttgtgtctttgaaaacgtaactctctcaaactgtcatgctgataaggagggaggtgctgtttatgttagaggagacaacgtaacatttaacaatgtaacatctgaaaacaacactgcagaacgtggaggttcatcatttgttgcaggtgataactgtaaagttattaattgtgaccttaacaataacaacgctacctggagaggtggtggtttggacgttacaggtacaaactgtctctttgagaatgtaaccctttcaaactgtcactcagatgaggatggtggtgcggtttatatcagtggtgatgataacaggtttgtaaatgttacctcagtaaataacaccgctgtgaattatggtggttcaacctatataggaggaactagcaattctgtagagaattgtaccatatccaataacatagcttacaatggtggtggaatatttattgagggagaggattccaaattcacaaacaacaacattaccttcaataaggctatagctactgatgaagatcatgactttaacattatgggtggaggagtattcattttaggtggaaattccaatttcaccaataacaatatctcttcaaaccatgctaaggataatggtgggggagtgcaaatattcttcggacctgacacttttatggacaagatttatgcatttaacaacactgcagaaaacggtgggttcgcaaatcttctctactgtgataacttgaatgttacaaattcaaccttctatagcaatcatgctacaggtgacatatcacttgatagaggggaaggtggagctttccacatgtcctatgccactaacattgatgttcaaggtaactttagctataacaccgcaacaaacggatctgcaatatattctgatggttcagacatcagagtacatgattcaagtttctttgacaaccaggcacattcctggttcttattaataactccaagtgatgagacctatttgaaaggtcaggatgtaattattaacattagtcacattggaggggataatattgctaacgctatccataatagagatgctgaaagcagtattaccgtaagaaacgtaacttatccattttataacaatggagttttaataaacaaaacaaccccaattgatgaagatattcctatagagattataggatatgaaaacagtgataatggtaatttgatatatattgatgatttagaagataatcaagtcatatactataacattaccaatagggatacaaatgaatccatattggtaggtttcaataaaacagacatttctggtacagtatcactaagactcactaatttgcctgcgggcaattatgtagtaagtgcatattatccggaaactacttattatactgaaattagaaatgtttcatcatttagagtaattgatgttgatatggttgcaaacaagactgttgataatcagacttccaatgttggcgacattcgtgattggaatgtcacaatatggaatgatggtgcgtctgaagctcagaacgttaccatcattgatttcctacctgacggtcttaacttaactgataatctaaccattcatttctataatggcactggtggcctatggaacaatgctgtccttaatttaactagcaataacctgactttcagtgtatataacaaggcagatggcacctggattaatggtgttgccagttatgatgagtcaagcaatacctggacatattatgtccttagtttggctgataacagaacatttgcttacagtgttttcaatcaatccgattacactgatgcgtttggagaggccaggtattatgaggacatcaacagttggacctatagaaatatcagctatgatgtggataatgccgattggtattattacacatttgaatatgatgaccatacctatgtttatggtgttttcaatgggtcttacttcgttgatgcatttggagaggccaggtattatgaggacatcaacagttggacctatagaaatatcagctatgatgcaacaacaggaaattggtattattatacctttgattatggtggaaatacctttgtttatggcgttttcgatgagtctttcttcgttgatgcatttggcactgccatatatgatgatggttcttggaattatgaaaatatcagttataatgcaacagatggcaaatggtattattacagtcttaattatggtgatgattccaataatgtaacttactatattttcaatcctgaaaatttcgtggacgtatttggaagcaattatcattataatgctgaaaacaatacctatgtatatgtgaatgcatattatgacgctgaaaccgatagcctcattagaaatgacaccatttacaatgtcagttctggcatttggacaattaacaatagattagttgttccagaattggtgtcaattaatccaaatgtatcttacatcagtccggaaaagatttatcttgttaataagattagtttaagcatagcaaaccatactaattctactgacatttctttagatgttggcagatttgatggaaacggcagtgtgcttatgaatctcgtcaccaatgtgactaaacgaggtaactttaccaatattgttaatgtgactacagatagtccggaaaagaattacactaacaatgttgctaacaacagcactatagtttacaacgaccttgtaatcaataagactgtaagcgataatctaaccaatgtttcaggcattgtcgattggaatgtcacagttttaaacaatggtacttttgaggcagtcaatgtaaccatgaatgattacttgcctgatggtcttgatttaactaatttgacagtcaaggtctataatggcactggaagtttatggactaacgctactcttgatttaagcactatgactttgtctttcagtgtttataacgagactagtggtgagtggattagcggcattgctgcttatgatcaagctgcaaagacttggacttattatgttcttgcattggatgatgatgttttaacttacacagcattcgatgaaacattcttctctaatctctttggagatgctttctataatgagtctagcaatgtttggactttcgtcaatagaacatatgatgaagtaactggcgatttgattagcgaagtgaataccacttatgacaacaatactggcatttggactattggtgataagacatttgtggaatataaggtcaatttaaccctagttaatggcactaactctacaaatcttactttaggcattaatagtttagatgaaaacagtacaatggtcatgaatttagtaactaatgtgactaaatatggtatctttaccaatgttgctaatgtcactactgttactccagagaccaattatactaacaatgttgcgaacaatactaccgaaacccttactaacattaccgttactaaggtttgggatgatgctaacaaccaggatggaatcaggcctactagcgttaacattactttgattggtagtgatggcagtgaacgttctgttcttgtaactggaactggtggtgtatggaattacactttcacagatttacctatgtttaacagctctggtgattctattgtttacactgtcaatgagtctgttgttcctaatggctatgatgtcagttacaatcaatccaattggacagtatataacactcatgttcctgaagtgactaacattactgttactaaggtttgggaagatgctaataaccaggatggtatcaggcctactagcgttaacattactttgattggtagtgatggcagtgaacgttctgttcttgtaactggaactggtggtgtatggaattacactttcacagatttacctatgtttaacagctctggtgattctattgtttacactgtcaatgagtctgttgttcctaatggctatgatgtcagttacaatcaatccaattggacagtatataacactcatgttcctgaagtgactaacattactgttactaaggtttgggaagatgctaataaccaggatggtatcaggccaagcagcgttaacattaccttgattggtagtgatggcactgaacgttctgttcttgtaaccgaaaataacggtgtctggaattacactttcactgacttgccagtgtacaatggaactactgatcctattgtttacactgtcaatgagtctgttgttcctgacggctatgaagtaagttataaccaatccaactggactgtatacaacactcacattcctgagcttgtaaacataaccgttactaaggtttgggaagatgctaacaaccaggatggtatcaggcctactagtgttaacattaccttgattggtagtgatggcactgaacgttctgttcttgtaaccgaaaataacggtgtctggaattacactttcactgacttgccagtgtacaatggaactactgatcctattgtttacactgtcaatgagtctgttgttcctgacggctatgaagtaagttacaaccaatccaactggactgtatacaacactcacattcctgagcttgtaaacataaccgttactaaggtttgggaagatgctaacaaccaggatggtatcaggcctactagtgttaacattaccttgattggtagtgatggcagtgaacgttctgttcttgtaaccgagactgatggcgtatggaattacactttcactgacttgccagtgtacaatggaactactgatcctattgtttacactgtcattgagtctgttgttcctgatggctatgaagtaagctacaatcaatccaattggactgtatacaacgctcatgttcctgaagtgactaacattactgttactaaggtttgggaagatgctaacaaccaggatggaatcaggccaagcagcgttaacattaccttgattggtagtgacggcactgaacgttctgttcttgtaaccgagactgatggcgtatggaattacactttcactgacttgccagtgtacaatggaactactgatcctattgtttacactgtcattgagtctgttgttcctgttggctatgaagtaagctacaatcaatccaactggactgtatacaacactcatgttcctgaaatcgtaaacattactgttaccaagatttgggaagatgctaacaaccaggatggaatcaggccaggcagtgttaacattactttgattggtagtgacggcactgaacgttctgttcttgtaaccgaaaataacggtgtctggaattacacattcactgacttgccagtgtacaatggaactactgatcctattgtttacactgtcaatgagtctgttgttcctgttggctatgaagtaagttacaaccaatccaaccggactgtatacaatacacatgttcctgaaatcgtaaacattactgttaccaagatttgggaagatgctaacaaccaggatggaatcaggccaggcagtgttaacattactttgattggtactgatggcactgaacgctctgttcttgtaaccgaaaataacggtgtctggaattacacattcactgacttgccagtgtacaatggaactactgatcctattgtttacactgtcaatgagtctgttgttcctgttggctatgaagtcagctacaaccaaaccaactggacagtatacaacactcatgttcctgaaatcgtaaacattactgttaccaagatttgggaagatgctaacaaccaggatggtatcaggccaatcagcgttaacattaccttgattggtagtgacggcactgaacgctctgttcttgtaaccggaactgatggatggaattacacattcaaagacttgcctaagtttaacggtacaactgtacctattgtttacactgtcaatgagtctgttgttcctgttggctatgaagtcagctacaaccaaaccaactggacagtatacaacactcatgttcctgaattagttaacattactgttactaaggtttgggaagatgctaacaaccaggatggtatcaggccaatcagcgttaacattaccttgattggtagtgacggcactgaacgctctgttcttgtaaccggaactgatggatggaattacacattcaaagacttgcctaagtttaacggtacaactgttcctattgtttacattgtcaatgagtctgttgttcctgttggctatgatgtcagttacaatcaatccaattggacagtttacaacactcacgttccaaatgttacagaaattaatgtaactaaagtctggaacgacagtaatgataaatatggtattaggccttctaatgtgactattgagttgtttgctgatggtaagaaagttaatgagaccaatttaaccgctagaggtgcttggacttatactttcagtggtttgcctcaatataataacggcaaattgattaattatactattggcgaggttcgtgtagatggctacagcgttctaattactaataatactgttggaaattggactgttactaatacacctatagcggttcctaacatgacagttcaaaaaatcgctaacgataaagtggtctacatcggtaatgtgactagctttactattcttgttagaaatactggtgattgtaatttaagtggagtttatgtagttgattctgattatagcgcaggtttaagttaccttagatacgagaatggttctcgtgattggacttatgatggcgctaaatggactttagtcggtaatctcactactgataatcctactgctaactttactgtttactttaccgtagtagataatggtactttagttaacaatgtttctgcaggttccaatttaaccaatgaaaccaatggaactaataacactactgcttacaggcctaacatgactattcaaaaggtcagtaatgatgaggttgtttatgttggtaacattaccagtttcactattgttgtgactaacactggtgactgtaatctgtctgatattgttgtgactgattctgatttcagtgctggtttaagttacttgacttatgctaatggcactaggaattggaattatgatgctgtaggtcatacttggagtttagttggtgatttaaccaatggtagttctgccgagtttactgtgttcttcactgttattgataacggtaccttggtaaacaatgcaagcgttagatctaatttaaccaatgaaaccaacgcaacaaataacactactgcttacaggcctaacatgactattcaaaagattagtaatgatgaggttgtttatgttggtaacattaccagtttcactattgttgtgactaacactggtgactgtaatctgtctgatattgttgtcactgattctgatttcagtgctggtttaagttacttgacttatgctaatggcactaggaattggaattatgatgctgtaggtcatacttggagtttagttggtgatttaaccaatggtagttctgccgagtttactgtgttcttcactgttattgataacggtaccttggtaaacaatgcaagcgttagatctaatttaaccaatgaaaccaacgcaacaaataacactactgcttacaggcctaacatgactattcaaaagattagtaatgatgaggttgtttatgttggtaacattaccagtttcactattgttgtgactaacactggtgactgtaatctgtctgatattgttgtcactgattctgatttcagtgctggtttaagttacttgacttatgctaatggcactaggaattggaattatgatgctgtaggtcatacttggagtttagttggtgatttaaccaatggtagttctgccgagtttactgtgttcttcactgttattgataacggtaccttggttaacaatgcaagcgttagatctaatttaaccaatgaaaccaacgcaacaaataacactactgcttacaggcctaacatgactattcaaaagattagtaatgatgaggttgtttatgttggtaacattaccagtttcactattgttgtgactaacactggtgactgtaatctgtctgatattgttgtgactgattctgatttcagtgctggtttaagttacttgacttatgctaatggcactaggaattggaattatgatgctgtaggtcatacttggagtttagttggtgatttaaccaatggtagttctgccgagtttactgtgttcttcactgttattgataacggtaccttggtaaacaatgcaagcgttagatctaatttaaccaacgaaaccaacgcaacaaataacactactgcttacaggcctaacatgactattcaaaagattagtaatgatgaggttgtttatgttggtaacattaccagtttcactattgttgtgactaacactggtgattgcaacctttccgaaatcgttgtgactgataatgattatagtcttggcttaaaatacagcagatatgagaacagcagcagattatggaattataatggtggcaagttcactctggtaggtgatttggctcctggtaattccgcaaacttaactgtgttctttattgttgttgacaatggtacattagtaaacaatgcaagtgttaaatctaatttaaccaacgaaaccaatgcaacaaataataccactgcttacaggcctaacatgactgttcaaaaggtcagtaacgatcaacttgtctatgttggtaatgagaccagtttcacaatcattgttactaacactggtgactgtaacttaactggtgtttatataaaagatgatgatttcagtaaaggtttacaatacaacaataagttcgttcctgttaaaggcacttggacttatgctggaggcagatggaaccttgaaggtcagttaactgttggtgataatgctagcataactgtttactttaccgtaattgacaatggtactttagtaaacaatgctaccgctggttctaatttaaccaatgaaaccaatgctactaacaataccactgcttacagacctaacatgactgttcaaaagatcagtaacgatggtgttgtctatcttggaaacaccactagtttcactattgttgtaactaacactggtgactgcagcttatctgaaatcgttgtaactgataatgattacagtgctggtctacagtacagcagatatgcgaatactagcagtaaatggaattatgatggagataaattcactttagtcggtgatttggctccgggtgcttccgctaacttaacagtattcttcattgttattgacaatggcacattggtaaacaacgcaagtgttaaatccaatttaaccaacgaaaccaatgcaacaaacaacactactgcttacagacctaacatgactgttgaaaaactcatttatgaggatacagtctatgttggagacacagctatctttaccatatttgttaaaaatactggtgattgtagcttgtctgatgttgttatttgcgaatattggttcagtgaaggtttagagtacaatggtgtttgggtacctaacggtgaccgcaaatgggattatgacgatgaaacaagaacatggaccttaataggagatcttgctcctgaaggtttcgctagttttgttgtctacttcaacgttaccaaaaacggtactttatataacaacatcagcgccaaatccaatttaaccaatgagacaaacgctaccaacagcacaagagcatatttacctaatatgactgtaatgaaagtagctaacgatgaaatcgtttatcttggtaataccacaagctttacaattgttgtaagcaacaccggtgactgtaacttatcagaagttgttgttaccgatacagattacagcactggtctaaaatataagaattatattaatggcagtgctaattggaattacaacaatggcgaatggtcattggtcggtgatttaacacctggcagttcagctaactttactgtgttctttaccgttgttgaaaatggtactttggtaaacaacgcttcagcaagttcaaacttgactaacaaaacaaacacaacaaataacacaactgcatacagtcctaaaatgactgttttaaaaattagtaatgatgaatctgtttatgtcggaaatatcaccagctttacaattcttgtaagcaatgttggtgattgcgatttaagtggaatatatgttatagatgatgattattcaaatggtttactctacaatagatatgagaatagcagtcgcaagtggaattatgatggttccagatggaccttagtcggttcccttgaacctggagattctgcaaacttcactgtattctttgacgttgttgaaaatggtactttggtaaacaatgtttccgctggttctaatttaaccaacgaaaccaacaataccaacaatactaccgctaaacctgtctgtgatttgattatttacaaagctgttaatgctacagaaattcttgtttatgatattgtcgaatggaaaattaccgttgtaaatcttggtccggatactgctttagatgtaattgttaaagatcttttagacaatggacttgaattaattagtgtaagcggtggcaattataataatattaccggtgaatggaatattggtgatttagagcctaatactcccgtttctttaagcttagttacccgtgttcttgtaaatggtactattgtaaacactgctactgtaaatactacaagccatgaatctaattatactaacaataatgcaagtaactttactgaagctgactatctctgtgatttagtcatttctaaagccgtaaattgtactaattgtaatgtttcagatctggtacaatggaatattacagttactaatcttggtccacatgatgcttctaatgtcattgtaaaagaaatcttaccgaaaggtttagaattaattgattataatgttagtgttggtaattttaatgaagttattagtgagtggtctattggtactttagaaaaggatactgcagtatctcttgtcttagttactaaagtccttattgatggtactttaattaatattgctactgttaatactactactctagataataattatactaataatgtagcaaataacactacagttgctagtccgatttgtgatttagtcataagtaagatcgttaatgctacaaaagtgaatatagatgatatactcacttggactgtaagagttactaataacggtcctagtgaagctttaaacgtatgtgtaagtgatattttacctgaaggtcttatgtttgttggttataaggcaagtacaggtaggtatgatgacgaaagtggaacttggactgtgggtaaattgtcaagcggttctagtgctactattaatatatatactaaagtcatcgaattaggaaatatcactaacccagtttctgtaaatactactactgttgagtctaattattcaaataataaggctaacaatactacagaagtttatcctattgttgatttagtaattgaaaaatcatctgataaaataaagtataatgtaaatgatacaatgcattggattataaaagtcatgaatgaaggaccttgtgatgcaattgaggtttatgtatatgatgcattacctgctagtacaaaattcattgcttataattcatctaagggaactttcgatgcggctaaaggtatttggtctattggtgatttagcaaatggtgaagaagtgacattagacatatgttgtaaagcacttatttctggaaactttactaacaatgctactgtaaattgttcaataacagataagaacacttctaataattttgataatgcaactatcgaaatcgctgataacaaatccgataatccagatcctattcctgataaaccaaaacatggtgtggatattagtttaagaacaggtaatcctttactaatattcttgatggcaatctttgctatctttggaggtataggactaagatgcaggaaagaataa

SEQ ID NO: 1656 - DNA, 597 bp, Methanobrevibacter ruminantium
atgaaaattttaggaatttgcggaagtccaagagatggggcttcaagttttctgcttaaaagagcattgaatgaacttgaaaaagaagaaaacttcgaaacaaagtttataagcgtgaaagacaagaatatatccccttgcacacattgcaatttttgccttgaatcaaaaggagagtgttcaattgaggatgatatgaatgaaatctacgattcacttaagcaagctgatggaataatatttgctagcccagtgcattttggaagcatatccgcccaattgaaggctgtaatcgacagatgccaagctttgataatggaggaccttgacatcttcaaaaataaagttggaatttcaatagttgttggaggggacagatgtggaggacaagagttggccatccaacagatcaatactttctatcttttaaacaaaataatccctctaagcggaggatcatttggagccaatttgggagcttgcctatggtcgcaagacgaagggaccgatggagtgaagaatgatgaatatggtttaaaaactttggacatgaccataaaccatttcaaggaatttttattagagtttaaacaatga

SEQ ID NO: 1657 - DNA, 693 bp, Methanobrevibacter ruminantium
atgacagatgtaaaagctggagtagaatataaaatcaacatagatggaaactcctttctattagatgagaagaaattcaatcttcttttatacatcaatgaaagcggatccatcacagaggcagcaaaaaggactaaaatatcctatagaactgctctacactatattgaaaaaatagaaaccacattaaacatagccattgtaagcactaaaaaaggcggaaccggtggtggcggaggtaccaaactcaccgaagaaggcttgcaaatcgttaaggaatgtaaaaaaatcaatgctatcatggagcttcacagagatgtcaatgagcttgaagctgaaatccttgaagtggatgcaagcaaaggcataatgaaaatcaagatggaagaccttaccatgaccatgcctttgaataagaaatatgtggttggagataagatacttgccttaatcagctatgacaatatattcataatgctagagcctcaagcatccagcatcagaaacatcttcaagggaatcgttactgaaatgagacttcaggatgagatggtgagagtcaagatagacattggcggagttgacatattctcagacataactctatcagcaggtaaagacttagacttaaaccttggaaaagaagtttatattggctttaaagcattgtcaatagctacattgaaattataa

SEQ ID NO: 1658 - DNA, 105 bp, Methanobrevibacter ruminantium
gtggcacgtgtatcaaacttgagttattgtcatgtttgtacgctatgtgcaatgaaatgcggtccagatgcaattaaaataataagaaatgcaccagatgaatga

SEQ ID NO: 1659 - DNA, 603 bp, Methanobrevibacter ruminantium
atgaatatagaaaaacgtgatatcatggaaagaactgcaaaagtttcaagaaagacttccgaaacagatattgaaattgaaatgaacattgatggaaaaggaaaatacgatatagacacaggggtcaagttctttgaccacatgctagaatcattttcccgccacagctttattgacttgaacatcaaggcaataggtgacattgaaatagatgatcaccatactgttgaagatgttggcatcctacttggagaggcttttgctaaggctataggagataagaaaggaattagaagaatgggacatgcgattgtacctatggatgattccgttgcaactgtagcgattgatatcagcggccgcagctattgcaatatgagtcttgactttagaaacgataagattggagaccttagttctgatattattgttcacttttttgaatcctttgcatctagtgccaaaatcaatatctatggaacttgtgaaggctttaatgatcatcacaaggcagaagctgtttttaaggcatttgcaaagtcaatctatgatgcctgtaagatagagcatgatgagattcttagtactaaaggcgtgctttaa

SEQ ID NO: 1660 - DNA, 1221 bp, Methanobrevibacter ruminantium
atgatgaattataattatgatatagatatggaaaatccatttgagcctggaaaatcagtatctccagacagatttaaaggccgtgagaaaaacattaaaaagattctaagggatatgggtaaagttcaaaagggaaatgtacagcattttttcttaacaggcaataaaggcatgggaaagacttccttagctgaatttgtaaaggaatatgtcgaaataaactatggcatgattggaatatatgtatccaataagggaaataattctttaaattcccttatcacagctataattcaagcctttttaaataaaattcctcgcaacgttctttttgaaaagataaaaaccctattttctagcattgaaagtgtagaaatcataggcaatagggtaagctttaagcccagcaaaagccttattgttgatattgaaaaggactttccttattacttaaatcagatcattaaagatctccctaccaacaatggtgttttccttataatcgatgacattaatggtttaagcgagtctaaaaagtttgttgattggtataagcgctttgcagacactatagaagtaaataggggggacttcaatcttcccttatatgtcctatttgcagcctatcccgataagtttgacagcctagtatatgaagagccatccttcggcagaatatttcattatgatgaaattgacaggctaagcgatttggaggtaaaggaattctttaaagacaccttttcaagtgtaaataagcaaatcaatgacaattccttggaattattgtcatatttctcaggaggaatccctttgataatgcaggagataggttattcaatctattggttatcagaaaagaccacaattgatgaagaggatgtcttaaacggcattatggaggcaattggagagcttgagtcaaagcagataagaaatatcgtaaatcagatttcaagcgatgactttgaagatttattgcttaagatagcaagccaaaagcagcaaagttatattgaaacagactttaaggagaaattgaattgggatgagtacaatatatgggatgagtttttagattgcatgataaaattgggagtcattaagacaagcaatcgaaaaagcaatttgaagttcagcttttccaatcagttttatttcacttatttctggttgaaatcattaaaccttcacgaggaattcgctaaaattgagtcttaa

SEQ ID NO: 1661 - DNA, 501 bp, Methanobrevibacter ruminantium
atggcatcaatagactattttgaatgtgaagactgtggattcagatggaaagatcaaggcccactcctcttctttctcaacgaaaacaataaaatagaagaatacatactccttatctcaaacatgaacttggattcaaattccaatatctcaggtgatatcatagagacctattgcacaaattgcgataagaagataaagatatacattatctctacaataaaaagcccatatgatgaggattcggctatagagtcaataagaaaattggcagatgaaaatcagatagacaataaggcccttaagcctttcattagatcttcagacctaaaggacaacttttacatcgtggatttatatagaaacttctattcaaataaggactaccattgtcctaattgtgatagtataatttccaagtatatcttatcaaaaaacaagtgtcctaagtgcggtggagagataagctcagtggatggtctctgtttggataaattttaa

SEQ ID NO: 1662 - DNA, 837 bp, Methanobrevibacter ruminantium
atggtagttaaaattggtatcgtaaaaagtggtaatattggtacttcaccagtattagatttattattagacgaaagagcagacagaccaaacatcgatgtaagagtatttggatctggagcaaaaatgaaccctgaacaagttgaagacgtcgtacctaaactcgaccaattcgaccctgacttctgtattttcattagcccaaacccaggagcacctggtccagctagagcaagagaattattatctgaaaaagatcttcctgctattatcattggtgacgcacctggtaaaggtaaaaaagatgaaatggatgaacaaggtttaggttacattattgtaatgtccgacccaatgatcggtgcaaaaagagaatggttagacccaactgaaatggctatctttaacgctgacatcttaaaagtattagcagaaactggtgctttaagattagtacaaaaaactctcgacgctgttattgctgctgctgatgctggcgaagaaattgaattacctaaactcattgttactgctgaaaaagctgttgaagctgcaggatttgcaaacccatacgcaaaagcaaaagctatcgctgcatacgaaatggctggagctgtcgcaggcttagacatgaaaggttgtttcatgaccaaaggcttcgaaaacttcatcccattagttgctgctgcacacgaaattgcatctgctgctgctaaattagctcaagaagctagagaaattgaaaaatccaacgacactgtcttaagaactcctcacatgaaagaaggaaacttaggttgcaaagttgatttaatcagcaaacctgtagacaaataa

SEQ ID NO: 1663 - DNA, 315 bp, Methanobrevibacter ruminantium
atgaaaaaggtaaagattacagttatgaaaaaggcaagatacgatgacctcattgaaaaatacgaaaatccattggagcatgaatgtgaggtagagcttggagatgtcttcattgcaaatggttgggaaaaaccggaggacttctgcagcagcgcttgggatagcatctctccatttgtattggcattatccagcgggggagaagacttatatgatggatggatgaaggataaaaagtcagcaatgatatcctgcaatgatgggtttcgtcctgtaagtttctatcttgaggcaatggacgaggatgctgattaa

SEQ ID NO: 1664 - DNA, 1125 bp, Methanobrevibacter ruminantium
atgaattctaaaaatattgctattgctggtgagatcaccccttcaaagaccataattcctctaattcaaaggttaaatgaattagataaggaagataaattaaacttcaaaataaacaagatatatggtctttatcatggggagtcatctaaattgcttcttgagccgtattgtgatgagctttatgatataggtcaaggaagacgaggccaaaagaagaactcaactgctaaattggcttatcttatctcaagagacataataaaggcattcaatgctctaaaaggaaataacatagaccttctaatcactgcaggcaatgcaggtgatgtaagaaagtccattgttgcagccaaccttttaaaaatccctattcttcatatagagcaggacatctacaaccctattgaagtaatttcacatgccaatctagtcactgttcctaaagaggattataaggactatcttgagagaaaatataatttaaaaaacgttgcatctattgacggctatcctatggctaaatatgtggacaatcatataaaagacaataatctgattgataaggaagagatatatggcgaatatggagttaaggaatttgtgctggttgttcttggaggggacttaaaggatgatgagattgagcctcttataagatcagtggaacagcttaatctaaagactctcattgctccttataggtttgatagaaatcttgttgaaagccttgtcctttcaccaaacattaaggttctcccacagtatgttgaccttttaagctttatgaatgcagcatcccaccttatctatgctgcgggaatgggactcaccattgaggcgggtgtattcaatatcccttcactaaagattgaaggatttcataaaacccatggaagcgtagaccttgcaagggaacttaatattcctattgtaaaaatagatgagattccagatgcctttgagaagctatccgctcatcaggataataatcttgttaaaaacagtgaaatcgccattgataagttggtggatctaatcaatggatttgatgagaatggtcttcaaaagagcggattcaagtcaacaaagcaaatctggaacagtcgtaaggtgtttagataa

SEQ ID NO: 1665 - DNA, 16956 bp, Methanobrevibacter ruminantium
atgagaaataaaaagattttcatttttactttaatgattgtcatgctattatcgcttgctgcagtttcagcaaatgatctggataatcttgaagttgatgatggaaatgttgtatctactgatacggtaatcaatgatgtgcccatggagagtacgtctagtgataagattgccctgaatgtagattcgacacaatctaatactacagagatacttaatgaaaatgaaataataacaaataatagtactttaagcattgatttgaatgaatcgattacaaatgaaatcagttctgatcatgaagattcatatcaggctgatagtaatcaagaggattcctatttcacttcagatggaaacatttatgttaaagtgaaaacttccatgcttaaagcggacggcgatcagatttattatatacatcctgccggtagccctacagcaacaggaactcgcgatgatcctttggatagtatgaattccgccttgaatttatttacttcagatggaacacacactattgtggttatggatgggatttataaagatacatactatgactataacaatacagatgtagacacaaacttaagcaacttgattataaagtccgatgaaggggcaagtccacattttaacctgagcacttcagattatcgaaggtctttatattgggcctttacaggagaaaacataactatagatggattgaagtttactgattcacaatacggctcttttaatgaggatggggtatacaaataccatacagtattgagattcattaattccactaatgttttggttgaaaactgtgtatttgacaatgacggataccttatcaatgcaactgattcaagtgatgttgttattaaaaattgtaatgtttccaatagtaatcgttcaaatgtatttaatgttttgaattccagctttactgttcaggattcaaatttatccaagattagagatagctatattaccaattcaagttttaagctaatcaacaacaccatctgtaacaatgtaaattcaaatttgttcacagtaaaaaattcaagtttggatattataaacaacacttttaaagacagcaattattcatcatattatgtgttccgtatttataacaataatgaaacctatgcgaatttcactggaaataattttacaaaccttacaggcacagattaccttcttcaggtaaactactatgttaacgataataccactgtgtcatttgtcaacaatagccttaaagacgttagtttaggtcttaatattagatattccaatcttactatggacggcaactcctttgacaatcttagtcttagttcccggccttcttattctggaataagtacaagttattcaaatgtatcattcaccaacaataatttcaccaactctgactcttacatttatttaggctatggagtcaatgctacaattgaaaacaataactttactgacaatattccatcatactatggtcttttgcgagctgagggtaacagtcatgacattaaagaaaacaatttcacaaacaacaaaggaaattgttcaattattcaacattactctggcaatgctacaattcatggaaatcatttctataacaattccttgaatggatgtggtcatgttatcaatgttactagtacttcaggttctgaaatttataaaaatgactttgtaaacaacagcgccgacaatggtactgtatatctatatggatcatctaatgtacatgataacaatttcaccaataacagcgtcaccggactcggaggagctatctattcctatagtttttataatattaatactacaattaaggaaaatgtctttgatggaaacaatgctagctttggtggtgcaatctattatgaaaactatcctagctataataataaaagggagattgtaaacaacaccttcataaacaacagcgctgactttggtggagcaatctactcaaataaatcaatcaacaacattatcgatgataatgactttataaacaacagcgctcaaattggaggagctatttttgttgattatctatacataaacgatttcagatacaacaacaccaataacaccattagcaacaacttgtttgcagaaaataatgcgcaaagtggtggagcagttgtattatattcacaaaacagcaccgtggaaggaaacagattcatttccaacaatgcaagtcgctatggcggaggagcattgattacaagcggaaataactctatcatagtaaacaacacctttgcaaacaacacagctcaattatatggtggtgctattggaaccaacgactctaagataattgacaataagtttgaaaacaacagtgcttatcaggctggagctatcttaacaatcaattccacaattcacaacaatgatttcgttggaaatgaagcaactagaggtccggcaatagtatatatagacgactttaattacactgcactcacttactacacttataactgcagctgcgaaaactgcagcaattgcagtggatgcagcgattgtgaatgctgtgtaactactatagtagaccctgaaactggggatgagataaaaattattaattgcagcaactgtgacggttgcaattgcacttgcgaaaactcaaccgtaactgaacataatataacattattatataataataccggcattgatatcgacgaagacgtttacgcctatcatgaaaatcagcttttaagggttgccaaggaaaacaatggaatgtattacctttatgacaatgttaatgttacaagcgctgaaaattacacttattgggcgtattgcatagagcagaacaattcctacccttggctaggaaatggaactcttggagttcatgtagatgatctatactttgtcagaaacagtttggatgactcttatgttggtgattaccttaagatattgatttcatacttctatcataatcttgatgaggataagatcaatgtcaaggagtatatctatatctttacagacaccgactatcgtagcaacaatgaccgcataatccaaaagattattaagctagccaataatgagtcaacagttcttgagaatggtaacaactggataaacggagtttacaactgccttgaattctcaacattcataaaccctaccacaaggcagaacctgattttaatcaatggatgcgaacctctagacaagcctgactttaacataactaaaaaagccaatgctacacatgtgaaaaccggcgattacatcaactatacaattcttgttacaaacaacggaacatgcaatttgcatggtttgaaagtgactgaaagaatgaattccatgttgatatatatgggcttcgatgatgttagcgataattggacccagacaggggatatggaatggatgctgaatagaaccttgaaggtcaacgaatcggcggaattacacatctacttcatgacaaataaggtaaccagctataccaacattacaaatgtcattgaggcaagaagtgatgaaagtgacacaaagatagcagaggaacatattgaaaccatatatcctaaattggtttaccgaaaggtcagcgtggaccctgttgcctatcctgaatccacaattagattcatacttctcgttaagaacataggtactgccaatgcatataatgtagccattgaagacagtggctttagctcaagtcaattgttatatcaagggacatggtccaactataagggaacttggtataatagcggatctagcgcaacatcaaccggacgcttcactcttaatgggtatttggctcctaaccaggaggcgggggtttacgtttcctttaaattgaaggaaggtgttaaaggtacaacagtatccaattcattcaatgtatatttaaacaatacttgggatggaagcgcttccaattttacaagagttgtctcttctgcaatgaaagttgaaaagctttgggtcgatcctcttcctattgcaacaatcggcgatgaagtaactttcgccataaatgtcagcaatgttggagaggccaatctgacaggagtctatgtagaggacttcttcccaagcggattggaatacattagattctataataccgatgcccacaactggactcattatgaaacccttgacggcacccataggttcattttacaaaacaccctacctaacagtcaaaccagcaggacactttcatcctcaatcatttatgttgtatttaaagccaatgaaataggcgatttaaccaatacagctattgtaaaaagtgactacactgaaaatgtcactgataatgaaacaatcattatcagtccttatggaatgaaagttgagaaattcagcaacaacccgatttcacaatctgacaatcaggtttcatacgtaatcagggttacaaacacaggaatatataacttgacagatgtttatgtaaatgaaagccaaaatgaatacatggtttatgaccatttcgaagatagttccaataaatggatctataacgattcaggcgatagcccaagatgggtttacaatggaagcttggagaataatacctattccgacttcattgtatattataacatcactaaaatacctgaaaacggattaatcaaaaacaccgttagggtatattcaaatgaaactgtagagagaaatgcaagcaatgaaaccaaagtctataaattatccctttggaaagtaagcaacaatcctgtatccagacttggagaccaaatttcatttaccattgttgtcaaacatgaatataatggaaattcttatgataaggacttatatcttgacggcgtcttcgttaaggaactgattcctgacggcttgacctatgaccattacgttgatgaaagcggcaaatggtcctatgattacaataccgacaattgggtatatagcggtactttagttcctaatactgaaactaactttaccttgttctttaacgtaaccaaaatggagaacttaacaaatgtagttattctcggtaccaatcaaagcaataatgtaaccgtcaacaacagctccgacagcagatactacagcatgcttgtagataagataagcttgaacgagactgtctttaaaggaaacatcacagaattcctaatcaaggtaactaataacggtgacttgaacttgactaatgtcactattcgcgaagtcattcctgatggattggtctatgttggatatcttaataaaaccggcaaatggatttatgaaggaggaaatggagcttcaagcgatgatcaaccaatgtggacttatcaaggcatattggctccaggagaatctgcagagttcatcattctattcaatgccactgaaacaggcacatttttaaatatagtttatggaacctctaatgaaacagaggaatttgtcgcagaaaacactacaaaggttttaaatcctctcttgtatgtagataaggtcacattgaatcaaacagtatatcgcggtgacttgactgcattcgagatattcattgtaaacattggtgattgcgatttacacgacctttatattgatgagatattccctgacggccttgtctattatggattggtggatgatacaggttcattgtcctatgatgagaaaactcaaagaatcagctttgacggaacattgaaagttcgcgaaactttggtattcacagtcatattcaacactacaaaggtaggcaacttcaccaataaggttgaagtgggctctaacgaaaccaagaaggaatatgctaataatactacccaagtattggaaaaggacttaaatgtcacaaaggttgcaaacaataaaaccgtcgtcaaaggtgacaagacagaatttacaattgacattactaatgtaggcgaatgcaatttaacaaatgtatatgtatatgaggaatccttcgagggactttcctattatgcctacatcgatgaaacaggcaaatggtttaaaaacggcaataaatggatttatgatggtgtcctgaaacctggcgaaagcgttaagttcactgttgtattcaatacaaacgagacaggcaactttaccaatatcatcgttgcaggtgccgatggaatcccaaataaaactgcaaacaacactacagaagtgcttatttgcgacatttccattgaaaagctcacacttaacaaaacagttataagcggagaggacacccaatttgccatccgtgttaaaaacattggattaggcaatttaactgatgtgaccgtaactgacagcttccctgaaggcttgacttacaagaccttcattgacaatagcggaaaatggtccaaaaacggcaataaatggatttatgatggtgtcttgaaacctggtgagtctgccgaattcattgttgtatttgctaccaatcaaacaggtaatttcactaactttgtaagtgtaagcaccaatgaaaccaaatccaagaacgcttccaacaaaacagaggttgtcttggcagatgttgaaattcaaaagatcaccctcaataaaactgttataagcggtgaggagactctatttgaaatagttgtcacaaacaagggcattattgatttgtccgatatcactgtaactgacagcttccctgaaggcttgacttacaagacttatattgacgaaagcggaaaatggtctaacagcggcaacatttggacttatgatggagttttagctcctggtgagtctgctggattcattgttgtgtttgatactaatcaaacaggcaatttcaccaactttgtttctgtaaagactaatgaaaccaaatccaagaatgcctccaacaaaaccgaggttctagtggcggatattgaaattcaaaagatcacacttaacagaacagtcatcagtggtcaagagaccatgtttgaaattgttgtcacaaacaagggacttgttgatttgtccaatgtcattgtagctgacagcttccctgaaggcttgacctataagacttatattgatgaaagcggaaaatgggctgtcaacaataataaatggctttataatggtgttctagctcctggtgagtctgctggattcattgttgtgtttgataccaatcaaactggtaatttcactaactttgtaagtgtaagcagcaacgaaaccaaaaccaagaatgcttccaatataacagaagtcctattggcggatattgccatccaaaagataactcttaacagaacagttgtaagtggccaagagaccatgtttgaaattgttgtcaccaacacaggaatcattgacttgactaatgttgttgtaactgacaccttccctgaaggcttgacttacaagaccttcattgatgaaagcggaaaatggtctaacagcggcaacacttgggcgtatgatggtgttctagctcctggcgagtctagtggattcattgttatatttgacactaaagatccaggcaactttacaaatattgttagcgtaatatccaatcagacaggcaataagtctgcccgtaacattactgaggttatcgttgcagatgtaggcattcaaaagataactcttaacagaacagtttatagcggtgaggagactcaatttgaaattgttgtcaccaatacaggaatcattgacttgactaatgttgttgtgactgacaccttccctgaaggcttgacttacaagaccttcattgatgaaagcggtaaatggtccaacagtggcaacaaatgggtttatgatggcattttgactcctggcaagtctgctggattcattgtagtgtttgacactaaagatataggcaattttaccaatgttgtatctgtaaacacaactgaggtaggtcctaagtattcctataatataactgaagtaattattaaggaaaacaagaccaaccataccaatgaaactcctccaggtcctaaccctccaggtcctagcccacctggtcctaaccctccaggtcctaaccctcctaagcctcatgttcctacacatccgcataagcctatagttccaactaatccgaaccagcctaaattggttaaatccaataaaaatccgttatctgatgtgaaagcaggtaaccctatagctttattattaatcgtattagtggttcttggttctgtgccatttgcatcatgcgatagcggtggaactagaagaagaagaaaaaccaaagagagaaaagcagcgaaacataaggaaatcgataagaagaaaggcattatcattttatccggatgtcttttattgatggtttctgtttcagccatttcagcagctgacactggtgatttaggctatgatgatgctggcagcgatgttgctgtacaatcagtaagtcacgaaccggctcaatattcctattcaactagcgaaaacatggcatatgatagttatgattatggcgattataatgattatggtggctatggcgattatggcgattatggcgattatgatggctatgacacttacaatgactattacatccttgacaacaacgaaacagtctatgaagatggcatggaaaattcagctgatggaaacagcgctgatgcagctaacggtcaagcaaatcaatatgctgaagatggttctgatatggaactttacagcattgatgatgaatcttatgattccaatgacaactatgacaattacaaagaatattcctatgatgatgattcatcccgcgaagatgcatcttcaattgtaagatataatgattgtaccgtaaacggcgataataaagtcaaatcaatttacacatcttcttcacttgctgaaggggaaggtgtagtggtttatgtttcccttgatggtagaacaggtgctgaaggtacctatgacgatccgctcctcactattggggcagcattgactaaattgtccactgtcagttctactgagacaaaaaccataattttgaaaggcggaaactattcaggaaacaattatagatatttatctactcgtttgaataatttgattataaaggctgaggacggcgctgaagtaaatgttgatttaaggggaatgaatcaaaacagtttgtattggactttctatggtgataatgtaactgtaagcggcattaactttatgaatgccaatatgacatcttacaaccttaacaattatcacgctgtattgaaatttatcaactcaagcaattctcgtgtggaagattgttcattcagcaatttgaaatcctatggaattcttgcaggaaacagtactgatgttgtaatcagcaattgtaatttcacaaatggaagctctagaatgttcagtataaccaattcaagtgtcactgttgaagattctatcatgaagaacttctctaccagctacattagaaattccacattcactatggtaaatagcaccgtgacagatttcaatgatgacgacatctttaatttcgcaaacactgatttggatattagggacaatacattcaagaatttgacattcccaaacaaaaccaattttcaacgttttggagtgttctatgcctgggatgataatgctggcataagttataatttcataaacaacacctttgccaatttcactggaacagatgcttatatgatttatcgttcagcatcctcttcagtcaaaccaatgtgcaaagtaaacttcacagacaacaatgtatcaaacgtatctgttggagttaatatatattatggaaatatcactgttgaaaataacagcttcgatcatatgagtccggccaatactttacgtttcagctattcaaacattgacataagagataacaactttacagattctaactctacccatgtttattcagatagatgcaatggtacaattgaatataataatttcattaacaactctgcattgcctgtttcagctgagtggggtaatttgaatatttcctttaacaatttcactgacaataagggcaatttctctgcaggagccattcaatctactggagtagtgaatatatttaacaatactttctgtaacaattccgctcgcgttggtgctgtgaatgttgccagcattagtagtaataaaaccatttacaataacacatttgtcaacaacacaggtgttagcggtaccctttatgtcaatggaaatgcaacagttcatgacaacagattcatagacaataatgtaagcgaaaatggaggagccatctatgcagcatatgataatagctataataattattataatatttctgctaatattactgacaatattttcgatggaaatattgctaataagggtggtgcaatctattatgaacaatataatagcgcttatggccttgataacttggcaaacaacacatttgtcaataacaaagccgaatatggtggtgcaatttattcaaataaaacagtgaatgtcactatttcagagaacgagtttgtcaataacagtgcaacaattggaggtgctatctttttagacaattatacctctgcctttaacactggaacaaacattactctaaacaatttcacaaacaactctgcacaaagtgctggagctgtagtggtttatggaaacaacaccaatgttataggcaataactttgttggaaacaatgctacacgctatggtggtggtgcacttgtgactgatggtgcaaatggattgatttataacaacacatttgaaaacaacaccgcattcctatatgcaggagccatcggaacaaacaacagcaagatcataaacaacactttcactaacaacaacgcttatcaggctggagcaattttaacaatcaattccactatacataataacacattcagtggaaatgacgctacaagagctcctagtgttggctatatagacaattacaactacactgtttcctcttactacgtttactactgtagcagtgaagattgcagcggatgcactgcatgcgaatcctgcacaagcacaatcatcgaccctataaccggagcggaaatcaaggtaatcaactgctctaacggtgatgtacctgagtgcatttgtgaagattcagttgcaacattgtataatattagcctattgtacaataatgaaggtctcaatcttgatgaagatgtttatgtttacgatgaaagcaccattcttagagttgctttaaacaataatgatatgtacttcctatatgaaaacgcaagcattccaaatgccagcgaatatcattactgggcatactgcattgaacagaacaactctaagccatggcaatggaacggaactactggtgttcttgtagatgacttgtactttgtaagaaacagcctggacggctcttatgttggagattacattaaggtattggtatcctacttctactttaaccttgacgaggatgtctataacttgaaagattatgtatatgtatttacagacactgactatcgtgctaatacagatagggtaattcgaagagttattaaccttacagaaagagaggacacatctcttgtaaacggcaataactggattaacggagtttataactgtctttcattccatagctttatcatgcctaccacaagacagaacctgattctcattaattcatgtatggctatgcagactccagacttcaatcctcagaaaatagccaacaaggagaatgtcggcactggagacattgtaaactacacagtcactgtttacaacaatggtactgtgtcactgcataatgtgactgtaaccgaaaggcctaacagcatgcttacctatctatcattcactgatttccgcaatcaaggatgggtgcaaactggtgagatgacttgggtcttgaataggcctctgaaggtccatgaaactggtacattcaatataaactttagggtaaataatgtcacatatctcactaatatcacaaactatattgatgtaggctgtgatgaggtttcaaacaaatctgcttttaccagaaccgaaaccaaatggccacgcatacaggttcaaaaaatcactttggaccaaaatgtaactccaggatcaactgtaagattcttgcttttagttaaaaatataggaacccttgaagcaagcaacatcactttggtggacaattttaatagaaatgaattggagtacgaatatagatgggattcatataaaggtaattggtctggaggacacggatggggaggaagcagctcttcttggcatgtcgacacattatacttgaaccaagtcctctatccgggtcaagaggctggagtgattatctacttcaaagtacctaacaatgtaacagtagggtctgcttataattcagtaaatgcttatagaaacggaacatctgaaggttattcaagcaattacacaattatacaacgtccttacttttcaatttggaaaaccttggttagctcaaaaacttcaaccataggagaggaagtggtattccaaatcaacgtacagaatacaggttatgtgaatttaactggtgtttatgtagaagacattcttccaataggattgaaatatcttaggttctacaatacagataatcataactggactcattttgtagatgaagatggaaaacatagattcctattgcaaaacactcttcctacctattattcagacagtcagaattatgttgcccgactttatattgtctgcaatgctacagaatatggtaattggtacaaccttgctacaggatacacagaacagacaaataagagtacctctcaggcaaatgttacaataattccatttggtgtatcaattgagaaagtcagcaataatccaatatcacaagttggagatcaggtctcatttaccattagggtaagaaacacaggaatatataacttaactgatgtctatgtaaatgaaacaaggaactcctatatggtattcgatcactttgttgacaattcaggcaagtggattttaaatgaatcttatgcaacttcaggcgtgcctagctggaattataatggtacttttgaagtaggagctgtaagcgaatttgatgttttctataatgttactaatattaattattatggaaacataacaaataccgcttatgtctcttccaaccaaactaccaacaggtctgtttccaatcagacagctgcctataatattaaggtaagaaaaatcagcaataatgctacagcaagggttggagatcaagtttcgttcactatccaaatatcacgggatggctattcttgggaaagtcctttctcattatatggcattcatgtaaaagatttggttcctgatggcttggtatttgaccatgctgataacagttactattggatttataatgaaagcgatgagacatggtactatagatctggtttgacagcaggcagaaccattagccttacattgtactttaatgtgaccaaggcagccaacataaccaatgttgcaattgtcggagtcaataacagtacagtgaaaactgcaaataatactacaaacagtatttaccataacttgcaagtggaaaaggtcactttaaacgaaacagtttacccaggaaatatcacagaattccttgttcgtgtgaacaacaccggtgacaataacctcacaaatgtattcgttaaagaaaacattccaaacggacttgtttactatgattatattaataagactggcaaatggaattatacggaagatgatgacggacctatatggctttatgatggcattttagctccaggagcattcggtgaattcattataagattcaatacaaccgtacctggaatctttgtcaacaatgtcgtagcaggctctaatgaaacttccaataagtccactgagaattcaaccaaagtcttgggtccaataatctctgttggaaaaatcactttaaacaagaccgtatatattggagagctaactgaatttagaattaaagtctctaatgatggggactgtaatttatctggcgtatatgttgttgaatacatcccagatggcttaaagttcgttgaatttaaagatgaaagtggtttatggacttacaatgaatcaagcagaacattctattacaatggaattttagaacgtgatgattcccttgagtttgtcgttgtatttaatgcaacaagagcaggcaactttaccaatgttgttcatgcaggatctaacgtgactaacgaatcagttgcaaacaacactactgaagcattggatgtaagaatggacattcaaaaggtcaccttaaacgaaaccgtattcactggtcaggaaaccggatttgtaattgtcgtttccaataccggacttaaggacttgactgatgtccgccttaaggaaatttatccagatggcttagtatattcacgcttcatagatgattcaggcaaatggtttaacagaggtgattattggatctataatggtgttttagctgttggagaaagcactaacttcactgttatattcaacacaaccaagagcggcacattcaacaatacaataattgtaagctctaatgaaacaggtcctaagaacacttcaaataccactaaggtagttgtagcaaatgttaccgttgcgaagatcacattaaatgaaactgtcatgagcggagagcaaaccagcttcgacattgttgtcaccaacgacggaatctataacttgactggtgttgtcgttaccgacgccttccctgaaggcttggcttacagcggcttcgttgatgcttccggcaagtggatctttgatgattccaaaggaaatgcttggatttataatggcactttggctcctggtgagtctgcaagctttacagttgtctttgacactgatgaagtaggtgaattcactaacatagtcaaggtaagcactaaccaaacccaagataagaacgcgtccaatataaccaaggtaatcaagcttattccaaatgtcgcaatccaaaaggtcactcttaacagaacagtctacagcggagagcaaaccagcttcgaaattattgtaagaaataatggagaaatgaatttaactgctgtgacagttactgacgccttccctgaaggcttggcttacagcggcttcgttgatgcttctggcaagtggatatttgatgatgctaagggcaatgcttggatttatgatggcattttggctcctggtgagtctgcaagctttacagttgtctttgacaccaatcaaacaggcaactttacaaacattgtaacagtaagcagcaatcaaactaaagagaaaaatgcatccaatattactgaagtaatcattaaatctgttccaggcattgagattataaaaatcacaatcaacagaactgtatacagcggtgagcaaacttcatttgacattgttgtaagcaatgatggtaatgtcaatttaagcaatgtgactgtaatcgacagcttccctgaaggcttgacctacagcaatttcattgacgacactggaaaatggtttaacataggcaataagtggatttataatggaattctacttcctggtgagtctgctggtttcagaattgtctttgataccaataagtctggaaacttcactaaccatgtaaaagtcacaagcaatgagactggagagaaaaactcatccaatgttaccgaagtaatatttgctgatgtcgctatccaaaagatcactcttaacagaacagtctatagcggagagcaaacctgcttcgatattgttgtaactaatgttggtgaaattgacttgactaatgttgtcgttgctgacagcttccctgaaggattggattacagcagctttgttgatgaaagcggcaagtggatctttgatgatgctaagggcaatgcttggatttatgatggcattttagctcctggcgagtctgcaggatttacagttgtctttgacacaaacattacaggtaacttcacaaacattgcaactgtaagcagtaatcaaaccagcgagagaaacgcttccaatattactgaagtaatcaagctcattccagacattgctatccaaaagattacccttaacagaactgtctatagcggagagcaaacctgcttcgatattgttgtaactaatgtcggtgagactaacttgactaatgttgtcgttgctgacagcttccctgaaggattggattacagcagtttcgttgatgaaagcggcaagtggatctttgatgagactaagggcaatgcttggatttatgatggcattttagctcctggcgagtctgcaggatttacagttgtctttgacacaaaccttacaggcaacttcactaaccttgctacagttagctgcaatgagaccgaggataagaacgcttcaaatattactgaagtaatcaagctcgttccagatattgctatcataaaggtcacacttaacagaactgtctatagtggccagcaaacttcatttgacattattgtatctaatgtcggtgaaactaacttgactaatgttgtcgttactgacactttccctgaaggcttgacctataacagtttcattgatgagactggcaaatggatctttgacgaagaaaaaggaaatgcatgggcttataatggtactttagctcttggagaatatgcaagcttcacagttgtctttgatacaaaccttacaggcaacttcactaactatgtaagtgttacaagcaatgagactggagagaagaactcatccaatgtgactgaggttattaaagtgcctaagaatgacactcctccggtacctgttcctccagagccagtggttcctcctgaacctgtaactcctccagagcctgtaattccaaataaaaaagttccaagacatgaattaccaagaactggtaatccattaatggtcttactcattgctcttgcagcagtaggattaagttctgtaagaagaaaaagagaataa

SEQ ID NO: 1666 - DNA, 1509 bp, Methanobrevibacter ruminantium
ttggggttatttagggttaaaagaattccggatgaaaaacaaataaaattaggcattagaactttagattttaacattccagaggatcatatttctcgttttgttggggatttcattgacgaatattatcctcttttaggaatcaaagaaaataaaaagaagaaagggcgtgacagttttccggtgaaagagatgttaaaattgcttatttatgctaaaatcgagcatattgatagtatgagattcttagcagacatggtaaaatatcatgacgtatataaattcgttggaaatggaatttgtccttcagaacgatcattacaacgatacagagaaaaatacggcaaatattacaatgaattgttaaaagcaaccttaaaaaaagcttcagatgtggattacactgatttcaacgaagtttccattgacggaaccatcaaaaaagcatacaattcaaaaaataaagtgatcacagaaaaagaaactgaaatattaacccgttacttcgaaggaggccgtgtaagtcaggaagagctagataaactccataaaccggcccgagagattcttgaaaataaaaaaatcagcaaccaagaaaaattatacctcttggatgacattaaaacacaattcacactgtctggtcaaaaatcagtgccagtaaccgacatagaagcacgttggatgaaaagcaagaaaggaaactcacaaataagctataatatccaatctgcagtcgattacgatacaaaaatgatttgtgcaataaacgtcgtacaagcccctacagaccattaccaattgccaaaaatcgtagataaggcaataaacaacacaaacgtaataccaagattcgtattggcagatacaatctatctgaatgaagaaagcttatcatatcttgcagataatcaaataaatggagttataccagatagaaagcaatccaaggaaaaaatcggaagattgaacaagaacccatatcacaaggatcacttcaaatacttccctgaaattgatgcatttgaatgtccagaaggccaaataatgtattttttcaacaaatacactgaaaaaaatgatgatttggacaagccagacaaaattaagcgtttatattccaattatggtgcttgtaaggcttgcaattgccgtgaaaactgcctttcatccacccaaacccacagaacaatcaccgaatatggcggaagtttaaagaaagcaatgtgggaaaaaatggaaacagaggaatatatggaagaatatgcaaaaaggtcatctgtcgaaggaccttttggcattttaaaggaacaattccatatagaaagcgaagtagtgataggaaaaacaaagacagaagaaagaatactattagatgccgtggcttataatttaatacgattatttaacttagaacaagaaataaaaaatgataaagaagatatagttgatttctgtgagaaaatttctgtccaagagaaattagaggtcagagcaaccatattttaa

SEQ ID NO: 1667 - DNA, 690 bp, Methanobrevibacter ruminantium
atgttagagaaagaagtaaaacaatataaaaggggaaatagtttcacttatcgtattgatctatctaagaaagataattttgaaggtggagaaaaaataatgatttttaggatgagcgaatatgaagcttatctaaatgaaatagaagatctaaagagtcaaattgaagaaaataataaaaccatctctgaacttagggaaagtcgcagcgaagctaattccaatataaataatgttgttgacaatcataataaggaaatagcagataaaaataaggaaattatggatcttattgaagagaacaaatcagctatccaaaaatgttatgatattattgaggaaaaggacaagctcctgacacaggctaatgaagagattagaatcgaaagggaaaaaaccgatgccactcgcaaacaggcccaggaagatattctcaatgagagaaaacgacatgatgaattaacccttgaaaaggataaacaattgaaattagtcaatgaacaacttcaggatagtctaaaagatatagcttataaggataaagtcattaccgcagataggcttctaattgaaagatataaaaatagaggttttgtagatcgtttacttaatagattgcctgatgacagcgatttaaaaatagatgacgtcaaggaaacctatgttttagaagctgaaaagaaggaatag

SEQ ID NO: 1668 - DNA, 138 bp, Methanobrevibacter ruminantium
atgatattatcattgcatctattttgctatggttacttttttatagactttgatgatattgtattgtcattgcattctatttgtaatttattttttatagattttgatgatattgtcattgcatctattggatattga

SEQ ID NO: 1669 - DNA, 1443 bp, Methanobrevibacter ruminantium
atgaaagtcgtacttgctggaactggaagcgcagttggaaaaactacaatttcaaccggaattatgaaagcgcttagtgatgaaaatgtccaaccatttaaggttggccctgattttatagatccttcctatcatacaatagctacaggaaatgtgagccgtaacctagactcctttttcatgactgattttcaaataattaattcatttgaaagagccttaaaaaaatccaattctaatatgggtatcatcgaaggagtcagaggtctttatgaaggaataagtcctataggagatgttggaaacactgcttcaattgctaaggccatagacgcacctgttgtgcttttgatggatgcaagaagtctcgttaaaagcgctgcagcagttgttcttggatttaaggcacttgatccagatgtcaggattgaaggagtcattttaaataaggtcaaaggtcagcgtcactataaaaaggctaaagaatctgtagaaaagcttgctgatgttccagttataggaggcattccaagagacgataagattactgtagaggaaaggcatctcggccttgtccctgctctcgagaaggaaagaattacaagaaacattaatctttggggcgagattgcagaggagtatatagatttggatgcacttaaggacattatgaagacaagctccaagtctactgcaagggacaataagaatattgcaatggaaaagcatgaagatgactttaatagagagcatactgaagcaatcgacctagaggttaccaatgactcaaagccagggcaattatggaaaaccggcaacaggaataaggtcaagattggagttgcccaggacgagatattcactttctattataaggaaacccttgaatcattggaggaaaattctgcagagattgttccattcagtccattaaaggatgagcatcttcctgatgtagatgcattatacatcggcggaggatatcctgaagtgtttaaaaaagaattatccgataataaaaccatgttaaatgatatcaataaattccataaggaaaatagacctatctatggtgaatgcggagggttgatctacctttccaaatcaattgacggcttagatatggttggtgcagttccatactcatctgagatgactaataaggttcaaggccttaattatgttgttgcaagggccaatcaagataatctcatatcaaatgagggcgatgtattcagagctcatgagttccattatactaaattaaatattgataaaactgattctttagtattcgatgtcttaagaggaaggggagtcctaaacaatatggatggtgtctgtgttaacaatactctggctaattacattcatattcatgcatgttctcatcctaactttggatacaattttactattaatatctcagagttagatatttag

SEQ ID NO: 1670 - DNA, 1116 bp, Methanobrevibacter ruminantium
atgtcaaccttagaaaagatgcaagtattagcagattcagcgcaatatgatttgtgcgactatgttagccatagcaagagctctcaagtaaacctgccaggaatataccatgcaacaggccacaacggatgcaagataccgctctttaaaacactgatgagcaataagtgcaaaaacgattgcaaatactgcataaatcaaagcaaacgtgatttcacccgtcttgaacttagcccggaagagcttgcaaaggcatttctccactactataacaacggctatgtaaacggcctattcctatcctctggaatctctaatgaaatcgatgaaacaatgaacaaaaccatagagaccgcaaggatattgcgaagggactatggataccaggactacatccatcttaagataattccaggctcaagcaaggattcaataaaaagggcgatgagccttgcaaatagggtaagcctaaacatagaagctgcaacaaaggacggccttagcgaaataacctcaacaaaggactataacaaggacatcctaaagagaatagactggatgcatcagattgcaaagaaaaatccggattatgcaaaatcaggccacaccactcagctcattgttggagcaaacgatgaaagcgattatgaaatactaaagcgaatggacagcctatatagaaaggcagaccttagacgcagctatttcagcgcattctcccctgtagagggaacagactttgaaaaaagagaagcatgcagcagtgatagaactgcacagctataccatgcagacgccctattgaatgactataagtttaaggtgaaggagcttgtatttgatgaagatgataagttgttccttaatgaggatcctaaaatcctagcagctcgtgaaatggatatcttcccagttgaaataaatacagcaccttatagggagcttataagagtccctggaatcggcccgaaatcagcaaggagaataatgagcataagaaaaaagatgccttttaaaaaactggaagaccttcaaaaattaggagtcgttataaaaagggcagagccttatattcaattggaaggcgcttatcaaaactctttagacaattattaa

SEQ ID NO: 1671 - DNA, 216 bp, Methanobrevibacter ruminantium
atgtctttagaagagattccttttgaagagcaattacgtggagttatcctagaaggagaaattgaacgtgctgaactaaaaggtgtagaaaaaggtagaaatataatcatcattaaactattggaaactatgaatcctcaagaaatttctgagagcttagatcttcctttagataccatcttaagtattcaagagtctcataccaaaaatgtttaa

SEQ ID NO: 1672 - DNA, 888 bp, Methanobrevibacter ruminantium
atggcggatgcgaaagattctaaagatgataaagtttatcatcttgaggatctattatttgtaaagtgtctagttcaatttgaagaatttccccaatatattactggatttaaggatattcgcaattcatttgacagtcgttttgcttcttcttctaatttttctagtttaaatcttgattgcgttcggcaaagagaggatttgagtcttattgatattgagcatcatagctctataaggccagatttaatgagaagaaattatgaatatgctgtaaatctgtataatgtgactggatatactgttcatccttttatcttttatactggagacttgcctgttaataaaataatccgtatgaatgattttaatacttttcagcctcagtggtttattttaaaggaaaaagatggaatgaaaagcttaaataacattaattataaaacatttaataaaattgattggaatgtttttgatgctatagattttgcttggatacctaaatttgatattgacatgtcaattgaagattgtatagttgaacttgctgaaatctataaaatgatgcctgctgacaataagttcttgcagttttgtagagaaagtctaaaattgtggacaggtaagtatataaaggataaagaaagattagataaagttaaggagtgtttaaatatgtctgagttagaagagattccttttgaagagcaattacgtggagttatcctagaaggagaattagaacgagctaaactaaaaggtgaagaaaaaaataggattgattttatttctaaagctttgaaacatatgagtcctaaagaagtttctaatatgtttgagcttcctattgaatatgtagatgaaattgcaaattcttattctaaataa

SEQ ID NO: 1673 - DNA, 1536 bp, Methanobrevibacter ruminantium
atgtatgcaataaacatggaacagaacaagaaggaattaaatatcccagatgaaatcaagatatttgacaccacccttcgtgacggcgaacaggctccaggaattgccttgaccgtggatgagaaaatcaagatagctcaaaggttggatgagcttggagttaacgttatcgaaatgggatttccaacagtttcaagcggtgagcgaaaggcagctagagagatggtaagccttgggttcagctctgagttatgtggccttgcaagagtggtgcaaaaggatatagatgcattgattgactcagacctttcatatgcacacctgtttatcggaacttctccccttcacagagactataagctaaagaaatcaaagacagagattctaagccaatccatggaaatggtggaatatgcaaaggatcatggccttaaagttgaattttcagctgaagatgccacaagaaccgaactgaactatcttatcgaattctacaagggagtggaaagcgcaggtgcagacataataaatgtgccagacacagttggaatccttgtgccatcaaccacaagaacattaataagaacccttagaaagaaaattaacctcccaataagccttcattttcataatgactttggtttagcagtatcaaactccctaataggcatagaggaaggtgcaaaccaagcccactgtacaataaatggaataggcgaaagagcaggaaacacctctcttgaagagcttgtagtaagccttaaaatcgcttatggagcaaacctaacagtagatacaaccaagctatatgacacttccaatttcatcggatcaattacaggtataaagatgcctcctacaaaaccgatagtgggagacaatgcatttgcacatgaatctggcatacatgtagatggaatcttaaagaacagctcaacctatgagccaatagccccggagatagtagggcataaaagaaggatagcccttggaaagcatacaggccatgctgcaatcaagtcaaagcttgaggagttcaatatagaagtgacccaaaagcagtttgacaatatctataatcaggtcaagacccttggagacaagggaaaatgccttacagatgatgacttaagatccattgcaataacagaaataggaacaagtggcaaggaatacataaagctcctaggtcttagcgtaatgacaggagagtcagtctcagcaacagcaacaattaagctttcaatagacggaaagattatggaaacatcccagataggagtgggtccagtggatgcatctgtcttagcacttaagacacttgtgcaggacagagttaatataagccttgatgaatacagacttgaagcaatcacaggtggtacagacgcattagcagaaacctttgtagtgatttcagacgacaaaggaaacaaggccacaggaagggcaaccagagaggacgttattctttcaagtgtaattgcggtcataaactcaataaacaggatacttgacatccaggagaactgttaa

SEQ ID NO: 1674 - DNA, 666 bp, Methanobrevibacter ruminantium
atgaagtttgatccacatattcacagtgttttttcaggggactcacgttcggaaccaatagacattctcatacaggcccaaaagatagggctagatgcaattgcaataagcgaccataatgaaataaaaggctcccgacttgcaagaagcatacctggagatataattgtagttccctccatagagatttctacagagaaaggccatatgttaggattgggagttgatgagattattcctaaaggattgtcagctgtagagactgtagatagaattcatgatgctggtggattagctatagttcctcatcctttttcctattatagacacggtctattctgcaatgtggattctaacttaggagtggatggtgttgagaccaagaatgcaagatacatatttggatactcaaacaaacaggcccaaacattggctgagcgaaaaaggcttgccagattaggagcaagcgattctcattttttagaatcaatcggggatgcctatacagaggtaaacactaaaggatatgattctgtagatggcatattaaaggcaataaaacacagacgctgcagggccatgggtcatggaacaagcaactttttggttgcaaaagaagtatttgttaagaaggtgcttagaaggtatccgaaaagggacgaataa

SEQ ID NO: 1675 - DNA, 1077 bp, Methanobrevibacter ruminantium
atgaagattttagctattgatgtaggaactggtactgaagatatcttattatacgatacagaaaaggaaatagaaaactctatgaaattggttattccttctcctcaccttacaatcggacaaatgataagcgaatcagagtctgatttatactttgacggagtaatcatgggtggaggaaaaataaaggacagatgtcttgaacatatggaaaaaggatataagatagtatttgaagaactatcaggcaaaaccattcgtgacaacattgaacaagtcaagtcatttggttttgaagtggtaaaagaaggtagctttgacaaggagctaaatgaagattcaagcttaaagtatgcagattatcaaaagatatccttaaaggatgtggatgtagataagttaatagacattttcaagtcatttgacctagaccttgaggttgatgagcttatcattgcagttcaagaccatggatacagtgaagatatgggagatagggacttcagatttgaaaagatcaaggaaaaattgccagagcctcttcctccggaagtttttgcaatggaaagggaagaagttccagagtatttcacaaggatgcagtctgtaatccaatccctagaggagtcaaatccagaattcaagccagttcttatggataccaaattcgcttccttagcaggggtctgctatgacaaggaagttctaaagctaaacagtttcattgtcatggacattggaaacggtcatacaactgttgcgtccattgaaaacggcaagatacaaggtgtttttgagcaccatactagagatcttagtccagagaggtttgaagagcttgtacttgcacttgcagacggcacaattaagcatgaggatgtccacgatgagggaggtcatggcgcatttgcactaaatcctatctcaaagatagagaaggtagttgttgcaggtccaaaaagagcccttgtagaaaagacaaatcttgactattatcatgcagctccaggtggagatgtgatgatgactggaactgttggtctagtaaaatcaatggagtacctaaggaaaaattag

SEQ ID NO: 1676 - DNA, 1302 bp, Methanobrevibacter ruminantium
atgcaatacagaattgatttaactaacgatgaagtacctacaaaatggtacaatattaacgctgatttacctgtagagcttcctgctcctaaaaacagtgaaggaaaagatcaaatatcaaccttacctcaaatatttgtaaacgagtgtctaaaccaagagttctccacagaaagatatataaaaattccatctgaagtaagagagctctaccaaagattgggaaggccgactcctttatgcagagcaagaggattggaagaaaagctcaacacaccagcaaagatctattataagagagaagacacctctccaactggaagtcacaagttaaacagtgcaattgcacaggcatattatgcaaaaaaagaaggaatcgaaagaataacaaccgaaacaggagccggacaatggggtactgcattatgtcttgcagcatcaatgatggacattgaatgtacagtatatatggtaagggtttcatacgaccaaaagccattcagaaagaccatcatgcaattatacgacggaaacgtacacgcatcccctagtgaaaacactgaagtgggtagaaaagtccttgcagaaactccggacactcctggttcccttggaatagcaatttctgaagctgtagaagacgctttaaaatatgatgatgtaaaatacacccttggaagtgttttaaaccacgttatcctacaccaaaccacaattggtcaggaaatcaaattacagcttgaaaaagctgaagaagagccagacacaatgattgcatgtgtaggtggaggaagtaacttcggtggatcattattcccattcattaaagacaaaatccaaggaaacagcgacactgaattcatagcagttgaaccttcagcttgcccaaccttaacagaaggtgaatacagatacgactttggagacaatatgggattcactccgcttttaaagatgtttacattaggacacaacttcgttgctccttctgtacacgctggaggacttagataccatggtatgaacactcaaatatccttgcttaaaaacgaaggttacattacccctgttacagctcatcaaagagatgtatttgcagcaggtaagatgtttgcaatgtgcgaaggagtcattccagcacctgaaacaaaccacgcaattaaagcagctatcgatgaagctaaaaagtgcaaagaaactggcgaagagaaaactattgttgttaacttctcaggccatggtttaatggactttaaaggatacgcaagttacatggacggatccatggaaaattccaaatag

SEQ ID NO: 1677 - DNA, 777 bp, Methanobrevibacter ruminantium
atgggagaaacaatagctgtaatgaatcagaaaggcggatgcggaaagacaacaactgtagtaaacttggcaacttcacttgctgccatgggaaaggcagtccttgtagtggacatggatccacaagcaaacgctacaacaagctttggaattaacaagacagaaatcaaaaagacagtatacacagctttagtaaacgaatgcagtgttcaaaaggcaactataccaacaaggatagaaaacctattcctcctgccaagcaatatcgacttaagcggtatcgaggtagaattaagcaaggaagacaactaccacattgctttaaagaaactgcttgagccaataaaaggcatattcgactatataatcatagacttacctccatcccttggtataattacaatcaactcattaatcgctgctgacagcgtaatcatacctatccaagcggaatactttgcacttgagggactggctgatcttatgaacacaatcaaccttgttgaaacaaggctaagaagcccaactccaataaagggaattgttctcaccttatacgatgcaagaacaagattaggcagagaagtatatggagagcttaaaaactacttcaaaggaaaggaatacatctttaagacagtgattccaagaaacatacgtttagcagaagctccaagttacggcaagccttgcatagcatacgaccctgaaagcaaaggatcaatagcttacctcaaaatggcaagagagctcttaaagctggatggtgaaatataa

SEQ ID NO: 1678 - DNA, 747 bp, Methanobrevibacter ruminantium
atggcaaaaaaacaaaattctggattaggaagaggactagattcattgattccaaaaattaaagaaatagaacaagatgtagaagaaggattatcattagaagacttattaaaaaaatcagatgatgaagaggaaatagaagaaacagtagaagaaacagttgaagaagaagcaattgaagaacaagaagacatttcaactgaagaaactgaaactgaagaagaacctgatgaagaagaagatgaacctgtagtagaaaaagatgaaacagaagaagaaaaaatagaaattgaagatgaacctaaagaagaactcgaaaccgaagctaaagaagaggaaacctcaaactatacaaacatcttcagtaatgatgatgaaatagtaactgaaaacagtacaaaaaccatagaaatttctagctcaaaaaataatgataaaaatattgaaagttcagttaatttaaacaaagaaactgaagaaagtatcaaaataaatgaagataaaactaaggaaaatgattctgatagtgttcttagtgaaaaagaagaaaaactggtatatgaagttatcgaaactgttgaaaagaatccaagaatcacattatggtctgcaagatcagctgctgtattaaggtatcttagaaagaccgaacctgaattcagcataagcaatgaagcatcaaatcttattgatgaggcaattgctcaaaagtatccagaaatctggacattgtttaatcatttatga

SEQ ID NO: 1679 - DNA, 759 bp, Methanobrevibacter ruminantium
atgaaattaggattttcactgctttcactgtttatgaaagaagttgatgagatgcttgagatagctgtagaaaatggatttgacagtgttgaactgcttgcagagggaccatacagacaagacatattattggaaaggaaagaaattacagaaacattccactcatatgaccttgacatatacattcatggtgtaaatgtggacataaaccttgcaagcctaaacgagggaattagaaaagagtctgtaaagcaaacaaaggaatgtcttgaccttgcagatgagataggtgcaattggggttactgcacaccctggaaaaataggaaggcctgaaaaataccttagagaaatggcattaggttttttaactgaatcaacccatgagcttgttgcatatgctgaagataaggaggcgaagatatctatagaaaacatgccagaacgcttttcttatcttggaaatagagcatatgagctagagaatctgaccaatgagactggctgcaatattacaatagacttaggccatgttaacacatgcaaagaccaattaagcttctttgaaattcctaacattctttattatcatattaatgataatgatgggataaaagacaagcatcaggccattggagatggaacccttgacttgaatcttttaaaatatgtggacaatggcataattgaattgaataattttgataatgtcttaaaaagcaagaaagttattgaagatttcttagcaaaaaatcaatga

SEQ ID NO: 1680 - DNA, 807 bp, Methanobrevibacter ruminantium
atgataaaaatgactaaaaaagctattgtatttgataactctggaacattgcttgagcgatttagagtcattaaagacctatctacaggtgaatttatcactcatgtaaactctttagacctaattgacagttgtctaaatgcagctttagttgttcttcaattcaatacaaatcgattaaaagatttagacccaaatactttaataagcgattttgtattggaaaataatattgattttgacattagctattattcaacagacgtttccaaagaagaaataaaggccattttagaaaaggacacagctattatcaaagacattacagacactttccctcttttaaaggaaagggttcctggaatggagctctgcaatggatcagcagtcatcatagacatagaggaagagagaatttcctatacaataacctctgctggtcaattgtttagcggagtaaaggatacaatagcaaagcttcaagacagcggaacagatgttttcattgcttcaggagacaggtcaggagatataaggaaacttgcaaatattactggcgttccagaagatcatgcctttgctacagcaagcacagacagaaaggcagaaatagttgctaatcttcaggatgagggttataaggtaatgatggttggtgatgggcctaatgacattttagcatttcaaaaggctgatgcagcagttctcacaacagaacagaaggatggagattttccagacaagttaaagtcttatgctgattttgttatagaggatattagtgaagtgctgcaaattgatttctaa

SEQ ID NO: 1681 - DNA, 951 bp, Methanobrevibacter ruminantium
atgcatctagacagccctttaaaaataaaaaacatctgcttatccaatcgcatagtcatgcctcctatggctagggaggagagcatagacggaaaggtcacatatcctctgattgaatactataggatgagagccaaatcaacaggactgattatagtggaacatgaatatgtgagagaggaaggaaagtcaagccctaaacagctttcaatggcagatgacagcgtaatagatggctatatagagcttaccgaaagcatacacagagagggatcctttgcaatagctcaaataaaccatggcagatatgggtcaatatcttcaaataatgtcaatttaaatggaatatcaatagaggaaatcgaagatataaaaaaggcctttgttgaagctgcagttcgaagccagaaatctggatttgacggcgttgagatacatgccgcccacgaatatctcttgaaccagttctattcaccatatacaaacaaaagaactgatgaatatggaggaagccttgaaaatcgcatgcgacttcataatgaaatcattagagaaatcagagaggctgtaggtgatgattatataatagccattagatttggagcatatgactatttggaaggtggatctaagatggaagatattccagctgcagtcaaatcttttgtagaaagcggagttgacatgattgacatatcaggtggactttgcagatatcagaacccttattcaagggagcctggatactttaaggacttgagcaaaatagctaaggaatcttgtgatatccctgttattcttactggaggggttaagaaagcaaaggatgctgaaaggttgattaatgagggatattgtgatttgattggcattggtagggctcttttgatggatggagattggtcaaagaaggctataagaaaagtaagaaaaataaaatcagacaaataa

SEQ ID NO: 1682 - DNA, 282 bp, Methanobrevibacter ruminantium
atgagggcgagagaaagacgagcacgactaatgagtttatatatttacatagtgatgaccatgatacaaacaaaagtatctgcaaggaatcagacaactattccttcaaaaatccgtaaaaaatacaatgttcaacctaatgacatagtggaatggaaagaaaacagaaatggggaactgacagtcacattcagaaaaagaatttccttcagagatatgataggaaaaggcacaataaaaactacaacaaatgctttagatttggaaaaggatttatattga

SEQ ID NO: 1683 - DNA, 1059 bp, Methanobrevibacter ruminantium
atgtttgaaaaaagaaaaattaagagactatctaatcatttaaataattcatatgatgcagaagattatgtttcagcgctatcttattgtgatatgattcttgatattgattctaataatcctcatgctttatttaataaggcaaagattttagttattcaaggagagctcttagaagcaatgtcctattataaaaaagctttacaaacaggtttctttgatatgtctacatgggttgatgaagtctcttattatatggatggggatatttcttcaacaaattataaattatctaatcgaaacgaaatttccttggaattgtgtgagatatgtttagagaaatatgctaaagatattttctttagcatatataaatctcaagctttagataatttaggaagatttgaggaatcattaaatgcaatctctctagatttaactcctgctgatggagagctttatgtttttcaatgtatcggccaatgttttccattatctaatttgaataggtgggaagatctattggaaacatcatcaaatggattaaaattgaagagtgaagatccaagcttaaatagttttaaagcaaaagctttatattatttaaatagattgaatgagtcagaaggattttttaataaatatattcaacttacaaatgatagtagggcatataattttctctcaaaaatagaattcaaaagaaaaaattatacaagtgcattaaaactaattaacaatgcaatacaactttctaaaaaggaacatttagatttactagaatcaaatgttttgatagaagatgatggaatatatgaaaatgattactatatgaaatcactaatcttattaaaattgaatgaattagacaaatcaaataagattattgattgtctaatggaaaaagaggaatctgctaagaattattgtttaaaagcgagaattctatatgaaatgaaagactatagaacttctttgagttttgttaataaatcattagatttaaaatccgattgcagtgaagcaattgaacttaaagaaaaattgggggagttttaa

SEQ ID NO: 1684 - DNA, 1119 bp, Methanobrevibacter ruminantium
atgtttacaaaaataaaaattaataaactttttaaagaattagattctgcattaaataatcaaaattttgataaagctttgattattcttaataatattttaattttagatgaaaataatttaggtgcactatataaaaaagccttgattttatataataaaggtgaatacgagaaatctttatctgtattggatcatctgctcagcatagattattgcattgatgcattcctgttaaaaggaagggtttattgcaatttaaatgattatgaaaattctttaaattcttataaggaggcatccattaatttcgatttggataaaatgaataatgaaatgacatattatgcaagccatccttctttatttgataaaggaattcatacaaaaattttcatagatttatgcaatatcatattggataatgcagatattattgaggtccgtcttttcaaatcttatgttttatctgaaatcggtcgcagtagagatgccttaaataatgtgaattatattttggcacataatccaaataatgaaaaagccatttctcttaaatcttccatattaattagtcttaatcattttgatgaagcattggcattaattaatgaaggtttaaatttatatccaaacaaccttcaattaatagatacaaaggctaggctttattatgctttgtctgactatgatgaggctctagaaatatgcaaagaatataattccatggatgattttggaaattattatctcctttcaaaaatagaatataaaaaaggagattattcattggctttgaaaaatattgatattgcattagataaattttttaaaaatcctaattttgatgacaaaaaggaattttctcatgcttattattggtataaatcgttaatcctttctaaattggatagatttgatgaagctaataaaatctgtgattgcctaattgaaaaagaggaatctgctaagaactattgccttaaatcaatgattctttttaaagaaggaaattatacagatgctttaattttcattgataaggcattggaattagattgtgaatgtgataaggcattagaacttaaaaacaatattgaagataaattatcttcataa

SEQ ID NO: 1685 - DNA, 1404 bp, Methanobrevibacter ruminantium
atgaaaaaaggtgttttaatgaatatccttgaaaaattaaatgcaattaaaaatcaggaaataactgcaaaggaaaatgttgaatcttatattaaagtcattgaagagaaaaacgatgaactcaatgcttttctcgaactaaacaaagaagatgcaatagctaaggcagaggaaatcgatgctaaaatcaaggcaggagaggaagttggagctcttgcaggattggtattcggtatcaaggctaacataaatgtggaagaccttatcatctctgcagcatccaagaccttggaagactacattggaagctatgacgcaactgtagtcaagctcatcaaggcagaggatggaatcattatcggaataaacaatatggacgagtttgcagcaggaagctctactgaaacctcatactatggagctgtaaacaaccctgcagcacctggaagaattcctggtggttcaagcggaggaagcgcagctgcagcagctgccggcatgtgcgacatcgcaataggctctgacactggaggatcaattagaaacccatcctcccactgtggagtgtatggtatgaagcctacctatggcgcagtctcaaggcaaggccttcttgacctttcaatgagtcttgaccagataggccctatggcacgtgatgtaaccggtatcacccttgcattggatacaatcgtcaaatacgaccctacagaatgtacaaccttaaaatgggacgctcctaactttactgaaatagcattaagcgtaaaggataaggaaaaacctcttgaaggaatgaagatagcaacttgtaaggaattcaaggaagtcacaaatgacgaaatcaatgaaatcattgacgaatcagtagctaaattagaatcccttggagctgaagttgttgagctcagctttgactatattgacatctgtcttccaacatactatcttatcaactatgttgaattcttctctgcaaccagaaaatacgacggcagaaaatacggctcaagaatcgaagaggtctgcggtcctgaagtacttagaagaatccaaatgggttcatacatttcacaaaaggaattcagcggaaaatattaccaaaaagcacttcaagcaagatccctcattagaaatgcaatcaatgacatgcttgaaggtgttgacttgattgtaggccctactgttccaaagcttcctcacaaacttggagaggaattggagcctatggaaatgtatgcatacgacgttcttactgtaatagctaaccttgcaggaatacctgcagcaagccttaaggcaggggaagttgatggcatacctgtaggattgcaattgcaggccaagccacaagacgatgcaaagatcgttaaggcaatggctgcatttgagtatgcccaataa

SEQ ID NO: 1686 - DNA, 570 bp, Methanobrevibacter ruminantium
atgatgagcgaacttgaaaaactaaaatccggccttgtatactgctatgacgatgaggaagtctcagcaataaaggacaatgcaatctatcaaagctttagatacaacaatatcgacccaaatgacaagcaaaagcaatatgatgcattggaagagattttaggaagctgtggagatgatgtctggataggaaaaagatttagctttgacaatggaaaaaacatacacataggaaacaattttacaggaaactacaatctaaccattcttgatataagggaagtctacattggagacaatgtaatgataggcccacacacccttataaccactgtaggccatccattagagccaaagggaagaaggaagcatcttgcaatggctgattctatacatataggtgatgatgtatggataggaggaaacgttacaattctccctggagtgaatataggaaacaatgtggttataggagcaggagcggttgttacaaaggacattccagacaattcacttgcaattggagttcctgcaaaggtggtccgcgagatagaaaacgatatagaatga

SEQ ID NO: 1687 - DNA, 864 bp, Methanobrevibacter ruminantium
atgacagataattcatcaaacatgggaagcaattcagataaaaaggagtttgattcagatagaaaagagtttaattctgataaagagtttaattctaaaaaggagtttgattctaaaaaagaatttaattctaaaaaggagtttgattctaagaaaaaagactttaattctaaaaaattcaattccaattataaatccaatagaagcagaaataacataaacacaatccaagatttaaaaaattctatcgaacttaaggaaaataagattaatgacttaaaagagcttttagaaatcaaggatgaagagaagcaagaagtagaatatgagctttccctaaaggaccaggaattgaatgacctgcaaagcaagttagacattttaacagtggaaaatgaggaattgaccatagagttaaatgaaaaggaaagcaaaataagcaaattaaacaatgctcttgtaaaatgcaaatacgaaaaggacaaagtggacttggttttaaagaatgaagttaacattgaaaaatcaaggcttaaggaaatggataatctaaacaatacaatcaaggaaaaaatagcaattatccatgataagcaagagcaaatcaattatctaagaactctcattgatgactataaagaccaaaccaaaaacaatacagacaatcttgacttgcagcttaaaaagattacaaaaacatatgaaggactgctcaatcaaaaggattcaattatagaaaagcaggaacaaaatataaatgaattgattgaatctcaaaagcaaatagctaaagacaataaagcaactattacacgtcttgaattggaaattggtaaatatagggaagagttgaagaaaagttaa

SEQ ID NO: 1688 - DNA, 390 bp, Methanobrevibacter ruminantium
atgattaaaatggaaattacaggaattgttacaacaggtttaggaaaagcagcttactttctaggtcaggatttctacaaaagtcaattcaatgaaaaatgcggttttacaccttttccaggtactttaaaccttattgtagaagagaataagctcgaagacatcagacttatgaaaaacagttgcacaaatgttataaagccagatcaaggatttggcggagtcaaacacatcagagcttatttgaatgagaatattgttggagcaattgtatttccagacaagaccactcatgatgaaaactatttggaatttatttcaaaggataaattgagggataaatataattttaaagatggagatgaggttgtaataacaatagacatttaa

SEQ ID NO: 1689 - DNA, 1710 bp, Methanobrevibacter ruminantium
gtgtcttggctagttgttcttatagtgtttctgcttgcttcaataaaatcaactaagaatccatctgtgtctgtggttataccagccttcaatgaagaagcgactgtagctcaagtggtaactgtagctcgcaagctatcatatataagcgaagtcatagtggtggatgatggatcaactgataaaactgtagaggaagcggaaagggcaggagcaactgtcataagccataaaggcaaccaaggtaagggggtagctatcaaaacaggatttaaaaattcccatggtgatatagttgcctttatagatgcagatgtatccaatttcactcctacaaagatagacaagataatcaagcctattttggaaggtaagacagacattacaaagaccaaatttgcacgggaaagtggccgtgttacagagcttactgcaaaacctcttttaagtttcttcttccctgaattgaattatgaacagcctttaagcggtcaatttgcaggaaagcgttctgcacttaataaaatcaaatttgaaaaggactatggtgtggatgttggcatagtattggatgctgatgttcatggaataagcattttggaagttgatattggagacattcaacatgacatgtcttcccttgccgatttaaacaaaatggcaaacgaagtggttagaaccatcattgacagggcagttgattatggccgtgtcactatgatggatacccttggaaattatatcagaatggccatcatgggattgtcccttatcattcttggactgttcatgattttctttgttccattcattccattggtcatatccgttttagtggctcttgttggaattgcactgactatagcctatataattaaaatagttcaaaggtcaattcctattttaaggaaaggggatacaagtacggcattaaagtcatttgttaagatgcactttcctgtaatcgtatcaggccttatattgattctaatgctttccacattcttatcagcagcaacatttaatgatggcaggatatcagtggagcttacttcaagaaactttgtatattccccttcagatgactatcatcaaaccatttcagtaagagggccttataccattgacagcgcaattgaaaatgaaacagatatggttagaatccctccagatgcattgagcacgttggagatgtctgcaaacgatacgatgattatagacggtgaatattattctgtcaacacttcaagagaaggggaagtggatgtattccgcctttcaaaagcagtaaggcatgatttggatttatatcctcgtgaagtcataccaaacagtcgtttggctgaagtcttcaatggagtcattgtcaatcataacatcaacttcaataattcctctgaagtcatggaaggatatgtccaattcagcataagtcctaaggctacaaatgcaactttcttcaatcttacattggataatgaatcacttctttcatcagtgggcaatttcaaaaacgattcctattatacaattgcatatgacgacgatattctatgtgcatttacaggagacgacatcaagaagggaaatgttacttttgagtatgcaggcaaggatggaatgatagtgtttgaagacagaaacaatacctctataaggaactttatagattccgatagggattcatttgttaagctgtacactctttaa

SEQ ID NO: 1690 - DNA, 9240 bp, Methanobrevibacter ruminantium
atgagtattaaacgaatattacttacgagtttaatgctatttataataatattttcaatttcgtttgtaagtgcaaatgaaaatgtaacaaatgacgtaagtacgaatgaactatcaacacaaactgtatcaaacgatataactactagtgaaagtataagcgatactagtctagactctggagaaaaccggggtttggatgagatcaaatcgaattcgacagaagagtcatcatcatccaatttggaccttgaggatggcactttaaataacgatgaaattgaaagtgatgattgtttaactaaaaatggaaaagaagcaacattgcaagcaaataaacttagtcttgacattaatatgagtagaggtacagcccaagatgtactggacgcaatcgtacgaatttccagtcaagggggaggtacactctatctgaatggtggaacctatactgaaggaggccatgccagagtttataataatgacactgatagtttccgtaatatcgtaaggaacgatggaatagtagacatttcaaatgttcgcgtagttggtggtagcgtagacaatccaaatcaatatgctacatttcaaccaaatactcgtgatagtacttcattggcctttagcggttacggtgtttgggatggtaatggaactagatattaccctgattccggttttaatttaactaacgttacttttgaaaatttaaactgtacaggtagattctttagttttaacagcgggtatttgacagattgtgtttttaataatctggagtcctatcagcacctcttcttcgtaactggagcttacaatgatggtggtaagccaatagtactaactaattgtaacttcaccaattccaaacaaacttacaggggtgacggccctggggatggtactgatggtaccggtcagtttggtgtagtattcggtgctgaaatgtatggatgtaacttcatcaatacaagcactgctactcacggtggtgctttttgtctttcagacgaatggataagtgctgcatgcgttccaagtaagttagttgattgtaattttatcaacattacttctcgatggtttgcagtttacatacatggaaattactccaataccaccagatttattacagaacctcaagtggtggaaaactgtagctttattaattgtacagcaaccggtgaatttggtggtgcactcggaataagtcataacaatgtaattataaataacactgagtttatccataacgtcggtggaaaaggttccgctattatggttggtggaatcaataatactcatgacggattcttgggtgttaatacgcaaggtaataatattacgatttataattgtacctttgaggacaatattgcaaaaattgaaggtcaaagcagtgctcacagtactgatcctccattcactacttaccctacaggttatggaggtgctgtttatgtgtatggtaatcataccaaaatcatagatagtacatttaacaacaacactgcagatgattcttgtggtgctgcaatctacattagaggtgacaataccactgtcgttaattctgagttctataaccataccagtgaaaacggtactatatatttagttggtaacgattgtaaaatcaaagattcccttttccacgacaacgatgcagactctactggtgcttgtattttcgttgaaggaaatagggcagaaatcggcaatactacattcgtcaacaacaccgctcctaatggtggatgtgtattcattataggtgaccataccttggtagacaatgacaccaaattcataacaaacaatgctacaaacggtgcaggaatctatgttaacggatcaaacaccatgattctaaataccagctttatcaacaatacagctgtaaacggatcaggtgcattcatctatggtcacgacactgacgtaaacggctcttactttgaaggaaacgatgctacaaacggtggagcagtattcattgaaggaaacatcaacgatatttccaacaatacattcctcagaaacaatgctaccaatcaaggtggagcagtatatattgacggaaaccataccaaagtcaattataacaacttcacagagaatgaagcgattccaattagcgaagatcaggaaaccggtctcggtggagctatcttcataaggggaaacgatacaaatacaactgcaaacactttcctccacaacaaggcacgtaacggatctgcaatctacacagacggaactaacttctatcttcacaatgatcatttcttagaaaaccaagcgtggagttatctgttaattacaactgcagaccctgcagaaagcttatataaggaacaagatattgaaatcaacgttttatacagagctggagacaatattatcaatgctattcacaacaggaacaaaccaaatgaaacacacttcatgaatgtaacctattcccacagtgaattcggtaatatcacaactagtcctgccgaccagtatgtcgaacctgtagacggcgttgaaaacagtcgagaaggagagttattgtaccaagacgaccgtgaaaactatcaacaaatcgaactcagggtagagcatgaaaatggtgatttagcattgccaaggacaccatttagaaccaacatctacggaaatgttaacactaccttgaataaatcttccttaaggaaaggtttatacgttgtaggggctgagcacattgaagattggaactataagttcattatgaattctacaagtttcagaatccttgatacaatggacataatggttaacaaaaccagtgacaaggaagaatacttccaagacgaaatagcagaatgggaattaattttccataacacagacaacggtactgacgctgaaaacgtgacaatgaccgatcacttgcctaatgtatttgaattgatgaatctcagctacatgttctataccccaacagaggcaattacaaatgctacactctacttaaacaataataccttaagatacggagtatataactcaagcagtcagcaatgggtctacggcgatgcaagatataatgcaagcgccaatagttggacatattatttctttgactatgacaatgtcacttatgtctacactgaattcaacgctgatgactttgtacctgtattcggacctgtcatatacagcaacagcactgatgtctgctatgacaacatcagctacaacattcctgaagaggactggtactatgataccatcatggtaaacggtcaggaagtaagatacggtcatttcaatgcaacagaattcgaacaatacttcggaccatcatactatgatgaagacaacaagacttgggtttggatacataggggagaggacccattgaatccaggccaggaaactgatcttcgcactatctatgatcctgagtctaacatctgggttatagatgattatatgcactatccagagagaaagacagttacagaaaaagtcgtctttaccattgtaaacgacacagcaaacaatctgacccatctttcattatacgcaagagactttgatgtaaacgtaacaggttacgtaaacttcacaacaaactgtacaagatcaggtgactacactaacgttgtaaacgttacaaccccagactatgactgggacttgtcaaacaacgtagctaacagatctgtactcgtcgacccgcttccaaacaagacagtcagcaacacaactccttactaccatgactatgtcgactacaacttgacaatcatgaacacaggcaattcaacctacgaccaaatcctaaccgttgtagacagcttgcctgaaggactagtctacaatacaacagtaggcattttatacgctgaccaaatcggcgaaacacttgtggaaaaccaaggacgcacagttacctggaacgttacaaacattccggcaaataccaatgcaaccataattgtaagggtatatgtagatgctcttggaaacttgacaaacaacatgacactcatagctccaagcggagacaacagaaccgtaaacgctacaattacaccggtaacctataccgatgtatctgttaacaaaacagtcgaaaaagaggaatacttcataaacgacactatagtttggaccataaccgtatccgttgcaggaaacggttcaaatgcaacaaacgtcaacctttcagatgtattgcctcctgaagtcgaatatattagcacaaacggtacatacgacaatgcaaccaattcctggtacatcggcaacatgaccaatggaagcagcgtatcaatcacaattgatacccgggcaataagagttgcagaaaatgttaccaacgtagcaaacgtaagctgtaacgaaaccgaatgggactatgaaaacaacagagacaacgcaacagtaagcattattcctgttcctcagaaaaccgtcaacgaaacaaatccaacatttggcaaatacgttgactacaacctaacaataatcaacaatggtgcagagccatatacagacacattgaccgttgtagacaacttgcctgaaggactagcctacaataacaccgtaagcattctatatgctgatcaagttggcgacacaattgtggaaaacaataaccgcaccattacatggtacgttacaaacattcctgcaaatacaaatgcaacaataattgtaagggtctatgtaggcattcttggcgaacagataaacaactacactcttataggtccaaaaggatctaacagaactgtaaatgcttcaattgttgtagaaccaaaagttgacatatcagttgaaaaaacaagcgacaaaatcaactactttgaaggcgaaaccgtaatctggaccattactgtatcaaatgcaaacaatgcaactccagcaaccaacgtaaccctcaaagacatcttgccagaggaagtagaatttgtaagtgccaacgacacatacagcaacgaaaccggaatctggtacatcggagacatggcaaacggaacaagcagaacaatagtaattaatactactgctataagatccaaaacaaatgtcacaaacgtagcaagcgtaaactgtactgaaaaagaatggaattacacaaacaatgttgacaatgcaacaataaacatctacccattgattaacaagactgtaagcaattctacccctgactatggagatgaagttgaatacaacctcacagtgataaacactggagacgtaatgttcaacgaaactgtcacacttgtggacaggctcccagaaggagtcgacttcataaaagtactaaacgaagatggtttaaaggtaataagtttcgaccactctaccaaaaacctaacatgggttgtcacaaacatatcagctaacacaaaagcaaccataaccatcctagcaaattgtaccttggtcggtctccaagaaaacacctggaccatctacggaccagagggcatgaacagaacagttaacgcaacaatcgtagtaggaccaaaagtagacgtatcagttgaaaaaacaagcgacaaaatcaactacttcgaaggggaaacagtcatttggaccataaccgtgcacaatgcaaacaatggaacaaacgcaacaaacgtgacccttaaagacatattaccagaagaagtcttatacgttagctcaaatggtacatacaacaataataccggaatctggtacataggcaacatgaccaatggatcaagcagaacaatcgtgatcaacaccactgcaataaaatccaaagcaaatgtaacaaacgtggcaaacgtaagctgtaatgaaaccgaatggaactacacaaacaatgtagacgatgctgtaatcaacatctatccattaatcaacaagaccgtaagcaatccaaccccagactatcacgaagagattgaatacaacctcaccgtggaaaacactggagacataatgttcaacgaaaccgttacactcgtcgacaggctcccaataggagttgacttcataaaagtagtgaacgtaaccggtttaaaggtaataagtttcgataacactaccaaaaacctaacctggaacgtaacaaacataacagcacatacaaaagcaactataacaatacttgcagtatgtaatgctattggagtccaagacaacacttggacaatctacggaccagaaggtatgaacagaaccgtaaacgctacaatcgaagtaaaaccaatagtggacgtgtcaattacaaaggtagccgaccaagaaatataccacataggcgacaacgtaacctggatcattactgtgcacaatgcatggaacggaaccaacgcaaccaacgtcaacgtcaacgacatattaccaaaagaagtcgaatacctaacccacacagttacacaaggtcaatacaacaacagaaccggaatctggactataggattcatggcaaacggaacaagtcagacactcacaatagtatccgtcgcaaaaatcaacaaaaccgacataaccaatgtcgcaaacgtaagttgcagcgaaaaagaatggaactattcaaacaacagagactacgcaacaatagaaattgttgacactccaatcaacaagactgcaagcaaaccggtcccagactaccacgaagagatcgaatactacttgacagtcacaaacctagcaaatgaaacctataacaaaaccgtgacactagtggacagcctaccagaaggagtcacattccttagagtggtaaacgaaaccggcttaagagtactaggcttcgaaagacgtggcaatcaccaaatctggaacgtcacagacatcgaaccaaacacaaccgcagtaattaccatactagcaagatgtgacgcagtcggaacaaaaatcaacaactggacaatctactaccctaacggagacagcgaaaccgtaaacgcaacaatcgaggtaaaaccaatagtggacgtgtcaattacaaaggtagccgaccaagaaatataccacataggcgacaacgtaacctggatcattactgtgcacaatgcatggaacggaaccaacgcaaccaacgttaacgtcaacgacatattaccaaaagaagtcgaatacctaacccacacagttacacaaggtcaatacaacaacagaaccggaatctggactataggattcatggcaaacggaacaagtcagacactcacaatagtatccgtcgcaaaaatcaacaaaaccgacataaccaatgtcgcaaacgtaagctgcagcgaaaaagaatggaactattcaaacaacagagacaacgcaacaatagaaattgttgacactccaatcaacaagactgcaagcaaaccggtcccagactaccacgaagagatcgaatactacttgacagtcacaaacctagcaaatgaaacctataacaaaaccgtgacactagtggacagcctaccagaaggagtcacattccttagagtggtaaacacaagcggcttaagagtgctaagcttcaacagcactgaaaaagtccaaacctggaccgtaacagacatcgaagcaaacacaaccgcagtaattaccatactagcaagatgtgacgcagtcggaatagaaatcaacaactggacaatctactaccctaacggagacagcaaaaaagtagaaactccaatcgatgtacagccaatagttgacttgtcaactacaaaaaccagcaataaggacgtatacttcctagacgacacagcagtctggaccattaccgtccacaatgcatggaatggaaccaacgcaacaaatgtcgtcatagacgaattgttcccaagtgaatttgaaatcatcaactacacaacaacaaaaggaagatacgatcctagcgcacgtgcatggacaattgatttcatggaaaatggcacaacagaaacattggtaatcacctcagttgcaacagtggttacaccattcgttgacaaccctgtaaatgtaacaagcgatgaaagggattggaacctatccaacaacccatccaataagtctgtaaaagtcatagacattccagatccagaaaaaaccgtgaacaatgcaactccttactacaatgataccgttgtatacagcttgactatcaaaaacactggagacattaaatacactaacaagttaacagttattgatagcatgccacaaggattggaatatgtcaaaaccgttggtataagtggtgctaagttaatcaaggaagttgttaaaggacaagtgatcacttggacaattaccaatatctctgcacactcaaatgcagtgataaaagtaagagtcagagcaaaagcacttggaaacctaaccaacaacttgaccattgtaactccacatgcaaacaagactgtaaactgtaccattactccagtacctattgctgacttagcagtcacaaaaacaaatgaccattatggcaaagactgccttaacagcacatttgtatactggactataaaagttgtaaactacggccctaacaccgcagtgaatgcaatcgcaaaagacatcttacctgaaggaataatctacctttcagatgattctgacggagcatacgattacgaaactggaatctggacaataggaaaccttgcaaaaggcaaatctgtaacaatgaccatagaaacaattgttgacgctatcgacacaagaatcaacaacaaagtggtcgtctcatcagacacctacgatccggacaaatccaacaaccgtgacaacagctctataaaagtcatttcaatcgctgacttgaaactcaccaagacagctaacgtgaccaaaacttatgtaggagaaaacttcacttacactattaccgttgtcaaccttggtcctgatacagcagtaaactctcgtgtatacgacgtattgccaaaaggagtgaaactcctaagcttcaacgaaagcaaaggaagttacaaccctcaaacaggcaaatgggccatcggagacatggcattaggtgaagaagtaacccttaaagtaaacgtcagagcattaacaactggaaaaattgttaacgaagcacgcgtcgaaagtgacacttacgacaacgacacttcaaacaacaatgactcagcaactgtaatcgtgatcggagacaatcctccaatcaagatgctacctacaggtaatccaatactaattgcactcttgtcattacttgcaattgttggcgtaacacttagaaggaaaagttaa

SEQ ID NO: 1691 - DNA, 2187 bp, Methanobrevibacter ruminantium
atgatgattgctgatacattatcacaagaacttaatataaagatatcacaggctgaaagcgttataaaacttatagatgatggaaacaccattccatttattgcaagatacagaaaggaacttacaggttccctcgatgatgaagtgctacgtaaattcgatgacaggctaaaataccttagaaaccttgaagagaaaaaggagacagtgttgaattcaatcgaagagcaaggcaaactaacagatgaacttaagcaatccatccttgactgcaaaacacttgtagagcttgaagacttgtatcgtccatacaagccaaagcgcagaacccgtgcaacaatagctaaggaaaagggcttggaagagcttgcaaacattatccttgcacaggaaatcgaggttccattagaggaaatcgctgaagactacattacaaaggatgactctgtagaagaggaattaagagtaaacactgtggaagaggcaatcggcggtgcacaagacattatcgctgaaatcatatctgacaatgcaagcttccgctccctaattcgtgagctaagctatgaagatggagaactaatctctgaagcaaaggacaaggatgcagattcagtctatgacatgtactatgaatatagcgaagaggtcagcaagattgcaagccatagggtgcttgcaatcaaccgaggagagaaggaaaagttcctgaaaattaagataagcgctcctgaagaggatataattagctatcttaccagacatgtgcttatcaataagggcggaaagccaacaaagcctatatataacaagtatactgaagagactcttaaagaggccatacaagactcctataaacgtcttatagctcctgccattgaaagggagcttagaaatcagctctttgaaaaggcagaggacaagtctataaagctcttttcaaaaaaccttgaacagctcctgatgcaggcccctatcataaacaaggttgtccttggctgggaccctgcattcagaacaggatgcaagcttgcagttgttgacgaatatgggaaagtccttgacactacagtggtctatccaacagagcctcaaaacaagatagctgaaacccgctcaactgttcgcgaccttattttcaaatatgatataaacatcattgcaatcggtaacggaaccgcttcaagggaatccgaggcgattgtagcagacataataaaggaccttgacgttcagtatgtgatagtgaatgaggccggagcaagcgtatactctgcaagcgaacttgcaacagaggaattcccagactataatgtaggggagaggagtgcaatctcaatagcaaggcgtcttcaggaccctcttgccgaacttgtaaagatagatcctaaatctatcggagtgggacagtatcagcatgacatgaaccagaagaagctaggtgagtcccttgacaatgtggttgaaaagtctgtaaataatgttggggttgatgtaaacacagcatctgtatccctcatggagcatgttgcagggataagcaagacagtggccaagaacattgtaagctatagggaggaaaacggcaagttctatacaagggatgagcttttaaatgtcaagaagcttggacctaaggcattcgaacaatgtgcaggattcatgaaagtcaaaggccctaatccattggacaacaccacagtacacccagagtcctatggggcaacaatagctttcttaagcttcttaggctattctattgaggatttagagaataagaagataaaggaatcagaccttgaccttacagacaagcagtttgaggacatggcccaagaactaggaataggttcaataacattgaaggacattgcaaaggagcttaagaaacctggccgtgacccaagggatgagatgcctcagccaatccttagaaaggatgttctaacaatggaagaccttgaaaagggcatggtattaagcggaactgtaagaaacatagttgactttggaatctttgtagacattggggtccatcaggatggcatggttcacaagtcagagataacagacagccaatacgtaaatcatcctatggactttgtaagtgtaggggacataattgatgttaaggtcttggatgtggacattccaaaacgtaggattcagttatctatgattatttaa

SEQ ID NO: 1692 - DNA, 3675 bp, Methanobrevibacter ruminantium
atgaaaactagagtaagcgtgatcattcccatttataatgtttacgaattcttagaggagtgccttgaatccgtcgttaatcagaccataaatgatatggaactgactgacggatatgaaaggaatcttcaaataatactgatagatgacggatctacagattccagccctataatcgcaaaagaatatgcccaaaactacgaaaacattgaataccaccatgaagtcaatcaaggattaggccatgccagaaactacggatgcgaatttgcagaaggggactacataattttccttgattcagatgataagctttctccaaatgcctatgaatggatgtataaaacagccataagaaacgatagcgatatgaccattggaggattctggagatttaattcaaaaaaatacaagatttcaaacattaataaaatagctttcaatggaaacaaagagaaaacacacatcagcgaaagcccagaactcttttatgatacaaccgcttggaacaagctaatcaagcacagcttctggaagaaacataatttccagtttcccgaaggaatactctatgaggacatacctgtaacaatacctatgcattttctagcaaacaacgtttcaatagtctacgaaaactgctacttatggagaataagggaaggaaaatccaaatcgattacacaaacaaccaccgaaattaaaaatctcgaagacaggctttatgtcatggggctggtggacaagtttttcgatgagaatgttgatgatgaaaggctccgccatgtaaaaacaatgaaatggcttaaaaccgaccttcttatttttattagaaagctaagaagcatggataaggaacagggatataaaataatgtcactaatccgagattacatccaaaataacatagatgctgatgaattcaagtacttgaatgagtatgaaaggttaaaatatgaatatctgatggatgatgaaattgacaagatagtttcaatattgaacttcaaggctgaaaatataaaggagacaaaggtctatcaaaaaaacggacatataatgttcaatgcagataaggaagtgtttaagcaaagcccattttacatagaccaatacatcagggaaagatacaatagaaaatacattcaagacattgagattagggatgacggatttctaataagaggatttatgcttattccaggactggatatcaaaaactttaaggacagagagcacagattccatctgacaaatgccaatagccataaaaagatcaagatagattcagaagatgttgaaactggaaacataagctccttcaacataaggtttggaagaggattttcatatgatgctgcaggatataagatcttcataccattctctaaaatatgtgatgatgaggacttctttggagagaatagaatatctgtagacttcaagctaaatggcatctatcaaagcccattcctatcttatgaaaaaaaggaactctgtcaaaatttctttttaggatatgcgaaaaaggacattcgtcaaaaaaccaatatgaaagctgtaatctataaaaacacctatttcctcattagatataccttgaaggatgaaatcattattgaagcactccctttaaaaaactactttaaagagattagactagatgaaaatgttttaaaattagatagcgaccatatcggaaatttatacatttattacgaagcggactcaataaatgaagaagaaaaaatagcttttgaatatgacaacgaggataaaagctaccagatagatattagaaagctaaagaagaagccaggtaaaatactttgtgatggggaaaattccatatacaagtcaaaagaacttatattattagattccaaatatggacaatgtcttattagtaccttaaatgattattacttggacatttattattttgatagcttgacacaagttttagatatcagacaaaatagggacagaattgatattgatgccaaattatattccaataggtttaatgaaacaagaagcacatataaagcagatagaataaaaacagccaaactatactttaaagacgattcaagcaaagagaattacatactatctgatggaatgatagataggcaaaccggagatataaaattcagcatagacttttcaaataaggagattactaaaaacctatatgagaagattcatgatctctatgtggaatatgcttatgatgaaacttctacagaagaagaagcaattgtaaataaagaagtagatgaaagtgaatatgattcagtctcaaaagaagaaaaagaaaataataaaatagaaaaaaccgaaaatgaaccagttccagttgaaggaagaaacaataaaatcaatgaagaatcccgattttcaactgaactctatcttttcaagggtgatgataaaaccatctctaaaagctactatgaatataaggtctatcatgatttaaaaggcttcttaaaactaaaagtcttaaaaagatggccagtctatgaagacacccctggaaaaaggcttaaacattcacaaatatcctataaattgttttcaaaactgcctataaataaaaagcgcataatgtttgagtcaatctggggtggaaaatacagctgcaatccaagatacctttatgaatacatagacgaaaactaccctcactatgaatgcatctggtcctttaaggatgagcattaccctatcaaaggaaatggaaaatgcgtaagaagatcttcactgaaatacctctattacctcgcaacttcaaaatatctaatcaataatgtaaactttaagaagcatttcataaaaagaaaaggccaggttgaaatacagaccatgcatggaactccattaaagacaataggactggacgccccaggagagtttccaaccaaaaagagccaaaaggactatatcaaaaagaataagaattgggattacctcactgtgcaaagcgattatgttgcagagataagcagaacatgttttaaatatgaaaaggacttcttaaaatttggatatcctcgaacagacatattatatacaaaaaacaataaggaagacattcaatcaataaaagaaaggatggggcttccatcagataagaaagtaatcctttatgcccctacatggcgctttaaaaacaattttgacttgatgctggatttgaagtcctttaaggaaagcctgaaggatgaatacatattgattctcagattgcatcacttttcagcgggaggctggaaacagcctctggatgatgatttcgtatatgacttttcaggatatggctcaatcgaggagctgtatctgatttcagatattctaataaccgattactcctctgtaatgtttgattatgccattttagacaggccaataatactgtttgcatatgatttggaagaatatgatgaaaagcttaggggattctatatggatattgaatcaaataagcctggacctattttacatagctcaaaagaggttgaggaagccattttaaatattgaaaagactgaaatgaaatataaggatttaagaagaagcttcaaagaaagatttaatcagtatgaatgtgaaaactcatcagagaaaatatttaataaagtgatagataaaaagaagaataagaaataa

SEQ ID NO: 1693 - DNA, 294 bp, Methanobrevibacter ruminantium
gtgaattgggttgtaattccagaatattcattaattccttctttaaattggtttataactgattttttagggacttgctgcagatgcggtgttgatatatttttaatgctctctggagccttgtccttagggcgtgattgggacatcaagtcttttttaggcaaaagaattccaagaattacctatccgtatctgttctgggccacattattaatttccataatgttagttgcagtttatttcaatcccgatttattaaaactttttttcggcatatcacattcctttatataa

SEQ ID NO: 1694 - DNA, 1008 bp, Methanobrevibacter ruminantium
atgatgattcctaaagttatgataattcttggaagtgcatctgataaggatatagcaatgaaatccataaagattttggaaaagcttcagattccatatagcttaaaagtggcatctgctcatagaacccacgataaggttaaaaagcttgttaaagatgcaacagataaaggcgtagaagtatttataggaatagccggacttgcagcacacttgcctggcgctatagctgcatatacccacaggccagtcattggagttcctgttgacggagctgtgggaggtcttgatgcattgtatgcatgtgtccaaatgccgtttcctacagcggttacaactgttggaataaacaggggagacaatgcagcaatccttgccggagaaatcattgcaagctatgacgaaaaggttggtcaaaacatttccgatttaagggttgaatatcaggaaaaggttgaagcaggtgaaaaggagcttatcgaaagcattgaaggggaatacttccaaaaagacttcttggaagaagaaaaatacgaaaagatagagtttgaagagcttgatgacactccagatgttatgatccttgcaggaagctattcagatatggaaatagctaaaaatgtagcgatactacttgaaagaatgcgaataaattataaacttgattatatttctccaataagacatgctaaggattttgaatcatatatgagtaaaagaaacaatgctaaaatattcattgcaataagtggcctgtctgcacttgtagcaggaagtgttgtagcacttactgaaaagccagtgattggggttccttgttctaagaaattaaatggccaggatgcattgctgactatggcaaacatgccacctggagttcctgttggaaccgttggaattgataatggtaggaatgctgcaatagttgctggagaaatccttgcaatatccaataaggagatagaagagaacttaaaatggataaagtataagaatgctgatttataa

SEQ ID NO: 1695 - DNA, 1263 bp, Methanobrevibacter ruminantium
atggcagaagaattaaacattattcaaattgatgaagagctagatgctgaatatgaagctgcaaaggtgcttcgcaagtatccaaaggatacagtcatgctaaacaatataaaaggatacgacattccagttgtctccggtatctgcaatacaagggaaaagatagcacagtcccttggatgtcaggttgatgaaatattatacaagataattgatggaatgaacaatccaactccaatcaccaaattcatagaccttaaggatgaatacgacagcaaaagagtggatttaggaaagatcccaatactcacccactataaacgtgacggaggggcatacattactgcaggggttgtctttgcaaaggaccctgaaacagggattcaaaacgcttcaatccataggatgcttgttctggaaaagaacaaattagctattagaatcgtcccaagaaacctttacacctatttccaaaaggcaaaggatatgggaaaagacctagatatctccattgcaattggaatggagccttccatacttcttgcatgtacaacttcaattccaatcgatgcagatgaaatggaagttgcaaacaggttcaagaatggagaattggaacttgtaaactgtaaaaacggaataaaggttccagaagcagacattatctttgaaggtaagatattgattgatgagaccgctcctgaaggaccatttgtagacttgactgacacttatgactatgttagagaagagcctgtaatcaaattaagcaagatgtatcttaaaaaggaaaatccaatgtatcatgcaattcttcctgccggattcgagcacaagcttcttcaaggaatgccgcaagagcctagaatattcaatgcagtcaagaacacagttcctaccgtgcagaatgtagtgcttaccgaaggaggctgctgctggttgcatgctgctgtaagcatcaagaagcaaaccgaaggagatggaaagaacattataatggctgcactcgctgcacatccatcattaaagcatgttgttgtagttgatgaggatgtaaatatatttgacccacaggatattgaatatgcaatagctacacgtgtaaaaggtgatgatgatataattattgtacctaaggcaagaggttcttccttagatccaaaggcttcagaaatagatggaaccactacaaaagtaggtgtagatgccactaaatcaattttagaaccacataagttcgaaagagtaagctttagtgagtaa

SEQ ID NO: 1696 - DNA, 1053 bp, Methanobrevibacter ruminantium
atgaaggaatctagcttttacatcaaactatatgaagagaacaattccaccgaccatatctctaactcaaataagtcagtacaatgcaatctatgtgctagagaatgtaaaataaaaaataataatacagggttctgtaaaagtcaaaaaaacatagatggcaaactatttgcacttaactaccaaagaattgcctcataccatatagatccaattgaaaagaagcctctataccacttccttccaggctcatccacttactccataggcggttttggctgtaatttctcatgtttgaactgtcagaactatatgctttcaatgaattcttataatgaaaacaactcaattaagatactgccagaaaggattgttaaaaatgcacttgacaatgattgcctatcaatatcttggacctataatgaacctacactatactttgaatttgctgaggaaacttctagacttgcacatagtcaaggccttaagaatgtcttcatcagcaatggttatatgggtgaagaagtcttgaaagaaacagtaagttttattgacggattcaacatagacttgaagttttttgacgatgagctctatagaaagatttgcggtggcagactagacattgtccttgacaatctaaggactatttatgagtctaagaaaaagtacaataatcatttggagataactactcttctaattaatgatttgaatacggagaaggagcatattagagcaattagcagatttgttttagatgagttaggtcctgaagttcctcttcacttttcaaggttctttccgatgtataaaatgactgataaggctccaactgatattgattatcttattagggcaagagaaatagctatctctgaaggattggagtatgtatatttaggaaatatgcctgctgataacaatacttattgcccggagtgtggtgagctattgatagagagaaataggtattgcaatagggataaaaatagaataaaggatggatgttgtgttaattgtggacatgaattgaattttgtctttgattag

SEQ ID NO: 1697 - DNA, 1242 bp, Methanobrevibacter ruminantium
atgaaaagcactcttaaagtctctgatattggtgaaaaacaactaatagaaagaatcatagaaaaatcaaaattatgttccctaaaaaatccatttgatttagatgatttcaattctaattacccgagttctaattttaaaacatcaattggagacgattctgcactcttaaaccaaaatctaaatactaatcactatttagtggcatcatctgatatgcttatccaatcaagccattttccaagagaaatgacttattaccagatgggatataagtcagtcatagtcaatgtaagcgacttggcaagcatgggggctaaaaatataggattccttttaaacatagctatccctaaagacacatcacttgacaattttgacgatctcatttgcggcattattcgtgcatgcgacaattataatattccgcttgtcggcggagatacaaatgaagcgagtgagataatcttatctggaacagcaatcggacaggtagaaaaaggcaaggcccttatgaagcacggatttaaggaaggagacttggtctcgataagtgaccatcttggctatgccgctttaggctttgagcttttaaaaatcaaggaagagaatattgacaaatacaatgatataattttccaaattaataaaattgacccaacagttaaggatttggctctttttaaggcattaaagccagaagccaaatatgaagaaggccgtattttagcaagccataatagtcaagaaaacagaatatctgcaacagacattacagacggccttgcaagtgaattctatgagattttaaatgccgataaaaagtattatctattcaataaagatactgaatcccataatccgaatgattcgaatgattcgaatgatctgaataatcagcagaataatcagaataacacaaataatcaagatgtgattgatgaatatgatgatagcaattattcaaaaggcataagaatttatgaagacaagcttccagtggacgatgaatttaagcaaatagcagatgttttaggtattgattaccttgatttatttttacatataggggaagactttgaactcctatttacaatcaataaagaactaaagagccaattagaaaatgatatgaatttttatgtaatcggtgaaattacaaacaataatacagttgaaatagtactctctaatggagatataaaaaatataagttcaaaaggatacgagcatcttaaataa

SEQ ID NO: 1698 - DNA, 684 bp, Methanobrevibacter ruminantium
atgaatttaattaagggattagataagaataatggccttgatttaatattacatgctcccggaggagatgtaggggctacagaatctataatagattatttgtatgaggtttttaatggagatattagagttattatacctcaaattgccatgtctggagggactatgattgcatgctcatcaaaagaaataattatgggtaaacaatctagtttgggccctattgatcctcaatttaatggcattcctgctgagatagttattaaagagttttatagggctaaaaatgaaatttctgaaaagccagaaaccattcccttttggcagactaatatttcaaaatatcctcctgcatttattattctttgtgaaaatgcaagaaaatggtctgatgaaattttagataaatctttaagatatgctatgtttgatgggtcggatgaggaaaaaattaataaaataagattagaattaggctctcatgaaaatacgaaaagtcatggcagacatttatcagctaaagattgtcaagaattaggcctaaaaatttcatatttggaagatgatgacgagttccaagacactgttttgtccattcatcatgcctgtatgaatttttttagtattaataaggattgttgcaaaatagttgctaataatgactcaaaatttttcatacaataa

SEQ ID NO: 1699 - DNA, 168 bp, Methanobrevibacter ruminantium
atggctgtagaatttaatgaggtgataaaaatgaacgaatcttatgtaaagagattatatagagatcttggaatcccttattatcgtccaaaaaaagataaaggagatgaggagttcgatttttttccaaagtatgacctaatgcattggatacctttgaaagtatag

SEQ ID NO: 1700 - DNA, 321 bp, Methanobrevibacter ruminantium
atgtttaagataagaaaattatccaataaaattatagttttgcttatatgcgggctattgatctgtagcatacaggcctgctcggcctcatgcactgcagtctatgtagggcctgatgtcagtgcagacggttcaacaatcattgcaagatgcaacgaccatcagggagtttggggaaaccatatcacagtgaccccaagggtagagaacaagtcaagccgtcttatggctgtatgcgaagatggaagcgtaaaaacagagcttccggcaacaacttacaaatacacagccacaccatatatgaacagcacaaaagcatga

SEQ ID NO: 1701 - DNA, 462 bp, Methanobrevibacter ruminantium
atggaaacaatattaaccaacgaaaaagacgaaagattcatagagctttctaatgaattgaacaatgaatattactctaatattggagaagactctctaaagtatctcgattacaacaccttagaagatcctcatgttgtattgcttgtattaaattggggaaatcctatagcctgtgccagctatcgtatatttgatgagcagtcagttgaaatcagacgagtctatgtaaagaagagatatagaaataaaaaaatagcttataagcttgtcaaggccttggagaagttggctatggaaaacaatttcaaatactcaattattgaaactggaagtgaaaatatggctgccatcaacttatataagaagctaggctatgaaaagatagataattttggcttttttaaggacgatgatgcttgcatttgcatgagaaaggagtttaagactcttattttttaa

SEQ ID NO: 1702 - DNA, 468 bp, Methanobrevibacter ruminantium
atgcatcaaaaatttatggaagaggccatcaaagaggccgaaatctcatcaaaagagggaggattgcctataggagcagtccttgtaaaggaaaaccaaataatctctagaggccataacagacttattcaaaaggattcatccatcctacatgctgaaatggatgctatcgaaaatgcagggcgattaaatcacgaagactaccaaaaatgcaccttatacacaacattatctccttgtccaatgtgctcaggtgcagtgattctatacaatatcccaagagtcgttatcggagataatcaaacccttatgggagcagaaaagctattaaaagataatggtgttgaaataattgtcttaaacgatgataaatgcaaagagctctttgaagactttgtaaacaataatccaggaatatgggaaaatgagcttgctaaggtgggaaacactacagagctaaaggaataa

SEQ ID NO: 1703 - DNA, 969 bp, Methanobrevibacter ruminantium
gtgattattatgagtgaagatactgctgttttattattaagtcatggaagtagtctcccttatgcagaagaagtttttaaggacatatgcgctaaatttaaggaacagactgaatttgacgctgaagtaggctatatgaaagtggctaagccaagcctccctgaggcaataaatatcttaaaggaaagaaacccaggtctaaaaagaatcatagcaactcccgtatttttagcccctggaattcatacaaacatcgacattcctataatattaggccttgagcctaaggaaaccgacccaagacagcctgacggcaattacccagaaggccactatctctatggccttgaagaggttgatttcgatggagaattaaaacttatcgatgcaataggccctaatccaagacttattgaaatcataaacaacagaatagacacagctcttgaagattccaagctagatgatgatgcaaagacagcagtcttacttgtatcccatggaagcagattaaactacaataaagagttcatttcatgcgtattccaacagtttgaagaacaaaccgattatgtatgtgactttgcattcatggaacttgtagatcctaacattccaactacaattaacaagcttgtaagcgaaaatgaagttgacagattaattgtagtccctgtattcattgctccgggcgttcatacaacaagggacattccgacaatattaggccttattgaggatgatggtagcggacatcatcaccatcaccatcatgatcacgaccatgaccacagtcacgaccacggacatgaccatgatcacggacactctcacggacatcatcaccatcatcatgcccatggggatgaaaagatggagttcgatggagaaatcttatatccagaaccaatctgtgatgatgacatattgattgaaatattagaaaccatggttaaagaagctctttag

SEQ ID NO: 1704 - DNA, 399 bp, Methanobrevibacter ruminantium
atgtctgatactgtaagaacatggcgtcatatccaacaaagatacaatcttattggatctaaatgtactacctgcggtcaagttttcttcccgcaaagagttatctgtcctgaatgcagaagaaaaggaaatatagaagatatacaattttccggaaaaggaaaaattcacacctattccgtgattagaacacctacttctgactttaaaaagatagctccttatgctgtagctatcattgagcttgaagagggcgcaaaggtcactgcacagattgttgacgctgatgttgatgatattcaaattggcgaccctgtagagatggtctttagaaagattcgtgaagatggccctgatggcgttatctcatatggattcaagtttaaaatcgtaaaataa

SEQ ID NO: 1705 - DNA, 1017 bp, Methanobrevibacter ruminantium
atgtactcctcagaattgattctgtccctcatattgattatattcatcataggaatcatggccaatataacagacagcgtcaatgaaaaggtccttagccaagaggagctttcctccctagaggccataagcatagaaagtgtagattatctattgaacaatcctggaagtccaatgaattgggaggaagatgaaggattgaataatggaattgtatcaagacgaatcataccaggacttgccataaataaaaaatctgtggaaaatggctttttttatgaagaaagcagtagtgatgaagagataatacctaactccatatcatatatcaagctcttaaagcttcaatctaactatgatgacttgatcaatcggaatctatttaattcgactcttaaaagttcaataactatttatccccactctgatattgatataatagctatgggagatgatttagaatcatctagtgatgttgtggctataaatagaacagttagatgtgactatcttagcaattttgtgatatataggttcaatgactttgagctttatggtgagaattataaaaaaaccgaactctgcaatcatgacagcaatgttaatctatctaatcatagcaatgatcgaaggtatttttggctttgcaagaactttagaatctatagaagttctctaaataactataattattacttgatttctgattcgtcaataaggcatgcaaatagttattatatactggaaagccttaacagaacaagggatgatatggaaagattaaatgatgaggtgattgaattaaatccgttctttgctgaagatatggtaaatagctctaatgagatttattcaattcattttaaggttccacatgatgatattgatgattttaaaacggttatggtagctatccataagaatatgactgatgagattgtatccaataatcagttgagatatgattattttaatagcggggaggtggattttgttttaaaaacggcttatagatag

SEQ ID NO: 1706 - DNA, 435 bp, Methanobrevibacter ruminantium
atgagcactacaatcagaattaacaaagacgtgaaagaattattaaaattaaaaagtgttgaaacaggtgtaagtcagatagatttagcaaatagatacattctatatggaatcaaatacgatgatacccctagtaaacctataaaatcaatcgaagaaatagaaaaactattaaattacgatgaaataagagaatctgtcgaagaaatagatcttaaagattacgaatacgaaatacctcaaggaatttcattagttaaagaaggagaagaaaataaaccaatcaatactgaagaagaaattaaaaagatattaaaatatgataaaccagaaggagacgatgtttcaagaagcatcgccggaataataaagacagaagaagtcacagatgcggtaaaactaaagaaagaaagattaaaagagaggtataaatga

SEQ ID NO: 1707 - DNA, 393 bp, Methanobrevibacter ruminantium
atgatttttttagatactacctatataattgcattaataaatgaaaatgataaatatcataagaaagctttaaaattgatggaagatgtggattatgaaaagaagatgacaaacagtgttgttttcgttgaatcattaaatatgttggataaaagaagcacacaaaaggatatagataacattgttaataaattatatcaattagacaaaatacattgtgtaaattctgcaaatatcaaaaactcactaaatatatttaaattttacaatggttctataaattttgcagattgcactataattgatagtatgatcacatatcggataaatgaaataatatcttttgattctgattttgataaggtgaaagggataaaaagaatttatatttaa

SEQ ID NO: 1708 - DNA, 705 bp, Methanobrevibacter ruminantium
atgacaacaatgatagaatttcaaaatgtttcaagagaatatcaaagtggagatcacatattaaaggcattagacaatttaagcctaaagattgaaaaaggagaatttgttgttattttaggaccatcaggtgcaggaaaatccacatttttaaaccttttaggaggattggataccgcaactagcggaaaaataatcgtaaatggggaaaacatagcagattatgatgataatcaattaacaaaatacagggcaaaggaagttggattcatattccaattctataacctgattcctaatctaacagcaaaggaaaacattgagcttatgagtgatataaccaatctaaaggtagatggaaataagatattggattctgtaggtctcttagaccatgcaaaccaattccctgctcaactctctggtggagagcagcaaagggtctcaatagctagagccattgcaaaacaaccggctatgctattatgtgacgagcctacaggtgcattagactctaatactggagtactgattctttccttgctccagacaatgtgtcacgagaagaatacgacagttgtgatagtgactcacaatgccaaattggcagatgcagctgataagcttatcagaatcaagaatggacagatagaggaagttaaaatcaatgaaaatccattagatattaatgaaattgagtggtaa

SEQ ID NO: 1709 - DNA, 609 bp, Methanobrevibacter ruminantium
atgcctagcgtaaaagatattttaattgaaatgaaagatatgtcggaattaatggtcgatttagcttattcagctgtattgtttaacaacagagcagctgctgaagaggtaatcaccttggaaaacaagttaaacagcatgaattatgagattaaaaaacaatctcttgttgctgcaagatctcttgaggatgcagaaaagctaacaaccttgcttgagattgcagaagctgcagaatccatcggaaatgcagctaaagacttagccgacttgacattgaaaggattcgaacctcacccagtatttaaaatggttatggaagaaagtgaaaagaccattatccgtttgaatgttgatgaaagttcagttcttgtaaacaattcattaggtgacttattattattaaaccgtactggtatgagaatcatttccatcagacgtggagattcttggatttacggacctgataaaaacacagttatcattgcaggagatgtattgatagctaaaggttctgaagctggtacagagattattgaaaaattagcagaaggagaaatggatttagaagatttagtcaatatggaagactttattgatgataattag

SEQ ID NO: 1710 - DNA, 1365 bp, Methanobrevibacter ruminantium
atgatgattcatcttattggtattgggaatgataaaggaaatataactttaaatgcttttaaggctattaaagaagcagatgttattattaattacaatgatattgatttaagtttctttgattctgaaattaaagacaaagagattatttcagctattgatttgattaatgacatagatttagaagatgatcttgatttaaatgatgatgtagctgaaaatattgattctgatgaggatttagattctgaaattaattcagatgacttagaatctaatattatttcagatgacttagaatctaatattatttcagatgatttagaatctaatattatttcagatgacttagaatctaatgtgggttcagatgatttagaatccgatattgattcagatgactcatctgacatcgatttagaagatgatctaaaatcaaacccattattagaaagaatacttcaagaaaacttcttaattgaactagccatctctaaatcattggaatccaagcaagttgctttaatagtctcagatgacccaaatatcctaggcctatccaatcgcttccttcaaattaagtccaagtatagcgatgtaaaatataaaatatatcctggggtttcttcaataagccaatcagcatctatagttggtgctcctttaggtgattttgctcttatagacctatcaaacccaattacatctttatctgaaatagaagacaaggtaaaacacattttagatgccaatttagtcttggcaatcaaaaatcctatcgacgataaaagagaagatggaagagaggcttataatttaattaaatcaatcataaacgaatacaatgatgaattattgactgcaatagtctatagtgatggctattactctatagatgagtttaaaaatatttatgatgaagatattgatgaaaattcaatctttttcattggaaataagttatcctatattttagaggaatcaatggttacttcctctgattatattgtagagactaaacttatctcatggtctattgagttctttgaaaggtatttgaatggagaggttccaagaggccttgattatgattgcgatttccttccatgccatgtgaatctggaagcttgtgacttttgctattgtccattctatccctgtgcagatggagttacaggaggagaatggattaaggacagggatgtttggagctgtcagcactgtgattggatacatctggaagagccttgtgtagctattagagaaggcttggatgatatcttaaaggaaattgatgatttgaaggataaacatattgagctacttaaattaagacgtaagagtcttttaaagaccttaaaatag

SEQ ID NO: 1711 - DNA, 1974 bp, Methanobrevibacter ruminantium
atgacagctgaaacacttcttaaatttgcaagaaaaggaataatattaacaccaggggcgtatgatttaattctaggctcagataatcctttagatttaagttcatcaattattttaaaattaaaaagcggaaagtattctaatgaagatctggttccggtagatgagaagcagataaaagaaatgatgaaagcgcttggaataagtgttaaagagaacaagggattagatcatggctctttagatgactttggtagtagaactagtggagaaggtcttgaaagaaagattgaaacaagacctgaaaaaactgtggaaaaagcagtagagccacaacaagcagtggaaactagagaacaaaaaccacaacaaaccttcaaaccaacacaagaaaaaactgtggagaaacctatagaaaaaccacaacaaacattcgaaccaaaccaacaaagaaccgtggagaaacctatagaaaaaccacaacaaacattcgaaacacctgcaaaacaaacccgtgcagaaaaaccaataaaaccacaaataaaaccaattagtgcagaaaaaccaacagaagcaccacaaaggcaagaaactaaagaaatagaaaaaaccatagaaaaacctaaatctgataagcctaaagtaaatgcaggctatcctagtgatcatattgtaaaaatagacaatgtagaagtgtctgaagagactaaaaagaaatacagaagaaacttaacagaatctaaagtcaattttgacggtttcaaggtcctaaaggacacaagcaacaagtcatacacaagcggtgagataggaaaccttatcgaatatttccaaaacaggtataagaaattatctgacatattatctaaaaggccagaactacgtacatggcagaaaatcaatgaaatcaccgagactcagactgatttaaatcttattgtaatgattacagacataaaaagcactaaaaacggccattacttcatagaagtggaggacgataccggctctatgcctatccttgtaagcaaggataacgaccagctgatacgagctgccaagaatcttatgaaagatgaggtcattggtattgtcgctcaaaaaaggccgggaaatgagcttgcaatctgtcaaaacatcatagatccgggagttccaagaatagctaaaaaggaagtgaactttggaacagtatttacctcagacattcacattggaagctcaaccttccttgaagacgcctttacaagattcatcaaatggattaatggcgatttcggaagcgaagagcagatggaaatggctaataacgttaaatacatgattattggtggagatatcgtagacggaattggtgtctatccaaatcaggataaggaattggcaataaaagacattacagcccaatatgatgaggctgcacgtcttgtaggcgacataagaagcgatgtaaagatcatcattactcctggaaaccacgacgcttcaagagtggctgagccacagcctgctgtacctgaaaagtatgctaaatcattatatgaattgaataatgtggaattcctctccaatccaagtatggtaagtctagatgggcttgaagtgctcatttaccacggaaggggaatagatgatatggttatgggttcaaatgacttttcacacgagcgaaatgaccttgtaatgaaagaattcttaaataaaagacatttggctcctttatatggtgagagaaccccacttgcttcagagcttgaagatcaccttgtaatcgatagggtcccagatgtactgcacacagggcatgttcacataaatacctatacaaactataagggaattcattgcattaattcaggaactttccagactcaaacagagttccagaagatttataacattgttccaacccctgcagaggttcctatcattgatgttgggggcaattataagcaattgaagtttatagactaa

SEQ ID NO: 1712 - DNA, 588 bp, Methanobrevibacter ruminantium
atggaaaaggaaatagtaaaatcagttgtagagatgtcagcttatgtatttgaaagaggccttgtatcagggaaagctggcaatgtaagcgcaagattcaagacagaccatggtgacatagtcgccataactccaacacttaaatcccttgctgatttggaagataaggacataattcttgttgattcagagggcaataatctaactaaaggcaagccatcctctgaacttggaatgcatctggcaatctatcgtgaaaagccagatgtctatggaatcgtacacacccattcaccttatgcaacaggattcgccttttccaataaaagaataaagcgtttggaaggattcggacaaataaaatcagaatacattaaagatatagactactataagcctggaagtgaagaacttgctaaaaatgctgctgaagcattgaaggaagaggatgttattgtcctaaggaatcatggagtcatcgccactggatctactgttaaagaggctgccacacttgttgaattcgttgaagaaagtgctaaaacccaatttgtgacactagtcttgaattccttagatgaaaaatag

SEQ ID NO: 1713 - DNA, 492 bp, Methanobrevibacter ruminantium
atgaaaattgaatttgacaccataggaacaatacactctccttttaaagagctagagggaatgcctattcaaccaaccggtgcgaaaggcattaaaggagaaatacatattaaagatgaatataagcctggattaaaggatattactggtttttcacatcttatacttatctatcacttacataaaaccaatggaaatgcattggaagtgaagcctttcatggataataagacacatggagtctttgcaacaagatctcctaaaagaccaaataacataggaatgactgtagttgcattggatagcgttgatgatgactgtgtcttgcacatatccaatgtagatattcttgatggcactccacttcttgatatcaagccatatgttcctcaattgcatgaggacaccattgtagacttaagaattggatggtttgaaaccaatcataaaaaagcgaaaacacaaaaagcggatgatagatttattaactaa

SEQ ID NO: 1714 - DNA, 249 bp, Methanobrevibacter ruminantium
atgacaaatgaaacttttgaggaagtatcacaaatattaaagcatattatggaaaatcctagtgtaccacgtaatatcagaagagctgcagatgaatccttcaacactttaaacaatgaagaagaagatgaaactgttagagcaagcgctgtaatcattaaattagatgaaattagtaatgatcctaacattcctgttcatgctagaaccttaatttgggaaatcttatctaaattagaagctatttaa

SEQ ID NO: 1715 - DNA, 357 bp, Methanobrevibacter ruminantium
atggtaaaaaatgaaaaattcataactgtaatttgttttaataaatttcatggaaagaagatttttaaaatcggatctattttaaagcttgttaaagagcctgacaatgcctatgacgctgaagctatccgaattgagatgagatatgcaggtaaggttggatatttggcaaacagcgttaaaacggtagtgcgaggcacaatgagtgcaggaagagtctatgataaaataaatgatgaggctgcttatgctcaagtgaaattcatttcaaatgaaaatgtgattgcacgtattcttgaagaggaagaaataaaagaccttaaaagagatccggaaagtgatttaaactttatttaa

SEQ ID NO: 1716 - DNA, 1008 bp, Methanobrevibacter ruminantium
atgtcaaatacagaaaaaataaatgtaaatgtagaatccaataaagataagggatttagtgatgatatcaacacaatcttcataaacttcaatggtctaaacattagccttgaacttatggaaaaacaatcctataaaaatatggacattattcctataaaaactgacagctttgcaaaaaaagatttcatcacacttaaaaaaggctttgaaatgggccttgttgaaataaaggagcttgaaaatgaggaagtaaatacagtaatctgcaaaaacgatgcagttgttccgcttatcctaatcgatggtgatgaaataataggagccaagcaaaacagaataatgaatgaaagccttctaattccagcaaagtctcaagtgaaaatcccagtcagttgtacagaacatggccgctggagattcaagtcaaacgagagagaattccaacattctgattattcccttaacttcgaaagcagaagaatcaagtcaattgcaagaaacgaatgcagagactatcaatctgatgtatggagtcatataagcgatcttgaagacagacattcctttagatcaaggacaagctcaatgaacgacaattacgagcattctaaaaccgctcaagatgactatataaagaatttaatgattgcagatggagctaatggtctcatttgctttataaacggtgaatttaagggattagagttattctataatcatagcatctataaggaatattatgaaaagacattaagaagctatattattgaagccatttcttatggaggaaataatacagttggcgaagaattatttagagtgattaatggtgaaatgaatgatttatcttcatctgaatttatagaatatgaaaccgttggccttggaaagaatataagattcgcaactaaaggaggatcaggttctggccttatatttgaagatgaattagttcatatgacttacttcaaagaggattccaataaaaactatgaaattttatag

SEQ ID NO: 1717 - DNA, 1026 bp, Methanobrevibacter ruminantium
atgataactgaactttactccaattcaatttatatgttacttacaatcttgctattttcacttgcagtagatcttcttctaggtgagtttccaatgcagatacatcctgtagtatggattggaaaaataataagcttttttaagaatatcctaatcaaatacgacaataagatagctggattgattctctcaattgctgtaataattgtttcatcacttattgttctaattccaatggctatagcaaggtatctattgccatataatgatatgatgatttatctattcaagctgatagcgattttgcttcttacttcaacattttcagtcaagctgttgttggattctgcccgtgatgttgaaaaggacttaaggaacaataacttaaataaggcacgtcaggccgttagctatctggttagccgtgacactaatgaattgaataaggagcatgtcatatccgctgtaatagagactctaagtgaaaacatacctgactcctatgtttcaactgtattctactattcaattgttggaataatagctagcctatgtggaattggagactttgatgtcataatacttgctgttcttgctgcatttatccatagggttgttgatacaatggattccatggtaggatacaagactaaggaactctacaatatcggttttattccagcgcatttggatgatgctttaaattacatacctgcaaggttttctggagctttgattgttgtatctgctatgtttctacgtttaaattggaaaaatgcattgtttattatgagaagggatgcaaacaattgtgacagtcctaattcaggatatacgatggcaacagtagctggagcattaaacattcagctagaaaaggaaggagtttataccttaggggataatataaatccaataaatgttgattgcattgaaaaggcagtggatctagcaagactgaccatatttttagttacaatattcttcatgtttgtatttatggatttaattcttttaatgctttaa

SEQ ID NO: 1718 - DNA, 465 bp, Methanobrevibacter ruminantium
atggctgtaatagatgaagaacaagtaagagaatggttaatggaagaagacatgattagagaaaagatttatgatgaaaatgctaatttccattatattatcaatttcccaaataacaatgcaatggatgtaattcagcctagaacaaaagaagacgttctccttataggctgtgcaacagaagtctcacaagtagagcaagacatgataaaaaacactgataaggcaataaatcaggagtttatatggaacgtaagatttgccttaaacgaaatgcttctagactttgagttggaacatccggatgatcaattgaaacgttttatcataactgaagacatattttctgatgggcttacaaaacatgtccttgttaaatcaattaaaaaggtatttaaagcaaaattacaatgtatttggttgttaggtaaaacatatggaacagtccagatgaaaaaagaataa

SEQ ID NO: 1719 - DNA, 13 bp, Methanobrevibacter ruminantium
gatgattttcatc

SEQ ID NO: 1720 - DNA, 448 bp, Methanobrevibacter ruminantium
ctattaaaataaaagaagagtttgttgttttaattcgtcaaaatatattaatttggaaaatataatatatggatacccatgatataattatagaacaccgaattaattaaaaaatcaagaataaaaaaagtaagaggacaaaaaatcctctaatcaaattaagaaaatatatgcctaatatgcctaaaagactactcaaaagtcttaagagcatcaaccatgtctagctttctaatcttcctagagaaatataaattcataacaataaacacagatacaattatcaaaaagctaaaggccatattcaaaacagaaatattaggaatcaaatagatcttatttccaaatgcaggcatcaacaatgttaaaatataataagctacaggaagacctaaaataaaaccaacaataataaagaaaaagccctgagtagctagcaatttagtga

SEQ ID NO: 1721 - DNA, 29 bp, Methanobrevibacter ruminantium
gtattttgagctgtatggctcaaaatcac

SEQ ID NO: 1722 - DNA, 440 bp, Methanobrevibacter ruminantium
agaaaaaaataaaacattgccttgttaattaataaattaatttcttaaaaaggaacaattaaatcaaatgaaccagttcaaccaagaaccacaccacaaaaataaaatcaaatgaactagttcaacaaaatgaatcacacaagaaatataaatttaactaccacccaatcatataaacaaatgtaaataatattaaaaataaaataaaaatggaaatgcttaaaaattaattagttttatagccgtgattaaatgaagtttttaagattcaaaaagaaaatcaatgaattgggcaaagacaattcaatcaaaataggattctacgatggagaaaagataatcgaacttaaaggagacatattagactattttaactctaatctagatgaaataaaggaaaatatgatagaatcatatagtctagaagatatagaaataga

SEQ ID NO: 1723 - DNA, 107 bp, Methanobrevibacter ruminantium
gttttaaaatatataaaataaattaaaaaaaatgaacaaaagagaaaaaaataaaacattgccttgttaattaataaattaatttcttaaaaaggaacaattaaatc

SEQ ID NO: 1724 - DNA, 253 bp, Methanobrevibacter ruminantium
atttcaaaatatgagatttcggtttttcaaaagaaaattttaaaaaatcatatttatataaaaattttaaaaataaagaatctaaataaatattttgtaaaaatattgtcttagacgccttatttcataagcacatactattcttattaacatcattatatttaaaactttctaaaaaactggctaaaaagggcataaaatcaaaaaatttgactaaaaacatgataaaatctaaattcaagttaaattgatt

SEQ ID NO: 1725 - DNA, 207 bp, Methanobrevibacter ruminantium
ttttagaaagttttaaatataatgatgttaataagaatagtatgtgcttatgaaataaggcgtctaagacaatatttttacaaaatatttatttagattctttatttttaaaatttttatataaatatgattttttaaaattttcttttgaaaaaccgaaatctcatattttgaaatgatgataatataaaaatttttataagtata

SEQ ID NO: 1726 - DNA, 464 bp, Methanobrevibacter ruminantium
aattttagatttgtaaattattatataaaaaaatatttgttttaatcaaaagggaattttttaaagttaaatcaataatttgataaaaattagtttttaaaatagaaaataagttaaaataagattaaagtaaaagtataataaaaatagaaaaaaataaaaaatgaaataattaaaaaattatttcttattttttattaattataagtttttgattgctaattcgatatcttcagctttgacggtttttctttttgccatagctgcgaattcgattgcttttttagcaacagcttcagcttgtgcggttacgtatgcgtttaattcttttttagcatcttcgcttactctttcagcaccagcgtctttaatgattcttccaataggagctacaggaatactcataattaacatctccttaattttttttaaataaaaatatatacttataaaaatttttatat

SEQ ID NO: 1727 - DNA, 24 bp, Methanobrevibacter ruminantium
agaaataattttttaattatttca

SEQ ID NO: 1728 - DNA, 265 bp, Methanobrevibacter ruminantium
aaaaattggtaaaccattgttaataaatagtaaaccgtctattttattcaaaaagacttatatatgcaaataaattaaaataagttaaatcaaggttctttaaaatcaaaaatattagaaaaaatagaaatggttgaaaagctattaaaaaaaatgtcagtagaaaaaatatctgaactgaccaaattagatgaagaagtgataaaaaatttaaaagaagaaatatctgattagattaaatgataagagattaagaaattaataa

SEQ ID NO: 1729 - DNA, 13 bp, Methanobrevibacter ruminantium
gtaagcaacttac

SEQ ID NO: 1730 - DNA, 23 bp, Methanobrevibacter ruminantium
gcaacttactttttgtaagttgc

SEQ ID NO: 1731 - DNA, 273 bp, Methanobrevibacter ruminantium
ttctatttctaaaacttctatctttttttctttcattatttttcaaatcttagcttatattgattaaatttgatgcaaaattattgataaaaattcataaaaacttcctaataaattaacattattccaaattaaatatatttatattatatataagaacttacaaaatatttaataattataaaacaatttattgactaaataaaaaattattaaaaaacctttcaataagttaattaaatataattttggggatttttatgaaattatata

SEQ ID NO: 1732 - DNA, 17 bp, Methanobrevibacter ruminantium
tcgaatattttattcgg

SEQ ID NO: 1733 - DNA, 42 bp, Methanobrevibacter ruminantium
gtaatttttataatttaatcatttctaaattataaaaatttc

SEQ ID NO: 1734 - DNA, 248 bp, Methanobrevibacter ruminantium
ttatagaggtttatttgaaggcttgatttttttcatattgataaattattgatagaaaatttcatataatttaatcaaaataacacctaattaaaatacaagttaccactttttcttttattatattaatcaactcttaaattaaatcaatcactatatgcaatattatttttttaagatagtatatctacatctagcaaataaaaataataaaaatatataatctatcccctatcacaagtgatgaa

SEQ ID NO: 1735 - DNA, 22 bp, Methanobrevibacter ruminantium
taatcagacagatgactgattg

SEQ ID NO: 1736 - DNA, 173 bp, Methanobrevibacter ruminantium
aaatttcacttaactttcaagttaagttccgacacatttagtgttataatatataatttatattttctatataataatttttttcaaatttttttaatttttctaaacaatgtttaaatgttaagtgactgaagtattaagtgacttaacaaattgttattttattgaacaaa

SEQ ID NO: 1737 - DNA, 339 bp, Methanobrevibacter ruminantium
aagacataattatataattacttatatataaatatttttaaaaaataaggaatatatactctttaaattaaaaattaaccatatataactatttataaactaattagtttactatatataaccatttataaaaataagaataattaatcaattttcaatgattaaaaaaaatattagttttaaacctatagaacggtttactatatataactatttataaattactctacaatttggacttattttttaccatattaaactatatataaaccattagccaaataacgaatttttcatagagaaaactataaatactatccattacaaagtaatttgtac

SEQ ID NO: 1738 - DNA, 391 bp, Methanobrevibacter ruminantium
tgttatgctttacatgctgaacaatggatcatataagcaaaaaagttaataaatagggctatattgaagattaacaatattgaaaataatattataatctttttatcaccagagagtttgtcttttaacatgttatctagtttttaagtatataaaatataatatggatttaattttattcttaagttgtttaagtttggtctcttttttgattctatttatttttattttctttagtttttaaagttttatttttaatcgcgttttatttagctttttaattttatttcttaagccgtttaagtttttttcttaagttttttaattttatttttaggcttttaaattatggaaattgaatattaggtttaaattgactattaatatttaa

SEQ ID NO: 1739 - DNA, 325 bp, Methanobrevibacter ruminantium
ttattagcttttaaaaaatttccatttaacttagcaattaaaaacagttatgagaataaatataattctgttaaatctaaaataaataaaaaaaaggattaaatcacagaaataaggaacaaagaaaaagaaaaacaaaattatatgataaaatatattataaataatgaatataaattaagttaagtaaacaggttaagagcgtgggaaaaatgactaaaatggaatttgatttaacagatgaacaaattgaaaaagtgaaagaattagaaaagagcggaattagtcttggagaagctatagaccttctttttgaaataaaaga

SEQ ID NO: 1740 - DNA, 146 bp, Methanobrevibacter ruminantium
atttttgaataaaaactctttttaactaattctaaataaaaaaaacttaaataactagtttaaaaataataaaaactctttttaactaattctaaataaaaaaaacttaaataactagtttaaaaataataaaagctctttttagc

SEQ ID NO: 1741 - DNA, 18 bp, Methanobrevibacter ruminantium
ttttaattaaaattaaaa

SEQ ID NO: 1742 - DNA, 24 bp, Methanobrevibacter ruminantium
tagggtgtttttataaaacaccta

SEQ ID NO: 1743 - DNA, 19 bp, Methanobrevibacter ruminantium
ggtgtttttataaaacacc

SEQ ID NO: 1744 - DNA, 30 bp, Methanobrevibacter ruminantium
tctctagtctatttaaaaatagaatagaga

SEQ ID NO: 1745 - DNA, 305 bp, Methanobrevibacter ruminantium
ttttctaggttcaaatagagagtcaggttttcctgggaaaaatattaaaagaaccgctaaagaaaaaagggaatttgaaagaaaaaatttaattaataaaaatcgtatttttgattcatcaagctattattattttagtattttagaatatccatctgatttaagaattaaattcaaagtcaattctacaaactaacggattatcagatattataaattcaagtattttaagtcaagaattaactagagtaaataatcatgttattgaaaataaaaatataggcaaatatcttaaaaataaaaaa

SEQ ID NO: 1746 - DNA, 80 bp, Methanobrevibacter ruminantium
gattctattataagcagatatatttcagtagagatgatgataaaaaatgcctaaatggataatcagaaaaaagtagattc

SEQ ID NO: 1747 - DNA, 23 bp, Methanobrevibacter ruminantium
gtatgtgcataatttgcacatac

SEQ ID NO: 1748 - DNA, 24 bp, Methanobrevibacter ruminantium
taaagaatggacttccattcttta

SEQ ID NO: 1749 - DNA, 24 bp, Methanobrevibacter ruminantium
taaagaatggaagtccattcttta

SEQ ID NO: 1750 - DNA, 16 bp, Methanobrevibacter ruminantium
gaatggacttccattc

SEQ ID NO: 1751 - DNA, 25 bp, Methanobrevibacter ruminantium
tttatggttaatatttaaccataac

SEQ ID NO: 1752 - DNA, 23 bp, Methanobrevibacter ruminantium
ttatggttaatatttaaccataa

SEQ ID NO: 1753 - DNA, 72 bp, Methanobrevibacter ruminantium
agtcctatggtgtaatggcaatcatacgagtctctggaacttgtgactccggttcgactccggataggacta

SEQ ID NO: 1754 - DNA, 89 bp, Methanobrevibacter ruminantium
ttcttaaaaaagcaaaaaattaaataaataaataaaaaaataaaaaaagcaattaaaacaaatctaattaagagaaatatgaattattt

SEQ ID NO: 1755 - DNA, 361 bp, Methanobrevibacter ruminantium
gatttaacatattcataatctcctaaatcataatcttttctaaatttaagatagaaagaatcattttgaggattatttatctcagaaaacaatagcatcttctgagccgaagacaaattaaacaaatccatatttttcacccatatttcttattccatatcttaatcaaaatcaaacactaaatccatttctaatccaatttaaaatcaacatttaagtcaaattcaaaatcaacatttaagtcaaattcaaaatcaacatttaagtcaaattcaaaatcaaattctaaatgaagaatatattattaatataatatttttacaataatattactattcattaataattttgtaaaaaacaa

SEQ ID NO: 1756 - DNA, 16 bp, Methanobrevibacter ruminantium
ttgggctttttcccaa

SEQ ID NO: 1757 - DNA, 251 bp, Methanobrevibacter ruminantium
tatccataataaaaaccttttttgattgattttttaaaatattatcaataatttttaaaatttagcaatattttttaaatatcggcaataaaattatcagaaaataattgaattttataataatgactatattttatgtattaaataaaaattactattattttaaattatgctaagtgattatgtagaaaaataatcaattttacaataaatattaaaaaaaataaactaaatcattattaaagcaataa

SEQ ID NO: 1758 - DNA, 20 bp, Methanobrevibacter ruminantium
taagaggattattcctctta

SEQ ID NO: 1759 - DNA, 214 bp, Methanobrevibacter ruminantium
tttagctcctaattaaagttctttataaaaaataaaaattattaataatgttttctaaaaaattaaattataagaaatgtataaaaaagttttctataagaaacaaatattctaaattatataaaaaagtattctataagaaactatttataaaaaatatattaaaaagttttctataagaaacaaatattccaaattatataaaaaagttttc

SEQ ID NO: 1760 - DNA, 29 bp, Methanobrevibacter ruminantium
ttaaggatagttttataaactattcttaa

SEQ ID NO: 1761 - DNA, 28 bp, Methanobrevibacter ruminantium
tgtttaaaatttttcaaaatattaaaca

SEQ ID NO: 1762 - DNA, 22 bp, Methanobrevibacter ruminantium
gaatagttttttaaaactattc

SEQ ID NO: 1763 - DNA, 28 bp, Methanobrevibacter ruminantium
tcacaattgtgttttttcacatttgtga

SEQ ID NO: 1764 - DNA, 20 bp, Methanobrevibacter ruminantium
gaatagttttttaactattc

SEQ ID NO: 1765 - DNA, 20 bp, Methanobrevibacter ruminantium
gaatagttttttaactattc

SEQ ID NO: 1766 - DNA, 215 bp, Methanobrevibacter ruminantium
atatgatggttattttgaaaaaatagcaattaaaatttaattctttaaaaaaagttcgtataatgataaactaaattatcttccattaaaaaagagtaactataaaaatatagttactcaacaatgatttagataataatgattaatactaaaaataattccgagattagattaatcattatcattaatattctatttaaactaataaaaatagt

SEQ ID NO: 1767 - DNA, 26 bp, Methanobrevibacter ruminantium
gagtaactatatttttatagttactc

SEQ ID NO: 1768 - DNA, 271 bp, Methanobrevibacter ruminantium
taatttatattaataattttttaatacaattaaaatttatgaatcttaattataattatacaatgaagacttatttttaaaaatttttaaaaacagtcaaatttatatgaaaaattttaaaatctattcaaaaatgaatttttcttagcgaatcaaatggataataatatctgtgaatgaaaataagagagttttaatcagtgaaattaatatgaaatgtatggattaaatttatattaaaaaaagagcagtcccaaataataaaatttag

SEQ ID NO: 1769 - DNA, 317 bp, Methanobrevibacter ruminantium
ctattaaaattataaaattataaaactatcaaaataaattaaataatcagaatttataaagatttagaagataatttaatgtttagaagataaattgtttattttattaaataagtttttactactttttctataaactttaaattttaataaactctcctcataagcaatggatttgaatttttatttattttgggtacgaatcaattttgaacttttattcctaaaatttcttatcttatagtgtcttgaaaaatagtttaatatccatttataaaattagattttataatctaagtaaatgaaaataatctttc

SEQ ID NO: 1770 - DNA, 213 bp, Methanobrevibacter ruminantium
taactggaataattgcttgcattgatgataagtctataattatcttaaaaattgattagtaaaagattaattaaaaaaataaaaaaaagtttatatttaattaaaaaagtcgaataagacagaattaactgtttaaatcaaaagacttgaataaaaatagctaataattattaaaatcatagctgaaaaaatagttaaaaactattaaaatca

SEQ ID NO: 1771 - DNA, 20 bp, Methanobrevibacter ruminantium
gaatagctttttagctattc

SEQ ID NO: 1772 - DNA, 24 bp, Methanobrevibacter ruminantium
gatgaatagagttttctattcata

SEQ ID NO: 1773 - DNA, 20 bp, Methanobrevibacter ruminantium
tgaatagagttttctattca

SEQ ID NO: 1774 - DNA, 17 bp, Methanobrevibacter ruminantium
ggcggattcattccgcc

SEQ ID NO: 1775 - DNA, 23 bp, Methanobrevibacter ruminantium
tcaatcttaatttttaagattga

SEQ ID NO: 1776 - DNA, 50 bp, Methanobrevibacter ruminantium
atttaaaccttttttttaattgatttaatcaataaaataaaggtttaaaa

SEQ ID NO: 1777 - DNA, 48 bp, Methanobrevibacter ruminantium
tttaaaccttttttttaattgatttaatcaataaaataaaggtttaaa

SEQ ID NO: 1778 - DNA, 139 bp, Methanobrevibacter ruminantium
atatgttctcagggcggagtgaaattctccaccggtggtaattcataaaacaaaaaagtgataagtccacgagcacagatgtgttgatttggtgaaagtccaaaaccgacggtgaaagtccggatggaagagaatatga

SEQ ID NO: 1779 - DNA, 35 bp, Methanobrevibacter ruminantium
ttaaaagatagagaatttgattctctaacttttta

SEQ ID NO: 1780 - DNA, 222 bp, Methanobrevibacter ruminantium
aaatcttattaatatggattttgatttttaacttatgaaaaaatgttcattaatacaaaaatatgatgaatttttaaaaaagtggaaaaataaagaaaatttaattaactacttgtttaatatataagaatactaataatttataagtcgtagataaaaatatataatattaataaaatttaaatttggaaatggagtcatgatttaaataaaaaaattcat

SEQ ID NO: 1781 - DNA, 34 bp, Methanobrevibacter ruminantium
tcaaatggtggaaaattgattttcctccatttca

SEQ ID NO: 1782 - DNA, 23 bp, Methanobrevibacter ruminantium
gggagggatagtttatcccttcc

SEQ ID NO: 1783 - DNA, 241 bp, Methanobrevibacter ruminantium
tcagatagataaattaaaaaatagtctaaaagataataaattaaaaaaaagaattcatttgaattcttttaatactttttttcataaaaattataataagaattaatttaatcaaaatatatcttaagacattacattaagaactaattattatcttaaaagacattatattaatttttacaagaattatcctttttaaaaactttttttaaaggtttaagtgataatatggaaattttaa

SEQ ID NO: 1784 - DNA, 257 bp, Methanobrevibacter ruminantium
attttatattatatataattttaaaaaatatgatttatataattacctattttaattgcctaaaaaaataataaaagtttttagaataattataaatttaaaaaaataataattatttaaatatttgataaaaaaagtaataaaaattagataagaataaattaagacaataagataatttttaaaaaagtctgtattgattaaaatatcatttggaataagaaaattatagcctgaaagcattctaaactaaatta

SEQ ID NO: 1785 - DNA, 193 bp, Methanobrevibacter ruminantium
atatttaaataattattatttttttaaatttataattattctaaaaacttttattatttttttaggcaattaaaataggtaattatataaatcatattttttaaaattatatataatataaaatattatgtttacttggataattattatgtgaatataatttttataaaataatttttacttagaatataag

SEQ ID NO: 1786 - DNA, 34 bp, Methanobrevibacter ruminantium
taagaaattagcagtttttactgctaaattatta

SEQ ID NO: 1787 - DNA, 20 bp, Methanobrevibacter ruminantium
ttagcagtttttactgctaa

SEQ ID NO: 1788 - DNA, 463 bp, Methanobrevibacter ruminantium
ttgccataataaattatgacgcaatattttttaataaaagtattaaaaatttaaataaaaatattaaaaataaaatataaattttttataaaaagataataatcattattaaaaaaataattattattaatctaaaacttattttaagaatttatattattctttttaatatttaaatatatatgattaattcttttacaaatgtagttcgtttaacaactccatacagtatatggatttgcttatttataaaggtttgcttttttcaaatatgaattttgtccttaaaattaagtacaattgaaataaaaattgatgatgatttttgaacaataaaaaattgaaaaatagatcctggagggaaaagataaatgattaaaaaatagaataaaaaaatccttaaaaaaaaagttaaagaataaaaagattaaaaaaaagaaaaaaagaatcctaaaaaaggaaa

SEQ ID NO: 1789 - DNA, 32 bp, Methanobrevibacter ruminantium
taaaaggggattatctaaataattctctttta

SEQ ID NO: 1790 - DNA, 313 bp, Methanobrevibacter ruminantium
tttaattctttataaaattcttattaatatagaatataatttttaagttaaataaaagtttttattaaatgtcaaaataaggcagttttttattaatttttttgtatttagtaataaaattgataaatagaaatcggataaaaaacaaaatcttttaagaaaattaaatttatgaaaatgagccctatgaaacatttaaaaagttaaataaaaaagagttaagatttaagagttatatttctaaacaatgaaaataaaataaaataagcatataagaaaataaaataaaagaaaagcttttctaaaggaacga

SEQ ID NO: 1791 - DNA, 25 bp, Methanobrevibacter ruminantium
cttttttggccttcggccaaaaaac

SEQ ID NO: 1792 - DNA, 23 bp, Methanobrevibacter ruminantium
ttttttggccttcggccaaaaaa

SEQ ID NO: 1793 - DNA, 149 bp, Methanobrevibacter ruminantium
aataggtgatgaagtagagttaaaataaaaaaataagttatttaataaaataaaaattgaaataattttttaaaaaaaaaaagaaaataaaaagaatgagttttttaaaaaaaaataagaaaaaattgaactgagctttttttaaaaaa

SEQ ID NO: 1794 - DNA, 92 bp, Methanobrevibacter ruminantium
tatttaataaaataaaaattgaaataattttttaaaaaaaaaaagaaaataaaaagaatgagttttttaaaaaaaaataagaaaaaattgaa

SEQ ID NO: 1795 - DNA, 346 bp, Methanobrevibacter ruminantium
tataattgttattattattagtattaattaaaatgattatagtaatataatagagatttacactctcacatcaatattgatttaagattgttaaattgatatgaaagtgttaaaaaaggttttaaaaaacaaaatatttatttagatgaaagtttaatagaaaataagataattatgaaaaataatagaaaaaataatcaaaataaagagaataatcatttaaaatcattgcatttaaaaaaatccaatgaaaaaataacagacctaagaatagcagatagctttttaagtcgttttcttggattgatgtttaaaaaagatatagattatcctttattgtttaaga

SEQ ID NO: 1796 - DNA, 186 bp, Methanobrevibacter ruminantium
attagaaattaatcttttatcaattgaatttattttttaatattggaactgaatattgatattttaattattatctaaataaatgacttttataaaaatcagaatttaaagactaatttaaattttatacataattagaatttaaaaaacaatttaaattttaaaaaatcatttttataaaaatta

SEQ ID NO: 1797 - DNA, 20 bp, Methanobrevibacter ruminantium
gcagtagtttatactactgc

SEQ ID NO: 1798 - DNA, 17 bp, Methanobrevibacter ruminantium
ttttttaatttaaagaa

SEQ ID NO: 1799 - DNA, 32 bp, Methanobrevibacter ruminantium
tttaagagatttgatgttcaaatcttcttaaa

SEQ ID NO: 1800 - DNA, 23 bp, Methanobrevibacter ruminantium
gataagaattattaattcttatc

SEQ ID NO: 1801 - DNA, 254 bp, Methanobrevibacter ruminantium
tcaaggccataattttcaagtctgcccttaaatacaattgcaatagtccaaataagtagaaaggctattacataataatatattccgttcatagtaacacttattgataatcattagttttaattattttccatttaattttctaaacaaatttaaggtcaaatttaataagattataaaaatcatttagaatatttgaataatattattaagttttcataatataaaaagataatcattttagcaataaaatt

SEQ ID NO: 1802 - DNA, 30 bp, Methanobrevibacter ruminantium
aaatagaactttagttttaaagttctttta

SEQ ID NO: 1803 - DNA, 20 bp, Methanobrevibacter ruminantium
gaactttagttttaaagttc

SEQ ID NO: 1804 - DNA, 300 bp, Methanobrevibacter ruminantium
tatagcatatatacttgttcttatgtatacaaaatgttttatttttttaaaatttagtacgaacagtttaataaagtctaaactagtttaagttaaaaataggaataattcgtataaaatgttaaaaataaagaaaaaaatacgaacagttagtaaaaatacaaatttttatcgacttttaaaaacttttatgatttcactaaaaaattgtgaaaattcagtgaagatgtttaatgttgaatgagagaaaagtgaaaaaaatacaaaaataatgatattctaaataaaaaaaataactaa

SEQ ID NO: 1805 - DNA, 19 bp, Methanobrevibacter ruminantium
tttaacaattcttgttaaa

SEQ ID NO: 1806 - DNA, 26 bp, Methanobrevibacter ruminantium
tgaagtttttattttaaacaacttca

SEQ ID NO: 1807 - DNA, 47 bp, Methanobrevibacter ruminantium
tttaaaccaagcttttttggccttcggccaaaaaaccttgaccaaaa

SEQ ID NO: 1808 - DNA, 78 bp, Methanobrevibacter ruminantium
gggcctatagtctagtcaggattatgacgtgggacttcggatcccaaggtcgggggttcaaatcccccctagggtccc

SEQ ID NO: 1809 - DNA, 277 bp, Methanobrevibacter ruminantium
gaattaagataaagtattaatttgttctttaatggaagataaatatttatatattttaaattctaatgaagataaattattaaattgttttttattccaaatatgaaaataaatttgattgaaattttaactaaatctatttatattaatttttattaatatttttatctaaaaaaagtaaaattttaaaaaagataagagataaagtataataagtaattaattaatattttttatattttattttgggcctatagtctagtcaggattatgacgt

SEQ ID NO: 1810 - DNA, 21 bp, Methanobrevibacter ruminantium
gaaatgattattaatcatttc

SEQ ID NO: 1811 - DNA, 474 bp, Methanobrevibacter ruminantium
attttaaggaaataaagacaataatcctaattattttattcaatttccctaataaaaattagtctaaaatctatttaaaattaaaaataatctttaattatttttcttttttaaaaataataaatattctttttgtttctcccaaataaatatgtaagtaaacacttgcattcgaaaaactttatataataaggtatttatatattatagtgtggaagaaactcacaaaaactaaacctcgtaattatacctaaaaaattttaagataaatattaaaacaattctagttttaatttttatatctttgttgcaactagtgtttctgcatctttgatgtggatacattagcgcacaagatataaatggattaaattctattttttattaaataaggtttagattaaacttaaaactatttttaaagcaaaaatctatttttataaagaattattcttactcgtttctatgaatgaa

SEQ ID NO: 1812 - DNA, 178 bp, Methanobrevibacter ruminantium
tttacttacatatttatttgggagaaacaaaaagaatatttattatttttaaaaaagaaaaataattaaagattatttttaattttaaatagattttagactaatttttattagggaaattgaataaaataattaggattattgtctttatttccttaaaataggttttaaagaatct

SEQ ID NO: 1813 - DNA, 27 bp, Methanobrevibacter ruminantium
ggctaaattatttttgataatttagtc

SEQ ID NO: 1814 - DNA, 50 bp, Methanobrevibacter ruminantium
tttatgactcaagcttttttggccttcggccaaaaaaccttgaccaaaaa

SEQ ID NO: 1815 - DNA, 27 bp, Methanobrevibacter ruminantium
ggttttttggccgaaggccaaaaaagc

SEQ ID NO: 1816 - DNA, 77 bp, Methanobrevibacter ruminantium
aatagataaagaaaaaacttaacttttaggaataaatagtgaaaaataaataaaaactagaattaaaaaaatattaa

SEQ ID NO: 1817 - DNA, 22 bp, Methanobrevibacter ruminantium
tctagtttcttttgaaactaga

SEQ ID NO: 1818 - DNA, 197 bp, Methanobrevibacter ruminantium
tttccatgttaattaatttatttggaagtctttaaataattttttaaaaaatttaaataaaagaagcaaaaagtaaaattggtaaagaattttttaaaaagaataaaaagaataaaaagaaaaaaatctagtttcaaaagaaactggaacaaaaaaaataaataaaaaagaagaaaatctagtttcaaaagaaacta

SEQ ID NO: 1819 - DNA, 22 bp, Methanobrevibacter ruminantium
tccagtttcttttgaaactaga

SEQ ID NO: 1820 - DNA, 22 bp, Methanobrevibacter ruminantium
tttattattctttaataataaa

SEQ ID NO: 1821 - DNA, 28 bp, Methanobrevibacter ruminantium
tgagtcttagaattatttctaagattca

SEQ ID NO: 1822 - DNA, 32 bp, Methanobrevibacter ruminantium
tagaattaaggaccaataggtcctaaattttc

SEQ ID NO: 1823 - DNA, 22 bp, Methanobrevibacter ruminantium
ttaaggaccaataggtcctaaa

SEQ ID NO: 1824 - DNA, 201 bp, Methanobrevibacter ruminantium
taaaaattttaataatttcttattttaaaatccaatgataaattaaataattcaataaatttttttaaattcaaaaacccatgaataaaataaataattcaaaaatttttataatttcaaaaatccaatgaataaatttaaatatcctatattcaataattttataacaaaagataaataaacttttatataatattaatt

SEQ ID NO: 1825 - DNA, 20 bp, Methanobrevibacter ruminantium
tgaagaattataattcttca

SEQ ID NO: 1826 - DNA, 207 bp, Methanobrevibacter ruminantium
taaaaaatttaaaatatttgattgaaaaattaatgaaattcttcttgaaactagaataaaaaataaataaatttttcaatgaaaaacttgatgagatttataaaaatttataaaaaataaataaatttttcaatgaaaaacttgatgagatttataaaaatttataaaaattaaaaaaatataaaaaataaatttggaaaaaaatag

SEQ ID NO: 1827 - DNA, 15 bp, Methanobrevibacter ruminantium
tttttcattgaaaaa

SEQ ID NO: 1828 - DNA, 15 bp, Methanobrevibacter ruminantium
tttttcattgaaaaa

SEQ ID NO: 1829 - DNA, 28 bp, Methanobrevibacter ruminantium
agaaaataagagttttctcttattttca

SEQ ID NO: 1830 - DNA, 26 bp, Methanobrevibacter ruminantium
gaaaataagagttttctcttattttc

SEQ ID NO: 1831 - DNA, 29 bp, Methanobrevibacter ruminantium
gaataaattaattttaaattaatttattc

SEQ ID NO: 1832 - DNA, 11 bp, Methanobrevibacter ruminantium
gatttacaatc

SEQ ID NO: 1833 - DNA, 39 bp, Methanobrevibacter ruminantium
tatatcggttaaacttttagaaaaagtttaatcaaaata

SEQ ID NO: 1834 - DNA, 14 bp, Methanobrevibacter ruminantium
tagctattcagcta

SEQ ID NO: 1835 - DNA, 19 bp, Methanobrevibacter ruminantium
ttaattaaaatataattaa

SEQ ID NO: 1836 - DNA, 32 bp, Methanobrevibacter ruminantium
tctaatgttcaatctttttgattgaacttaga

SEQ ID NO: 1837 - DNA, 29 bp, Methanobrevibacter ruminantium
aaatagtttaaatcatatttaaactatta

SEQ ID NO: 1838 - DNA, 23 bp, Methanobrevibacter ruminantium
tagtttaaatcatatttaaacta

SEQ ID NO: 1839 - DNA, 74 bp, Methanobrevibacter ruminantium
gccctggtggtgtagcttggataacacgtgggactgcggatcccattccccgggttcaaatcccggccagggca

SEQ ID NO: 1840 - DNA, 180 bp, Methanobrevibacter ruminantium
ctttcatatttgaattattactttcagatttaaattataacaattgttatgtatattctattatataaatatttctaaaattagatatttgataataaataaatgtttttaagatttatttaagataatgactgttcttaattgttttttccgcctaaaaacagttaatgaataaaaaat

SEQ ID NO: 1841 - DNA, 267 bp, Methanobrevibacter ruminantium
cctttaagataattgtttaaaaatttctctttttttattaaaaaaatagtgtaaatgaaaagaataatatttcgaaaaatgagaaaaaaatttgaaaaaaatccagaaataaataatcttaagagaaaataaaacagaatattaataaaaatagagttttaaaaatgaattagttaaaaatcaatccaattaactattaaaataaaaaaaataataaaaattaggtaatttttaaaaaatagtaataaaccgatatgaaaatattta

SEQ ID NO: 1842 - DNA, 23 bp, Methanobrevibacter ruminantium
gagataatattttttattatctc

SEQ ID NO: 1843 - DNA, 15 bp, Methanobrevibacter ruminantium
taatttaaaaaatta

SEQ ID NO: 1844 - DNA, 30 bp, Methanobrevibacter ruminantium
taaaagagcaatttgcttattgctcttcta

SEQ ID NO: 1845 - DNA, 15 bp, Methanobrevibacter ruminantium
gaagaataattcttc

SEQ ID NO: 1846 - DNA, 41 bp, Methanobrevibacter ruminantium
tggtcaaggttttttggccttcggccaaaaaagcttgctta

SEQ ID NO: 1847 - DNA, 35 bp, Methanobrevibacter ruminantium
tcaaggttttttggccttcggccaaaaaagcttgc

SEQ ID NO: 1848 - DNA, 33 bp, Methanobrevibacter ruminantium
caaggttttttggccttcggccaaaaaagcttg

SEQ ID NO: 1849 - DNA, 85 bp, Methanobrevibacter ruminantium
gctatggtgactgagtcaggcttaaggtgtccgcctggagagcggatgtgcgagagcaccagaggttcaaatcctcttcatagcg

SEQ ID NO: 1850 - DNA, 85 bp, Methanobrevibacter ruminantium
gccatgatgactgagtcaggcttaaggtatccgccttgagagcggacgtatgaaagtaccagaggttcaaatcctcttcatggcg

SEQ ID NO: 1851 - DNA, 72 bp, Methanobrevibacter ruminantium
gaagatatagtttaacggcaagaatgcttggctccagaccaagagatgagagttcgaatctttctatcttca

SEQ ID NO: 1852 - DNA, 72 bp, Methanobrevibacter ruminantium
gctttagtgttgtaattggaaacaaacacctcttctaaaggtgaattctgggttcaagtcccagctagagct

SEQ ID NO: 1853 - DNA, 73 bp, Methanobrevibacter ruminantium
gggcctgtggtctaattggtatgacgtctcccttgcgaggagaagactttgggttcgactcccaactggtcca

SEQ ID NO: 1854 - DNA, 72 bp, Methanobrevibacter ruminantium
gctttagtactgtaattggcaacacccgccccttccaagggtgaaatctgggttcgaatcccagctaaagca

SEQ ID NO: 1855 - DNA, 73 bp, Methanobrevibacter ruminantium
ggatctatagcttaacggaaaaagcatctagctacggactagaagattgtgggttcaaatcccattaggtcta

SEQ ID NO: 1856 - DNA, 73 bp, Methanobrevibacter ruminantium
gatgcattggtgttaatggctagcatacaagtctgtggagcttgtggaaagggttcaaatcccttatgtgtcc

SEQ ID NO: 1857 - DNA, 73 bp, Methanobrevibacter ruminantium
gtctctgtagtatagtggcctagtatccatggtggtcagccgtggtacccgggttcgaatcccggcggaggcg

SEQ ID NO: 1858 - DNA, 74 bp, Methanobrevibacter ruminantium
tggtctgtggccaagcatggtaaggcgcttgtctgatatgcaagtgatcgagggttcaaatcccttcagaccaa

SEQ ID NO: 1859 - DNA, 84 bp, Methanobrevibacter ruminantium
ggcgtggtggcctagctcggtagggcggagggctgctaatcctctgcgataaaacgctcatgggttcaaatcccatccacgccg

SEQ ID NO: 1860 - DNA, 73 bp, Methanobrevibacter ruminantium
gcttctatggggtaatcggcaaacccatcggactttcgatccgataatccgggttcaaatcccggtagaagca

SEQ ID NO: 1861 - DNA, 75 bp, Methanobrevibacter ruminantium
gggcctgtggctaagtctgatcaaggcgtccggcttttaaccggaagatcaggggttcaaatcccttcaggctca

SEQ ID NO: 1862 - DNA, 25 bp, Methanobrevibacter ruminantium
gggttggaggtaatagctccaaccc

SEQ ID NO: 1863 - DNA, 72 bp, Methanobrevibacter ruminantium
ggttctatagtttaacaggtaaaacaactggctgttaaccggcagataggagttcgaatcttcttagaaccg

SEQ ID NO: 1864 - DNA, 72 bp, Methanobrevibacter ruminantium
ggagctatagctcaatggcagagcgtttggctgacatccaaaaggttatgggttcgattccctttagcccca

SEQ ID NO: 1865 - DNA, 73 bp, Methanobrevibacter ruminantium
agttctatggtgtaactggcaatcattccgggctttggacccggagattcccgttcgagacgggatagaacta

SEQ ID NO: 1866 - DNA, 73 bp, Methanobrevibacter ruminantium
gggattgtagtgtagtggtctagcaccgtcgctttgggagcgacaaactcaagttcaaatcttggctatccca

SEQ ID NO: 1867 - DNA, 71 bp, Methanobrevibacter ruminantium
ctctgtgtagcaaagtggttatgcggcggtctgtagaaccgtttatgggggttcgaatccctccgcggaga

SEQ ID NO: 1868 - DNA, 72 bp, Methanobrevibacter ruminantium
ggggcattagctaagcgggaaagcgacagtctgaagatctgttcatcgctggttcaaatccagcatgtccca

SEQ ID NO: 1869 - DNA, 84 bp, Methanobrevibacter ruminantium
agccgagtagctaagcttggtaaggcactggacttaagatccagggagttagtctcctcatgggttcaaatcccgtctcggcta

SEQ ID NO: 1870 - DNA, 22 bp, Methanobrevibacter ruminantium
gttaagagcaattactcttaac

SEQ ID NO: 1871 - DNA, 246 bp, Methanobrevibacter ruminantium
ctgttacattaaaatccatacttttcctcctatttgctaattaattttataaaaataatttatagaaataatataaatgaaatttttactaaatgaacaatttttatagaatataattataaattaagtttttactataaacaattttttagaatataattaattaatttattaaattatttaaatttatttaattttcgcttatccaaaaataaaccttcatttcagctttatagagaaataaaa

SEQ ID NO: 1872 - DNA, 11 bp, Methanobrevibacter ruminantium
tagttttacta

SEQ ID NO: 1873 - DNA, 225 bp, Methanobrevibacter ruminantium
taaataaattatataaaaattaagattttttaaaaaattataatcaaatttgacaatgactagtcaagtttaaattaaatcaataatcattattcaaatttaaaattttaatcaaagctaaacagaaattcaaaatcattattcaaatttaaaagtcaaatttaaactgaaatttcatcatcatcaaatttaaatacgtcctcaatacttagataggaatctaca

SEQ ID NO: 1874 - DNA, 42 bp, Methanobrevibacter ruminantium
taaaagataataaaattcttatttgaattttattttctttta

SEQ ID NO: 1875 - DNA, 100 bp, Methanobrevibacter ruminantium
atgaaaaataagagttaaataataaaaataagaaaaaatagaaagaaaataagaaaattagggataaaaaaataatttggaagaaaaataaaaaaaataa

SEQ ID NO: 1876 - DNA, 134 bp, Methanobrevibacter ruminantium
tttcaaaaaactaaaagttttaatataagaaattataaaaatatataatacttgaaaatatgatatgattattttatagatttttattaaactaatttcatattgatttaattataaaaattattgtataaaat

SEQ ID NO: 1877 - DNA, 530 bp, Methanobrevibacter ruminantium
ttatcatcttataaaaaattaattgcaaaaactcaaaaattcattaattaagaccttaagtgaaaaagatcttataaaatttattatataaatgataataaaaacatctagaaataatgaaaaataataataaaaacaatccagaaataatgaaaaataataaaaaaacattcaaaaagtaatgaaaaataataaaaaaaacattcaaaaagtaatgaaaaataataaaaaacattctaagagtaatgaaaaatagtaataaaaacaatccagaactaataagagataaatcaaaaaaaataagaaaataaaaaaaccataaaggtttaaataggattctaaaagaaccctattaagtggaaaatagagttttaacttaaaaaagctaaaacccttaaattttaaaatgataaaattatttttcaatattaacactagcttaatcccatattgctcctaaggctaaaacaagattaatcccagtattaaatatttgaaaaaataaacataatggtttaaaaaaataaaat

SEQ ID NO: 1878 - DNA, 28 bp, Methanobrevibacter ruminantium
gggttttagcttttttaagttaaaactc

SEQ ID NO: 1879 - DNA, 21 bp, Methanobrevibacter ruminantium
tagggttcttttagaatccta

SEQ ID NO: 1880 - DNA, 139 bp, Methanobrevibacter ruminantium
atttttgagtttttgcaattaattttttataagatgataataaaaatatataatatgataaaatattaacatatttgcttaatattctatttttataatgattaaaaatttaaaaaatatttttaattttacttctaaa

SEQ ID NO: 1881 - DNA, 183 bp, Methanobrevibacter ruminantium
tcaccataataattataaagtgtactttcaatttaattaatttattttttctattgcaaattattaaaattcaatcaattaatttgtattaaatttgaaagtttttagaagtaaaattaaaaatattttttaaatttttaatcattataaaaatagaatattaagcaaatatgttaatatttt

SEQ ID NO: 1882 - DNA, 47 bp, Methanobrevibacter ruminantium
cttaactcaagcttttttcgccttcggcgaaaaaaccttgaccaaaa

SEQ ID NO: 1883 - DNA, 45 bp, Methanobrevibacter ruminantium
ttaactcaagcttttttcgccttcggcgaaaaaaccttgaccaaa

SEQ ID NO: 1884 - DNA, 27 bp, Methanobrevibacter ruminantium
ggttttttcgccgaaggcgaaaaaagc

SEQ ID NO: 1885 - DNA, 30 bp, Methanobrevibacter ruminantium
agattaattaattattcaattaattaatca

SEQ ID NO: 1886 - DNA, 28 bp, Methanobrevibacter ruminantium
gattaattaattattcaattaattaatc

SEQ ID NO: 1887 - DNA, 28 bp, Methanobrevibacter ruminantium
gattaattaattgaataattaattaatc

SEQ ID NO: 1888 - DNA, 40 bp, Methanobrevibacter ruminantium
tgtaaaataaatgaataaactcttattcatttattattta

SEQ ID NO: 1889 - DNA, 32 bp, Methanobrevibacter ruminantium
aaataaatgaataaactcttattcatttatta

SEQ ID NO: 1890 - DNA, 26 bp, Methanobrevibacter ruminantium
taaatgaataaactcttattcattta

SEQ ID NO: 1891 - DNA, 26 bp, Methanobrevibacter ruminantium
taaatgaataagagtttattcattta

SEQ ID NO: 1892 - DNA, 235 bp, Methanobrevibacter ruminantium
ttttattaatattttccatataacaaatgttaataaaaatcattaaatattggattgttctaaaataataatgttgtaatttttctaaaaaaaattttataaacagctttaaaacatattttatttataatttaaaaaagagttttaaatggtttaatttatcattttattaaattttactatttaaatcattatttgaagaattttaatatttaatttttaaaaataattatta

SEQ ID NO: 1893 - DNA, 25 bp, Methanobrevibacter ruminantium
taaatgattgattttcaatcatttc

SEQ ID NO: 1894 - DNA, 17 bp, Methanobrevibacter ruminantium
tgattgattttcaatca

SEQ ID NO: 1895 - DNA, 286 bp, Methanobrevibacter ruminantium
tttaaatattatatttttttatattataaacttatcgatttatttatgcttattttttcaaataaagacataaaaatcggtttttatcaaatagttttgacacttctcaaatatattttattataacaatttttttaaaagaagccttttttaatttttgcaaaaaattttcaataaaaataaaaaaaacacaaaaccaaaaactaagcaaaaaatgattcaataaaaataaaaaacagaaaaatagaaaaaaaattaaaatgaaaaattgcttgataaaaacaaa

SEQ ID NO: 1896 - DNA, 29 bp, Methanobrevibacter ruminantium
taacttgggagtgtcttgctccaaagtta

SEQ ID NO: 1897 - DNA, 216 bp, Methanobrevibacter ruminantium
aaggattgattatttaaaagtaattatatagtataaaaattataatttaattaattagaaaaaattctttaaagaaaatttatttagtttattttaacaaagttttgattattttatttaaaactttataaaaaacttaaaaagtatttattattaagtatggtgttaatatggtaagtgtagaagactatgaagaacaattagctaaagctggtg

SEQ ID NO: 1898 - DNA, 335 bp, Methanobrevibacter ruminantium
catcaattctaaaaaaatattgtcggaaaatacatataaattttatgattcattttagatgcaattaaaataaaaatagccatactaaatttataaatcaaatattatttagtcaatttaattaatcgaatatttaaaataatgaaaattatataaaaattataaaaaaataagaaatgctatctacatataaacatagagaaaataaataaaaaagccaaaaattaaaaaaatttaaaatatgataaaataacagatactgaaaaaagagaattagaaaaattaagaaaaaatagaattataaaaaaaagaaataaagatgaaattattcatct

SEQ ID NO: 1899 - DNA, 16 bp, Methanobrevibacter ruminantium
gatgaataatttcatc

SEQ ID NO: 1900 - DNA, 26 bp, Methanobrevibacter ruminantium
taaaaaataattaattttatttttta

SEQ ID NO: 1901 - DNA, 23 bp, Methanobrevibacter ruminantium
ggagaataatgaaattattcttc

SEQ ID NO: 1902 - DNA, 308 bp, Methanobrevibacter ruminantium
agtagagcatttgaaaagtaatcgagctcaatcttcaagtgtaaaaaaattaacaaaataattaaatatagaaaaacaaaatattattatgttttaatttttaaaaaggggatgacaatatgggaatgaaaaaagttaagatcgaaagtaaagcaaaaaataatatgacaagaaacgaaaaactcttctataaattatatgacgatttatataatgaagatagattaattttattctccacatattttaacatatatgataaatttatttttaaaaaagatataatccattatgttttaatgaactac

SEQ ID NO: 1903 - DNA, 56 bp, Methanobrevibacter ruminantium
tcgagtaagtattggtacgtattataagtataaatacgtatcctatacttacttta

SEQ ID NO: 1904 - DNA, 48 bp, Methanobrevibacter ruminantium
gtaagtattggtacgtattataagtataaatacgtatcctatacttac

SEQ ID NO: 1905 - DNA, 13 bp, Methanobrevibacter ruminantium
ttattataaataa

SEQ ID NO: 1906 - DNA, 17 bp, Methanobrevibacter ruminantium
gtattactgagtaatac

SEQ ID NO: 1907 - DNA, 17 bp, Methanobrevibacter ruminantium
gtattactcagtaatac

SEQ ID NO: 1908 - DNA, 32 bp, Methanobrevibacter ruminantium
gcataatggtatgatttcgcatatcattgtgc

SEQ ID NO: 1909 - DNA, 13 bp, Methanobrevibacter ruminantium
cagaactcttctg

SEQ ID NO: 1910 - DNA, 331 bp, Methanobrevibacter ruminantium
catatttgataattatgaaacttcttttaacaggataaatttatattctacatttgtggaaaaaagttattatttgctaaaaaatgaagggattttttcatttatcatgcctaattccattttatttaattctacttactctaaaatcagagaactaattcttaataatacatccatattaaatattgtaagaacttctgatgatgtttttaaagatgctaaagtggaacctattattttaatcttcaaaaaaggatatgatgaaggaaataagactaagatacttataaaaaaagatgatatggatgaaattccaataaataattattca

SEQ ID NO: 1911 - DNA, 25 bp, Methanobrevibacter ruminantium
tttttatttttttaaaaaatagaaa

SEQ ID NO: 1912 - DNA, 40 bp, Methanobrevibacter ruminantium
taatttttgaaaagtaatttaaattacttttcatatttta

SEQ ID NO: 1913 - DNA, 30 bp, Methanobrevibacter ruminantium
tttgaaaagtaatttaaattacttttcata

SEQ ID NO: 1914 - DNA, 26 bp, Methanobrevibacter ruminantium
tgaaaagtaatttaaattacttttca

SEQ ID NO: 1915 - DNA, 310 bp, Methanobrevibacter ruminantium
atattataatgaaaaaatataaaaaatacatataaatcgatgaaaatttctaaaaaaataagaattttttaaaataaaataagattaaaaatattataattcatatcactttttaaactttaaattgaaaaataaacattataataaattttaaaatatattaaagtaaaataaactattatttttaaattttaataaaaaattacaaatattaatataaattataagaaataaacaaaaataattataaccataagatatatattgcatatcaacaaaacatattattactaatattaataaaataatt

SEQ ID NO: 1916 - DNA, 224 bp, Methanobrevibacter ruminantium
ggatatatgtaaaaaatagaaataattgaacattaatgtacaaaaaatctacaattaatattatatattttaagaaattaaataatatttaataggttttaataaatgaatataaaaaaattaaataatatttaataggttttaaaaaatgaatattaaatattattacataaaactattattataataaaatttatactctaaatttataccctatagaattt

SEQ ID NO: 1917 - DNA, 32 bp, Methanobrevibacter ruminantium
ttatatttaagagattttctcttaaatcataa

SEQ ID NO: 1918 - DNA, 347 bp, Methanobrevibacter ruminantium
aatacgttttgaaatatttagtaaaaataattttgaaacttttaacaataaatttaatgaaatttaagagttaatttaacaattaaattaatttattaataaaagttttcatcgtttacgcaataattgattttgtcaatagaacttaaatcaaaaaataaaaaccttgattaaaaaatggagattataaaatggttgagataaaatatgtaccatctatttgtccttactgtggtaccggctgtggtattaactttgtggtcaaagatggcaaaattattggtgtagaaccttggaaaagacacccagttaatgaaggtaaagtatgtccaaaaggtaactttgga

SEQ ID NO: 1919 - DNA, 437 bp, Methanobrevibacter ruminantium
aattaaaaatataaatcaataatctcttttaatttaaaaaaatcatttttaaatttaattcattcaaataaacccctggaataaataatcgtagataaaattatctacaatgaagaaatttaagaaaaagagcagggagaaattataaataaattaaatttaaaaacaaaatgaaatgaatcaaattaaaaaaataaataaagagaatataaattttaattaaataatctaaaaatagcattcattatagaaatgagtgaataagaggtgactatttttaaaattattaattaaaaaataaaaaaatgaataaaaatagaaaattgtaaaacgaatataataagatatcttaggcaattccttatttttaagaaaatacttattacaaagttttacaataactaaaatttattctaatatctttttaaccaacgaat

SEQ ID NO: 1920 - DNA, 129 bp, Methanobrevibacter ruminantium
attattgaataatgaatattaattgaataaaattattattgaataataattattaattgaaaaattaattgataaatatattattactatcttaatatataattctatctttaaaaaagttttttaaat

SEQ ID NO: 1921 - DNA, 446 bp, Methanobrevibacter ruminantium
tcataaaaataaaaaaaaaaattaaaattaaaattaaaaataatttaaatcataaaataactattcattctttattgttatttcaacatccttaacttcatctacaccatattcagaagttttaatagctttcaataatccaagaatggtttctttaataatatcatctgtaaatttgtttaattcaatatcattgccattgattgctaaagtcacattgttttcaaaatcatcattacaagccatataatcacctaaatactaaaattaaaaaattaattgaataataaattattaattgaaaaattaattgaataatgaattattattgaataatgaatattaattgaataaaattattattgaataataattattaattgaaaaattaattgataaatatattattactatcttaatatataattctatctttaaaaaagttt

SEQ ID NO: 1922 - DNA, 28 bp, Methanobrevibacter ruminantium
taaaaagagtttaaataaactctttttc

SEQ ID NO: 1923 - DNA, 16 bp, Methanobrevibacter ruminantium
gagtttaaataaactc

SEQ ID NO: 1924 - DNA, 30 bp, Methanobrevibacter ruminantium
gttctagaaaattgaaaaattttcaaggac

SEQ ID NO: 1925 - DNA, 129 bp, Methanobrevibacter ruminantium
agcaaaattaacaataaaataaattttaaaaaaaaaaagaatagcttttcactattctttttatttttattttttttagatgactattttttgattttttaaaatcctatccaattttttccaaaatta

SEQ ID NO: 1926 - DNA, 31 bp, Methanobrevibacter ruminantium
aaaaaagaatagcttttcactattcttttta

SEQ ID NO: 1927 - DNA, 19 bp, Methanobrevibacter ruminantium
gaatagtgaaaagctattc

SEQ ID NO: 1928 - DNA, 196 bp, Methanobrevibacter ruminantium
gaaaaacattaaaaaaaaaaaattcattgaaaaatactaaatgaattaaaatactaattaagtaaaattctataagtaaaatactaaatgaattaaaatactaattaagtaaaattctataagtaaaatactaaatgaagttaataaatcaaaatcaatatataatttatggtataaatttataactaattaaaaa

SEQ ID NO: 1929 - DNA, 504 bp, Methanobrevibacter ruminantium
ttattatatttattatgtatacatataaaaggtacatatttagactaaagtaaaaagacttatataggagtgtgtggtatatacacttttcgaaaataatttatctttcttaataatagtttaatttattatttataaataaaataattattatatctgttaatacaattatattatcatcattattttcatattatcattcataattataatttttatttttaaactattttaaaagaaataaaaaatctaaaaaattggtgaaaaatcaatgaattatatctccaatatgtaagcaattttatatcgaattttttaaaaatttcaaattatttaggccaatctaaaaaatgtgtagtaaatacacacaattatggtgtagtaagtacacatacctattttgatgatgattttctaataaaaaaacatgcaaaattcatgaaaaatattaaaaaaatttttataaatttataaagagactcttgaaaaaattaaaaaatttta

SEQ ID NO: 1930 - DNA, 23 bp, Methanobrevibacter ruminantium
caaactttttaaaaaaaagtttg

SEQ ID NO: 1931 - DNA, 142 bp, Methanobrevibacter ruminantium
aatttaaaagattgaaaaaactgaagctcaattaataaagattaaaaactgaagctcaattaataaatttaaatcaataaaaatcgagcattagaaattaattaaattatgacttaagaaattataaaaattattgaaataa

SEQ ID NO: 1932 - DNA, 13 bp, Methanobrevibacter ruminantium
gctacattgtagc

SEQ ID NO: 1933 - DNA, 277 bp, Methanobrevibacter ruminantium
attttgtaataatagaaaaaataaaaaagcattaaaaaaattgtttcaaaaaaaatgaaaaattgttttaataaaaaaaataaatgaaaaattgtttcaataaaaaaaagaaaattagaaaaagactaaaaagaaaaagaaaattaaaaaagaaaggattgagataaaaatataaggtttctaaatattatagcctttttcaaaacttaattcttgagataaaatttaatcaaacttcttttaagaatatagagatacaatttttggaaatgaaaat

SEQ ID NO: 1934 - DNA, 27 bp, Methanobrevibacter ruminantium
atagctatttaaattttaaatagctac

SEQ ID NO: 1935 - DNA, 25 bp, Methanobrevibacter ruminantium
tagctatttaaattttaaatagcta

SEQ ID NO: 1936 - DNA, 129 bp, Methanobrevibacter ruminantium
aaatatactttttagaaaaataatttttagaaaatataattcttagaaaatataattttaagaaaatataatttaatattaattttttagaaaatttattgcgattaagtttataatattccaaagatt

SEQ ID NO: 1937 - DNA, 214 bp, Methanobrevibacter ruminantium
ttaagataatttataaatgaatagttatttgttcaatttttactaataaaattaaattatttctaaaattttaacaaaaaattaaataaaataatgaaaaatattaaaaaaaataaactaatccttaagatttaaaaactataagatagataaaataatatattaaaaaaattaatataatattatagatggaaatatatttccgaagaaaata

SEQ ID NO: 1938 - DNA, 251 bp, Methanobrevibacter ruminantium
ttttcatgataataatttagttttaaaattataaatattacattatatgcaaaacatatcttttaatatattccacataccaccaattaagtaattatactattcatatttaagtaattatactaattttatttaagcaattactaatttattttaagaaatatatcaaaaaaaataaataaaaaatttaatcatatttttatagatattattaattataaactatttaaaattatttattttaataataa

SEQ ID NO: 1939 - DNA, 176 bp, Methanobrevibacter ruminantium
ataatatctataaaaatatgattaaattttttatttattttttttgatatatttcttaaaataaattagtaattgcttaaataaaattagtataattacttaaatatgaatagtataattacttaattggtggtatgtggaatatattaaaagatatgttttgcatataatgtaat

SEQ ID NO: 1940 - DNA, 27 bp, Methanobrevibacter ruminantium
gatatagcttaatattttaagctattc

SEQ ID NO: 1941 - DNA, 20 bp, Methanobrevibacter ruminantium
tagcttaatattttaagcta

SEQ ID NO: 1942 - DNA, 22 bp, Methanobrevibacter ruminantium
taagcaatcaaaagattgctta

SEQ ID NO: 1943 - DNA, 22 bp, Methanobrevibacter ruminantium
taagcaatcttttgattgctta

SEQ ID NO: 1944 - DNA, 29 bp, Methanobrevibacter ruminantium
aaacaatgagagttaatctctcattattc

SEQ ID NO: 1945 - DNA, 17 bp, Methanobrevibacter ruminantium
tgagagttaatctctca

SEQ ID NO: 1946 - DNA, 110 bp, Methanobrevibacter ruminantium
gccggggtggctcagctggttagagcgcacggctcatagggtaactaagcgtgctctgacttttttcctgggataccgtgagatcgcgggttcgaatcccgcccccggca

SEQ ID NO: 1947 - DNA, 240 bp, Methanobrevibacter ruminantium
ccttctccattatcaatatagcgaaaataagacatgatatcagttaattaaattattaaaatcaaatagattataaaaatgaaaataaataaaaaataaaaataaatagaaaaaattaatcctctaaaagaggataaatttaaaataaaaataaaaaattaaccatttaaatgattatgaatttaatataaaataaaaaaatcaaccatttaaatgagaataattttaaaaaaataataa

SEQ ID NO: 1948 - DNA, 100 bp, Methanobrevibacter ruminantium
attataaaaatgaaaataaataaaaaataaaaataaatagaaaaaattaatcctctaaaagaggataaatttaaaataaaaataaaaaattaaccattta

SEQ ID NO: 1949 - DNA, 23 bp, Methanobrevibacter ruminantium
tttatcctcttttagaggattaa

SEQ ID NO: 1950 - DNA, 15 bp, Methanobrevibacter ruminantium
tcctcttttagagga

SEQ ID NO: 1951 - DNA, 22 bp, Methanobrevibacter ruminantium
tgttgatttttaataatcaaca

SEQ ID NO: 1952 - DNA, 201 bp, Methanobrevibacter ruminantium
gtaaacattttaaaaaattaatataattttagttttataatgaaaaaaacttaataaaaaaacggtaaaattaataaattttttataaaatttttactaataaaatatattatttaaatagtatataaacttaattgaaaaaaatttaaaaatcggtaaaaatattatgaactttaacaaaagtattaataaaaattattc

SEQ ID NO: 1953 - DNA, 111 bp, Methanobrevibacter ruminantium
tattaataaaagattaggaagcaacagagctagaagaagaaaatctgagaaaactagcaatgctcctggtaaaagaaatcgtgaagagaaagagaaagctgaagctatctt

SEQ ID NO: 1954 - DNA, 450 bp, Methanobrevibacter ruminantium
ataagatatttataaaataagaataattcatgattttagaaataaaaattttaaatcaaatcttgaaaatcgacatctaaattcatattaaaattcaaatttctaaagttcaataataaagttagatttaactattatattaactttacttatattttgagattgtgattttgagaaattgctttaatcttaaaaatagaaaaaatattaatattaaaaaataagtgtaaatactattataaatgctaaattaagtatttaaaattatttaaataagaaaataagtttaataataaaaatataagaaaagtagaaataaaaatataataaaaaaatgaaataaaaatagaaataaaaatataagaaaaatagataataaaaaaatatctaaataaataaaaaaataggtttaaaataaaaaatcaaaaaaatcgatttagaaaaaaataa

SEQ ID NO: 1955 - DNA, 328 bp, Methanobrevibacter ruminantium
ctaaaataataatttaaataattattaaaggataaacaaaattatataaaaattactatccaaataattttgtaaaaaaatttagttgaaattataaatattttaattcaattttaatatttaagactttctatttttggaaaacaacaaaactaagttaagtcaatattgctttaagttggaaacaatattgatgtggccttgcaagatatataaataatttattataaattaagcaatttttacaattattaggcgtaaatactgatattataaaatgcttcttaaataatattaaataatattataataattttataaatattta

SEQ ID NO: 1956 - DNA, 288 bp, Methanobrevibacter ruminantium
taaaataagtaaaaataagaaagaatttgaaataatagtttgatagttatagaataaaatattttattaaattttagaaaattattgaaaaaatgataaaaaaatatgaaaactgaaaaattgaattaaaaatatgataaaaagagtaaaatttaaaaaaaaaataaaaattgaaagattatgaaaattagtttattttataaaaaaaagaaaaataataattaaaagtaaaagaaaaagaattatttactctaagaccttaatctaagactaaaaacaattatttag

SEQ ID NO: 1957 - DNA, 77 bp, Methanobrevibacter ruminantium
aaaaatgataaaaaaatatgaaaactgaaaaattgaattaaaaatatgataaaaagagtaaaatttaaaaaaaaaat

SEQ ID NO: 1958 - DNA, 297 bp, Methanobrevibacter ruminantium
ttaatatattttaaaatacatctttaataacatataattaattattaaactaaaattaagatttaaaaaaatcaatctaaatttaataataattaaatatacattttatatacatataaaagtttctactaaactaattttttaaaaaatcgccaatatgtgcaaataaaagttcaaataaagtcatttgaaaaaagagtaataataatttaattatagttaataaaaaattatatcgatgtgtaactttattaaatacaataaaaatattagttagataaaatataagaatattat

SEQ ID NO: 1959 - DNA, 227 bp, Methanobrevibacter ruminantium
ttttcattatttaatcttaataaattatttttttaattaatttatattcataaattattttttaaatacaataataaaataaattatttttaaaataattaattttaaaaaattattttttaaataaataagttttataatagaattcagtttagcacagaattcatttttaagaagggatttaatgtctatttcagataaaatcgaagaaaataaagtaatattca

SEQ ID NO: 1960 - DNA, 407 bp, Methanobrevibacter ruminantium
ttgtttatttaaaatgttttataattgttttattttgaatattatattaacaaattgttagatataatttaaagttttaactattaatagttttatatttaaaaatttataaacttttcattgttttgcttaaataaaaataatgaaattgataaaagcgattaaaattaaaaaacttttagaataggaaaataagagttttgtgtaaaaaacgtgcataattattaaaatacaaaaataagaaaaataaataaaaattagttaaaataaaaattaaaaaaatgttaaaatataaaaaaatattaaaaatagaaaaattaagaaaaatataaaaaaatagataaagttaattaaataaaagaaatggaactaataaagaggctgtcccatttgcgcttgagctttag

SEQ ID NO: 1961 - DNA, 127 bp, Methanobrevibacter ruminantium
atattaacaaattgttagatataatttaaagttttaactattaatagttttatatttaaaaatttataaacttttcattgttttgcttaaataaaaataatgaaattgataaaagcgattaaaatta

SEQ ID NO: 1962 - DNA, 19 bp, Methanobrevibacter ruminantium
gttagccttaaaggctaac

SEQ ID NO: 1963 - DNA, 236 bp, Methanobrevibacter ruminantium
caatccggttttaacgttactgtctaaattcataatcacaccataaaaaattgaaaaataaaagaacgaattttattatttaaaagtaattaagaataaatatcgttcaagaatatggattaataatttgttaattaatttttgaattaattaattattattacactattatattattaaaaattactatataaatttaactttataaagcaataaatttagatttataaatctaa

SEQ ID NO: 1964 - DNA, 151 bp, Methanobrevibacter ruminantium
aagtctttaaataaggtgaaaggatttaggaaacttaaattattatttaagtttctctttttatttttttataaaatcattatttttattatttatttaagttttttaattatttatttcatttaaaagctatttttcagatatttctatt

SEQ ID NO: 1965 - DNA, 29 bp, Methanobrevibacter ruminantium
ggaaacttaaattattatttaagtttctc

SEQ ID NO: 1966 - DNA, 26 bp, Methanobrevibacter ruminantium
gaaacttaaattattatttaagtttc

SEQ ID NO: 1967 - DNA, 240 bp, Methanobrevibacter ruminantium
aatatactttaaattttatgatttaaaaattttattttaattaattaatgaaattcaaattagaattaaaataatttaattaattaatcaaaatagttaaataatagccaataactctttttaatagaaatatctgaaaaatagcttttaaatgaaataaataattaaaaaacttaaataaataataaaaataatgattttataaaaaaataaaaagagaaacttaaataataatttaag

SEQ ID NO: 1968 - DNA, 23 bp, Methanobrevibacter ruminantium
gtagaagactaatggtcttttac

SEQ ID NO: 1969 - DNA, 23 bp, Methanobrevibacter ruminantium
ttagatgattaaaaatcatctaa

SEQ ID NO: 1970 - DNA, 21 bp, Methanobrevibacter ruminantium
tagatgattagcaatcatcta

SEQ ID NO: 1971 - DNA, 13 bp, Methanobrevibacter ruminantium
ttagtttaactaa

SEQ ID NO: 1972 - DNA, 26 bp, Methanobrevibacter ruminantium
tttatagggataagaacccctataaa

SEQ ID NO: 1973 - DNA, 373 bp, Methanobrevibacter ruminantium
ccttaaatattaatagttctatttaaaaaattatttaattatttctaattttttattgttttattaatagttaactaggattagtgttttttagttgttttggttctagaaggagtagtttttagttttatttatgagggcttgtttgttaaagtaaaaaaagaatgtaggttatgtaataagaagaataataattttaaaaagggttttattaaaatagtaaaagattattttttttattaaattagttagtggtttaaaaagggttttattaaaatagtaaaagattattttttttattaaattagttagtggtttaaaaagggttttattaaaataaaaaaagattctagcttctattataaataaaagc

SEQ ID NO: 1974 - DNA, 35 bp, Methanobrevibacter ruminantium
aaatctagcttttatttataatagaagctagaatc

SEQ ID NO: 1975 - DNA, 31 bp, Methanobrevibacter ruminantium
atctagcttttatttataatagaagctagaa

SEQ ID NO: 1976 - DNA, 29 bp, Methanobrevibacter ruminantium
tctagcttttatttataatagaagctaga

SEQ ID NO: 1977 - DNA, 386 bp, Methanobrevibacter ruminantium
tgtctttaataatacttataaattcttaaaagtttccaataataaagagaaattaaagattttgaataatattcatcaaatcatacaaacccctaataaatctaataagaaatataaaatttttatttaaatctagcttttataagtcttatagaagctagaacctttttttatttttttaaaattcaacaaaaactagttttaataaaacataaatcattttacacgaattaatttatcaaataactctttctaatccccctaaattactagatcgacttatatactgatatagaacaatattgaactagttaagtattagagaacatattagaaataattaaataattattcaaataaagatataaataatttaaaaaaattat

SEQ ID NO: 1978 - DNA, 35 bp, Methanobrevibacter ruminantium
gaatttaaaaaggacatctgtcctttttcatttac

SEQ ID NO: 1979 - DNA, 26 bp, Methanobrevibacter ruminantium
ttaaaaaggacatctgtcctttttca

SEQ ID NO: 1980 - DNA, 12 bp, Methanobrevibacter ruminantium
ggacatctgtcc

SEQ ID NO: 1981 - DNA, 22 bp, Methanobrevibacter ruminantium
ttaagagagtttcctctcttaa

SEQ ID NO: 1982 - DNA, 22 bp, Methanobrevibacter ruminantium
ttaagagaggaaactctcttaa

SEQ ID NO: 1983 - DNA, 181 bp, Methanobrevibacter ruminantium
tttattaatttctaatattatttattttaggtatagtttattttacttaatgtttaatattatttactttatgttaaatatattttactattattatatatttatataggattatgaatatatattcataatgtaatttatagtaattttgatttgttttttatttaacaattagaattct

SEQ ID NO: 1984 - DNA, 20 bp, Methanobrevibacter ruminantium
gggctgttgtcgaatggccc

SEQ ID NO: 1985 - DNA, 15 bp, Methanobrevibacter ruminantium
gataaaatttttatc

SEQ ID NO: 1986 - DNA, 16 bp, Methanobrevibacter ruminantium
caaaaatgcttttttg

SEQ ID NO: 1987 - DNA, 315 bp, Methanobrevibacter ruminantium
ctaaatagtttaaataaaaaaataatatgataagaataaaaatagattaaaaaaataatgaattaaagaaaaataaattaaattaatctttaatccattatttaattctttacaggtgttttagtgtatatttgtttatggtttaagatttgagaatcataaacgagtttataaactgattaactctatttaaggggaaacagtttaagataaatcataagaataaaaaaaccctttaaggatttaataggaggaaaagtaatgaatagaaactttttttagaaagacctatccattacttaaagttttttaaag

SEQ ID NO: 1988 - DNA, 11 bp, Methanobrevibacter ruminantium
tccttaaaggg

SEQ ID NO: 1989 - DNA, 232 bp, Methanobrevibacter ruminantium
atttgaatgtatataatatagtatttatgttttaatttgtatttaaaattaatctaaaattgactaaaaaccagaaaaaattggaaaataaacttaaaaaataggaaaaagggattaaaaaataaattaaaatatttaagaaatttaaataaaataattaatgaaatctaaataaaataatttaatggaaattttaaataaaaataagccaataaattaagaaaattaataa

SEQ ID NO: 1990 - DNA, 83 bp, Methanobrevibacter ruminantium
tgactaaaaaccagaaaaaattggaaaataaacttaaaaaataggaaaaagggattaaaaaataaattaaaatatttaagaaa

SEQ ID NO: 1991 - DNA, 71 bp, Methanobrevibacter ruminantium
gattaattttaaatacaaattaaaacataaatactatattatatacattcaaataaaaaattaaattaatt

SEQ ID NO: 1992 - DNA, 11 bp, Methanobrevibacter ruminantium
ctatggaatag

SEQ ID NO: 1993 - DNA, 333 bp, Methanobrevibacter ruminantium
caataaatttaattagataaaatacaatttaagaaaattaaagtaagaattaaaaagaatttttataaaaaataaggaaaatagtagtttaaataaaaaaacaatgttaaatagtctgaaataaaaaaataaaaaaaatagtagttaaaaataaaaaaaataataaaagaatactctgaaataaaaaaataaaaaaaatagtagttaaaaataaaaaaaaataatctgaaataaaaaaataaaaaaatagtagttagaaataaaaaaaataaagaatagtctgaaataaaaaaaaagagaaaaaaattaatctaaaagattaatcatgaacta

SEQ ID NO: 1994 - DNA, 17 bp, Methanobrevibacter ruminantium
ttaatcttttagattaa

SEQ ID NO: 1995 - DNA, 380 bp, Methanobrevibacter ruminantium
tatcttaactaaaaaaagactttgagccaaaataatgaaaaaacggccaaattttaaaaattaaattgtttaaaaaaaatataaaaaatataaacaaacttataaaaaaaagttaatctaataatcaaacaaatagtaaaataaaaattatatctatttttaaataaaaaaagatttttatactagattgaacaaaataataattgacaaacttaaatttgaggggcgaaaatgaaaaaagaatcaatattcaatgacgaagtaagcctattcaattccatttatgtaatgcacaaggcatttgaaaagtttttaaaaacccatgtaaatgatttaaatatcaataaggcagaatctaaatttttaggtgaaatctatta

SEQ ID NO: 1996 - DNA, 41 bp, Methanobrevibacter ruminantium
ttaattttaattaggggatttaatctcctaatttcatttaa

SEQ ID NO: 1997 - DNA, 21 bp, Methanobrevibacter ruminantium
ttaggggatttaatctcctaa

SEQ ID NO: 1998 - DNA, 15 bp, Methanobrevibacter ruminantium
taaaactttgtttta

SEQ ID NO: 1999 - DNA, 22 bp, Methanobrevibacter ruminantium
tattagattaaataatctaata

SEQ ID NO: 2000 - DNA, 212 bp, Methanobrevibacter ruminantium
ctgtacaaataactttcatatttttcctcgtaaaattaaatattaaaatgataataaagaatgttaaacaagtgtttattgcctaaatcattaattaaatcaaaattataaattagaaataaaattaataataaaaaaggtttattgtttaaatattaatatttttatatttcttaaataaatagttaatcaaaatttaaatcaaaataaaa

SEQ ID NO: 2001 - DNA, 75 bp, Methanobrevibacter ruminantium
aggctagtggcacagcctggtcagcgcgcacggctgataaccgtgaggtcctgggttcgaatcccagctagccta

SEQ ID NO: 2002 - DNA, 11 bp, Methanobrevibacter ruminantium
tatttttaata

SEQ ID NO: 2003 - DNA, 286 bp, Methanobrevibacter ruminantium
tcttttgaataataggatcgcttagcatatatagtcttccttatatatatttaaatttaaataaattaaaaaattaattaaattaattttaaattctaaaataagtaatttgtaaaaataaaaatataagaaattacgtataatcttaataatttaaaaagtaatctaataagtatattaatagtatttatatgtttactattttataaacttaatgtttttataaaaatttaaaaaaaataaaacttggaaaataaatagaatcaaacatctttataaaaaaaat

SEQ ID NO: 2004 - DNA, 154 bp, Methanobrevibacter ruminantium
attactttttaaattattaagattatacgtaatttcttatatttttatttttacaaattacttattttagaatttaaaattaatttaattaattttttaatttatttaaatttaaatatatataaggaagactatatatgctaagcgatcctat

SEQ ID NO: 2005 - DNA, 272 bp, Methanobrevibacter ruminantium
ctgtcatgttaatctgttgttttagttggattgtttatagttggataaataattaaaaaattaataattaaaagtttagtgattaaatgaaataataatcttaatgattaatagtaatttctaaagtttgattccaaataaaataataacttagttattaatagtataatttatatttagtaaatatataattattattgtttataataattaattaatttttcaattattcaaaagttaattcataatcataagattttagaatttgatta

SEQ ID NO: 2006 - DNA, 370 bp, Methanobrevibacter ruminantium
taaaggacatttataaaattccaaaccatccatatttccttaaaaaagaaatataaatgattttgtaaaatatttataaatattaaattagttataataagtatattatttattagttatgtttaaagtaatatttaaatgcaatgaatatactttatagtattcaatattttaaaccttcaagtatataactatttttatatttagacagaaatagaatgttttataccaatcgaactatcctcataaaaagacctaagaagattttaaagaaaatgaataagtcaatgataaaaaataggtaaaatcatctgataaaaatatagaaaagctataaaataaagtcaatgaaaataataaaagaatataa

SEQ ID NO: 2007 - DNA, 242 bp, Methanobrevibacter ruminantium
tcttcttgataattcatttaatatcctcacaataataaaataattgaaaatataaaaaattaattctaatatattttaattgattaaataattaaaaataaattaatttataaattaaaaaataattaaaaattaaataaaataaattaggaaaattcctaatttagaatttaatttaaaaatctgatttaaaaactaattaaaaatccgattttaatcctaatttaaaaatctaattttat

SEQ ID NO: 2008 - DNA, 177 bp, Methanobrevibacter ruminantium
aaataattgaaaatataaaaaattaattctaatatattttaattgattaaataattaaaaataaattaatttataaattaaaaaataattaaaaattaaataaaataaattaggaaaattcctaatttagaatttaatttaaaaatctgatttaaaaactaattaaaaatccgattt

SEQ ID NO: 2009 - DNA, 146 bp, Methanobrevibacter ruminantium
aaattaattctaatatattttaattgattaaataattaaaaataaattaatttataaattaaaaaataattaaaaattaaataaaataaattaggaaaattcctaatttagaatttaatttaaaaatctgatttaaaaactaatta

SEQ ID NO: 2010 - DNA, 24 bp, Methanobrevibacter ruminantium
taaattaggaattttcctaattta

SEQ ID NO: 2011 - DNA, 258 bp, Methanobrevibacter ruminantium
cttttatcttaaatatattcatataatgattttaataagaatataagaaaagaattttaaaaaaaatagaagaataatagtatttaattagaaatactaaaatacaagaaaaatagttaaaaattattatttaactaaagaattttataaaaattctaaaaaattaatttctaaatataatatttttaggaaaataattaagacctaattaatcttctaggaaaaaattaagatccgataatcttttagaaaaaaatt

SEQ ID NO: 2012 - DNA, 130 bp, Methanobrevibacter ruminantium
aatattatatttagaaattaattttttagaatttttataaaattctttagttaaataataatttttaactatttttcttgtattttagtatttctaattaaatactattattcttctattttttttaaaa

SEQ ID NO: 2013 - DNA, 214 bp, Methanobrevibacter ruminantium
ttaaattatttaaataatcaagctaattaatcacttaaataaataatttataaatataatttttgaattaaaatttaaattataaaattttattcttgaattaaaaatttaaattaataatataatttttaaattaataagatacgaaaatacttgaatagattataaatctattctactaagatatcgtcgtattctccagcgtcaactgctt

SEQ ID NO: 2014 - DNA, 19 bp, Methanobrevibacter ruminantium
ggatagattctttctatcc

SEQ ID NO: 2015 - DNA, 15 bp, Methanobrevibacter ruminantium
tcagtttcaaactga

SEQ ID NO: 2016 - DNA, 247 bp, Methanobrevibacter ruminantium
tttattatagaatattatttgttttgtagaatatttataattattgaaatgatttaaggattaattgaagccttataaaaatagttaaattataaaaaatagcaataaattagttaaataaataaaataagttataaaagtagttaaaataataaaataagtaataaaaaataattaaataaataaaataagtaataaaactaagtaaattaataaaaatagtctaaaaaaagttaaaataaataaa

SEQ ID NO: 2017 - DNA, 72 bp, Methanobrevibacter ruminantium
ttaaaataataaaataagtaataaaaaataattaaataaataaaataagtaataaaactaagtaaattaata

SEQ ID NO: 2018 - DNA, 21 bp, Methanobrevibacter ruminantium
tagttttaattcttaaatcta

SEQ ID NO: 2019 - DNA, 315 bp, Methanobrevibacter ruminantium
tttataaattaatcagcgtaattaaagttgatttgtcattaataaattagcataattaaaagttgaaatagtgaataattagttctaaaataatcatttaaaaataattattttaatataattatttgataatatatttatatttgttttttaatctattaaagagttttgtataaaatgctttttaaaaactaaactagtaaaaacttattaaaaaaaaataaaaattaagaataattaaaggcttaacactaaataaaaaaaaaaaaaaaaaattaagaaaaaataaggtcaaatataaattaaaaaaataaa

SEQ ID NO: 2020 - DNA, 180 bp, Methanobrevibacter ruminantium
aataaattagcataattaaaagttgaaatagtgaataattagttctaaaataatcatttaaaaataattattttaatataattatttgataatatatttatatttgttttttaatctattaaagagttttgtataaaatgctttttaaaaactaaactagtaaaaacttattaaaaaaaa

SEQ ID NO: 2021 - DNA, 138 bp, Methanobrevibacter ruminantium
aaagttgaaatagtgaataattagttctaaaataatcatttaaaaataattattttaatataattatttgataatatatttatatttgttttttaatctattaaagagttttgtataaaatgctttttaaaaactaaa

SEQ ID NO: 2022 - DNA, 31 bp, Methanobrevibacter ruminantium
tcctcaattgattagctaaccaattagagga

SEQ ID NO: 2023 - DNA, 271 bp, Methanobrevibacter ruminantium
gagcaatgattaaatcataattcataaaatacctcataaaaattaataaatcagcaattaaaactatttaaagaatacaataatcaaatcctacataaaaatatatcatcattaataaaattcaagcaattaaataaatattccatagatattctacaaatataccataatatactaaaattctatagaccaatataaatattctataaatattcttttaatctttttaatatatttactttatagtttataaatataactattgttataa

SEQ ID NO: 2024 - DNA, 222 bp, Methanobrevibacter ruminantium
aggaataattatattattaataactaattgttataataattaattactgaattaatagctaatataaaataattaaattattaatcaaactaaatactttttaaataactaaatagaaatatatgataattcctttagttatttaatatacattattatttttgatttatattatatataataattatgatttaaaatcgaatctttattaaaatgagtgat

SEQ ID NO: 2025 - DNA, 131 bp, Methanobrevibacter ruminantium
attatatataatataaatcaaaaataataatgtatattaaataactaaaggaattatcatatatttctatttagttatttaaaaagtatttagtttgattaataatttaattattttatattagctattaa

SEQ ID NO: 2026 - DNA, 252 bp, Methanobrevibacter ruminantium
ttttcatcttaaaacacctcagtaaataaaatatacaaaatatagtaaaatactataaatactatttaactagataatatgctttttttagtcaaatagtgcaaatatttagctttaattcataatataagaataataattaactattatagcaattaactattaaggaataattatattattaataactaattgttataataattaattactgaattaatagctaatataaaataattaaattattaatca

SEQ ID NO: 2027 - DNA, 17 bp, Methanobrevibacter ruminantium
tatagtattttactata

SEQ ID NO: 2028 - DNA, 25 bp, Methanobrevibacter ruminantium
tttttttggcctacggccaaaaaac

SEQ ID NO: 2029 - DNA, 32 bp, Methanobrevibacter ruminantium
caatttctttaagattcctcttaaagattttg

SEQ ID NO: 2030 - DNA, 22 bp, Methanobrevibacter ruminantium
tctttaagattcctcttaaaga

SEQ ID NO: 2031 - DNA, 282 bp, Methanobrevibacter ruminantium
ataaatgaataaattgattatttgctcttttaaaaattatttaaaactttttaaaaaatattttctaaatcttttagataattaattaaaaacttttaacaaaagttttcacataaatgctaaataaatctatttaagttcaattatttaaatctaattttttattgaaaaatcttgatatttttcacatcaatattgctttaatattgaaacaactttgacctaagctaaataaaaattatgccaaaaataaagcaaatctaacaggatgaaaacaattta

SEQ ID NO: 2032 - DNA, 358 bp, Methanobrevibacter ruminantium
ttttattaaaaaataataacttttttatttaaattattaattttttctattttaatgtatatttttgtatattctcacctgtttggtgattgttttataaatagttttatatgtatcttttaatatattatatagtgttgtaactttgaaaattttactatattctaattaattattaattggtttttaactaatttttattaatctaatcaattaatctattaattaatttacattactaactaactagcttaatttgaaaaggattaggcaaaaaatttatatttattgatttgaaagggtttgttaaagatgatccaaaagaagaaatatgcaaaggcagcaaagattattccag

SEQ ID NO: 2033 - DNA, 21 bp, Methanobrevibacter ruminantium
ctaaataatttatttatttag

SEQ ID NO: 2034 - DNA, 312 bp, Methanobrevibacter ruminantium
aaattatttttataaaaaaataaaagcaaatattcatttttaaattttacaagaagatggtagaaattgtaatgaaatcttcaaaaatcgaaattgaaagtaataaaaattaaaagtttttagtgaaaaattatgctaaaaaatgataaaaaaatgatgaaaaatcattaaagaatatacctcaaaatgattataaaactatgaaaaaacaatgacatgaaaaaatttaaaaaaaagaaaaaaattaattaatgattaaaaaaattgaaaaaaaattaattaaaaaattcaaaaacagtaaaaatataataa

SEQ ID NO: 2035 - DNA, 46 bp, Methanobrevibacter ruminantium
ttttggcaagcttttttcgcctacggcgaaaaaaccttgaccaaaa

SEQ ID NO: 2036 - DNA, 22 bp, Methanobrevibacter ruminantium
gaatttgaaattattcaaactc

SEQ ID NO: 2037 - DNA, 28 bp, Methanobrevibacter ruminantium
gaataatttcaaattctttaaattattc

SEQ ID NO: 2038 - DNA, 355 bp, Methanobrevibacter ruminantium
cattagttttaaaataaatttatcatattattaaaagctagaaaaattaaaaaaaagtctaaaaaataaagaataataaaaaaaatgaacatttttaaaaaatataaaaattatcattatcctataattcaaataaaagtaagataaactggcgcaaaactagcacaaaccaaatcaaactaccccaaaaaccaccacaaaccatcacaatccaaatcgaattatcataaaattatcataaattatcataatattttagtattataaattcaatatatatgactatagcataatttaatatttgcttatgaactttaatattaaaatttagctttgatatttattagaataaata

SEQ ID NO: 2039 - DNA, 291 bp, Methanobrevibacter ruminantium
ttatctttttatatgaaaaatattcaaaaaataagatttatcttaagagatttttataaaaataaaaaaataatacaaaaaatgaataaaaatataaaaatgtaatacttttttagaaaaaagtaataaactttttatatgacaaactataaaataaaaattgtttaaagagaataattttttttaaattatatcgctcaaattaaaataaaaaataactctttaaacaatataagaacaatgtgtcaccttaaaaaaaaacattgttcttattcatattttaaaatttta

SEQ ID NO: 2040 - DNA, 214 bp, Methanobrevibacter ruminantium
ttatccgaatctaaatcgttaaaagcttcttttaagaattaatttgtaaaaaatattatcttattataaaacttcttttaggagagaattataaaactataatataatattaaaagtttttaagttatttagattggaattttatctaataaaaataatagttttaaaattatattttagattggaattttatctaaattataataaaataata

SEQ ID NO: 2041 - DNA, 234 bp, Methanobrevibacter ruminantium
atataaataataatctataaattaatataatatttttatattcaaaaataataatattagtattataattatcttttaggtataccaaaacttttaaataaaattaaataaaaattatttattgtaattctaaaaaatttccaaaagaattaacaattaaaaaacaggtgattatatggtagacagacatgaaattgtagacaaaatgtatgaaaacaaacacactttactttt

SEQ ID NO: 2042 - DNA, 221 bp, Methanobrevibacter ruminantium
aaaataatatccaagaagtaggaaatttaggtatacctaaattaaggtttattggaatctcaatattttgaggtatttgtagtttaattaaaatttttaaattttctttaaaaattagatatttttaaaataaattgcattggtttttaaaaatatattggattgttgattaaatgaaaataaaaagattactataaaaacctaattaggcatacctaaaa

SEQ ID NO: 2043 - DNA, 398 bp, Methanobrevibacter ruminantium
aatccaatatatttttaaaaaccaatgcaatttattttaaaaatatctaatttttaaagaaaatttaaaaattttaattaaactacaaatacctcaaaatattgagattccaataaaccttaatttaggtatacctaaatttcctacttcttggatattatttttatattatgatttttgcgaggttataaaatgattaaaaaattaagcgaactcaaatctggagaacaaggcaccttatcttcttacggaactggcggagatttggaattgaaaagacatttgctcggtatgggcttcattaaaggagcagatattgaagtagaaaaagtagctcctcttggagatcctatgcaaattaaggtaaaaggatactctgtatgtcttagaaaagaaga

SEQ ID NO: 2044 - DNA, 31 bp, Methanobrevibacter ruminantium
ggtttgggattgggttaacccattccaaatc

SEQ ID NO: 2045 - DNA, 32 bp, Methanobrevibacter ruminantium
gagttatgaactagtttagccagttctaactc

SEQ ID NO: 2046 - DNA, 226 bp, Methanobrevibacter ruminantium
ttccaatattaaaaaaaagttttgctcttatgatttaaaagcattttaaaattaactttaaaaaatgatttttacaataagttaaaaaacagtaaaataataagttttaagggataagaattgttcatttagcgaataataaacagttatttcttatttttatataatatttatctaaaaaaattcaaattaaaatcataataatatgcattattattaagtaaaa

SEQ ID NO: 2047 - DNA, 226 bp, Methanobrevibacter ruminantium
cctccaaattaattaaattgaataaatcacactaaaaagattactttttaaacttaaataagattattaaaaataaaaatattagaattttaaaagctaataagattattgaaaataaaaatattaagaaaaattattacccattaatactttaaatactaaatacaatgcaaaaaaataatttacttttaaaaagtaatacttttttaatataattcattatgaa

SEQ ID NO: 2048 - DNA, 18 bp, Methanobrevibacter ruminantium
ttttaggtatgcctaaaa

SEQ ID NO: 2049 - DNA, 25 bp, Methanobrevibacter ruminantium
tcattcatagcattgctatgaattc

SEQ ID NO: 2050 - DNA, 19 bp, Methanobrevibacter ruminantium
ttcatagcaatgctatgaa

SEQ ID NO: 2051 - DNA, 19 bp, Methanobrevibacter ruminantium
ttcatagcattgctatgaa

SEQ ID NO: 2052 - DNA, 83 bp, Methanobrevibacter ruminantium
gcaagagtgcccgagcggccaaaggggaaggacttaagatcctttggtgtaggccttcgagggttcgaatcccttctcttgca

SEQ ID NO: 2053 - DNA, 73 bp, Methanobrevibacter ruminantium
gccttagtggctcagccggtagagcgctaccttggtaaggtagaagtcgggggttcgaatcccccctaaggct

SEQ ID NO: 2054 - DNA, 267 bp, Methanobrevibacter ruminantium
cttatagtatataaagtaatgcattgattattcgtatttaaacaaactacattcttatattgtttaattttttaaaatcgttatattttagacaaaagaagaaaaaattcctaataattttgaataaaaaaaattattgggataaaaaaactaaaaaaccattataataacatatatttcactgaacaaagcttaatcaaatagcaaattgtctagtatttgaaaattaaaaaaaaaaaacaatccgaagattgaaaaaaataaaaa

SEQ ID NO: 2055 - DNA, 354 bp, Methanobrevibacter ruminantium
ttataatgataaataattacaaattattatttttttagagaagacaaaattagaaaaaaattataatatttataaacagataactataaaaaaatcataaaaattaaaatataaaatcatttttctgatatttataaacaaaatatcaatgttttaatctttagaatgtttataaaaaaaatagattaattattaataaaaaataattattttttaaaacgataatgataaatcgttaaagaatcaaaaatcagagggttttttaaaagttttaattttaactaaaaaataaaaaaaataaaaaaataagaggatcattaaaaaattataatcctaaaattaaaaatttaataa

SEQ ID NO: 2056 - DNA, 141 bp, Methanobrevibacter ruminantium
ataattacaaattattatttttttagagaagacaaaattagaaaaaaattataatatttataaacagataactataaaaaaatcataaaaattaaaatataaaatcatttttctgatatttataaacaaaatatcaatgtt

SEQ ID NO: 2057 - DNA, 15 bp, Methanobrevibacter ruminantium
ttataaatattataa

SEQ ID NO: 2058 - DNA, 35 bp, Methanobrevibacter ruminantium
aatgatttttaaagagctattctttaaaaattatc

SEQ ID NO: 2059 - DNA, 31 bp, Methanobrevibacter ruminantium
tgatttttaaagagctattctttaaaaatta

SEQ ID NO: 2060 - DNA, 109 bp, Methanobrevibacter ruminantium
tcttgaaataattaaacaaaaaaataaaaaaaaagaaaatagttaaataaactcttcaagagccttgaataaataaaaaaagtaaaaaagaatagttaaataaactctt

SEQ ID NO: 2061 - DNA, 118 bp, Methanobrevibacter ruminantium
ttttataaacaaaaaatcatttttttattaaaaaatattataaatttaaatttaaaaatatcatattatataatatattaaattttagtttaatttatataaataattattgttttat

SEQ ID NO: 2062 - DNA, 219 bp, Methanobrevibacter ruminantium
cttcaatggttaattcttcatctgtcatttaaaaaccttttttagttaattgtttaaattaaactattaaaattattaaaacatatcaaatatctaataaaagtaattttataaacaaaaaatcatttttttattaaaaaatattataaatttaaatttaaaaatatcatattatataatatattaaattttagtttaatttatataaataattattgt

SEQ ID NO: 2063 - DNA, 694 bp, Methanobrevibacter ruminantium
aaaattacatcaaatggggatttgctttaaaaagtcatgataaaaacatattaaataaaaattttaaaaatatatataaattattaataatatattaaatatactaaaaaattataaaaattataaaaattaaacaattaaaaaattttataatttatagtttttttattatatagttctattaatcaaataaaggtaaaagaatggaaattagagaattaacaaaggaaatcagagacagatctatagaatatgcaaagccaaaggacttggataacttatctgccagctggtatcaagaggacctattatattcaggaaagggaaagacaatattccttattctacctactcccggatgctcttgggctcttggaccaagcggaggatgcacaatgtgcagctacatctcagactgctatctaaagccaatagaaacttccaaaataatcgagctctttgaaatggaactgggcaaatgggattttgctgaagactataaaaatggagagaagattgcaataaagctatttgcatctggaagctttttaaacccagaagaacttccaaaggaagctagaaattacatccttcaaagattggcagacctggatgaaataagcgagatagtcgtagagtccagacccgaatatgtaaaaaaagagataatcgatgaaatatttgaaataatcgg

SEQ ID NO: 2064 - DNA, 77 bp, Methanobrevibacter ruminantium
aattattaataatatattaaatatactaaaaaattataaaaattataaaaattaaacaattaaaaaattttataatt

SEQ ID NO: 2065 - DNA, 96 bp, Methanobrevibacter ruminantium
aataattaatttttataccatagaacattttatattaaacaaacaaaattagcatttttccaagacaaatatctttagaagtctttaaaaaaaatt

SEQ ID NO: 2066 - DNA, 255 bp, Methanobrevibacter ruminantium
aattgttattttgttgtcgagcttataaagtatttgttatttgaaaaatatagaaagatttatatattatattataatttttattttttaaaaaaaataataaacaaaaatgattttttataatacataaataaacaaattgaataaaattaataataaattttaaaaatcttcattcattagaaaaaaataaaaaaatcgatgagacttaatagaatatataaataaaagaaaatgtattatagaattataaaa

SEQ ID NO: 2067 - DNA, 312 bp, Methanobrevibacter ruminantium
ccatattattaaaaataaaaaattggaaatgaaaatttaatttaaaaaattaaaattctagaaatcttttaatatataaatatatctatttttatttcataatttagaaaataatgataaaatgatataaaattgtacaaaataggatattagaatacttgattaaaagtttagggaaatttgataaaaaaattcattataagaattatagtaataggtaaaatttattaattttattaatagataataattttttaaatatattatttattatttattttcattatttatttttattaaagaaattaagaa

SEQ ID NO: 2068 - DNA, 144 bp, Methanobrevibacter ruminantium
tttctttaataaaaataaataatgaaaataaataataaataatatatttaaaaaattattatctattaataaaattaataaattttacctattactataattcttataatgaatttttttatcaaatttccctaaacttttaat

SEQ ID NO: 2069 - DNA, 287 bp, Methanobrevibacter ruminantium
tttaaatctttaaagaaatataaaataagagttaaattagaaattaaaattaaatttttattatatagtaaaaataggaatatttagttaaatgatttagatataaataatatagatttatttattaaaaatttaaataaaggatatcagttaaatttatgattaaataaataatcaatcataaaaatcaaaaaatattatgatttgattattattctttaaatatcttatgatttttattttaattataatataaaaatataattgataagtttaatattaaaaaa

SEQ ID NO: 2070 - DNA, 1436 bp, Methanobrevibacter ruminantium
tcctggcagaagctactgctattgggattcgattaagccatgcaagtcgaacgaatttagattcgtggcgtacggctcagtaacacgtggataacctacccttaggactgggataaccctgggaaactggggctaataccggatagataatttttcctggaatggtattttgtttaaatgttttttcgcctaaggatgggtctgcggcagattaggtagttggttaggtaatggcttaccaagcctatgatctgtacgggttgtgagagcaagagcccggagatggaacctgagacaaggttccaggccctacggggcgcagcaggcgcgaaacctccgcaatgtgagaaatcgcgacggggggatcccaagcgccattcttaacgggatggcttttcttaagtgtaaaaagcttttggaataagagctgggcaagaccggtgccagccgccgcggtaacaccggcagctctagtggtagctacttttattgggcctaaagcgttcgtagccggtttgataagtcactggtgaaatcctatagcttaactgtgggaattgctggtgatactgttgaacttgaggtcgggagaggttagcggtactcccagggtagaggtgaaattctgtaatcctgggaggaccacctgtggcgaaggcggctaactggaacgaacctgacggtgagggacgaaagccaggggcgcgaaccggattagatacccgggtagtcctggccgtaaacgatgcggacttggtgttgggatggctttgagccgctccggtgccgaagggaagctgttaagtccgccgcctgggaagtacggtcgcaagactgaaacttaaaggaattggcgggggagcaccacaacgcgtggagcctgcggtttaattggattcaacgccggacatctcaccaggagcgacagctgtatgattaccaggctgatgaccttgtttgactagctgagaggaggtgcatggccgccgtcagctcgtaccgtgaggcgtcctgttaagtcaggcaacgagcgagacccacgcccttagttaccatcagattctccggaatgctgggcacactaaggggaccgccagtgataaactggaggaaggagtggacgacggtaggtccgtatgccccgaatcccctgggctacacgcgggctacaatggctgggacaatgggttccgacgccgaaaggcgaaggcaatcttttaaacctagtcgtagttcggattgagggctgtaactcgccctcatgaagctggaatgcgtagtaatcgcgtgtcacaatcgcgcggtgaatacgtccctgctccttgcacacaccgcccgtcacaccacccaaaaagggctgggatgaggatatggtctgtggttgtattcgaatctcggttttttgaggagggtgaagtcgtaacaaggtagccgta

SEQ ID NO: 2071 - DNA, 73 bp, Methanobrevibacter ruminantium
gggcccgtagctcagttgggagagcgctgcccttgcaaggcagaggccccgggttcaaatcccggtgggtcca

SEQ ID NO: 2072 - DNA, 2975 bp, Methanobrevibacter ruminantium
tgctacttgtactatctgggggatagctaggcttgagttgcctatgaaggtcgtggtaagctgcgataagcttggggtaggagcagacatcttttgatcccaagattgcctaatgggacttcctaaataacttgttatttgatccgagaggattgggaacccactgaattgaaacatcttagtaggtggaggaagagaaagcaatagcgatatcgttagtaacggcgagcgaaaacgatgtaggacaaactgaatcccatattgtgaggtatgggagatgtggtgttttagaaatatttttaggccccttgaactaagctgaagttgacttggaatggtcacaccgtagagggtgacagtcccgtaagtatgtgttcttgtggtcttgtttattttctagagtaggatgcattggatattgcgtttgaatttgggtggcatcaacacctaatcctaaatacatctcaagaccgatagcgtatttagtaccgtgagggaatgctgaaaagaaccccgattggggggtgaaaagaacttgaaaccagatagtgatagccagatatggcctgtaaggaatgatgtccctgttaaagaggcagtggtgacgctgtagtatgattggggatggactagggtcgtatcgtccgtcttgtaacacgggccagggagttctttgttgtggcgaggataaggagttttagctttgtattcggagggaaaccgatttctcgtagcattttttgtgtgggagagaggtcttaatagggccttttagtcacagcattgaaacccgaagccggtcgatctattcctgagcaggatgaagtcgctcttacgagtgatggaggtccgcagggttgttgttctgcaaaacactcctctgacttgggaatagtggtgaaaggccaatcaaggccggtgacagctggttccactcgaaatgactcttaggtcagcctgactggagattggtagcggggtagagcactgattgggcgtttagggagggaaacttctcggcgttctgtaaaactccgaactcgttaccgttgttgatggttggagtgcggggcgcggggtaagcttgtgtcccgaaagagaaacaactcagactatggttaaggtccctaaatgttggataagtgtaagggagtctttggcccaagacaatgggcaggtgggcttagaagcagccaccctttaacgagttcgtaacagatcacccatcgaggtcaaaggcatctaaaatggacgggaattaatccaactaccgataccatagaacacgtggttttgcgtgattgtgtagagtggcgatctgtcggggttgaagttggggcgtgagttcctttggacctggcaggtatgtggatcctggtagtagtagcagcaaagtaaggtgagaatccttaccgccggaggggctagggttccttggcaatgttcgtcagccaagggttagtcgatcctaaggccggtcgtaagtcgagccggtcgaaagggaaacaggttaatattcctgtacatagttgatacgtgcggtgacgcgtggactagtttctgacgctttgagataggttttgtatgattgtcgtcatatttaagtgtttaagccaggggagaggtgtaatggcgagaacctggtgtaggcattaacagcaacctgtatgggttgtttaactgattcatggagtccttgaaaagggaattagtatggattcaactatttcgtaccgagatccgtcacaggtgcccctagttgagtagactaaggcgttttaaggtaaactagctaagggaaatcggcaaaatggccccgtaactttgggagaaggggtgccagccatgtgaatggctggtctcagtgaccaggggggcccgactgtttaataaaaacatagctctctgctagcctgaaaaggtgtgtacagagggcgacacctgcccagtgctggcacgtgaagcttcggttcaacggagtgaagcgccagtaaacggcgggggtaactataaccctcttaaggtagcgaaatgccttgtcggataagtaccgacctgcatgaatggtagaacgaggtccccactgtccctagctagatcttagtgaacctgctgttctggtgaacaagccagagacttccattgggaagtgaagaccccgtagagttttactgcagtctgctgttgaggcttggttgttggtatgcagtgtaggtgggagaattcgatgcgtgttcgccaggatacgttgattcgtccttgagacaccaccttctggtaactgtgtctctaacatgatttttggtattgtggacatcggtagatgggcagttcggctggggcggcacgggcttgaaagtgtatcaagcccgccctaaggtcaactcaggtgggacagagatccaccgtagagtgtaagggcaaatagttggcctgactgtattttgatcagtaagaaattcagaggcgaaagccgggcctagcgaacctcaaactcctcgttgatggggggttgagatgacagaaaaactacctcggggataactgggtggtcgcaggcaagagcccatatcgaccctgcggcttgctacttcgatgtcggttctttccatcctgggtgtgcagcagcacccaagggtggggttgttcgcccattaaaggggaacgtgagctgggtttagaccgtcgtgagacaggttggttactatctaatggatgtgttagtagtctgaggggaaggtggctccagtacgagaggaacgagttgtcggtgcctctggtttaccagttgtctgataaggcattgctgggcagctacgcactggacgataaaggctgaaagcatctaagcctgaggtgtcccctgaaaatagattgcttaggacgcgagtagaagactcgtttgatggggtagggatgtaagcttagaggttttttccgatttgtttagtccgctgcttccaattgttcgcttg

SEQ ID NO: 2073 - DNA, 127 bp, Methanobrevibacter ruminantium
ggtttggcggtcatagcgatggggttacacctggtctcgttccgatcccagaagttaagtcttttcgcgttttgtttgtgtactatgggtttcggtctatgggaatttcatttagctgccagccttt

SEQ ID NO: 2074 - DNA, 196 bp, Methanobrevibacter ruminantium
taatattgttttaaataagtatatataattttttataaaatgaatagggcaatataaattaaattttaaaagtgaaagaagatacaaaaataaaaaataaaaattgcaaatgaaatataaattcaaaaaggactatttttcgtagagtataggataaaaataatgaaaaaaaaactgtttttaatgaaaattaaaa

SEQ ID NO: 2075 - DNA, 438 bp, Methanobrevibacter ruminantium
aaacatatttcaaaaatccggatttcagataatgggaataaaaaataatgaaaaaatatttaaacgaaataaaaagacatgggagttttaatatgtttgcattgaaagaattatcccatttcaaaaacattatcaaaaaaaagatttcattatttccagtaatattctcattatattatttattatattttttatataaaacaagtaataaaatttttgaaatatcgggtaaatttaaaagtaataaaaatatatacttctttgttttatattataattagagagctaaaagtagtaaatattttgtatagtatacgggcaaaatattaaattaattattttttataaaaagagtaattatcaataaatactttatagtgatgatgtgtaaataaaaaagcgcttttaattgattaaaacataaaataataattttat

SEQ ID NO: 2076 - DNA, 366 bp, Methanobrevibacter ruminantium
ttaatgaattaaaatagaaattacaatatttgaatcttatcaaaatataaattgattaattaattaatttaattaaatcttaataggttttcatgaaaaacagattagatcaatcttattaatttttaaaaagaatagcattctttaaaagagccaaaatgacaagatagaaataaaagagcctaaagtaataaatttgaggaattattatggaaggaagcgaattacagaacataaaaggaattggagataagctgtcccaaaagattttgctaaaccttggaggagaagaggaacttaaccgggtcataaatgagcttgatcttgaaagacttatccaaattgaaggaataagccaaagaaagg

SEQ ID NO: 2077 - DNA, 396 bp, Methanobrevibacter ruminantium
tgatctaaataaatttagtcttgattttctcatatattcaccaaaataataaaaatatttataaatgttttaaaaacattaaaaaaaacttataaaaacattacaaaaacattataaaatttttataaaattattataaaattattatacatcattaattatttacttttaagtatttaaaattatcataaaatcaaggcaaaaagagaatatgaaaaaaatgattatcaatcaaaccaaactattaaaacctaaaccttaaaagaggagtaaaataaaaaaaataagtaaaattgaagcaaagtataaatataacttagtgaatcaaagtaatattgttacgaaatcaaaacaattttgatgtgaaaaaataggcaaaaaatgaaaaatcaataa

SEQ ID NO: 2078 - DNA, 32 bp, Methanobrevibacter ruminantium
gttaaataaataatcaaattatttatttaatc

SEQ ID NO: 2079 - DNA, 29 bp, Methanobrevibacter ruminantium
ttaaataaataatcaaattatttatttaa

SEQ ID NO: 2080 - DNA, 21 bp, Methanobrevibacter ruminantium
gaaaattattacataattttc

SEQ ID NO: 2081 - DNA, 23 bp, Methanobrevibacter ruminantium
tattaaatgaaactcatttaata

SEQ ID NO: 2082 - DNA, 18 bp, Methanobrevibacter ruminantium
gaattccaaatggaattc

SEQ ID NO: 2083 - DNA, 37 bp, Methanobrevibacter ruminantium
tttttaagaactgaaactattaatcagttcttaaaaa

SEQ ID NO: 2084 - DNA, 223 bp, Methanobrevibacter ruminantium
ttgatagataaaactaaaatattaattaaaagaaaaatcaataaggggatttgactaaagaagattaaattagacaaataaagaaactaatttaaaatctctaaaatcaaataagttttgattaaattctaaattaatattttgaaattataataattaatatcgtatttaaaaaacacacaatgcaatgcaaaaatacaacatacaacattatataatttat

SEQ ID NO: 2085 - DNA, 33 bp, Methanobrevibacter ruminantium
ttgcctgtttagatttgaattctaaacaggaag

SEQ ID NO: 2086 - DNA, 18 bp, Methanobrevibacter ruminantium
gcataatgagtattatgc

SEQ ID NO: 2087 - DNA, 308 bp, Methanobrevibacter ruminantium
catattaaataattaataattttttatatataattattactacttgatttgtttaaagcctttagaaagcagatttagtaaaaataagcaatagaatagattaaaatagagaataagaattagaattaatattataaaaaaataagaagataaagaattagaattaatattataaaaaaataagaagataaagaattagaattaatattataaaaaaataagaagataaagaattagaattaatattataaaaaaataagaagacaaataattaaaattaagaaataaataatttaatacattaaccc

SEQ ID NO: 2088 - DNA, 321 bp, Methanobrevibacter ruminantium
tttaaaaaatattcttaatcctttttcaggaattacattataaaatatctgtttttcctattttataattctttttggaataatttcttttcataaaaaacatcataatgaaaacaattatgcaatactttttactataagaataattaattttagccataattatttataccatcaatcatcaaaacaattgtttaattaaaccagaaatgaatattttaatagatgtatgaaaatttgataaaattaataaatgaaatacacatgatataatctaagtagaataaaaaaaatagtttaaaattttaaaaatatataaaa

SEQ ID NO: 2089 - DNA, 15 bp, Methanobrevibacter ruminantium
gattattttatagtc

SEQ ID NO: 2090 - DNA, 22 bp, Methanobrevibacter ruminantium
gattccattttttaatggaatc

SEQ ID NO: 2091 - DNA, 214 bp, Methanobrevibacter ruminantium
attataaatttaaatatcaaatcttaaaaataaaattagaattaacgaaattaataataatagaaatttaaattgtcaaatattaaaaaattaagttaaatcttttaacgatattattaataattatgaaattcaactaatataaaatttttcattaattaaagtttatattaagactatgtagttaatcatataaaaaacttacaaaaattat

SEQ ID NO: 2092 - DNA, 233 bp, Methanobrevibacter ruminantium
cgaatcatctaaaattattgaataaaatccatataatctaaattaaatttattaaattattaaaaattatactaaataaatcaagatacctacaaaaactaaatttaatcaagtataaatcctcataataattaacttagttaataatataagcgagtgaaaatatgaattttttaaataattaagaaaattaaagtttgataaaaaatcaaattacttgatgaaaaacaaat

SEQ ID NO: 2093 - DNA, 35 bp, Methanobrevibacter ruminantium
atacaaagttattgataaattcaataactttatac

SEQ ID NO: 2094 - DNA, 33 bp, Methanobrevibacter ruminantium
tataaagttattgaatttatcaataactttgta

SEQ ID NO: 2095 - DNA, 33 bp, Methanobrevibacter ruminantium
tacaaagttattgataaattcaataactttata

SEQ ID NO: 2096 - DNA, 426 bp, Methanobrevibacter ruminantium
tcatttttttaatataataatttgtaaatataatttattttaaaagagattttcagatttaataacctgaaaatttataataatttaaaaatttctaataaattatcataataaaatattagttgcttaatatatttaataatatcattttttttaacttgcttggaaaaataattaaatttggataattattctaaaagaaaagtcaaatccaaaattaaaactaaacaaaaacaaaataattattctaaacgaaaagacagaccccaaaaaaattaaaataaataaaatttttagaaatttctaaaaaaatactaaactatataattaaataaatagaaatatatataatgttattttatattatataggataaattatattttataaaaaagagatagttttgaaaaaaatatcaaattctta

SEQ ID NO: 2097 - DNA, 24 bp, Methanobrevibacter ruminantium
ttaaagactctttgtagtctttaa

SEQ ID NO: 2098 - DNA, 272 bp, Methanobrevibacter ruminantium
taagaatccttaagattattaagattagggtataaaaaaatttcgtgatataaaagaatttttaattataaatattagttagaataaattatctatatcttaatgttagtcataatttagtaatttaaaaagataaaaataattaaaaatattatgaaaaccattgtttaaaaaattcaattttcaaacaaaatcatatttattcaatttattttcaaaaccccttgaatggaggtgttaagatagaatctactgatataagatatttttat

SEQ ID NO: 2099 - DNA, 352 bp, Methanobrevibacter ruminantium
atcagtatttccgtaaggatcccaacatgcataaatgtttaaaaccgcataaagggaaggaaggataattatgcctattagaacaataactacaattggatttgaaaatgctgatttaaaatccgatttaattatttcatcaatattcttaagaatattccctttcatcttctaatctccaagcttaaaattgcacaagactaaataagcaattattaattatattaattttttaacctataattttatagaattttattaatttaattaattttaactataaaattaatagaaattaattaatattatttattttaaggtatataatcttatttgatatttaaagataata

SEQ ID NO: 2100 - DNA, 315 bp, Methanobrevibacter ruminantium
cttttagaattaaaccatttactatagtcttcatactatttaatttaaattaagttttatatatttttatttaaattcttaaaaagcagtcataattatcgaaacaaaaagaatgatgaaaacattcccaatatcctattataaagcaataatcaaaaataaagaaaaaacaatgattaaaataaaacaatgaaataaaaatagaaaataaataaaaaaataataaaaataaaagaaataaagagttaaaaaactccctttaaaaaaaaagaaagaataaatagaattaatcaaaatcattagataattctatct

SEQ ID NO: 2101 - DNA, 559 bp, Methanobrevibacter ruminantium
ttatttaaataatttagtatttttttaaaaatttttgttgaaatttctctaaaaaactaggaattttgattgtcttaataaaaaaataaaaaaataatttacaatattgttttatttttttaaaaaatattacaaaatgataacttggaaaagtaaaaattgatttgaaactgttaaataaaaagagaaaaaagaaaaaaataaccaaaaatagaaaaataaaaaagagagaaaagaaaaaaaaatacccaaaaatagaaaaataaaaagagaataagaaagaaataattgcaataagccaattagattattttaacaatgtcattagcttctgttcgattgatcaaactcaaataagggttatttgacttcttatttacaatcatgagttcggccttttggccttctccaatatatgacttatcaataggcagattagaaatgcttgaatctgcattagtggtagccatttttaatatttctctagcatctatgtgatttctagaaactcctttcattatctttaatgtaaattccaactccctaaacatatttggtg

SEQ ID NO: 2102 - DNA, 379 bp, Methanobrevibacter ruminantium
ccagaaagataatagatattgttgaaattagccaccatcattgcatccaagtctttttcttccaatctctttaaaatattctttatatgaaaatcatgaactttattttcacttgaaaccataaaaaagccccttaatcatttattgaaatgacaaatatggaattcttaaatatactaaacatcttttagaattccaggtaaaataaaacataaacaaataaatattaatttttattatttaaaaactaatctaaattattttaccaaaaattgaaatttaaaaattcataaaaaaccaatgaagccctccaaattatgatataaataaatattataataatcaaaaataaagatataaaaaaatagctaggaataaa

SEQ ID NO: 2103 - DNA, 42 bp, Methanobrevibacter ruminantium
cttaaagtttaagaattcaaaaaatgaattcttaactttaaa

SEQ ID NO: 2104 - DNA, 40 bp, Methanobrevibacter ruminantium
ttaaagtttaagaattcaaaaaatgaattcttaactttaa

SEQ ID NO: 2105 - DNA, 240 bp, Methanobrevibacter ruminantium
ctttattgttttttaactaaaaataatcttataaaattaaaatttgataataaaattaaaagaaaataaagaaataaaattaaaccatatgaataaattaaaaaataagtgaaatcatataggaaaaatagaaaataagaaaaatagataataaaaaaaatcaaaattttcaaaaatgataataacatgataatatcatttgaaaatatgggaaaattcaataaataaggccaaaaatat

SEQ ID NO: 2106 - DNA, 290 bp, Methanobrevibacter ruminantium
tttttaaatttaaatcaaattagaagtttaaaaatatatttaaaagataagtttacttttttaatcttaaaaaaaatatattataatatttttttaatcttgaaatataaaatattattaaattttttatctatataatttattaatctttatttaataaataactatccttatttaaaaataatatctgaaaaaatagatagaaaatctgaaaaaatagatagaaaaagaaactttaaaaattaaaaatcatggaaaaaaatagcctaagaagattataaaaataaaaa

SEQ ID NO: 2107 - DNA, 89 bp, Methanobrevibacter ruminantium
aaataactatccttatttaaaaataatatctgaaaaaatagatagaaaatctgaaaaaatagatagaaaaagaaactttaaaaattaaa

SEQ ID NO: 2108 - DNA, 131 bp, Methanobrevibacter ruminantium
aaataaaataaaattaaaaataagcaattaaaaattaattattaaaattcttgatataatcaagagttttaatcttcttttctttttttaaaaaataagcaaaattaaagaaaataattctttttaaaaat

SEQ ID NO: 2109 - DNA, 35 bp, Methanobrevibacter ruminantium
tattaaaattcttgatataatcaagagttttaatc

SEQ ID NO: 2110 - DNA, 31 bp, Methanobrevibacter ruminantium
ttaaaattcttgatataatcaagagttttaa

SEQ ID NO: 2111 - DNA, 31 bp, Methanobrevibacter ruminantium
ttaaaactcttgattatatcaagaattttaa

SEQ ID NO: 2112 - DNA, 280 bp, Methanobrevibacter ruminantium
ttaccattttaaatacctcacaatttttttaattattatttcggcttttatgaataataactatttttataattggaagcatatagtatataaatctttttaaattaatttgaatattaaaaacaaagcaatgggaaaattctctaattagaaaaaataaaaaatcaaaatatggacaattaggcccttaaaaaggtatttattaaataaatgaaagttaaaaattataataaaaaattgattaaaaaaaggctagtttacaaattatttaaatataatg

SEQ ID NO: 2113 - DNA, 249 bp, Methanobrevibacter ruminantium
ctaaacttaatgattaattaaattatgaataaaattacaaagataaattcttaaacctaaataagaatttaattgaattaattattaaatttatcgaaaaatagtaaaaataaaagactgatgaaaaataaaaaaaatgtctaaaaattcaaaaaaatagaaaaaataatgagttaaaagagaagtaaaaaaagtaaatctcaagcaaaatgagataaaaattttggtccagcttttgctggccgaagg

SEQ ID NO: 2114 - DNA, 220 bp, Methanobrevibacter ruminantium
ggaaattaataaattttttaaatattgctaagataaaatagtcaattttatattattctaaaaagataataatattattaaaatttatttaaactaattaataaaaattatcttaatttaaaaattataagtttatggaaattaataagtttatgtataaaaataaaaaaataattattattatctaaaaattattatctgaaaaattagtaatgactat

SEQ ID NO: 2115 - DNA, 328 bp, Methanobrevibacter ruminantium
ttttaagtttcttatttataaattaatctattttattctaaaaaattataaataatgataatttattagtggcactgaatggctttattaaaactattcatttttataaaaaatattaaaaattttaaaaaacgttaggaaattttataaaaattctagataaatccataaaaaatagctaaaaaggcatttattttactccaaaaatagggaaaaaaactaatcccagttaataagaaattggggaaaaaaatattccggaaaagttttaaaaaggattaaaaattatagaaaaaaattaaaatccatgatatcgtgaaaataatca

SEQ ID NO: 2116 - DNA, 20 bp, Methanobrevibacter ruminantium
gatagaattttaattctatc

SEQ ID NO: 2117 - DNA, 91 bp, Methanobrevibacter ruminantium
ttgaatcatcattattttcattattttcttttaaatttaaataatcattgtctaaatttgaatcaatagaatttaaaagactatttttcat

SEQ ID NO: 2118 - DNA, 380 bp, Methanobrevibacter ruminantium
gaattaacgttaatataaaattaaataacgtttaaataaaatatttaattaaattcattaaaacttctaaaatagttaaatatgagtaaatttttatctaaatattttatttaaagtcttatgggaggtgaaataataaataatgaaaaattaaagttaattttaattttaaccttaattttttcaatattaattatgaatacagtcaatgcaagtgacaatggtatcattgcagaatacgctgatatctccacaattccaaatgatgaaaaggtttctatcaatgaaaatgactatgatacaaattattatgagttacctgataaaaaattagatcatttagaatcaaatgataatcaaaatcatttagaaatgaatga

SEQ ID NO: 2119 - DNA, 99 bp, Methanobrevibacter ruminantium
attcatcaattgaatctaaacttaaatcatttaaaaccagagaaatggccactgcataaggcaatgactgctttaaatcctgtggattctttggattga

SEQ ID NO: 2120 - DNA, 229 bp, Methanobrevibacter ruminantium
attacatgattaaatataatttacctttataataaatttttttaaaataatgaaaaaatgaatttttgaaattgataaaaaaaccatttttgatggcttgaaaaatttaattgaaaatttttgaaaatatggaaaataaaaaatataatctttataattaactacaatttaatgatagataaattaaataaaaattgtatttttatctaaactattaaaaaattaaagc

SEQ ID NO: 2121 - DNA, 259 bp, Methanobrevibacter ruminantium
aagaatttataataattctctattttatctaaaacaagttattcaataattattttaaaaagatagtaaaaatatcttttatttaatttataaaaaatatttaaattaatatctagcaaaaatagtccttttaagaaagataaattttttaataaaaatctttgaaaaattaataaaaaattaatataaattaacaaatacactcgatttctaatattatataataaaatatatatattaacaaaaataaaaatttaat

SEQ ID NO: 2122 - DNA, 337 bp, Methanobrevibacter ruminantium
tttaatatataataatctatattttttattttataatatataaagtatgctttataaatctctaaaaaacaaatttaaattgagattgggataaatactgcaaaaatagcggaattgtaaaaaaaagtttaaaaagttggtaaaactataaaaataactataaaaatagtgaattgtaaaaaaaagtttaaaaagttggtaaaactataaaaaataactataaaaatagtgaaattgtaaaaaaaagtttaaaaagtttatattaaaaaatttaaaaaaagaaaaagagaaattaagaaaataaacacatattctattttaacaagcaaaatatgaa

SEQ ID NO: 2123 - DNA, 186 bp, Methanobrevibacter ruminantium
gataaatactgcaaaaatagcggaattgtaaaaaaaagtttaaaaagttggtaaaactataaaaataactataaaaatagtgaattgtaaaaaaaagtttaaaaagttggtaaaactataaaaaataactataaaaatagtgaaattgtaaaaaaaagtttaaaaagtttatattaaaaaatttaa

SEQ ID NO: 2124 - DNA, 72 bp, Methanobrevibacter ruminantium
agtcccgtggggtagtggtaatccttctaggctttggacccggagacggcggttcgactccgctcgggacta

SEQ ID NO: 2125 - DNA, 15 bp, Methanobrevibacter ruminantium
tataacactgttata

SEQ ID NO: 2126 - DNA, 272 bp, Methanobrevibacter ruminantium
tttacttcgttatacattgaatgttgcttttgataaaagtagttttgtaaattataataatttgttaaattgctttattgtaaaaatattattcaataaatatttatttattgaaattaggattgaattatctttattttaaaaaatagtagttaaactgaaagaataaataaataaaataatataaaatgaaaaaataataaaataagaaaaataataaataagaaaaaataataaaaaaagaaaaagttatagaaataagtaattatttc

SEQ ID NO: 2127 - DNA, 321 bp, Methanobrevibacter ruminantium
tttacattttaaaaatgttttattcaacattttaattaaaatttatcaattaacttattaaaatttacagtataatttaaaaaaaattataatcaattataatttattcattaattaaaattaattataattaagctagtagtaaatttgttattatgctaaatcttaattaaaataattaattttaagctattaaaaaaaaatatggagtaaaattaataattagaatctataaatagattaaatctagtattttataaaaaatccattattaaataatgagagataagatctaaaattcaaataaatataattatttaa

SEQ ID NO: 2128 - DNA, 429 bp, Methanobrevibacter ruminantium
aatcaatcgtaaaatatacaaatgctgttttttattatttaaatgaaatttaaaaactttttctaattatcatataatcatcaatactttttctattattgtctgattcctaacgctttttaattaaaaaatcaaagtttcagtttaccatataaaactatatgacataaaaatctggaaaaattaggcttatgaaaaaaatataaaatagtttatatacaatgataaagataatattatgtggatactaaaatcatatttaaaaaatgatatttacaaattattattcacaattattacattattattaaaaattaaaggagaaaggtaaaaataaagatttcttaagattaaaattattcaaaagccgataaaaagattatagactgaaaacaaaggaataattctaataaaaagagaaatctatag

SEQ ID NO: 2129 - DNA, 369 bp, Methanobrevibacter ruminantium
atttatatataaaaaatttctttattaaaaagcatttctaaaaaatccaaaacacaaatatatttaaaaagcaattttattaattttttaaaataaacaaaatagaaaaaataattaaaaaattaataaactgtttaatgtcaaatttggataaaattaaattaaaatcgtttttagataataaaataaaaaattattagactgtaaaaatatttttttaaattttaaataatatgaaaaattttaatgaaaaattatcaatatttaacattacaatatgataaatagtggtcatatataaaggtttgtaaaaaatcctagaataattgataaaaaaaatagaataaagattggcaaagggatttgctc

SEQ ID NO: 2130 - DNA, 194 bp, Methanobrevibacter ruminantium
agcaattttattaattttttaaaataaacaaaatagaaaaaataattaaaaaattaataaactgtttaatgtcaaatttggataaaattaaattaaaatcgtttttagataataaaataaaaaattattagactgtaaaaatatttttttaaattttaaataatatgaaaaattttaatgaaaaattatcaata

SEQ ID NO: 2131 - DNA, 17 bp, Methanobrevibacter ruminantium
gataactttaagttatc

SEQ ID NO: 2132 - DNA, 249 bp, Methanobrevibacter ruminantium
tttcaatcactaaaataagtttaattaagtaaataaataatattaattaatataagttaatataggataatataaactaatataaactaatataaattaatataagcaaatataaataagttaatttaaacaataaaaattaagataattaaaaaaaagacaaataatttttctttaagttaaaaataaatattttaagttcatttataaaaaacgaacttatttttttatctaatcagatatgactct

SEQ ID NO: 2133 - DNA, 250 bp, Methanobrevibacter ruminantium
atcttaagtttatttaaactcactgaaaacacctaaaaaaatattattaaaacaaaatgatacttctaaatttataattttaatatataacttatttataaaaaattttttgcttatataaaatctaataaatacattttcaaaaaataattaaatataatacttaacaccccaaaaaatttttatatttatttaattgaaaaaataaaaaaatattaaaaaatagttttctagctttaaaaaaaaatta

SEQ ID NO: 2134 - DNA, 47 bp, Methanobrevibacter ruminantium
tttggtccagcttttgctggccgaaggccagtaaaaggtggagttag

SEQ ID NO: 2135 - DNA, 39 bp, Methanobrevibacter ruminantium
gtccagcttttgctggccgaaggccagtaaaaggtggag

SEQ ID NO: 2136 - DNA, 37 bp, Methanobrevibacter ruminantium
tccagcttttgctggccgaaggccagtaaaaggtgga

SEQ ID NO: 2137 - DNA, 39 bp, Methanobrevibacter ruminantium
gtccagcttttgctagccgaaggctagtaaaaggtggaa

SEQ ID NO: 2138 - DNA, 37 bp, Methanobrevibacter ruminantium
tccagcttttgctagccgaaggctagtaaaaggtgga

SEQ ID NO: 2139 - DNA, 39 bp, Methanobrevibacter ruminantium; identical to SEQ ID NO: 2137

SEQ ID NO: 2140 - DNA, 37 bp, Methanobrevibacter ruminantium; identical to SEQ ID NO: 2138

SEQ ID NO: 2141 - DNA, 39 bp, Methanobrevibacter ruminantium; identical to SEQ ID NO: 2137

SEQ ID NO: 2142 - DNA, 37 bp, Methanobrevibacter ruminantium; identical to SEQ ID NO: 2138

SEQ ID NO: 2143 - DNA, 20 bp, Methanobrevibacter ruminantium
tagttgggccaatccaacta

SEQ ID NO: 2144 - DNA, 205 bp, Methanobrevibacter ruminantium
ataaattgataaataaattgataaataaattgataaataaattgataaataaattttgaaataaattgataaataaaatgataaataataaattagcaagtgatttttaaaattatgattataaaaaataattaaattatggcttgaaaaataatttaaaattatgattataaataataatttaaaaaaagtttagataaactgg

SEQ ID NO: 2145 - DNA, 41 bp, Methanobrevibacter ruminantium
taaaattgaagagtaattatttttaattattcttaattttc

SEQ ID NO: 2146 - DNA, 30 bp, Methanobrevibacter ruminantium
tgaagagtaattatttttaattattcttaa

SEQ ID NO: 2147 - DNA, 27 bp, Methanobrevibacter ruminantium
cagctattaatgattcattaatagcac

SEQ ID NO: 2148 - DNA, 25 bp, Methanobrevibacter ruminantium
agctattaatgattcattaatagca

SEQ ID NO: 2149 - DNA, 23 bp, Methanobrevibacter ruminantium
gctattaatgattcattaatagc

SEQ ID NO: 2150 - DNA, 24 bp, Methanobrevibacter ruminantium
taattagttatttttaactaatta

SEQ ID NO: 2151 - DNA, 209 bp, Methanobrevibacter ruminantium
ttttaacttttaactattttttttaattttttagatttcaactattttttaattgaagatatttcttcaatagtttatttaatgtcattcaaatcattatcgatttcaagatatcatttgaaaaaaaagtaaaaacaattaaaaaactattttaatttgaaatataaactataattatgagaaggtgaatggaatgaacgaaatcattg

SEQ ID NO: 2152 - DNA, 28 bp, Methanobrevibacter ruminantium
gtagaaggttaatttattaatcttttgc

SEQ ID NO: 2153 - DNA, 406 bp, Methanobrevibacter ruminantium
ctttatggcttaaagaacccaatctcccccatatattaatttaagtttagaatcaatgaaaatcgtcattaatcctttttttaaacaattaaaaacctttttctaatttctttttttctatttttacatatttctagctcataaaaatcggcaaatatattcttttgattaaatcatataatttaatgaaacatgaatttaatcaaatgaacttagtgtcaactataaaaatattgattgaaactataaatttaataatttttatattatagtttaaaaaaattagtgatgtatatatagatgcaattaatacaaaatgaattttttcagatatgctttttaaaatattaaaagtttaccaaatattttatgtagtttttgtctaaacctatcaaaatattgatag

SEQ ID NO: 2154 - DNA, 268 bp, Methanobrevibacter ruminantium
gtttaagtttactatttagaataaatagtaaacttattttcatttagtctataaataatgaatattataatataatattaactttaattaagtattacaagagatattattactatcttatatttgtttaaactaattatttagagtaaataattattaaataaatcttataatatgaataaactattatattggctgtttaaataaaaataattaatattattcttttaaaaaaattcattaagtccaaatttatggaaaaataata

SEQ ID NO: 2155 - DNA, 20 bp, Methanobrevibacter ruminantium
gtagataatttattatctac

SEQ ID NO: 2156 - DNA, 11 bp, Methanobrevibacter ruminantium
cttttaaaaag

SEQ ID NO: 2157 - DNA, 259 bp, Methanobrevibacter ruminantium
tgttaattttattttaatttaatcaaccataaataaagaataataaaagaaaaaattttacatcaaaagcaggtgtatctcctcagttaaaattttcgtttagccacagtataacgaaattaaataaacaaagagaaatttattaattagatattaaaaataaaaaaagagaactattaattagattttaaaaataaaaaaagagaactattaattagattttaaaaaaaagaaataattaaattttaaaaataaaaaa

SEQ ID NO: 2158 - DNA, 18 bp, Methanobrevibacter ruminantium
ctggttttattaaaccag

SEQ ID NO: 2159 - DNA, 390 bp, Methanobrevibacter ruminantium
ttataagggtgaaaaagccgttagggttgataaacgttatagattgcattttaaatatgataaaaaagaaaacttatttgagctagtatctttttataaaaaagactatcaataagttctttttttatctttccttcttttttagcttttttttaacttttaagaaaagattatatattattattcttataatagttattgtgagtactcaaaaagtgcacgcaatatgttgtagaaattattagtaagaattcatcagaattcttacttttagttttaattaattaaaaatttcttaaaaactatttttcatttaataattttcaatttccatccaattcttgtttttctgtagataaattttaatctatttaataagaagatttattt

SEQ ID NO: 2160 - DNA, 24 bp, Methanobrevibacter ruminantium
gtaagaattcatcagaattcttac

SEQ ID NO: 2161 - DNA, 248 bp, Methanobrevibacter ruminantium
tcaaagtgttaaattgatttaatattggaacaatgattttaatcaagcatatggtgatttaattaataaaaattagagaaaaggattattaatgcaaattatttctttaaattataaaaaaaactaaaaaagaataaaatatgaaaaaataacttattgatagtcttttttatatagagactatcataatatgagtatttttcccatataactagcttaaagaaatatggatttaagaaaaataaata

SEQ ID NO: 2162 - DNA, 24 bp, Methanobrevibacter ruminantium
gtaagaattcttcagaattcttac

SEQ ID NO: 2163 - DNA, 82 bp, Methanobrevibacter ruminantium
agagacatagcgaagcggtcaaacgcggcagactcaagatctgttgattagttcttcaggggttcgaatccccttgtctcta

SEQ ID NO: 2164 - DNA, 36 bp, Methanobrevibacter ruminantium
cttaaagtgagaattcaaatgaattcttactttaaa

SEQ ID NO: 2165 - DNA, 34 bp, Methanobrevibacter ruminantium
ttaaagtgagaattcaaatgaattcttactttaa

SEQ ID NO: 2166 - DNA, 38 bp, Methanobrevibacter ruminantium
tagttgcattagggaatagattattccttaattaacta

SEQ ID NO: 2167 - DNA, 44 bp, Methanobrevibacter ruminantium
taatagttgcattagggaatagattattccttaattaactatta

SEQ ID NO: 2168 - DNA, 36 bp, Methanobrevibacter ruminantium
aaagaaaagatttttccaatgaaaaatcttttttta

SEQ ID NO: 2169 - DNA, 30 bp, Methanobrevibacter ruminantium
aaaaagatttttcattggaaaaatcttttc

SEQ ID NO: 2170 - DNA, 20 bp, Methanobrevibacter ruminantium
gatttttccaatgaaaaatc

SEQ ID NO: 2171 - DNA, 20 bp, Methanobrevibacter ruminantium
gatttttcattggaaaaatc

SEQ ID NO: 2172 - DNA, 15 bp, Methanobrevibacter ruminantium
ttaaaatttttttaa

SEQ ID NO: 2173 - DNA, 386 bp, Methanobrevibacter ruminantium
ctatccagttttatgctgccgataaaaaattttattttaattattcaaataatattgaaaattctagtttaagattatgtgatttatgtaatagatatatgctttttgcatttgaaaaacttaaagctaattttaaaggaaatatattagttatcccaaagacttatgacggagattatagtgaatttttagagattattcaggaggataatgattttgaagtaattaatgaattacttgaagagaattctaaaaaatttacttatgatttcttaatatatactccttcaaatgctcttttgaaaatagaaaaatatattgataattatcaagctttccttactaaatttgatgacatcaatctatataattatggaaatttaaat

SEQ ID NO: 2174 - DNA, 246 bp, Methanobrevibacter ruminantium
attttagattcaatagaacaagttcgaggtagatgcaataggagtagggaattaaatgataagtttcatgattctaatattaaaggtaatgtttatttaattaatttggaggatgataatagtaatctttataaatatatttataaagatgtggaacttaaaacaagaattaaagaaacaattaatctttttaatgaaggttttgagttaaatgatgatttaaattatcaatatagtaacatatta

SEQ ID NO: 2175 - DNA, 29 bp, Methanobrevibacter ruminantium
tttatgatggattataaattcatcattga

SEQ ID NO: 2176 - DNA, 21 bp, Methanobrevibacter ruminantium
tgatggattataaattcatca

SEQ ID NO: 2177 - DNA, 20 bp, Methanobrevibacter ruminantium
tgctttccatatggaaagca

SEQ ID NO: 2178 - DNA, 227 bp, Methanobrevibacter ruminantium
tttaaataattattaaataataaataattaattaaaaaagaattgaagctaattaattaattaaaaaataaattaaatctaattaactaattaaataattaattaaaaaagaattgaagctaattaactaattaactaattaaaaaattaattaaaaaataaattgaagctaattaactaattaactaattaaaaaattaattaaaataaattaaagctaattaact

SEQ ID NO: 2179 - DNA, 22 bp, Methanobrevibacter ruminantium
aatgctttcgaaagaaagcatc

SEQ ID NO: 2180 - DNA, 18 bp, Methanobrevibacter ruminantium
tgctttcgaaagaaagca

SEQ ID NO: 2181 - DNA, 276 bp, Methanobrevibacter ruminantium
tttgaaaactaatatttccttaaattggttttatatggtaaactatttataaaaacaaaaaataagcttaaatagtaaactatacattataaatagtaaatctaacgaagaaaagagtttattatatataatgaatagtaaactaaaatatgaagtttttatttttaagatatatagtaaaattttgagtatgagaaaaaataagtttaattaagtgagattatgtgaaattatgattaattaatagatatttctaaaaatagagtaaaatcaata

SEQ ID NO: 2182 - DNA, 23 bp, Methanobrevibacter ruminantium
taaagaagagtaattcttcttta

SEQ ID NO: 2183 - DNA, 515 bp, Methanobrevibacter ruminantium
cgtccttaattatagttataatagtatagtatataaaggttttgtaaaatttttgtagtgtcaccttttaggttacactttttccttatttttaggctaacctaataggacaattagtgtttaacttgtcattaaattatagctgtctttaattatttgatagtttgaatctgtgaaattttaaaaaaaagtcttaagaaaatagttaatatgagtaaattagttaaaaaaaatacataataataattaaaataagtaaaataaataaaaaataagattagaaaaataagtaaaataagtaaaaaataagattagaaaaataagtaaaataaataaaaaataagattagaaaaataagtaaaataaataaaaaataagattaggaaaataagtaaaataagtaaaaaataagattaggaaaataaggaaaatattaaaataagtaaaaaaaatgaaaaaatagctaaaaataactatttttcaaaatatttctgtgaattgtttgtaaaagtatc

SEQ ID NO: 2184 - DNA, 31 bp, Methanobrevibacter ruminantium
tgaaaaatagttatttttagctattttttca

SEQ ID NO: 2185 - DNA, 21 bp, Methanobrevibacter ruminantium
taagtagtttaaaactactta

SEQ ID NO: 2186 - DNA, 34 bp, Methanobrevibacter ruminantium
gaataattatagttttagtcaactatagttattc

SEQ ID NO: 2187 - DNA, 292 bp, Methanobrevibacter ruminantium
actggagggttaggagtcctctgtaagcacaaatctcctatggtgtggtcgaaatttaggaggcggcttttggatttaattaaggcctaaaaggctgatatagaagcttcgtcctgcaggatcaatggtgatagaaggattactggagggtaattcttaactgtctttattgtgggaacgtgtcaggcctggaaaggagcagctctaccatttacagctgatgcttgtagaaccgcgaggtggagttagtcttttagataaccttgattgatgaaaattgtccactccttta

SEQ ID NO: 2188 - DNA, 96 bp, Methanobrevibacter ruminantium
taattcttaactgtctttattgtgggaacgtgtcaggcctggaaaggagcagctctaccatttacagctgatgcttgtagaaccgcgaggtggagt

SEQ ID NO: 2189 - DNA, 470 bp, Methanobrevibacter ruminantium
aattatttttctaactgcttttttaaggaatttataaaaaaattagagaatattgcagtaaaaagaaaaagtatatatactaagttttaacataataattaataattgcattttatgtgattactatttttcatttgtatgtcgggatggcccagcctggtacggcgtcggactgctaatccgatgatcaatagatcgccggggttcaaatccccgtcccggcgctttttcaattttcttatctatttttgtaaatttattatcaatttattattctttcacgttttattaaattttaagctatttttaactattgaaagactatgattttaattgtttgattttaaaaaaaagaaaaaagtgattttaattaattttcctaaaaataaatatttgtattaaatagtaattatcttttagagatttaattaattaaaatcaaataaagaacttattttataaaaagaatg

SEQ ID NO: 2190 - DNA, 84 bp, Methanobrevibacter ruminantium
gtcgggatggcccagcctggtacggcgtcggactgctaatccgatgatcaatagatcgccggggttcaaatccccgtcccggcg

SEQ ID NO: 2191 - DNA, 211 bp, Methanobrevibacter ruminantium
tttatctaatattgttgattattgtttttttaattaaataattgttaattgtgcttaataaattaaataaatattattgcgcttaattaattaaatcgtgcttaattgtgttttattaattaaataaatattaattgtgctcaattaactaaatataagattattaattttttaaattaataaaatatagcctttaatataaaaatattaa

SEQ ID NO: 2192 - DNA, 333 bp, Methanobrevibacter ruminantium
aaatttacattatttaactaaaaatagaacaataatttaagtaaataatttaaaaatttttagttacaataaattattttaaaaaccagttaaaattaagctaaaatatcttttaaatgtattaatatagtttttaaattaaatttaagtcaattttattgagttttataaaaaataaagaataatacattgttttttaaaaaatgaataatttttattaaaaaaattgaaaattggtgaaaaaattaggggtgaaattaggtaaaaatggatataattttagtggaattttaacttgaaattagggtcagatttcagttggattttaacttg

SEQ ID NO: 2193 - DNA, 243 bp, Methanobrevibacter ruminantium
aagttataataattaaaaactcataaaaattgctataaaaatgataaaagtataaaaaaagcttaaaattgctataaaaatgataaaagtataaaaaaagcttaaaattaaaaatacgaaaaatttaaaaaaagaaattttgatagaataataaaattattctaatttaattcaaataatataattctataaatcaagaattggaaaaataaaaagttaatcaaaataattagttctaaatga

SEQ ID NO: 2194 - DNA, 255 bp, Methanobrevibacter ruminantium
ctatttatttaaaaggatattagatttagaactgttgaataataatttgggctatttaaatcttttatctttttaaattttttatataaactatttttaaaaaaataatattaaatatgctctttttaaaaaaaatagataaaaataactaaaattaaaaaaataatattaaataaactatttttaagaaaagaagacaaaaataattaaaattagaaaaaatatgataaaataaactctttttaaaaaacaata

SEQ ID NO: 2195 - DNA, 109 bp, Methanobrevibacter ruminantium
ggtacggtagcctagcctggtatagcactcggtgacttttaccgagagcatagggccctagtggatagctgggaactctatgtcgaaggttcaaatccttcccgtaccg

SEQ ID NO: 2196 - DNA, 40 bp, Methanobrevibacter ruminantium
ggttttaaaagaatataaatgattatattctttaaaactc

SEQ ID NO: 2197 - DNA, 37 bp, Methanobrevibacter ruminantium
gttttaaaagaatataaatgattatattctttaaaac

SEQ ID NO: 2198 - DNA, 345 bp, Methanobrevibacter ruminantium
tttttaaaatttttatgaaataagttttaaatataattatagattcataaatattataaaaaatattaaaaaatattaaaaaatattaaaaaatattataaaaaatattttatgacaatattaaaatcataaaaaaactataactattaattatataagattatataatatataaaatattgcataaattcttaagaaaaaatctgattttgacaaatatcatatgaaaaaattataaaaattaaaattttgacaaatatcatatgaaaaaataaaaaaacttatgatttttgaggacatgaaataattgaaaatttgattcaatagcaatttaaaaaaaaaaaa

SEQ ID NO: 2199 - DNA, 180 bp, Methanobrevibacter ruminantium
tgaaataagttttaaatataattatagattcataaatattataaaaaatattaaaaaatattaaaaaatattaaaaaatattataaaaaatattttatgacaatattaaaatcataaaaaaactataactattaattatataagattatataatatataaaatattgcataaattcttaa

SEQ ID NO: 2200 - DNA, 170 bp, Methanobrevibacter ruminantium
ttatatattatataatcttatataattaatagttatagtttttttatgattttaatattgtcataaaatattttttataatattttttaatattttttaatattttttaatattttttataatatttatgaatctataattatatttaaaacttatttcataaaaatttt

SEQ ID NO: 2201 - DNA, 21 bp, Methanobrevibacter ruminantium
ctaattatttataataattag

SEQ ID NO: 2202 - DNA, 222 bp, Methanobrevibacter ruminantium
tattttaaataaactattcttttgattaattaaatttatttaataaaatccctctttaaaatttagataaatattcaactaaattaagtttaaacaattaaaatcaattataaaggtttataagcgattaaataaaaatttattatcataattaatatagtattaattcgagagtattataaataattgaataaaaattacaaaaaataataagaattatta

SEQ ID NO: 2203 - DNA, 199 bp, Methanobrevibacter ruminantium
atgtcatcatctgtaattggagtttttaattctatcatggaaacacctaatcttaattgaaattttaattgaattaataataaatgaattaagttacttttatatataaaactttatataattaataatgtaaaatcaataatattaaacactatttccgatttaaaggaatagtaaataaaataatatatttattaac

SEQ ID NO: 2204 - DNA, 86 bp, Methanobrevibacter ruminantium
agcaaatttaaatgataaaaattgttttatcttttttaaaacttgattgaaaaaataattaaaaattcattaagtattcttatgct

SEQ ID NO: 2205 - DNA, 304 bp, Methanobrevibacter ruminantium
aattaattatgaaaatttatatctattttccaattataaaaataaaaatattttttaaaaattatctaaaagttttttaaaataattctattatgatatttaaaaaaaatgatatataaatctttataattttaataatttattaatggaaaattgatttgacttgggaaaactagtgaaaaaaaactaaacttaaaataaaagaaaaatagaaaaaaaggaaaaatataaattaaaaattagctttaaagaaaaaaataataagggaaaatataaattaaaaattagttttaaagaaaaaaat

SEQ ID NO: 2206 - DNA, 84 bp, Methanobrevibacter ruminantium
aaatagaaaaaaaggaaaaatataaattaaaaattagctttaaagaaaaaaataataagggaaaatataaattaaaaattagtt

SEQ ID NO: 2207 - DNA, 19 bp, Methanobrevibacter ruminantium
ttggataataattatccaa

SEQ ID NO: 2208 - DNA, 17 bp, Methanobrevibacter ruminantium
gtatttttttaaaatac

SEQ ID NO: 2209 - DNA, 31 bp, Methanobrevibacter ruminantium
gggaatggaaaagttcatctttttcattccc

SEQ ID NO: 2210 - DNA, 31 bp, Methanobrevibacter ruminantium
gggaatgaaaaagatgaacttttccattccc

SEQ ID NO: 2211 - DNA, 270 bp, Methanobrevibacter ruminantium
cttaaactttaaattttaattttctatttttcaaaaccacattataataattttttaaaatttttaaccaataactactttttaaattaaaaatcaatccaacacattaataaattaattagattaaaaattaggataaaatttaatattaataattataaatatataatataaaatgaatcaatgattatttaatatttgattatacttgattattatcttattaaatttgattaataaagtgatccattacataaaacttaattttta

SEQ ID NO: 2212 - DNA, 40 bp, Methanobrevibacter ruminantium
tttaaagttgagaattcactacgaattcttaaactttaaa

SEQ ID NO: 2213 - DNA, 303 bp, Methanobrevibacter ruminantium
ttatatcgttaaattgatttcatttcgttaaattgatgtgaagttgtaaaattgatttcattttgtaaaattgatgtgaagttgtaaaattgatttcattttgtaaaattgatgtgagagtgtgaaattgatatgaaattgaacaaagattatagattcaatatattttaaaaataataatataaattaattttatagtaaaaattataattaataaaattaatatctttaatagaaatcaaaaaaaaatatattttttcaatttaatgatttttaattattcaagtgttattatgaaaatta

SEQ ID NO: 2214 - DNA, 223 bp, Methanobrevibacter ruminantium
aaagaatcttattactaatcacaatttaatcttaaaagtaattcaaattattaaaaaattcaaataattaaataattaaaataattaaataattaaaaatattaaaatattcaaataatttaaattaattaaattaagtatttttagaaacataactctaaaattacttaaatacgctataagatttttagtaaagacatagcccaagctaaatcattaaaaa

SEQ ID NO: 2215 - DNA, 19 bp, Methanobrevibacter ruminantium
tgaaaaacattgtttttca

SEQ ID NO: 2216 - DNA, 18 bp, Methanobrevibacter ruminantium
ttgattccgatgaatcaa

SEQ ID NO: 2217 - DNA, 29 bp, Methanobrevibacter ruminantium
taatcaataaacattcttgtttattgtta

SEQ ID NO: 2218 - DNA, 22 bp, Methanobrevibacter ruminantium
caataaacattcttgtttattg

SEQ ID NO: 2219 - DNA, 214 bp, Methanobrevibacter ruminantium
atactattattaaagcaattaaatagaataattctaataaaaatgaaaaaattaaataattttaataaaaatgataaattaacaaatttttataaaaatgaaaatattaaataattttaataaaaatgataaattaacaaatttttataaaaatgaaaatattaaataattttaataaaaatgataaattaacaaatttttataaaaatgaaaa

SEQ ID NO: 2220 - DNA, 260 bp, Methanobrevibacter ruminantium
ttaaaaagaaataatatccttattattttttcttttttaaattattttaattataatttttttaaactagttccaatcagtatttaaaaatcattttaataacagtattttaaaatattactttataaatttgtaaaaaatttataaactaatagtttattatacatctatgaaaaagtaattttatcaattaaaattattaataaaagtttatttcatctttaataaagagagataatcttatatttaaaaataagaat

SEQ ID NO: 2221 - DNA, 80 bp, Methanobrevibacter ruminantium
gattagaaaaaaagaaaaaatataagaactcatctaaaagatgaattcaaaatatacaaaaattgtattttattttaata

SEQ ID NO: 2222 - DNA, 23 bp, Methanobrevibacter ruminantium
gaattcatcttttagatgagttc

SEQ ID NO: 2223 - DNA, 77 bp, Methanobrevibacter ruminantium
taaaatcaaaaaaggataataaggtcataaaaaagataataaggtcaaaaaagtaaactgaataaattaaataataa

SEQ ID NO: 2224 - DNA, 30 bp, Methanobrevibacter ruminantium
aggtaaagaagaatagatcttctttatccc

SEQ ID NO: 2225 - DNA, 300 bp, Methanobrevibacter ruminantium
cctagaatttattttcttaaaatgaattttttaaaaatgcttaaattgcttttaaaataaatttttaaaaatgcctaaaaattgtttttatatgaatttttcaaatacctaaatgattaaatttagatattttagaaaaccataagaaacataactaaattaattatagcaaatagccttaaatttaatttaaagttaaataaacacattatattttaaagcaagtttaaatagagcactattataaatttaagaatttttgataaaaaatatgctcattttagttaatataaaataaat

SEQ ID NO: 2226 - DNA, 28 bp, Methanobrevibacter ruminantium
tatagagaataatttattattctcaatc

SEQ ID NO: 2227 - DNA, 28 bp, Methanobrevibacter ruminantium
tttgagttaatttttaaattaacttaaa

SEQ ID NO: 2228 - DNA, 162 bp, Methanobrevibacter ruminantium
attcatgcttaaatttcaattatttaagataaatttatatgtttttaaaatattatattttattaatgatatttaatattatttaattttttaatgattattaaaaggatagtttagttaaaataactaaaaaataaaataatttaataattttaacgagta

SEQ ID NO: 2229 - DNA, 51 bp, Methanobrevibacter ruminantium
ctatagctcaagctttttaaggccttcggccttaaaaaccttgaccaaaaa

SEQ ID NO: 2230 - DNA, 49 bp, Methanobrevibacter ruminantium
tatagctcaagctttttaaggccttcggccttaaaaaccttgaccaaaa

SEQ ID NO: 2231 - DNA, 385 bp, Methanobrevibacter ruminantium
cataatgtgtaatataaacactataaaaatataagtaattaatagtatataaagtttttgattaatttagtaattttttaagaaaaatagcaaatcgaataatttacaagtcacaagattatattaattttaataatatttaagattttttaataaaattacgaaaaagtttatatattagaaacaaaaaaataaaaagttaaaatgattaagcaaaaaatcacaatcaaaattccgatgaaatctggatcaaatgaaaaatattattaggactttatctgaaaaaaagaaaattccaaatataaaaataaatatatttttaattgcacatatttaattagggtgaaaatatggaaattaaatcaatccctcaagtaattaagga

SEQ ID NO: 2232 - DNA, 84 bp, Methanobrevibacter ruminantium
gccgagatagtctagcctggtaaggcgcgggactggaaatcccgtgagggaaacctctcctgggttcaaatcccagtctcggcg

SEQ ID NO: 2233 - DNA, 29 bp, Methanobrevibacter ruminantium
gcttttttgagccttcggctcaaaaaaac

SEQ ID NO: 2234 - DNA, 215 bp, Methanobrevibacter ruminantium
ttaaatatttttatactcaatataaagaacatatgttcattaaaatcaaaaaataactatacataatccttaaaaattaaaaaaataataaatagttacatatagtaaaccaaatgaagaaaaattacaatgtgctgaaaatacattagtttaattaaattgaaaaaaatagaaaataaaataaagatttaactaaaataattgaaaataattga

SEQ ID NO: 2235 - DNA, 49 bp, Methanobrevibacter ruminantium
tttttcagcaagcttttttggccttcggccaaaaaaccttgaccaaaaa

SEQ ID NO: 2236 - DNA, 17 bp, Methanobrevibacter ruminantium
ccatatttatagtatgg

SEQ ID NO: 2237 - DNA, 261 bp, Methanobrevibacter ruminantium
ataaataattattaatgaattatatggtggttatatttatttgattattatcatatgattggaattttaaattgtcgtttgtatattaaagtttaaaattcatccgggaccctaataaaacacttaagggtatttaatttatcaaaaaagatttaaaataaaaaattaaggtgatttataaattttaaagaaataaaattttatagatattagattaaaatttgattaagatctagattaaattttaggtcaaattttaga

SEQ ID NO: 2238 - DNA, 179 bp, Methanobrevibacter ruminantium
atataattttagctaaatagataatataagatatagttttagctaattattaatttaatgaatttaaaaaagattatttaatttaaaggataattatctattttttaaaataacttatcaataggtctattttttaattttattaaagataattatcttaatttaattttaaaacctta

SEQ ID NO: 2239 - DNA, 51 bp, Methanobrevibacter ruminantium
attagctcaagcttttttgaggcctttggcctcaaaaaaccttgaccaaaa

SEQ ID NO: 2240 - DNA, 49 bp, Methanobrevibacter ruminantium
ttagctcaagcttttttgaggcctttggcctcaaaaaaccttgaccaaa

SEQ ID NO: 2241 - DNA, 11 bp, Methanobrevibacter ruminantium
tttattttaaa

SEQ ID NO: 2242 - DNA, 18 bp, Methanobrevibacter ruminantium
tggtaataaaaattacca

SEQ ID NO: 2243 - DNA, 263 bp, Methanobrevibacter ruminantium
ctagtaaaatacgttttagattcacaaattaacctcccctaaaacaaaagaaaataaaataatttatttgaataaattattacttatttagatattaaattaaattattattaattaatattttttatttatttattaataaagtttacctaaaaaattataaaaatcgactactttttggtaaaaaacttaaaaattattgaattttaaaaaaaaaggacatattggaaaataaaaaaattattgggttttgaaaaaaatag

SEQ ID NO: 2244 - DNA, 217 bp, Methanobrevibacter ruminantium
ctaaaacaaaagaaaataaaataatttatttgaataaattattacttatttagatattaaattaaattattattaattaatattttttatttatttattaataaagtttacctaaaaaattataaaaatcgactactttttggtaaaaaacttaaaaattattgaattttaaaaaaaaaggacatattggaaaataaaaaaattattgggttttgaa

SEQ ID NO: 2245 - DNA, 158 bp, Methanobrevibacter ruminantium
atttttttattttccaatatgtcctttttttttaaaattcaataatttttaagttttttaccaaaaagtagtcgatttttataattttttaggtaaactttattaataaataaataaaaaatattaattaataataatttaatttaatatctaaataa

SEQ ID NO: 2246 - DNA, 20 bp, Methanobrevibacter ruminantium
taatttattcaaataaatta

SEQ ID NO: 2247 - DNA, 29 bp, Methanobrevibacter ruminantium
aaaaaacttgaatttgattcaagttttaa

SEQ ID NO: 2248 - DNA, 17 bp, Methanobrevibacter ruminantium
cttgaatttgattcaag

SEQ ID NO: 2249 - DNA, 21 bp, Methanobrevibacter ruminantium
tttaagaatttaattcttaaa

SEQ ID NO: 2250 - DNA, 69 bp, Methanobrevibacter ruminantium
aatctcttaaaaaaatataaaaaataaatgtctgaaaagacataaataaaaataaaattaaaaaagttc

SEQ ID NO: 2251 - DNA, 448 bp, Methanobrevibacter ruminantium
gaatttttataaaaaatttagatttttttcaggcattttttaaaaatttttactaattcattttgaaaaattttcatcttcaaatcatcatcttcaataggaaaaatttttgaagtttcttattattctttccaatatttttttttcaattttttcaatttttccaatatttttttcaatttttttcaattttttccaatattttttttcaattttttccaatattttttttcaattttttttagatttgactaattttcttattcaagtttaactagtttttcagtataagaattaatttctttaaaaaaatttcatctcccattattgtgatctagaattttttaagataatttgctaagatttcttgaataattttttaataaatttaattaaaataacgattaattaaacaataggtttagtcaaaattaatattaaatattaa

SEQ ID NO: 2252 - DNA, 248 bp, Methanobrevibacter ruminantium
ctttaaatttaaaaatagttttttattctattaaaaatgagtcgatattaaaaaaataagcaatattaaaaaaataagcaatatataaaaaatagcaatttattaaaattagcaatatattaaaataagcaatatataaaaatagacttctatctgaagtggtatgttataaaaataggcatattattgaattaaataaatgaagaaaaataagtaagctattgtatctcttcgttagtcttaatgac

SEQ ID NO: 2253 - DNA, 204 bp, Methanobrevibacter ruminantium
ttaaaaacctcttatagttattttgatttttttagtatttattatcgtgggatgaagattaatggaagttaataaaaaaagaaaagtgaaaaaaaagaaagtgtttaagattaattcggttgtatttaaaaaaataaaaattaaatatttgtttttttttttaaaaaaataaagaaaataaaatagttaaaaaactattttatt

SEQ ID NO: 2254 - DNA, 24 bp, Methanobrevibacter ruminantium
taaaatagttttttaactatttta

SEQ ID NO: 2255 - DNA, 356 bp, Methanobrevibacter ruminantium
caataaatttagttttgcagataaataatgatttttatctgaatttaattagtctatttaataaaaataataatttttcaattgaaagcacaaaatttgaaaagtttaaaaaataataatttttcaattgaaattaaatataattgatttttaataattaaaatagttaagaacattaaaatatctatttttttagtcttaatgaaaagtcaataaagattcataacattgaccatatatattttattttttaatatttataaatattatcctaaaaattaaacataaaaattgtttttgatgtaaaaatatgcagtttttataaatttattcaaaatgaataaaaaaaattatgt

SEQ ID NO: 2256 - DNA, 15 bp, Methanobrevibacter ruminantium
gaattattataattc

SEQ ID NO: 2257 - DNA, 327 bp, Methanobrevibacter ruminantium
atcttaaaataataagttgttttttataaattctttttaaaaaaaactaattattaaaataaaggtttaattttggaaattaaaaaggtatttttgaattagttcttatggattataaaacttataatttaaaaacttattactatataaagattgtataaacaaagtatataatgtttttcattaaataaaggattgatagattaatagtgcaaaaaataactaaaaatttttaaaatcagtacaaattaaatgctttaaaagcttttaaatatacaaaatcgaagaaatattaagccatattaaaaataaattgatattatttaa

SEQ ID NO: 2258 - DNA, 41 bp, Methanobrevibacter ruminantium
gtttaaataagcattgctccttgagcaattcttattttttc

SEQ ID NO: 2259 - DNA, 27 bp, Methanobrevibacter ruminantium
taagcattgctccttgagcaattctta

SEQ ID NO: 2260 - DNA, 227 bp, Methanobrevibacter ruminantium
gataaatggtaaaaattttttcttaatttccacataaaccacgatctataaaattttttaatataatttattaattaatgaatcatatcctaagaataaattaaagtattaattaatgaatcatatccaaagaattaattaaattattaattaatgaatcatatccaaagattatttaaaattattaattaatgaattatattatccatatattaatagattaatac

SEQ ID NO: 2261 - DNA, 51 bp, Methanobrevibacter ruminantium
cttagctcaagcttttttgagaccttcggtctcaaaaaaccttgaccaaaa

SEQ ID NO: 2262 - DNA, 49 bp, Methanobrevibacter ruminantium
ttagctcaagcttttttgagaccttcggtctcaaaaaaccttgaccaaa

SEQ ID NO: 2263 - DNA, 50 bp, Methanobrevibacter ruminantium
tactagcaagcttttttaaggccttcggccttaaaaaaccttgaccaaaa

SEQ ID NO: 2264 - DNA, 315 bp, Methanobrevibacter ruminantium
atattaatttatatatatgtatacaattaataaaataagttttgatttaatcctagaaaaacaagataaaaatagatttcttatgatttaaattaaaaaatagctaaaaaagtaataaaaagttatttttcaataaaatctgacaaaccataaatagtcttaattaaaaggataaaaatgaataaaataaaatgaaattaaaaagcaaattattcaaaataagaaaaatcaactaaaaactatataatcaattaaatacaaactattaatattattaaataaaaatataaaacaagatatttaataaataaaaaa

SEQ ID NO: 2265 - DNA, 24 bp, Methanobrevibacter ruminantium
gtgtaaaatacttataatttacac

SEQ ID NO: 2266 - DNA, 30 bp, Methanobrevibacter ruminantium
taaaaagtttaattaagtttaaacttttta

SEQ ID NO: 2267 - DNA, 220 bp, Methanobrevibacter ruminantium
aaacaaaaataaaaaataacttttgcaattatttatataattaataaaaagaaataaattaataattaaattttaaatagctaaatttattagaatttattagaaaatataaagtttatgaatattaaatataatataaatagctaaaatgaataattcttattgaaaaataagcaaaataattaataaaaatcaagataaattttttaaaaataagaat

SEQ ID NO: 2268 - DNA, 22 bp, Methanobrevibacter ruminantium
gcgaattacttatgtaatttgc

SEQ ID NO: 2269 - DNA, 484 bp, Methanobrevibacter ruminantium
tttaatttttactaaatttttatgaacttttcaaattaatcttttaaaacaaatttaatatgatcaagttaaaattaagacaaaaataaacttaaaatttacttatttttgctgaaaaaattataagaatatctaaaaaattaaaggatatttaaaagataaaacaaagaaaagactcccataaaatctttattttatcaataaataaagttaaattatttttagataaaattcaaatcatttaatccaaataagacaatttaaagaatattaatataattagcatattaacttaaccaaattaggtttttatcgttgaaaaaggattaatcgaaaactgtccattatactatatatatttatttaatctaatatataaatgttatgaaaagattttttagggcttatttaaagaataaagcaaaaattaaaggaattgggatatttaaaaatataaaatagtcctatgcataaaaatatccaa

SEQ ID NO: 2270 - DNA, 359 bp, Methanobrevibacter ruminantium
tatgtttgttgaatgatatttttcataaattatatgattattacaatttaattaaataaatttgattcgcctttatacaatcagaaagatcaagcaattgaaattctattgactaatgatcatgaatttggccgcaatcacaatattcatataatttggtttgaaaaatattttagtttattgaaagtatataatttgaataatgaaaacataatttatatggttgtttttaatttattcaaattaaaaaattattaatcaataaaaaagaaataaaaagtgattatttgaggaaattattgattgataattcatcaattattaattaagctaaactgaagcaagttaaaaataattaa

SEQ ID NO: 2271 - DNA, 225 bp, Methanobrevibacter ruminantium
atgatagaataaaaaaaatttgattgatcttaaaaattaaaaatatgaaaataaaaattttgaaaaaataagatgataaaaattatgaaaataaaactttcttgaaaaaatcttaatgaaaaatatggactttaagactaaaaattatgataaaaaataagatgataaaaaattatgaaaaaaatagataataaaaaaatagaagataaaaaataaaaattttaa

SEQ ID NO: 2272 - DNA, 20 bp, Methanobrevibacter ruminantium
ttgttacgatatcgtaacaa

SEQ ID NO: 2273 - DNA, 451 bp, Methanobrevibacter ruminantium
tatacctattaaacaaaagatcgatttataaagggaaaaatattgataaaagaatttatttgattttggaaaaaataggggaaaaatattgataaaagaatttatttgattttggaaaaaattgagaaaaaataaaaaaagtcgagaaaaaaattcataaaaatttgcaaaaaaaattgcaaaaaatttgatagattagaaagatcaatcgaaaaattatggaaaaattgctaaaaaagcttaaaaaataacagaaaaaaatcgttaaaatagctatcgaacaagtcttaaaaccccctcaaagaaataaaaccacctaattctggtttactatacattataaatagtaaaactgctaaaaaaccaccataagtttatataagataaaacacaaacccacgaatatatcatcatgaaaaataaggaaaaatccattttatttcaataaaag

SEQ ID NO: 2274 - DNA, 24 bp, Methanobrevibacter ruminantium
gattttagaccaatgtctaaaatc

SEQ ID NO: 2275 - DNA, 331 bp, Methanobrevibacter ruminantium
tttatatggtgaaaaatgatggaaattttgcaaattgattatgatttggtgtaaaaatctttgaaaaaaaaacagcttaaaaattagggaaaaatattgtaaaattttttaaaatgattgaaaattggaaaagagagtcctaaaaatagctgaaaaactgagaaaatatggtgaaaaaatttaaaattggaaaaaatagttctagggaggggtgaatgaaaaacagtgcaaaaaattgttgaaaaagtattaaaaataattaaatagtctaaaaaaagtccaaaatagattataaatagaataaatactctaaaaatagttaaatcaatta

SEQ ID NO: 2276 - DNA, 187 bp, Methanobrevibacter ruminantium
ataaggatatgatttaataaaatagattaaaatgtattaaaaatagaaataattattattaattaattattatttatttaaattatcttaatgtatgttaaaataaaataaatcataaattataatttttattaaaaataaataaaaattattgtatattacaattaaaaaaaagaagggcattata

SEQ ID NO: 2277 - DNA, 266 bp, Methanobrevibacter ruminantium
ttcttttttttaattgtaatatacaataatttttatttatttttaataaaaattataatttatgatttattttattttaacatacattaagataatttaaataaataataattaattaataataattatttctatttttaatacattttaatctattttattaaatcatatccttatcataaattttaatatgtaataattttatagaaagatttatataatattattacaataatataaattgtagcttgaatcgaaagattcaa

SEQ ID NO: 2278 - DNA, 54 bp, Methanobrevibacter ruminantium
ttttataaattatcttatattctaagggggtggaatataatttaatttataaaa

SEQ ID NO: 2279 - DNA, 22 bp, Methanobrevibacter ruminantium
tccattcatttttatgagtgga

SEQ ID NO: 2280 - DNA, 31 bp, Methanobrevibacter ruminantium
cggtttactatttattaacaatggtaaaccg

SEQ ID NO: 2281 - DNA, 276 bp, Methanobrevibacter ruminantium
ataaaattcctcaaataaaaataattctaattaataatgagatttaattaattaagttaattaaatttttatttttcataatatatataattaaaatttttattttaagaatttgttaattggacattagaaagtctggatttatttgaattaataaatgttattttagctttaaataagtttaatgcccctaaactttatttaaattagatatttttaaaattgctccagataaggaaaaataataaaggattattcattatatgtatcccttat

SEQ ID NO: 2282 - DNA, 281 bp, Methanobrevibacter ruminantium
aatcagacttgattctgtccattttttaatatatttgttcataaaattcctcaaataaaaataattctaattaataatgagatttaattaattaagttaattaaatttttatttttcataatatatataattaaaatttttattttaagaatttgttaattggacattagaaagtctggatttatttgaattaataaatgttattttagctttaaataagtttaatgcccctaaactttatttaaattagatatttttaaaattgctccagataaggaaaa

SEQ ID NO: 2283 - DNA, 255 bp, Methanobrevibacter ruminantium
ttaaaataattgaataaaattagataaatatttgaaaaaactaaatgaacatattatatgctaaaaaaaagacttaagaattaaaattgaaattgaattaaaataagttatattcaaaatagaaaaaaaacagaaaaataagataaaatcaaaaaaagataaaaaaaaataaaaaaaaatagatttaaaagattataaacctattttctaactcttaaagtaccaagtccaatgatggaaagggacattaataaa

SEQ ID NO: 2284 - DNA, 207 bp, Methanobrevibacter ruminantium
gctatttattaaaatatattagtttacttgtatactattttattgattaaaatatttaaatcttattaaataattttaaaataattgaataaaattagataaatatttgaaaaaactaaatgaacatattatatgctaaaaaaaagacttaagaattaaaattgaaattgaattaaaataagttatattcaaaatagaaaaaaaaca

SEQ ID NO: 2285 - DNA, 252 bp, Methanobrevibacter ruminantium
taactatcatagtatatctcctaaaatatcagaatttatataaaatctataaaaattcgttattcttatttatataagaaaatatttataaatctttctttttatttaaattttttattgtttaactttgtaatgtttagtaaaaaataagttttaatgaacatttgattaatattttattaattttatataattttgtaaaatttaatatttgaaaaaaaataatatagtcattaaattagaaaaaaatag

SEQ ID NO: 2286 - DNA, 23 bp, Methanobrevibacter ruminantium
tcaaactttttttaaaagtttga

SEQ ID NO: 2287 - DNA, 260 bp, Methanobrevibacter ruminantium
ttgatattttgaattatctcttttatattcaagcgtttatagctttgattttagtaatatttgtattgtataattatttgaagtttttaatgaactaggagagttaaaataaataaaataaataaaataagttaaaagttaaattaacaaaacaagggctattatttctttgataaaattttagggtgtttaaatgaatgcaatatttaaaagaaaaagcataagaaagtttttagataagccaatagaagatgaaaaga

SEQ ID NO: 2288 - DNA, 17 bp, Methanobrevibacter ruminantium
ttattttaagaaaataa

SEQ ID NO: 2289 - DNA, 65 bp, Methanobrevibacter ruminantium
gattgaaattaatttaattttttattttaaaacttcttaaataattttaagactgaaatttagtc

SEQ ID NO: 2290 - DNA, 35 bp, Methanobrevibacter ruminantium
gtttgggtaatctgattatttagattgctcataac

SEQ ID NO: 2291 - DNA, 50 bp, Methanobrevibacter ruminantium
gtatagctcaagcttttttcgccttcggcgaaaaaaccttgaccaaaatc

SEQ ID NO: 2292 - DNA, 47 bp, Methanobrevibacter ruminantium
tatagctcaagcttttttcgccttcggcgaaaaaaccttgaccaaaa

SEQ ID NO: 2293 - DNA, 335 bp, Methanobrevibacter ruminantium
tgtctactttattaattaatgaagtataaagccttaaaataagtaaaattttaaaaaattgtgataaaattagtaaaataagtaaatagtaaataataaaaataaaattacgatttttaaggtaaaagcaaacagtattgtgtgttgtgtttgcattttacccttttttgattttttgattttttaattgaggtatcgttgatttacttttgattttttcacctctaatctttttttcgatttgatagatttttttcttttttttgatttgtttaaactagattgagagatttttatttgatttgttaattttagcaatgttttgaaaaagatga

SEQ ID NO: 2294 - DNA, 321 bp, Methanobrevibacter ruminantium
attataattttaattaattattttatgattttagtcataatgcaatgatttaaataatttaagaatcatatattattacatattacatatatatttaggaatacataacttttagatggctatttttagtctattttaaattattattatgataatcattagttctaattattatccgattaaaaaaaaagaattcttttaacaatcaaggtgaaactatgggaaatatggctgaagcaagaagaaagatgcatgaaagagatgagagaataaaaaaagaaaataagtctgatgtcaagaagattagaaatttcttcttcg

SEQ ID NO: 2295 - DNA, 311 bp, Methanobrevibacter ruminantium
ttattatgataatcattagttctaattattatccgattaaaaaaaaagaattcttttaacaatcaaggtgaaactatgggaaatatggctgaagcaagaagaaagatgcatgaaagagatgagagaataaaaaaagaaaataagtctgatgtcaagaagattagaaatttcttcttcggatgttgtgataataaagaaaaaaagaaagtaaaagagcattaaattaaactgaattagctattttttcaaaaacaattaatttatctcttttttaataaaaaaatagtgtttttctttttttttaaaaatta

SEQ ID NO: 2296 - DNA, 172 bp, Methanobrevibacter ruminantium
atttctcctaaagtatttttaatctgtaaaatctttatttaataatcttaaattattattttattttaattttcatttctaaagattgatttgaaaatggtctttttttttaaaaaaaattttcattttaaaaaatttgattcgaaaattatcttttttttttaaaaatttt

SEQ ID NO: 2297 - DNA, 254 bp, Methanobrevibacter ruminantium
tttctacgattatcaataaaagatttttaaattttttaactcatttaattaatgaataaataaattttttaactaatttaattagtaataaaataaatttattaattataagaataaaaattatattatttaactaataaactatatttaacttatttctaatataaatttggttttatttaaaaatttttaaaaaaaaaagataattttcgaatcaaattttttaaaatgaaaattttttttaaaaaaaaaga

SEQ ID NO: 2298 - DNA, 189 bp, Methanobrevibacter ruminantium
accaaatttatattagaaataagttaaatatagtttattagttaaataatataatttttattcttataattaataaatttattttattactaattaaattagttaaaaaatttatttattcattaattaaatgagttaaaaaatttaaaaatcttttattgataatcgtagaaaagtttatagagaatt

SEQ ID NO: 2299 - DNA, 19 bp, Methanobrevibacter ruminantium
taataattttaaattatta

SEQ ID NO: 2300 - DNA, 298 bp, Methanobrevibacter ruminantium
tgctataattaatttttttgatcttttcatgctaatcctcttaataaaaatcataaataaatgaataattaaaaattaccttatttgtaatttaattataaaatattttaaaaatcagacattttgaacgatttaaaatatttaaaatactaattttaaaaattattaaaatatatattaaataattatatatagtttctaatttataaaagtatttattattttgaccttttttagcaaaaaactttaaaaatcattgaaaaaattaagattgggttaaataaaaaattaaaaaaaa

SEQ ID NO: 2301 - DNA, 186 bp, Methanobrevibacter ruminantium
ttaaaaattaccttatttgtaatttaattataaaatattttaaaaatcagacattttgaacgatttaaaatatttaaaatactaattttaaaaattattaaaatatatattaaataattatatatagtttctaatttataaaagtatttattattttgaccttttttagcaaaaaactttaaaaat

SEQ ID NO: 2302 - DNA, 35 bp, Methanobrevibacter ruminantium
aattctttaaagagtttttaattctttaaagaacc

SEQ ID NO: 2303 - DNA, 33 bp, Methanobrevibacter ruminantium
attctttaaagagtttttaattctttaaagaac

SEQ ID NO: 2304 - DNA, 31 bp, Methanobrevibacter ruminantium
ttctttaaagaattaaaaactctttaaagaa

SEQ ID NO: 2305 - DNA, 31 bp, Methanobrevibacter ruminantium
ttctttaaagagtttttaattctttaaagaa

SEQ ID NO: 2306 - DNA, 31 bp, Methanobrevibacter ruminantium
aaataaataaagataaactctttatttatta

SEQ ID NO: 2307 - DNA, 25 bp, Methanobrevibacter ruminantium
taaataaagataaactctttattta

SEQ ID NO: 2308 - DNA, 187 bp, Methanobrevibacter ruminantium
atttctatttttagttttttagttattctgtattatcctcttttttcagtattttttctagaataattagtttatgattaatacattaatttttttataaggtcatgattaattcataaaattttttatacgttcatgattaattcattaaattttttttataaatctttacttagaatcatctaaa

SEQ ID NO: 2309 - DNA, 190 bp, Methanobrevibacter ruminantium
atattatattataataataatatgagttaatactatatttaaatctattgaataaaatctcaaatattgaaaaaatttaagcaaaattcttaattttaagcaaatattaatttttaacaaaataactgataaaataagatttattaaaaattaaataatataaaatctaaataaataattaaaaaaataa

SEQ ID NO: 2310 - DNA, 18 bp, Methanobrevibacter ruminantium
ttaatcaattttgattaa

SEQ ID NO: 2311 - DNA, 348 bp, Methanobrevibacter ruminantium
tagccatgataatcctcctttttagttgtattaattaataagcataaatttaaacttaaaacttttaatcgtctgattaaaaatatttaaatctcaaattaaattattattagtttttaataaaaaaaattaatagaatccattaattttttataaacaacactaaataaaataacttaataatatatttatttttaacctttataaatcttttccctatttaagcaatcttttggacttgaaaaagaaatttcaataaaaagccaatatttttgataaaggatatgataaaaattagtcaaaattgataaaaaaaggatataataaaaattaatcaaaattgattaa

SEQ ID NO: 2312 - DNA, 17 bp, Methanobrevibacter ruminantium
ttaatggattctattaa

SEQ ID NO: 2313 - DNA, 21 bp, Methanobrevibacter ruminantium
ctggaaaaaataattttccag

SEQ ID NO: 2314 - DNA, 40 bp, Methanobrevibacter ruminantium
ttataaaaaaagcggagattactctccgctgtttttatta

SEQ ID NO: 2315 - DNA, 22 bp, Methanobrevibacter ruminantium
aagcggagattactctccgctg

SEQ ID NO: 2316 - DNA, 18 bp, Methanobrevibacter ruminantium
gcggagagtaatctccgc

SEQ ID NO: 2317 - DNA, 18 bp, Methanobrevibacter ruminantium
gcggagattactctccgc

SEQ ID NO: 2318 - DNA, 31 bp, Methanobrevibacter ruminantium
ttcaaaaatagttattttaactatttttgtc

SEQ ID NO: 2319 - DNA, 27 bp, Methanobrevibacter ruminantium
caaaaatagttattttaactatttttg

SEQ ID NO: 2320 - DNA, 15 bp, Methanobrevibacter ruminantium
tagttattttaacta

SEQ ID NO: 2321 - DNA, 18 bp, Methanobrevibacter ruminantium
gaagaataataattcttc

SEQ ID NO: 2322 - DNA, 269 bp, Methanobrevibacter ruminantium
atgaagtcataaaagaaatagagaaattagactaaggtaaaagattatgaaaacacataaaatcaataataaaaatactcgcagatattataaaatactattaaaattaatgaggaaagctaaaagacattaaaaataattcttcataagtaaaaaaaaaaaaaaaaaccaaaaaataatgaaaattaaaattattcttaataagtaaaaaaaacccaaaaaaataattaaaaataaagatagaggctaaatatgttaaatataaccac

SEQ ID NO: 2323 - DNA, 404 bp, Methanobrevibacter ruminantium
tatactcaataatcatacaaaatcaacttatgtcaagtgaagatatccaattaataaaatttaaacagaaatctttataagaggaacaagaatatttttaagttaaaaattcaaaataaaaagattcctttagaataaaaccaagcaatgtttacaaaatgaaaaaaaaatgtacaaaaatatacattgatgattaaaattaaaaaagattaaaacttataaaatcataatataatatattaaaaaaattagggattatgatttatgataaaaattgcaagaattgatggagacggcataggcaaggaagtgacagaggcaggagtggctgttctcgaatcattagacctaaacatcgacttcgtagaagctgaagcaggtcgagaatgttttgataagaacgg

SEQ ID NO: 2324 - DNA, 505 bp, Methanobrevibacter ruminantium
ttatttggctttaaaaagagtttaatacatttttattaaaaaagagatttaaaataagtttaaaacttaaagtaaggattcaaaatgaatccttggctttaaattttctatcatcctaggagttaatgaaataactctatgtaatattatatgtttaaagtatataatattaactgttgaagaaaaaactaccctataaaaaatataaaaacaattattttttttagttcaacaactgaatacattttatttcattaataaaatgaagattttgaggatttctaaagagtattttagaatcttttcagagttgtctttcaagaattctaatgaatcttttagaagatcattgtttatatttttcatttttttcctccattttcggatgatagatatttttttgtagcaggaaaaaacttcaattaataatttatttttatcattaataaatataatggtttttttgagataaatattgatttaaaagtgttaaattgatttaata

SEQ ID NO: 2325 - DNA, 38 bp, Methanobrevibacter ruminantium
cttaaagtaaggattcaaaatgaatccttggctttaaa

SEQ ID NO: 2326 - DNA, 36 bp, Methanobrevibacter ruminantium
ttaaagtaaggattcaaaatgaatccttggctttaa

SEQ ID NO: 2327 - DNA, 27 bp, Methanobrevibacter ruminantium
gcaatgattacaggtcttaatcattgc

SEQ ID NO: 2328 - DNA, 211 bp, Methanobrevibacter ruminantium
ttacaatgatattatcatggaaaaaatgatattaacattataatatcatgataaaaatagatagaatttttgcttattttctaaaaaaaagaagaataaaaatttttttagtttattaagaaataaaatgaaaaatttagtgaaaaaaagagaaatatgaaaatttaaattattcattaaaaaaaaatggaacaaatcatgaaagaaatga

SEQ ID NO: 2329 - DNA, 188 bp, Methanobrevibacter ruminantium
atacttgcaaagctttatatctttgcataattctttaatttctttattttaaaaatttaaattaagttttttctttaatttatttatattaaaaaatttacttagttttttttaatttatttattttaaaaaattaatttagttttatttctttaatttgtttattttaaaaatttaaataattttta

SEQ ID NO: 2330 - DNA, 327 bp, Methanobrevibacter ruminantium
gaatctgctaattcatttaaaaagtatgtttttgacatattaatcacggaaactgattttgatagaaaatagatagaaataaattaatttttaaatataaagttcttaaattaatgaaaatgaaaaataacgacaaataaataaaaattatttaaatttttaaaataaacaaattaaagaaataaaactaaattaattttttaaaataaataaattaaaaaaaactaagtaaattttttaatataaataaattaaagaaaaaacttaatttaaatttttaaaataaagaaattaaagaattatgcaaagatataaagctttgcaagt

SEQ ID NO: 2331 - DNA, 266 bp, Methanobrevibacter ruminantium
aaactgattttgatagaaaatagatagaaataaattaatttttaaatataaagttcttaaattaatgaaaatgaaaaataacgacaaataaataaaaattatttaaatttttaaaataaacaaattaaagaaataaaactaaattaattttttaaaataaataaattaaaaaaaactaagtaaattttttaatataaataaattaaagaaaaaacttaatttaaatttttaaaataaagaaattaaagaattatgcaaagatataa

SEQ ID NO: 2332 - DNA, 18 bp, Methanobrevibacter ruminantium
tagctaaatgattagcta

SEQ ID NO: 2333 - DNA, 18 bp, Methanobrevibacter ruminantium
tagctaatcatttagcta

SEQ ID NO: 2334 - DNA, 114 bp, Methanobrevibacter ruminantium
attttgacttaaaaaaaaatgaatgatttttataaaaaaatagtttctataaaaagtttaaaataaagagcaaatttttttaaacaaatcatcaaaatgaaatttttaaaaaaa

SEQ ID NO: 2335 - DNA, 252 bp, Methanobrevibacter ruminantium
ttttaaatatatataaaattaattaataattagtaaaagattaacttggttaataaaaaaataagacttcaattaatattaaaagttaaaaaaagacttaaaataatttaaaaaggataatgagtaaaaaaaacaatccaaattaaatttaaaagagaaattagctaaaacaattaaaaaaaaaaaaaaagaaaaaaaagaaatagtagaaaataaataaaaaatatagtataaaaaaagattaatctttaa

SEQ ID NO: 2336 - DNA, 24 bp, Methanobrevibacter ruminantium
ggataaaatcgactgattttatcc

SEQ ID NO: 2337 - DNA, 12 bp, Methanobrevibacter ruminantium
gagatatatctc

SEQ ID NO: 2338 - DNA, 477 bp, Methanobrevibacter ruminantium
cttaaaagatacaaaaatgatgtctatagagtatattcaaatttataataatttactggaaattaaataataatttaaaaattaaattataaaatttaattggaaattaaaaaatataaacaatcgaattattaaaaattataaaaattatttaaaattattaaaaattataaaaattatttaaaaattattaaaaattataaaaattataaaaattaaaatattgtaaataatcaaataccgatataaaaaaaacaaaaatactaattagaaaaggaagataaaaaaaaacaagattttcggtgttaatatggaatttataaaatataaatctcaattcgaaaaaatgatagataataaaattattggtatgccagaattaattgattccaatataagctttaaaggtaaaaataatattttatgttgcaacaatattaaattagaaaatatagacatagatttcaatggaaataa

SEQ ID NO: 2339 - DNA, 31 bp, Methanobrevibacter ruminantium
tgagtatttaattaactcaattaaatactcc

SEQ ID NO: 2340 - DNA, 29 bp, Methanobrevibacter ruminantium
gagtatttaattaactcaattaaatactc

SEQ ID NO: 2341 - DNA, 31 bp, Methanobrevibacter ruminantium
gtataagaacactaaattgctgttcttctac

SEQ ID NO: 2342 - DNA, 18 bp, Methanobrevibacter ruminantium
tatgcttatttaagcata

SEQ ID NO: 2343 - DNA, 34 bp, Methanobrevibacter ruminantium
ttagttgaattagttttaaactaatttaaactaa

SEQ ID NO: 2344 - DNA, 31 bp, Methanobrevibacter ruminantium
gaattagttttaaactaatttaaactaattc

SEQ ID NO: 2345 - DNA, 38 bp, Methanobrevibacter ruminantium
atgattgaatggtaatatcattattgccattcgattaa

SEQ ID NO: 2346 - DNA, 36 bp, Methanobrevibacter ruminantium
tgattgaatggtaatatcattattgccattcgatta

SEQ ID NO: 2347 - DNA, 30 bp, Methanobrevibacter ruminantium
ttgaatggtaatatcattattgccattcga

SEQ ID NO: 2348 - DNA, 98 bp, Methanobrevibacter ruminantium
tttaaaaaaaaattgaaaaatataaaatttgaaaaaataaaattgaaaattaaaaaaaaaggttaaaaaattaaaaattaaaaaaatgaaatgaaaat

SEQ ID NO: 2349 - DNA, 186 bp, Methanobrevibacter ruminantium
taacctttttttttaattttcaattttattttttcaaattttatatttttcaatttttttttaaacaattttattattttttaataattcttttttttcaaaaatctaatcaataattttattaacacgtgttaataaatataggaataagaaaaaataactgtaatttttattatttgattgatt

SEQ ID NO: 2350 - DNA, 225 bp, Methanobrevibacter ruminantium
cttgagagatcagattgttgccttaaagagcattaaaaaatagaaatcttaaatcttaaaagtaaaaaacaagaattttgataaaaaaagatttaagatgtttaaaatagaaaaatataaaaaaaataagtcattttattgaataaacaataatttgacttataacattattttagaaaaaataatctaaataaaaaaaatattaactaattttagaaaaaataa

SEQ ID NO: 2351 - DNA, 36 bp, Methanobrevibacter ruminantium
taagtcaaattattgtttattcaataaaatgactta

SEQ ID NO: 2352 - DNA, 244 bp, Methanobrevibacter ruminantium
tttcagtattattaatatattttggtcttatataaatttaattttttgattaaaattttcatatttttttctatttaaattacttgattttctaaaataatctcaatttaaatttattttttgtaaaatgaaataaaaattattatatactataaaaacataatctaatttataatgtaaattatttttacttattaaatattgagtaaaagttaatactattccaatcttattaaaataagat

SEQ ID NO: 2353 - DNA, 15 bp, Methanobrevibacter ruminantium
gagaatttcattctc

SEQ ID NO: 2354 - DNA, 104 bp, Methanobrevibacter ruminantium
aattaattctatttttctaaaatgagttttttcttttatttgaatcctataaaaaatgttttttttaaatttttaataatattataattttttatttaaaaata

SEQ ID NO: 2355 - DNA, 18 bp, Methanobrevibacter ruminantium
tggagaataatttctcca

SEQ ID NO: 2356 - DNA, 19 bp, Methanobrevibacter ruminantium
taattaatttaattaatta

SEQ ID NO: 2357 - DNA, 220 bp, Methanobrevibacter ruminantium
ttaaaaaaatcaatgattaattctctttttaagaatcaaaaaattaaaaaatataattaataaaaatcattaaaaatgataattattaattaaatcaaataaaatctatccttcagcagttttattagttaaaaaagataaaatctatccttcagcagtttcaggaatatttcctgttttgacctgttctatataatcctgcaattgtttaaaatcatct

SEQ ID NO: 2358 - DNA, 43 bp, Methanobrevibacter ruminantium
tttaattaataattatcatttttaatgatttttattaattata

SEQ ID NO: 2359 - DNA, 39 bp, Methanobrevibacter ruminantium
taattaataattatcatttttaatgatttttattaatta

SEQ ID NO: 2360 - DNA, 26 bp, Methanobrevibacter ruminantium
caattaatatcttttgatattaattc

SEQ ID NO: 2361 - DNA, 20 bp, Methanobrevibacter ruminantium
ttaatatcttttgatattaa

SEQ ID NO: 2362 - DNA, 403 bp, Methanobrevibacter ruminantium
attaggaattaattaaattgatacttaatttaattatatatattaatatttttcttcttattagtatttaaactattttaaaatatttaaaaaaacctttaacagggtgattttttttaaaaggaataatgggatattgaaaaaaataagatagtgattataaatagaaaaagagttagtggataaatcaatagaaaaagagagattagcaattataagaatagcatataaaaaaacgtagttaaacaataaaaatagcatataaaagaacaagtagttaaatcaatagaaatagtatataaaaagagtatttagtaattaaaacaataaaaatagtaaaaatctaaagagaattaataaattcccttttgtttaaaaaaagaattaatatcaaaagatatta

SEQ ID NO: 2363 - DNA, 48 bp, Methanobrevibacter ruminantium
taaaaataagtatttagttattattttaataattaatacttattattc

SEQ ID NO: 2364 - DNA, 36 bp, Methanobrevibacter ruminantium
taagtatttagttattattttaataattaatactta

SEQ ID NO: 2365 - DNA, 250 bp, Methanobrevibacter ruminantium
ttattttattaataatcccatacaaatttgaaaaaaataataatgctttaatatttaaaaaaataaaagaaatataagaacaaaaataaaaaaaaataatttaatttatcaaaattataatcatcgttaaaaaagtggtgctaatatgtttgaagaagatgaaaaagtaaataaaatatttaatcttataatcacacaaggaattgactctgaaaatgaatataaaatctttacagaaagattatactca

SEQ ID NO: 2366 - DNA, 226 bp, Methanobrevibacter ruminantium
acatttgtataaaaaataacatttcataaaaaaatatctaaaaaaaataatctgaaaaacttatagaaatagtttaaaatgcaaaataagaaaagtttgaaaaagagaaataaaaagaaagataaaaattaagtaatttttttatatgggataattgattttttaaatacttaatttttattctttaacttaagttagagtcttaccttaaaaggttatcttcata

SEQ ID NO: 2367 - DNA, 23 bp, Methanobrevibacter ruminantium
gaaataattttattaattatttc

SEQ ID NO: 2368 - DNA, 248 bp, Methanobrevibacter ruminantium
ttgtaaaattaattaaataattttaatttttataaacaatataatattatattttaaacaatataaagttttttaaacagataataaattttttaaataaatattataagtaaataactttaaattataggaaaatcattaaaaaaattctttttaaacaatatttttcaaaaataactactatatattaatacatataagaataaaataaataaaatgatttattctatattcagataaatctaaga

SEQ ID NO: 2369 - DNA, 369 bp, Methanobrevibacter ruminantium
taatttacttattatatttcattaagtaatatatattatttattaaattacttattaattattattaagttatatataattttaaggtataatgagaaaaataaagttgaaagaaaagaaagaaaaaagaaaaaatagaatagcaaaaaagataaaaaaaattagaaaaaaattaatggaaaaaataaaaaaaagataaaaaaaaattaagaaaaaagaataaagtttaataaaaaataaacaagtaaattatagaaaattaaaaaataaaattaaatctcaatttcaagttcaataggaagatgtttagaaccttcaacatcaactaatatagaagaagatttaaccttatccttaagagattcagaa

SEQ ID NO: 2370 - DNA, 23 bp, Methanobrevibacter ruminantium
tacttaatgaatttcattaagta

SEQ ID NO: 2371 - DNA, 25 bp, Methanobrevibacter ruminantium
tttagaataattaatttattctaaa

SEQ ID NO: 2372 - DNA, 95 bp, Methanobrevibacter ruminantium
ataatttattaagattatttaaggaaatataataaagaaaatatagaaaaatatagaaaaataaaaaaaaataaagaaaaatatagaaaaatata

SEQ ID NO: 2373 - DNA, 597 bp, Methanobrevibacter ruminantium
tataaaaaataataaagataatattgttgaatcagataaaaaacaagaggaaattaaagaagaaattcaaaaacctgttcctaaatctaaaccaaataatacaaaagagttaattaatcaaaataacaaaaccattgaagaattagaagaatatattaataatagttcaaataattctgatttagaatttgatggtgcttctgatattgatttagaaaaagaaattatttcagaagacaaaactaaattagacgtagaatcagatattcaaatggatgatgaatatgtgatagttgatgattctgaattggaagacgaatttgagtttatagaagaattagatgatgattctgaattggaagacgaatttgagtttatagaagaattagatgatgattctgaattggaagatgaagaatttgaatttattgatgatttagatgatgattttggttcagaagatgaatatgaactagttgatgattctgaattggaagacgaatttgaattaattgacgatttagaagaaaaatccaacaattatgataatgaagatattaatcttaaagaagatagtgaatatttagaaaaagaaga

SEQ ID NO: 2374 - DNA, 93 bp, Methanobrevibacter ruminantium
aaattataattaatattctaaacaaaaatagaaaaaaatagaaaaaaatagaaaaaaatagaaaaaaataaaaataaaatagaattattgttt

SEQ ID NO: 2375 - DNA, 301 bp, Methanobrevibacter ruminantium
attatcagctaaattaaaaagcaattttcatgattctaatttagctaaacagataaaaatttatcataatagaatttttttatttatgacaatttaatcaataataatagaattaaaaaactaataaaaattgattaaaattatctaaattaataagcacatatatatgcaatagttctaaattgaataatttaatacaatatataaaataataaaaataatgcttaattaaatatatacttattctataaactataaaaaatataaaaagtagaatttaaaattttattgaaaaatggct

SEQ ID NO: 2376 - DNA, 372 bp, Methanobrevibacter ruminantium
attaagtaataatttagtttatactttatagaaatgtttctatagttctaaactattttagtttgtatgtatgaaaaatgtttcaaagattataaacaatatttagtttgcatatattgaaaaagttttattatgatgaaattaaaatattgttttattctattgaaattattttatcatattaaaactatttttttaatatgtttttataaattgaaattatttcatacttatgaaacttttacaattagtttatagatatagaaataatttgtatttaatgaaacatttttttgttatttttcagattttttaaaaaaattagaaaatttcaaaatcttggaaaaatcttaatttttttgaaaaaataaa

SEQ ID NO: 2377 - DNA, 26 bp, Methanobrevibacter ruminantium
catattaaaactatttttttaatatg

SEQ ID NO: 2378 - DNA, 38 bp, Methanobrevibacter ruminantium
atcctacttcgttatactgtagtataacgaagtagaaa

SEQ ID NO: 2379 - DNA, 36 bp, Methanobrevibacter ruminantium
ttctacttcgttatactacagtataacgaagtagga

SEQ ID NO: 2380 - DNA, 36 bp, Methanobrevibacter ruminantium
tcctacttcgttatactgtagtataacgaagtagaa

SEQ ID NO: 2381 - DNA, 32 bp, Methanobrevibacter ruminantium
ctacttcgttatactacagtataacgaagtag

SEQ ID NO: 2382 - DNA, 312 bp, Methanobrevibacter ruminantium
tgaaacaaatagaaattttgttcatcttttataaaacaattaaaaaaagttttcattatatggaacaatattctaaattttgttttatatttgcgaaactattaaaaataatgtttttattatatgaaacaatatgatttttgttttaaataaataaaacaattagtttattttcataaaataaataattttaaaatttccagataataaaaataaaataaaaatagaataaaagagttattagaaaatgattaataaattaaaatagaataaaagtatttttagaaaaaataaaatttcaggattgaaaaa

SEQ ID NO: 2383 - DNA, 251 bp, Methanobrevibacter ruminantium
ccaccaatttaaattatattgagtctattttaatcattttatttttctaaataattgcttttttaatacaattaaatatatgatttttctaatattaatagttattagaaattatagaaaaattatttaattcaaattatatttttgataatattgagttattttctttaaatagattataacgctagaaattttatataaaagaaatttagaaaaaatttaagagatataataattttaaataaaaaaag

SEQ ID NO: 2384 - DNA, 316 bp, Methanobrevibacter ruminantium
ttttttatcttatatatactttggggctaaaaaaagtcatagagggctttaaatttatttttacttaattttttttagttttcttaatttgttttattacgttaaaactaactccattagctttgttttttgtatctttatttagttgtttagattaagactaatttattagttagatatttaaaatttaaaatacaaatataatatacaaatcttaatttaaatataattaaaaatcttaacttaaataaaatatataaaaatatttataaatttaataatttattataaagaggaattttaatgaattttaact

SEQ ID NO: 2385 - DNA, 129 bp, Methanobrevibacter ruminantium
attttcttgttcaagttttaattgaattattcaaatttcacttaattctagttttaattgaattattcaaatttcacttaattctagttttaattagaatatgacttttttgaatatcttaaaattaaa

SEQ ID NO: 2386 - DNA, 256 bp, Methanobrevibacter ruminantium
gtcctattatataaaagtttacaatatcaaatcaatattgatttgaaaaataataagttttaaaaaatatgaaaatcatataataaatagtataaaatatctttatttttctaaagatttactaaaaattcaataatttttcttaaattaaggaagattatagaatcaaaataaaagccgaataatgataaactgtctgtaaataaacagataaactaatattaaatacatagaacaaaataactgaaattttagg

SEQ ID NO: 2387 - DNA, 275 bp, Methanobrevibacter ruminantium
cttttttattaattggggtaaaaattgatttgaaagtgttttttctgattataaatttaacaaaatttcttgaattaaaaatagaaaaaatagtcattataataattttaaaagaaataagaataataaaaagagagtttaatttaatttaaagaataagaataataaataagagtttaatttaatataaaagtaaaaattaataaaaaaataaaaaattaagataaataattatcttaattaaaaaatagaaaacaaattgttatctaatttag

SEQ ID NO: 2388 - DNA, 22 bp, Methanobrevibacter ruminantium
ttaagataattatttatcttaa

SEQ ID NO: 2389 - DNA, 21 bp, Methanobrevibacter ruminantium
tagataacaatttgttttcta

SEQ ID NO: 2390 - DNA, 23 bp, Methanobrevibacter ruminantium
ttgatatctaaattagataacaa

SEQ ID NO: 2391 - DNA, 15 bp, Methanobrevibacter ruminantium
taagcaaaatgctta

SEQ ID NO: 2392 - DNA, 24 bp, Methanobrevibacter ruminantium
ttaataattcgccagaattattaa

SEQ ID NO: 2393 - DNA, 23 bp, Methanobrevibacter ruminantium
taataagcaattgttgcttatta

SEQ ID NO: 2394 - DNA, 17 bp, Methanobrevibacter ruminantium
taagcaattgttgctta

SEQ ID NO: 2395 - DNA, 232 bp, Methanobrevibacter ruminantium
attattatttttgtaataagaatatataaatattacgatataattattacaaaaaaattttaaaaagatttcaaattattagttgaaattttaattttttcatttaattaattgttttgaaaaatatgatttatataaaatttatttttgatttattatcgattagatttattgttttgataaataaattgtttaaataaagataatttttttatctttttgtaaaaaatta

SEQ ID NO: 2396 - DNA, 265 bp, Methanobrevibacter ruminantium
ataaaatattactaaattaagaataaatcattaatataatcatattaaaaactaaataaaaaactagtaaaaagttagtaaatttctattaaaacattattaaaagcatagttaaaaaaataagaaaaatgaaaaactataataaagacacaagcaaactatagcaaatatacagtaaaagtataataaagacataggtaaactatagcaaatatacagtaaaagtataataaagacataggtaaactatagtaaatttatagta

SEQ ID NO: 2397 - DNA, 30 bp, Methanobrevibacter ruminantium
gaataattattttaatataaataattattc

SEQ ID NO: 2398 - DNA, 317 bp, Methanobrevibacter ruminantium
ctttattcttactttttttaagaattaattttaaattgatttaaaagtttattatagtttattttagataaataaataaaattattactcttttttaattaaatattattttaagagttaatttgataaactttttacacttaactaaagaagatttaatcaatcaaaataagattataaagattatattcaaattcaacaacagaacgattaaaaagattttattcaatatatcaacagcaaaaaattataagtttttattcaataatacaagattattataatgatttattcaaaaatcaacaacaaacaactga

SEQ ID NO: 2399 - DNA, 24 bp, Methanobrevibacter ruminantium
taaagaataagtaattattcttta

SEQ ID NO: 2400 - DNA, 71 bp, Methanobrevibacter ruminantium
aaataaaaaaaagttaaaattaaaatctgaatgatatagtgagttaaaaaattaaataaaaaggaatatgc

SEQ ID NO: 2401 - DNA, 343 bp, Methanobrevibacter ruminantium
aattgaagatatggaactaattaatccttcttcaatatttgaattcattgattataaagaagaattcattgatttaatcatagaaagcgttaatcttataaaaaatcattttccaaaggcaaaaatttatttaaaatataattgggatcatgaatattgggatttaacttcaatctgtggaaatatttatctaaaagacggaaataatgatgaaaactatagtatttataaatataaactctttccagactttgttaaattaagaaagtcctatggtgatttcaattattatatagaaatgatagatagcgatgaattggatgaacttttaaaaaattgattg

SEQ ID NO: 2402 - DNA, 620 bp, Methanobrevibacter ruminantium
cttgattgattattacgatatacatgaccttatccttaaattaacaaaaagtgatgaatattataaaagtttgattgaaaagaatttagaaagcgaatagttaatttcaaagttaattataaaagattaatgtaaaagaatttagagagcgaatagttaattttaaatagaaacttaaagaattagaggggtgataatatctatttttatatcttaaagggcggaacttatgatgtggacttaaaagacgtttattattcttcaaaaccctatactcaagaggaatttgaaagtatcataataaatgcttataaatatgtctgtgaggagattgaaaccaaaaataaacgttttcaggcatgtcatgattttgaaccatgttttatttgctggaacatcgaattggaagggaatgaatttacaaaatggatagaggaaaattctgatcttagagtaataaataaattcaatgcttcaatggatgttggggttctaggctcatttacagaagatactattaagctggaaaatggcattgatctatctaaaattccaagatgcaaaggaaaatgcgatagggaatatttctttaatgaggaatgcttctttgaaagaagaag

SEQ ID NO: 2403 - DNA, 278 bp, Methanobrevibacter ruminantium
ttttcactgtaagatcaatgagaattttcttttgataaatccaaatgaaatctatgattttataggtgaaaataatagtttaatagaattaattaacattagtttcacattaataaaaaaatattttccagattcaaccatatatttggaatttaatcaagaccctgaatatgagggattgaattcaatctttgccaatatttatgatggtacaaattcctatgattgtaatatggatttatttgaagatttatcccttgaatttagagaattaaaaa

SEQ ID NO: 2404 - DNA, 258 bp, Methanobrevibacter ruminantium
gaattcagtttaattatgaagattaaaaaattgaaattttataaaaaagtaaaaattgcttttttatgataagttaaaaattgtagaatttcttgaaaaaataattgaaattaatgtaaaaatagaatttttattataaaatttttaaaatgatgtaatcaaaattgactcttgtttacacccttgatttttgatatattttaaattgatttttgattgattaaaattaaggttctatgtgttgatattaaaataatt

SEQ ID NO: 2405 - DNA, 139 bp, Methanobrevibacter ruminantium
aggattagaatggatgctatttgaatattaactaaaaataccattgacatttaaaaaataataataaatggtctggatttaattggaagataaaaattttaatctagaaatattagaaatataaaatgattagatttat

SEQ ID NO: 2406 - DNA, 195 bp, Methanobrevibacter ruminantium
attaatttatattttttagataataaattttagaaaattaacttattttttttgttaaaaagtgttataaatattttttaattaaaaaaaatctaattgatattgtgtttagattatatcagattagtgttatttgaatattagtatttggaatattttttagttagatttatataataaaatattccaatatat

SEQ ID NO: 2407 - DNA, 277 bp, Methanobrevibacter ruminantium
tcctaatgataataaaatcaaatcaagggaaaattggaataattatgaaatagaaatatttgataaagataaaattatctataaatcccatacttatgtaattatgtccataaattttaatatgggaataactacaaagataaaaaagattaaattaaataaatttgataaaatggtaaattcttcaaacttaaaaaccgaaaaattcacaatttcagaggaaaatggattaattaatatttctaattatttacttgaagaatctaaaaatagaaat

SEQ ID NO: 2408 - DNA, 284 bp, Methanobrevibacter ruminantium
ctattttgataaaagtaattttcatttcttaagattatttaaactgcatgaaatcaaaaattttgaattagaagagaaatatattgattttaactgtgaagacgaattaaaaaattacatactttttaattacattattacggaatatattcatagtgtagataaaaatttgcctaaggatataaaaacaaaaattgaatccgattttaaattaattgaaaaaatagaagttaatatacttataaaaattatattagactatattagattcgatgaaacaaaaa

SEQ ID NO: 2409 - DNA, 78 bp, Methanobrevibacter ruminantium
agaaaaaaataaagaaaaaaaattaaaagaattaatagacattgcaaaaaatataaattaaagttattcattcaaaat

SEQ ID NO: 2410 - DNA, 282 bp, Methanobrevibacter ruminantium
ctatcagattagaagcttctttaatagctttttctagtaatctaattttttcatatttttttggatcaaattgaatttctaaattatttaatttcaggtaagaattacaattatcacaatattttgctttatttctaattttatttccacaataactacatgtttgcatatatataaatatgtttttaaaatatttatttttaattttaattagcagataatttaaaaaaataatatcaaaaaataaaaaaatgaattcttaaaattttcaaaaaaggaatg

SEQ ID NO: 2411 - DNA, 184 bp, Methanobrevibacter ruminantium
atattttttcacattttagttaaaataaaaattttaatctgaagtgtattcaagataaagattgaataggaatttcatcctatcattatcatctttaaattttttagaactatacgctttatcaatagctttatctaattcgatatgtgctttttgtaatgagttaggcatatattctccatat

SEQ ID NO: 2412 - DNA, 241 bp, Methanobrevibacter ruminantium
ttatggggttagaggattataatgaatctttgaattttttagaattagcgcaatctttagttattgatgaagaaacaaaagagatgattttagttactaaagtaactatagaaaattttttagaaagataagaatttatacttaatctttttttctgcattaactttaaatacgaaataaaatatttttcattataaagaaataaaagtttaaaattaagaatataattaaaaataatgaa

SEQ ID NO: 2413 - DNA, 290 bp, Methanobrevibacter ruminantium
ctctctaaataaagatatcatttccataaaaggtaaaatgcaagcaaatacagatgagataaacaggaatttagaccatctacaaattcttaagaatattagggaaaatgaaaaatatttggaaaagattcaaaagcaatatgatgtttccaaaaaatctcatgaattgtttaaaaagatcaaagaagaagagcttgccaatatcttaaagcaaatagaagaatataccattgaattctacaattatatacactacgatgaagacataaacagccctaaaatgaaaatca

SEQ ID NO: 2414 - DNA, 13 bp, Methanobrevibacter ruminantium
tgcatttaatgca

SEQ ID NO: 2415 - DNA, 13 bp, Methanobrevibacter ruminantium
tgcatttaatgca

SEQ ID NO: 2416 - DNA, 28 bp, Methanobrevibacter ruminantium
tgggttaagttaagtaaaatttaatcca

SEQ ID NO: 2417 - DNA, 28 bp, Methanobrevibacter ruminantium
tgggttaagttaagtaaaatttaatcca

SEQ ID NO: 2418 - DNA, 561 bp, Methanobrevibacter ruminantium
aaatcatctttatcaagatttttgtattcagatgaaaaattattttccgcacggtaagaaaattttccaatatcatgaagtaaggaagcaaattctaaattttttctatccataatttttctccaataatagataaattcaacaacaagttacaaaataagatttaatttttaatttaattgacaaataacctataatcacttaaatttaattaaattaaataaaataagttaaaaaagtattaaacgcaaaaagagtaaattatttaattaaaccttattattttatataaaaaatatccataaccccaaatatcacccaaaatttatatataaacttattatatttttactacataataaatatttatatatttttattaaaaatttttaaacaattattcctcctatttttatttctttttatgaagtgtaaaaatgtcctcattgcttgaaataatataatttaattccttatctaaatttttcaaacagtaatattcatccaaatcatgatttaaataatttaaagcataatctgcttttagattgtatccttttt

SEQ ID NO: 2419 - DNA, 87 bp, Methanobrevibacter ruminantium
atatataaacttattatatttttactacataataaatatttatatatttttattaaaaatttttaaacaattattcctcctattttt

SEQ ID NO: 2420 - DNA, 344 bp, Methanobrevibacter ruminantium
ttgtgcaaatctaaaaacttaacccttatttatatatatttgcacaatttaaataaaaagttttctatcaatattaacaaataataatcattgaatcaattatatcaatgtttaaaattaaatattttaaaaaatactaaacaatatgtaattaattaaaaaaataaggaaaaaatgagaaataaaaaaatattaaaaaattagcggaaaattggaaatttgttaaaatcctataggtttgcacaaaatggatttttttgaattttctttataccggctaaaacagatgtattaatataatttactaaattattattttttaagacttattttataaaaaatga

SEQ ID NO: 2421 - DNA, 137 bp, Methanobrevibacter ruminantium
ttgtttttttagaagaaaaatttatgaaataaaataaataattataaaaggtttattataaaagaaatagttttaatatatcattttttataaaataagtcttaaaaaataataatttagtaaattatattaataca

SEQ ID NO: 2422 - DNA, 310 bp, Methanobrevibacter ruminantium
tttcttttataataaaccttttataattatttattttatttcataaatttttcttctaaaaaaacaaacctttatatactcccaagccaataaactgtttaaaaatatattctattttttaaatttatataaaaacaaatattttaaaataaaatttatgtttaaaattaaacttttaaaagtaaaaataaaagtttaaaaactaaaattaaactttaaaaacaaaaataagagtttaataaccaaaattaaactcaaaccaaaaaaataaaggtgattaatatgtctagtcaacttgaggaattaaaaa

SEQ ID NO: 2423 - DNA, 35 bp, Methanobrevibacter ruminantium
ttagaattattttccaaaatggattataattctta

SEQ ID NO: 2424 - DNA, 282 bp, Methanobrevibacter ruminantium
atttaatcatagtaacaccactttaactcttatttttatgttcttttactatttaaagattgttgaattatttatatgatttacatatgttaataaatagtttacagaaaaaaagaagttatctccgttctccttttggtttactatatatgtcatatagtttaccaaaagcaaaagtgataaaaatagttataattaataaaaatagtttagttaatcaaatgaaattcaatcatccaataaatcatatattagataatgaacatttattaaaaaataaaa

SEQ ID NO: 2425 - DNA, 19 bp, Methanobrevibacter ruminantium
ggttcttttaaatagaacc

SEQ ID NO: 2426 - DNA, 213 bp, Methanobrevibacter ruminantium
accttagaataattaatatattgtttaaatagatatttaaaattttataaattgctttatggtgtaataattaaaataagagttaaataaaggaatataaatcgggttaattctgaaattggattaaggataaaaagagtttaagaaaatgaatctgaattgggttaagtgttaaatcggattaaggataaaaagagtttaaaaaaataaaaa

SEQ ID NO: 2427 - DNA, 393 bp, Methanobrevibacter ruminantium
ttatatttttaaaattttgtgtttgttaaataaattgattgtagtgattttagattcaaataaacttttcattagtaattattataaaaatatcttaaatataggggggaaatagtaacttactaaaaaacccgaataataacactttcagctatttttaaattttaattgatttttataggtaacacagcgatatagtgaaaatctaaaaataataattatttgctaaaaagtattattatctacttaactataaggagtaataattatataaagtttttcttattacaaataatgaaaaattaggaaaaaaagtaatattgcttataaaaggtaataaaataattagataaaaaataaaaaagtaataaaaatttaatttgaaaaagtaat

SEQ ID NO: 2428 - DNA, 49 bp, Methanobrevibacter ruminantium
tctagctccaccttttacggccctccgggccgcaaaagctggaccaaaa

SEQ ID NO: 2429 - DNA, 45 bp, Methanobrevibacter ruminantium
tagctccaccttttacggccctccgggccgcaaaagctggaccaa

SEQ ID NO: 2430 - DNA, 31 bp, Methanobrevibacter ruminantium
ggtggaggtggaggtgccttctagctccacc

SEQ ID NO: 2431 - DNA, 200 bp, Methanobrevibacter ruminantium
tttttctaatcaaatatttcacactatttttaattcctatgaaaattaatttaactagttaaaaacaattcaatcaacttaaaacaaaatataattaaaaaataataacaattaaaaaatcatatttttttaaattaactataaataatgaatagtaaacctattaaaaaaataatctattttatcgatttaaatcataa

SEQ ID NO: 2432 - DNA, 374 bp, Methanobrevibacter ruminantium
ttcatattataaattatgtgtattaatatttacttgataagcataaaaacaataattaacacttaaaaaaaaggacaaataatataaaaagacaaagagaataatggaattctaagtaaaaatagcaatataaaacataaaataagaaaaacagaaataatgccatataaaacataaaataagaaaaataagataaaaataataaaagaaaaaggaaaataaaaaaataaaaaaaagacatttaaaatattatagaattaaagatcttgtttgaaaaaagtaaaaaagaataaagttaaattaaaaatttaactgttaaatctatttaataatttcttcaagaagggtgtcgtctgttacagtaacagtgacta

SEQ ID NO: 2433 - DNA, 19 bp, Methanobrevibacter ruminantium
gttaaatttttaatttaac

SEQ ID NO: 2434 - DNA, 13 bp, Methanobrevibacter ruminantium
gtattttagatac

SEQ ID NO: 2435 - DNA, 31 bp, Methanobrevibacter ruminantium
ctttttcagatttttaaaagatcttaaaaag

SEQ ID NO: 2436 - DNA, 19 bp, Methanobrevibacter ruminantium
ttaggttttttaaacctaa

SEQ ID NO: 2437 - DNA, 250 bp, Methanobrevibacter ruminantium
gaataagaataatttattattgtttttagtagaaaataagtatttttacttttaataaattaaaaaaattaaacttaaataagttaatgaattattaaaaaatattgaaaaagtaataaaaagttataaaaaatgtaagggataaaaaatagaagttaaaaagtaaaaatagaagttaaaaaattaagatagaaattaaaaaataaaaatagaagttaaaaatagttaaaaataaaataaaagaatttaa

SEQ ID NO: 2438 - DNA, 299 bp, Methanobrevibacter ruminantium
caatttatattttattgttttaagtataataaattaatcattcattaattaaccagttaaatgattattgatatttgtttaaaaattagataaaatagtctaaaataaataaaagcaatagatcgaatagcctaaaaataactaattattaaagtaaatatatgcaaaaaaaagataaaatagcctaaaataaactattaataaagtttaacaacttagaataaaattatactcaatataattttttaaagatcttgaataaaaacagacataatcatttaatttgaacaaattcaggg

SEQ ID NO: 2439 - DNA, 84 bp, Methanobrevibacter ruminantium
aaataagaataaaaaatagattgtaattaaaataaataataagataataaaaaaagtaaaaagtaagactaaaacatatgattt

SEQ ID NO: 2440 - DNA, 275 bp, Methanobrevibacter ruminantium
aaaaaatcatcataagtataaccaggttttgcattataaattttgtctgaaaaactcaatatttaacctcctaatccttaaataaatcaacaaataaaagttaattaaaagtttaaaaaaaattaattctttaaatgaatagcaaaggctataataaagaattaattattgaataaataaataaaaactctttaaatgaatagcaaagctattataaagaattaattattgaataaataaataaaaattaattaatgatttaaaaaaaattaatt

SEQ ID NO: 2441 - DNA, 26 bp, Methanobrevibacter ruminantium
ttaattcttattaacttaagaattaa

SEQ ID NO: 2442 - DNA, 120 bp, Methanobrevibacter ruminantium
ccataaatataaaaattgaaaagtatattaataattttgattaaattgaaaataaataaattaattaaatcagtttttttaaattttaattaatttaaataaatatttttttaagattaa

SEQ ID NO: 2443 - DNA, 264 bp, Methanobrevibacter ruminantium
ttttaagattaaaacttcttatatcttgctttttaaaaatcttaaataaaaaccaatatttagaattattaaaagtttttaaaaaattaatataatataaaaaattttagattatttataattatattaataatattataaaaaggtttatattttttaagcttttttcattaaattttggaaaaaaataagtaaaaactattaaaaaaatagggaaaatttaagaaaaataagtaaaaatccatgctaaataaataaattttg

SEQ ID NO: 2444 - DNA, 115 bp, Methanobrevibacter ruminantium
tcttgctttttaaaaatcttaaataaaaaccaatatttagaattattaaaagtttttaaaaaattaatataatataaaaaattttagattatttataattatattaataatatta

SEQ ID NO: 2445 - DNA, 18 bp, Methanobrevibacter ruminantium
tggagttttataactcca

SEQ ID NO: 2446 - DNA, 253 bp, Methanobrevibacter ruminantium
aaaattagtttagaaatttgaaaaattaggaaaaaatgagcaaaaaatagaagaaaaaaattgcaaaaaaatgaaatttttcgaaataataagaaaatgaaaatttttcaaatttttgaaaaaattaagaattaaaaaaatgtataaaaagttgtgtaatttaaaataagaagtaaaaatttaatctaaaaggaggattaataaggagaacccttatttttaatattgtccctaatagatttgtgctgattgc

SEQ ID NO: 2447 - DNA, 20 bp, Methanobrevibacter ruminantium
tttttcaaaaatttgaaaaa

SEQ ID NO: 2448 - DNA, 20 bp, Methanobrevibacter ruminantium
ttaaggtttttaagccttaa

SEQ ID NO: 2449 - DNA, 20 bp, Methanobrevibacter ruminantium
ttagtcttttttaagactaa

SEQ ID NO: 2450 - DNA, 244 bp, Methanobrevibacter ruminantium
ctaacaatatttgcaaggccttatttttttaaatatttatcaaagatattgttttgaaattttaagaataaaatgatatataaaaataatttaaacttatcttttctttcaaatcaattcgatttaattaaattttagttcttttcaaactttttggatatatttatatataatatataagaaagattaaagtataataatttgaatggaggtgaaaaatgaataaggttcaattgtcctccat

SEQ ID NO: 2451 - DNA, 279 bp, Methanobrevibacter ruminantium
tatctttgataaatatttaaaaaaataaggccttgcaaatattgttaggacaaaacaaaaaattataagaatatcaaattatacaaaatatataagaaaaagattatttaactattctaatgaatatttataaaaattgaaattggacagttaaaaaaaaaacatgtttaaaagaatttatttcattaaaaataaagaactataagttatattataaaaataaagaactataagttatattataaaaataaagaatttgaattattatttttcttataa

SEQ ID NO: 2452 - DNA, 197 bp, Methanobrevibacter ruminantium
acaaaacaaaaaattataagaatatcaaattatacaaaatatataagaaaaagattatttaactattctaatgaatatttataaaaattgaaattggacagttaaaaaaaaaacatgtttaaaagaatttatttcattaaaaataaagaactataagttatattataaaaataaagaactataagttatattataaa

SEQ ID NO: 2453 - DNA, 20 bp, Methanobrevibacter ruminantium
tggattaaaagattaatcca

SEQ ID NO: 2454 - DNA, 179 bp, Methanobrevibacter ruminantium
atattaatttaactaataatcaattttaaatctctttttatcaatttaatatctttttaattatttgaaacaattaactatttttttcgctatttttgaattaactttatcatcaaatccatttccaataaaagattttataacttaatttaaacaatataataattatgataccaaaa

SEQ ID NO: 2455 - DNA, 23 bp, Methanobrevibacter ruminantium
ttaagtaattttttattacttaa

SEQ ID NO: 2456 - DNA, 236 bp, Methanobrevibacter ruminantium
ctgatttcatttatacaccatcgtaagaattaaagttaaaataaataaaactgtaagaataaagtaaaataaaaaaatttatgataaaatagctaaaataaataatctaaacaaaataaaccaataataattaaaaattaaataaataaataatttaaacaaaataaaacttaataaaaattaaaaattaaataaataaataatttaaacaaaataaaacttaataaaaattaaaa

SEQ ID NO: 2457 - DNA, 11 bp, Methanobrevibacter ruminantium
tttatcataaa

SEQ ID NO: 2458 - DNA, 243 bp, Methanobrevibacter ruminantium
ataggattcttttaattagttggatttagaaatatgaaataatatttaaaaagttttatttttttaaaataaaaatttaaaactagaatcagattaaataaggtaaaataaaattaagataaaaaattacaaaagtcaatgaaattatgaaaaaagtaatacaaaaattgtcaaaaatttctaaaaatagcatgaaacatttaaaattaagaaaatagtccaaaaagattgtaaaaaaaaata

SEQ ID NO: 2459 - DNA, 12 bp, Methanobrevibacter ruminantium
gcacaattgtgc

SEQ ID NO: 2460 - DNA, 197 bp, Methanobrevibacter ruminantium
caaaaataagaaaaatattccaaaaaattaagtaaataactttaaataattaaaataaggccagaataaattaaaaaattataaaaatgattaaaaaaaagttaaaaaaaccaaacaattaaaattcatttaataagtaaaaataggaataaaaataataattaaaataagataaaaaaaaagttaaaaaaagttaa

SEQ ID NO: 2461 - DNA, 204 bp, Methanobrevibacter ruminantium
gttaaataatcctattttttcattcttttttttttaaaaatctagaaattttatggtttttaatagtttatcttgaatatttaaataaagtgaaaatcattatataataattaaaatataattaataataattaattaaataacattttaatataatagattaaaaaggtgagtaaaacgaataaaaagaaattatttttatct

SEQ ID NO: 2462 - DNA, 184 bp, Methanobrevibacter ruminantium
aaaaaaagaatgaaaaaataggattatttaacttaaaaagaaattaaaaaaaagaatgaaaaaaataggattatctaactttaaaagaaaataaaaaaaagaatttttaactttttaagtaaattaaaataaaaaaagattattagggtttaaaaccctaaaatactattttattgttagtttt

SEQ ID NO: 2463 - DNA, 28 bp, Methanobrevibacter ruminantium
tattttagggttttaaaccctaataatc

SEQ ID NO: 2464 - DNA, 19 bp, Methanobrevibacter ruminantium
ttagggttttaaaccctaa

SEQ ID NO: 2465 - DNA, 240 bp, Methanobrevibacter ruminantium
caatcattatatatttattttcaattaattttttagatatttcaatattagtccatttcaatatttttaagagatattgaaaaaaaatatttgattatttgaataatattcacaattaagttcctcaagacagttttacttttgcagaatctaaaaaaatatcaatatattaacaactattatataataatagtactatatataataatgttaaacgattaaccataataaaaattataa

SEQ ID NO: 2466 - DNA, 254 bp, Methanobrevibacter ruminantium
aaactgttttaaaaaaacagaacaaaatttaaactttaaattaaaactaaaattccgatgaaacaaattgttttataaaaacagaaaaaaatttaaactttaaacctatttatacaatttaagataaaataaaaaatagagattttaaaaattctaaaaaaaatgatatcactaaaatcttaattgtcaaattaatataaaaaattattaaatttataaaaaaattataattagcaaattttaaaaaaaaaatt

SEQ ID NO: 2467 - DNA, 210 bp, Methanobrevibacter ruminantium
taactattttaattatttttaattattttttaatttaaaaagatttaatctattttttataaaaaaagaagaatttgaaatttataataatagataaaattataaatttcaatttttaatttttaactgtttttagaatttatttataaatttaaggttttgtgctgtttttaaatttaaataagtctaattcaaattataaattataaa

SEQ ID NO: 2468 - DNA, 38 bp, Methanobrevibacter ruminantium
ttgaaatttataataatagataaaattataaatttcaa

SEQ ID NO: 2469 - DNA, 24 bp, Methanobrevibacter ruminantium
ttagggaagtttatacttttctaa

SEQ ID NO: 2470 - DNA, 506 bp, Methanobrevibacter ruminantium
aattgttaatataaattttaaatcattattatcttaaaacaatcattaaaataaaaaaaaattaattaaattttaaatcatgtttagcttaaaaaaatcattgaaataaaaaaattaattaaattttaaatcatgtttagcttaaaaaaatcattgaaataaaaaattaattaaattttaaatcatgtttagcttaaaaaaatcattaaaattaaaaattaaaaaaataattgatttgaattgattaaaaataaaaatttttaaaatactgtttgagactagtttagaaagtctattgagctctgaacatggttttgactgcaccgcataatgggcaggtgaaatcgtcaggtacatcttcccattcggttccagcagcaagatctcttctttcttcaccagtttcactgtcgtatacatatccgcaaatagtacatctgtgttgagccatggcattacctccctaattatttataattatagtttgaatttaataatatataaaa

SEQ ID NO: 2471 - DNA, 325 bp, Methanobrevibacter ruminantium
aattaaacttaattaaatttttagaatttttttaataaaaatctataaaaattttagccatcttttaattaaaatttataaaattcttaaggatttttttaattaatcttttattaatttatactacatataatttatattagttaatatttaaaaccttttattaaattataaaaataataattattcaagttaaaatattattttaaaaactagtatttgaattaaaaaaatagaaaaaaacaagattaaaatataaatccacaataaaaaattaaaaaagattaaaaatgggatgaaaaatagaaattaagaaaaattaaaa

SEQ ID NO: 2472 - DNA, 336 bp, Methanobrevibacter ruminantium
aatatagtataattatattaaattgtattaataatatatgacttttaaaatatataaaagtttttaaaattttcttaaaaaatgaattattcgttaaaaattcttatttgttaaaaagaaagaaaaatttggatttttttatttagattgattttaatggatttaatcattttaaaacctatgaaaaataattaataagattaaaaagggtttataagaattaataacatttaataataaacaaatccaaatattatatagaactagaataaattttatctaataaatcccaaaatgtattgttaagaggtagaaacatgggaatgaagaatctaa

SEQ ID NO: 2473 - DNA, 26 bp, Methanobrevibacter ruminantium
taggatttggattattccaaatccaa

SEQ ID NO: 2474 - DNA, 246 bp, Methanobrevibacter ruminantium
tttagaaagttttaataaaaaaaagctcattttaaatagttgtcaaataaattgacaactagattaaaacttgataaaaagattatataataaatataaattaaaaaaagtgaaattgaataataaatttattaaatgagttatttttaaaaataaatttattattgagtgtttttatgtgaataaatttattaaaattatttattagaataaatttattataaattgtttttatgtgaataaatt

SEQ ID NO: 2475 - DNA, 25 bp, Methanobrevibacter ruminantium
tagttgtcaatttatttgacaacta

SEQ ID NO: 2476 - DNA, 131 bp, Methanobrevibacter ruminantium
taaaaaaagtgaaattgaataataaatttattaaatgagttatttttaaaaataaatttattattgagtgtttttatgtgaataaatttattaaaattatttattagaataaatttattataaattgtttt

SEQ ID NO: 2477 - DNA, 378 bp, Methanobrevibacter ruminantium
ttaccatgttaatcaccaaaataattttgtacaattttttcattcaaattttgtacatagttaataattaaacttaatactatataaatgtatcttttttttagaaaaaaataaatttctatcgatttccttattttattcatatcgtaaaaaataaagtcaaaaataagttcaatatgaaaatgtaaaaactattgcatattaataaaataaaaaagcatgaaaagattgattcgataaaaataggtccccgaactataaaaaaggacatagcgaaaaatgaaaaagctaagaaaatcaaaccaatattcaaaaaagatataaaaattgtttaaaactataaaattttaataatattgtataaaaattagatataaa

SEQ ID NO: 2478 - DNA, 251 bp, Methanobrevibacter ruminantium
tttataatgttttaaatattgcttgttatcaaatatagcataagttaattgctttttctaaaaaaaaagaagtaaaaattagcaaataataaaatttacggcttttttataattttttatcgaataaaaatataacagtgttatataataaattaaaaaaatataattaaaaaaggaattagccttttttaaaagattaattatataaatcttttcttttaaagatttagccttttttaaaagattaatta

SEQ ID NO: 2479 - DNA, 15 bp, Methanobrevibacter ruminantium
tataacactgttata

SEQ ID NO: 2480 - DNA, 26 bp, Methanobrevibacter ruminantium
ttaaaaaaggctaattccttttttaa

SEQ ID NO: 2481 - DNA, 261 bp, Methanobrevibacter ruminantium
agtaagtattaattaaccatattgattatttaaattttatttgtatttaatttaatataaatatttttattttgcatgaattttataaaattaaccaattaaagaactaaaaaatgaacatatgaataatattagaaaatagtttaataagtgagtataaaaataaggataattaatctaataaaataaaaaatagagtaaactaagacagaatagcctaaataaataaaagatagagtaatctgagatagaactatctct

SEQ ID NO: 2482 - DNA, 364 bp, Methanobrevibacter ruminantium
atactatattaaatatgttcgtataatatataaatttatcgattctatagatttttaaatctaaaaaagtgtttattaaaaacaactataaaaacacagctatttttaaaatattatacagagattaattaattttagaaaaaacaaattgattttatattttaagacaaaagcttaaaaattagaatttttctaaaaatttaatcaattaataagattaaactataaaattaaaaaactaaaaaattatcttaaaaatcattaaaaactatgaaaattctaataaaatttgaaaataatcaataataatatagcaaaaccaaattaatattattaataattatattttatatagtatataaag

SEQ ID NO: 2483 - DNA, 322 bp, Methanobrevibacter ruminantium
attccttgattgattttacattaaaacaatccctattaaacattcattttaaaaattcaattgatatatttatttttcattttatgctataaaaactatactatgttacataattaacattaagtgaatttattaaaaattagtaaaatattattaaaataaactacataaataaaattgaaattgatttataagaaaataatattcaatctattaattgattaaattaattaaaatcattgatttttttaatttaaatctactaaatggtttcaaggtgctgattttgaaaattaagaaaagatattttttaaagaagaag

SEQ ID NO: 2484 - DNA, 39 bp, Methanobrevibacter ruminantium
aatatagattatgatttattttaaattataatctattta

SEQ ID NO: 2485 - DNA, 31 bp, Methanobrevibacter ruminantium
tagattatgatttattttaaattataatcta

SEQ ID NO: 2486 - DNA, 40 bp, Methanobrevibacter ruminantium
gttttagagcttgaattaataaaaatttaagttctaagac

SEQ ID NO: 2487 - DNA, 172 bp, Methanobrevibacter ruminantium
aaatctttttatttttttaatttaaaactttttctttttttatttttttaatttaaaactttttctttttttatttttttatttataaaatcagtttaattgttatattttatttttttcttttttttaattttaaagtcttagaacttaaatttttattaattcaagctct

SEQ ID NO: 2488 - DNA, 308 bp, Methanobrevibacter ruminantium
ctttaaaattaaaaaaaagaaaaaaataaaatataacaattaaactgattttataaataaaaaaataaaaaaagaaaaagttttaaattaaaaaaataaaaaaagaaaaagttttaaattaaaaaaataaaaagatttaagatattttaagtctaaatcttacttaaataaaatatttaagtctataactcattttttaacctacttttaatgatttcacgaatctctctgttttgagcatataaattcagactatccaactcttttttacttaaaagattattgtctttgatcatatcaataggctt

SEQ ID NO: 2489 - DNA, 31 bp, Methanobrevibacter ruminantium
aaaatcatgaaaaattctatttcatgattta

SEQ ID NO: 2490 - DNA, 23 bp, Methanobrevibacter ruminantium
tcatgaaaaattctatttcatga

SEQ ID NO: 2491 - DNA, 23 bp, Methanobrevibacter ruminantium
tcatgaaatagaatttttcatga

SEQ ID NO: 2492 - DNA, 214 bp, Methanobrevibacter ruminantium
tttctcttataatagtttaaacattgaattaaataaatttatgtaaattagtaaaaagttaaaaattaaaataaaaattaaaaattaaataaaataaaaaaaaagatataaagattaaaaattaataatttctctttaaaatcaataaatcaagagaaaaatgataatcatgctaaattagcatgattaccctcaatgatttaaaaataaataa

SEQ ID NO: 2493 - DNA, 31 bp, Methanobrevibacter ruminantium
gggtaatcatgctaatttagcatgattatca

SEQ ID NO: 2494 - DNA, 29 bp, Methanobrevibacter ruminantium
ggtaatcatgctaatttagcatgattatc

SEQ ID NO: 2495 - DNA, 24 bp, Methanobrevibacter ruminantium
taaattgtattcctatataattta

SEQ ID NO: 2496 - DNA, 115 bp, Methanobrevibacter ruminantium
tggcagaataactcctttaaagaagaattcatttttaaaattatccagaggtgaaggaggagcagttatttactgttctttctaatttttttctctttttaaaaaaaataaaata

SEQ ID NO: 2497 - DNA, 81 bp, Methanobrevibacter ruminantium
tgaattgattaaaaataaaatttaaaaaaaaattactatctatataaaaaaataaaattagaaataattttttaggtcatt

SEQ ID NO: 2498 - DNA, 241 bp, Methanobrevibacter ruminantium
ggacatagttaaagaagcggataaactaataaagataattgaaactggtaaataaaaaaaagttttaaattctaaaataattctttaaatatttaaaataagaaaaaagagtttttagaaataaattgattcaatatttaatttatttctatttaaatataaatttaaaaaatagcaatagtcagttgtttaattaaacaactgattaagcttattgtctgtttttgtaaagagttcattt

SEQ ID NO: 2499 - DNA, 30 bp, Methanobrevibacter ruminantium
taatcagttgtttaattaaacaactgacta

SEQ ID NO: 2500 - DNA, 24 bp, Methanobrevibacter ruminantium
tcagttgtttaattaaacaactga

SEQ ID NO: 2501 - DNA, 395 bp, Methanobrevibacter ruminantium
taaatctaataaaaagaacagttctaataaggaatttaaggattctaaaaaagataaaaagtctaagaattctaaagacaataaatctgagagttctaaaaaggataaaaaatccaataaatctaataaatataataaatataataaatctaataaatataataaatctaagaaatctaataaaaataataagaattcaagttcaaagaacaaaaatgataattctaaagattctaataaagataaaactaatcataaagagtctaaatcagaatctaatcaatctaaaaacttagaaaaagacagccatcctatctctaaggactataagaattcaaatgcatctgtctctgatgatttaaaggactattctaaaaaagtaatgtataataaaa

SEQ ID NO: 2502 - DNA, 25 bp, Methanobrevibacter ruminantium
aagaataagtttataacttattctc

SEQ ID NO: 2503 - DNA, 21 bp, Methanobrevibacter ruminantium
gaataagtttataacttattc

SEQ ID NO: 2504 - DNA, 27 bp, Methanobrevibacter ruminantium
ggtttatctaagttatttagataaaca

SEQ ID NO: 2505 - DNA, 25 bp, Methanobrevibacter ruminantium
gtttatctaagttatttagataaac

SEQ ID NO: 2506 - DNA, 255 bp, Methanobrevibacter ruminantium
tttagtttctaatcatatataaaccttttggaaaaatggataagaataagcaaaataccaaattgagcaaaaataaacaattaatcttaaaaatgaataaaaaatagacaatttagaaaaataagaataatattgattaagttaattaaataaaaaataactaaaatcaccataatatataaatactaattaatattaaaattataattgtattattgatatacaagaaatattaataaaaaaataaaattttaa

SEQ ID NO: 2507 - DNA, 230 bp, Methanobrevibacter ruminantium
cattctagataaaaagaaaagaatagacagaataaaacattataatattagaattagctttatttaaataaaacaaatcagaattaacctttatacaaataaagtattgaaaattacaataattctaaaaattgaagaaggttaatgataatacaaataatataaaaaaaaaaaaaattaaaaaaaaaattttaagaaaaaataattaaaaaaaataattataataatta

SEQ ID NO: 2508 - DNA, 300 bp, Methanobrevibacter ruminantium
ttatgatgattataaagaaatatttttcaactagcttaaaaagtcttttcatagatttatatttgttgaatagatagataaatttttagtttaaaaattctcttaaaacttgaaggaataattaaaaaaatcatagggatattgaaccgtgacaaaatatcacactttgaacttcatgcatgaaaaaattaaatataaaatttaaaatgagttatgatatgtatagatgacatataaattattaaacaaaaaaatatgaaactacaataattttaaaataaaactttattaaaataaaca

SEQ ID NO: 2509 - DNA, 115 bp, Methanobrevibacter ruminantium
taattaaaaaaagaattattgtatttgttaaaaaaaaattattgtatttgttaaaaaaaataaaaaaaaataaaattaattggccaattaagaccaattaaaaatattcacctaa

SEQ ID NO: 2510 - DNA, 26 bp, Methanobrevibacter ruminantium
ttaattggtcttaattggccaattaa

SEQ ID NO: 2511 - DNA, 24 bp, Methanobrevibacter ruminantium
acgattatttatttaaataatcga

SEQ ID NO: 2512 - DNA, 22 bp, Methanobrevibacter ruminantium
cgattatttaaataaataatcg

SEQ ID NO: 2513 - DNA, 22 bp, Methanobrevibacter ruminantium
cgattatttatttaaataatcg

SEQ ID NO: 2514 - DNA, 23 bp, Methanobrevibacter ruminantium
gaaaagagatttaatctcttttc

SEQ ID NO: 2515 - DNA, 13 bp, Methanobrevibacter ruminantium
gagatttaatctc

SEQ ID NO: 2516 - DNA, 51 bp, Methanobrevibacter ruminantium
ccttcgctcaagctttttaaggcctacggccttaaaaaccttgaccaaaaa

SEQ ID NO: 2517 - DNA, 49 bp, Methanobrevibacter ruminantium
cttcgctcaagctttttaaggcctacggccttaaaaaccttgaccaaaa

SEQ ID NO: 2518 - DNA, 47 bp, Methanobrevibacter ruminantium
ttcgctcaagctttttaaggcctacggccttaaaaaccttgaccaaa

SEQ ID NO: 2519 - DNA, 320 bp, Methanobrevibacter ruminantium
tttctatcatattatcatctttaaataaaaagaaaaattgtaaattagtgttgtctataaaaaacctaatatttaattgttattttatcttttaaaacatattaaattggattaaaagtaattatataataattaagcaaaggtattatttaaagtttaagaaaagtttgtctaatgagtaaaaaggcaaagttttgttaaataagtaaaaagagtaaaatcaatttatactaaaattcaataattaccaaaaaataagataaaaaaataattaaaaaagaaaaaatagaataaaaatataataaaaaagaaaaataaga

SEQ ID NO: 2520 - DNA, 39 bp, Methanobrevibacter ruminantium
ttaaggattaatagattattaaaatctattttttcttaa

SEQ ID NO: 2521 - DNA, 252 bp, Methanobrevibacter ruminantium
ttttcttgatgtggaaataagcatattatcactttaaaattgtataacaagtttaatttattgataaatattaaaaattattatgataaaacttcaaaataaataaaataatctaaatgaataaaaacactagtaaaataaaagcgcataataaaataagttaaaaatagttaaaaataactatttagctaaaaaatagtttaattaattgttaaaaaaggttataagctaaaatagttattaagataatta

SEQ ID NO: 2522 - DNA, 166 bp, Methanobrevibacter ruminantium
actaatttctaatttaattaatcttaattaattttagttaatttattaattttaattaatttattaattatcttaataactattttagcttataaccttttttaacaattaattaaactattttttagctaaatagttatttttaactatttttaacttattttat

SEQ ID NO: 2523 - DNA, 204 bp, Methanobrevibacter ruminantium
aataaatagttaaaaactaaatgaatactaattaaatagttaaaaactaaatgaatactaattaaatagttaaaaactaaataaatgctaataaatagttaaaaactaaatgaatactaattaaatagttaaaaactaaataaatataataatacattatgtaaataaaataaatataattaataaaaatatataaatataaaa

SEQ ID NO: 2524 - DNA, 455 bp, Methanobrevibacter ruminantium
tttattttttattaattcaaagaatgtttaaatataaattatggtgaaacttttatttttttaatgccgtaatttagaatcgtagatggaaaatataatggattatttgatttgaaaagattgatttttaattattctttattaggataatgaattcgtagactataacaaaaagtatccaattaaacaatcaattaattattgaaacttatcagattctttttattaagtcatgaaaaataattgaagttttaattttaagctttttttgaatgaataaaatagatatgtctttgtattatgaattgattggattaaactgatattcactttaatagtttcttgattattggttattttcctaagacagttgaattattaaatttataatatttaatatatttaaaagattttaaatttaaaaaaatattttaaaagattttaaattttaaaaa

SEQ ID NO: 2525 - DNA, 175 bp, Methanobrevibacter ruminantium
ttattattttattattataaatcttattttatataagtttttttaaaaatcaagcacaattattaaatatttcacggttttaagtcatttttgaatattttgataattttatattttccttattttttatctcttttttaagtttaacatggtgaactatagaaatattatttta

SEQ ID NO: 2526 - DNA, 26 bp, Methanobrevibacter ruminantium
ttatcttatattttcatataagataa

SEQ ID NO: 2527 - DNA, 97 bp, Methanobrevibacter ruminantium
tgttatgtttttttttaaaaatagaacaacttatatttttttaaaaaaagaatttaataatgtctgtttttttaaatggctaaagataaaatatctt

SEQ ID NO: 2528 - DNA, 31 bp, Methanobrevibacter ruminantium
gtgaaaaaagattaaaataatctttttttaa

SEQ ID NO: 2529 - DNA, 29 bp, Methanobrevibacter ruminantium
tgaaaaaagattaaaataatcttttttta

SEQ ID NO: 2530 - DNA, 13 bp, Methanobrevibacter ruminantium
gattaaaataatc

SEQ ID NO: 2531 - DNA, 285 bp, Methanobrevibacter ruminantium
aggacaatatttaaaatgtgttttgattaatcgttttagtttaaataaattgaattaataaattgtttaaaacaatttgaggtatcattcttaatttttgagttttacgtttttaattaattatttaattattaatcaaattttaaatattatagtcccataagagtttaataatacacgttaaaaattagttttaatgcaaaggcatgataaaacttatagtaaaatttctaacgtaattatatatttacaagtaatcatttaaaaagtttttgtataaaatta

SEQ ID NO: 2532 - DNA, 18 bp, Methanobrevibacter ruminantium
gtggagtttttactccac

SEQ ID NO: 2533 - DNA, 339 bp, Methanobrevibacter ruminantium
attcaattttaaaaatttaaaattgaaaatcttagtacttatataaatatagtaaaaactattatttaaactttcttaaattttcagataggcaaaataaaaaatcaaataatttaaattacattttattaaattttatttataacaaaatcaaataaagagtaacttgaataaatgctaataaaataaagaaaatacttaattctaaaagaaaatccatcatagatatcacctcccaacaatagtcaggaaagtaccaagatcctgcttaagaaaattcagatatctagataaattacttgattaataaattgcctaaaaatagtttaaaaatactta

SEQ ID NO: 2534 - DNA, 378 bp, Methanobrevibacter ruminantium
cagttttggttccttttaaatctgccatgataatctctcctatattttttttaataacaaatcctaattcaattcattgtttaaaaacatgatataaaaaaggacaaatcctaatccaaatcaccgttaaaaacaaatgatccaaataaaatataaaaaggacaaaatcctaattcaattcaccatttaaaaacaaatgatccaaataaaatataaaaaggacaaaataaattattttgaatctttttatttaggataagttattaaatataatttagtttcatagtataaaaactttttgaaaatcttttggaatattaaaaattaaaaattaaaataatttaaaaaattaattaaaattaattatgaaattaatta

SEQ ID NO: 2535 - DNA, 192 bp, Methanobrevibacter ruminantium
attgataatttatcctttgattaatgaggcacagattaactttattaattaatttcataattaattttaattaattttttaaattattttaatttttaatttttaatattccaaaagattttcaaaaagtttttatactatgaaactaaattatatttaataacttatcctaaataaaaagattcaaaataa

SEQ ID NO: 2536 - DNA, 361 bp, Methanobrevibacter ruminantium
ttgtgataataaaaaaatatttaattctatttatgttttaaaaattatttaaatattaatataaataattaagttattttaactaaagcaattgtataaaaataaatttattagaattaaaaaacattcatggaaatgacattttttaaaaattaaaatgaaaaaagagatagaaaatgaaattcaatgtaaattaaagaaatatataatgtttaaagaaaatttgaatagaaaaaaagaaaaataatcagttaagagcatttatacctataaaaacttaaatcaaacttttaaaaaagcctcaattactcccaactgagataaaaattttttatcaaggttttttggccgtaaggccaaa

SEQ ID NO: 2537 - DNA, 28 bp, Methanobrevibacter ruminantium
gcttttttggccttacggccaaaaaacc

SEQ ID NO: 2538 - DNA, 196 bp, Methanobrevibacter ruminantium
ttatttttttaaataaatcacttcaaataatcgtaaagatcataattgtttttaggcctaaaacaattaaaacatcttaatttagatgaaaattaactaaattaaatgtttaaataaataaaaaaaataattaagctaaaaagcttaattataattaatttaattttaaattgattctaaatcaattaaatctata

SEQ ID NO: 2539 - DNA, 24 bp, Methanobrevibacter ruminantium
taattaagctttttagcttaatta

SEQ ID NO: 2540 - DNA, 232 bp, Methanobrevibacter ruminantium
cttcactcattatatcacacaaaaaacctgtgaaaataaattaaaaattttattaatattagaaaatgaaaaaaaataaaaattaataaaacgataaaagttaatttattatcatatttatttttagcaatacacttattaaaactttattgaaattaaaaaatgatataatattttttaaaaatcaattggattttttaaaagaaatagtaaaaaattaataaaaaaatgg

SEQ ID NO: 2541 - DNA, 217 bp, Methanobrevibacter ruminantium
aaaaattttattaatattagaaaatgaaaaaaaataaaaattaataaaacgataaaagttaatttattatcatatttatttttagcaatacacttattaaaactttattgaaattaaaaaatgatataatattttttaaaaatcaattggattttttaaaagaaatagtaaaaaattaataaaaaaatggatgatttaataaaatttaaattatatt

SEQ ID NO: 2542 - DNA, 323 bp, Methanobrevibacter ruminantium
aatatatgtttttatataatattcattaaagattaattctttatcaatttgtttaataaatctagagttttgataaattttgattaaatattactttcaaatgattgaaatgtgatttttaatttactttcataattattagatttaaaaattcggaggagattttattaaaagagcagttattcttttaatcttattaatctctttatcctgtttgtctattgttagtgcaaacgatttgaattcaattgacgattccattgaagcagataatctaaattctattgaaattgaagacattcaagttgattctgtagaatcag

SEQ ID NO: 2543 - DNA, 245 bp, Methanobrevibacter ruminantium
taagaagacttttaaaatagctgattcaattgaaaaggtctttaaaatcttggaaagagaatgaaaattgttaaaaaataaataattataataaaaaaaatagaactataaaaagaataaataaaaaaaacaagcctaaaaacaagaaaataaaaaaaatagaactataaaagaataaattaaaaaataagaaatttaagaaaaataattttaaattaagggaaaaagaatcatttaaaaaataa

SEQ ID NO: 2544 - DNA, 398 bp, Methanobrevibacter ruminantium
tttattaaataattaaccttactctttttctatttttatttttattaaataattaaaatcttatccttttttctattttataaattatcaaatcatatcctaacttttaacttgtttcaatgtgaaactatttattatattcttaatgaaatgataattttatttaaaaaagtaaataaactaatttaactaaaataaaaagaaaaataagcaaatccagtgaaataaaaagaataaaataaatctaactaaaagcagataatacaaataatttaaaaaagaaccctaataagtttaaaaaccttataaagaattaaaaaaagataaaaacagtgattaaaaaaattaaatattgtctttttaaaaaagccataataattgaattttaataaaaatgg

SEQ ID NO: 2545 - DNA, 81 bp, Methanobrevibacter ruminantium
tttattatattcttaatgaaatgataattttatttaaaaaagtaaataaactaatttaactaaaataaaaagaaaaataag

SEQ ID NO: 2546 - DNA, 369 bp, Methanobrevibacter ruminantium
ctaataaaataataaaataaatattccttttcataatttcaccaaaaagtaaaaatatttaataaaattttattcctataaaaaataggacacattataatatatgataatgcatatataaatttttctaaatatttatagtttaattatgtctcttaaaaaaaaattttaagataggaaaaaatatgttggtggataaaaatcgttagtatagtttattattttttaccaaacattcttttatctttaagagaaatattcatttatttttttcttttaaaactataatgcatccataaaaacatagtttacaaaaatgtttcaccattaaataattaataagaagtcttaacttttaatcataaaatt

SEQ ID NO: 2547 - DNA, 162 bp, Methanobrevibacter ruminantium
ttttcttttttaagcttttttataatttagtatttggattatttttttatataaatcatttattttaatttttttttaattttatgattaaaagttaagacttcttattaattatttaatggtgaaacatttttgtaaactatgtttttatggatgcattat

SEQ ID NO: 2548 - DNA, 105 bp, Methanobrevibacter ruminantium
agtttaaataaaactaaaaaataatcttaaaaaaatagcttaaaaaaataaaaaataaacttaagataagcttaaatatactcataagataaacttaagatttta

SEQ ID NO: 2549 - DNA, 59 bp, Methanobrevibacter ruminantium
tataaaaaaagtataaaaataaattatataataaaaaaaacattaataaaagactaaaa

SEQ ID NO: 2550 - DNA, 227 bp, Methanobrevibacter ruminantium
gacaaaatttaataaagaaaattaaatttaaaaaatttttaatcgaataatactaaaaaaacgaaatattattactaaaatgaaaatttaaagaaaggggaatgatttttttaggcactcctaaaaatcatttagaaaagaaaccatcactaaattattcaaaatattaaaatagtattaaattaaaaaattataataatatgaaatagatttaattatgaaaatta

SEQ ID NO: 2551 - DNA, 199 bp, Methanobrevibacter ruminantium
aaaataggattttagttaaattttataagaactattaaaaaaaaagaaatattataaaaaattattaaaaaaagaaatattataaaaaaaactactcaaaaaagaaaaagagaaaaatatggcaattgaccatattttttttaattaaaaataatttaaacttattttatattaatatagctagtagcgctagctgcat

SEQ ID NO: 2552 - DNA, 275 bp, Methanobrevibacter ruminantium
atataataatattttattataatatacttaaataaatttctataatcttattatatttttaaatataaattaacaaaaaggagttaaattgtaaaaaatcttaacaattaaataaaataaggcataaaaattagtaaaaaaaactgaacaaataaaaagaaaaaagtgaaaataaataaaaaataaaaaaataaaagttaagtgcaaagcacttaatatgaaaaaaaacttttttaaaattatttaaataataatccaattaaaacaatttagaa

SEQ ID NO: 2553 - DNA, 21 bp, Methanobrevibacter ruminantium
attaagtgctttgcacttaac

SEQ ID NO: 2554 - DNA, 19 bp, Methanobrevibacter ruminantium
ttaagtgctttgcacttaa

SEQ ID NO: 2555 - DNA, 320 bp, Methanobrevibacter ruminantium
tcattttgattaatctttaaatcatttgaattatcctttgaattaaatgaattttcctttaaatcgatagacttatcattaattttaaagtcagaaacatctatattatcatcgatataaatagaattatctataatattatctgaagcaactgcacttacagaaggaattataattaaaataactaataaaaaagcaaaaaatgataatttttttagtttttccttgatattgcacctcctataaattttttaaacatatatatttaattaagttttaaataataacttatagtttaaatttatattttaacaatatat

SEQ ID NO: 2556 - DNA, 13 bp, Methanobrevibacter ruminantium
gttaaaatttaac

SEQ ID NO: 2557 - DNA, 303 bp, Methanobrevibacter ruminantium
aaaacttcttattaaataaaaatcattaccttttaattaaaaaattaaattcattaaaattataaatacaatatataataatttaaaaaatttaaatttttatatataatatactatagtatattcgattatatatattaactttattatttttttaaatagttttattaatacaaaacaaattttttattattttttaaatagttttgttattatagaacaaattttaaatctaatgatcatgattttttgacatttttaaaaatgaacaaaatataattcaaaaatgttttaaaaagcaaa

SEQ ID NO: 2558 - DNA, 29 bp, Methanobrevibacter ruminantium
aaatatttggttaaaataaccaaatattc

SEQ ID NO: 2559 - DNA, 23 bp, Methanobrevibacter ruminantium
tatttggttattttaaccaaata

SEQ ID NO: 2560 - DNA, 23 bp, Methanobrevibacter ruminantium
tatttggttaaaataaccaaata

SEQ ID NO: 2561 - DNA, 73 bp, Methanobrevibacter ruminantium
gggctggtagctcagatgggagatcgtcgccttggcatggcggaggccccgggttcaaatcccggtcagtcca

SEQ ID NO: 2562 - DNA, 21 bp, Methanobrevibacter ruminantium
ttaagttttttaaaaacttaa

SEQ ID NO: 2563 - DNA, 189 bp, Methanobrevibacter ruminantium
tttatttttttcatttttaagtcaaatcttatgtttaattttttattaactaatttaactttttatttttattcaaattaaaacttttgttatttatattcttcattggacaattttggacattatttttatttttttctttgattggcaatgctttttaccataatctttatattagtttaattacat

SEQ ID NO: 2564 - DNA, 254 bp, Methanobrevibacter ruminantium
ataaaaagttaaattagttaataaaaaattaaacataagatttgacttaaaaatgaaaaaaataaaaacttataaaaaagtttatattatatgaaacaataatattatttaaaaatgaaattcatggaatatttttaatcagagaaacattaaataaactactgattttagctgataaattcaaaataattgaaatttttattatctatgaaattttattagctaatgaaattatgattaaactaaagattatt

SEQ ID NO: 2565 - DNA, 51 bp, Methanobrevibacter ruminantium
ccttcgcccaagcttttttgagccttcggctcaaaaaaccttgaccaaaaa

SEQ ID NO: 2566 - DNA, 47 bp, Methanobrevibacter ruminantium
ttcgcccaagcttttttgagccttcggctcaaaaaaccttgaccaaa

SEQ ID NO: 2567 - DNA, 25 bp, Methanobrevibacter ruminantium
gaatattagattatttctaatattc

SEQ ID NO: 2568 - DNA, 21 bp, Methanobrevibacter ruminantium
gtaatggattctatccattac

SEQ ID NO: 2569 - DNA, 277 bp, Methanobrevibacter ruminantium
tttcattgcaaatcctttaaaagttgccattttaacacctcaaaaatataaaaatatttaaaaaaaatctattcattgttttctaaaaacaagaaaataaagatgttttaaattataaaaaacagtgaaatctttaaaaaataaagatttaaaacctatttaaaacagtgatttcctaaaaatacaatattaaattgatttattttagaaaaaaatagattttatataaatactttctaaataaagatttagaataaactatatataaaatttacta

SEQ ID NO: 2570 - DNA, 392 bp, Methanobrevibacter ruminantium
ttttgattttcatgatgtcaatttcaatccaatccgaaaaaacaatatttaattaaaaaaatttaataaaacaaaaaaattcaaaaccaaaaataaaaatcaaaacttaacccaaaaaaataaaaaagatacaaaaaaatcaaacaaaacaaaaaaattcaaaaccaaaaataaaaatcaaaacttaacccaaaaaaatgaaaatgatagggaaaaattatactaaacaagaaaaataatgaaaatgaaaatcaaaaacaaagtcttgataaaaaaacaagttagtgataaaaattcaagttggtgataaaattatttaaaaattgaggattgaaaattattaaaattgtttaaaaaataaaaataaagatatatatttaaataaataaaaa

SEQ ID NO: 2571 - DNA, 222 bp, Methanobrevibacter ruminantium
ttttcttcttcaaatcgatttgtcaaaatataacctcctcaaactatacttatatttatataataaaaaatatttaaactttataattgtttaataaattaagaataaaatgaataaatctataaaacttaactgaattaatatataaaatataacgaaactaaaaattagagaaatatttaatattaaaaaagaatatctaaaagctaaaaagaattagag

SEQ ID NO: 2572 - DNA, 339 bp, Methanobrevibacter ruminantium
atataatattaaaaaagaatatctaaaagctaaaaattctataaaattaaaatcaagcaaaacaaaaaaataatataattcttagacaaaaatagtaaaataagaataaaatggcctcagatcgcccatcattcatcacatatcagagctcatagggttcatcacaggccatttaatgaattaaagatagtgaatctaaaagttaaaattaaataaaaaaaaaataaaaatttaaaaagttaaaatataagaagttaaaaagtttaaactttaagttaagaaattaagaactaaaaaaatttaaaagaaggtaaaaataatctttttttaaaaaaaaaa

SEQ ID NO: 2573 - DNA, 289 bp, Methanobrevibacter ruminantium
ttaattaattacattataaatttgattgttaagattttatcttttatattttacaactaaatgaataattcataagaattatttattttttattttacaactttaaaaagaaatagaaattctatttctttattttgcaactttaaaaagaaataagctattaaaaactaatatttctttattttacatattttagaaaaaattctataaatacatactacaatttaattaaactttgtcttttaaatagtttactaaattttagtccaaaattaaaatttaaattaga

SEQ ID NO: 2574 - DNA, 19 bp, Methanobrevibacter ruminantium
gaaatagaatttctatttc

SEQ ID NO: 2575 - DNA, 130 bp, Methanobrevibacter ruminantium
ttcttaatttttgtaagaaaaataaattaattctaatttttatctaaattagttttaaaattctttaaaaaaataaataaaaaatacaaacaattattttatgcttatattatgaaaaaattaaagaaat

SEQ ID NO: 2576 - DNA, 276 bp, Methanobrevibacter ruminantium
gttcatatataaatatattgcatttgaattatatatactttttaatcaatattgaatttttaatttaaatcataattttatataatccattaataagttaaatagagaaatataatcagaaaaaagttttattctaaaagctgtgaatacacctaaaataagttaaaaaaaagaaaagaatgataaaatagttaaaataagtaaaaaaagaattaaagattaataaaaaagaatttaatcaagtaaaaaaagaaaattaatgaaagaaattacata

SEQ ID NO: 2577 - DNA, 384 bp, Methanobrevibacter ruminantium
atttatactttaatttcaaaaaagagcaataaattacaattaaatgattaattaaaatacttaaaattttatttaaataaataatttaattaaaaaaacttttttgaattattattttatatattcatcatttttaccagtataatagtttatttctttttatttaaaaagattactatcaattaagtgatttaactttttaaaaaattatctttaaagatgaaataaaactgaaagcttaaaaaaaaactataaaattaatagataaaaaataactaaaatatgaaaataactaaaatagatggaaaaataagtaaaataaagcaaacaaaacaaaaataagaaaaagataaaaaaaagtaaaattaattattaaaaaaataa

SEQ ID NO: 2578 - DNA, 31 bp, Methanobrevibacter ruminantium
tttcataaatgctttcaaagcatttatgtta

SEQ ID NO: 2579 - DNA, 25 bp, Methanobrevibacter ruminantium
cataaatgctttcaaagcatttatg

SEQ ID NO: 2580 - DNA, 459 bp, Methanobrevibacter ruminantium
tcaaataactaattaaataaattgcataataagtttttaaattaatttaaattaagaattgaatttaaattaaagtttattaaatatttcaataaattattataaatataaatttaattgacatattattaatagttaactattaaataagaaaacagattttgaaaatgataaaaagagataaaaaaattaataaaataaaatagcttaaaaataaaataaataaattaaattaactcaaaataatagaaataaataaaaattagttaaaaaataaaaaaaaataacttaaataactcaataaataaaaataaataaaaattagttaaaaaataaaaaaaaaataacttaaataactcaataaataaaaataaataaaaattagttaaaaaataaaaaaaaaataacttaaataactcaataaataaaaataaataaaaattagtttataaaaataaa

SEQ ID NO: 2581 - DNA, 171 bp, Methanobrevibacter ruminantium
atttctattattttgagttaatttaatttatttattttatttttaagctattttattttattaatttttttatctctttttatcattttcaaaatctgttttcttatttaatagttaactattaataatatgtcaattaaatttatatttataataatttattgaaatatt

SEQ ID NO: 2582 - DNA, 231 bp, Methanobrevibacter ruminantium
aagtcattttaaacaccaatttgctttttagatgataattttaatttgatttaataataaaaacttctaaaacaattaaaactctatttaagtaattttaataaatttaaattcaaataaactaaaaattcaaaaaaactaaaaactcaaagaaactaaaaatttaaataattttaaaattcaaataaactaaaaactcaaagaaactaaaaatttaaataaactttaaat

SEQ ID NO: 2583 - DNA, 307 bp, Methanobrevibacter ruminantium
tgtttcacatacaatcagtgagataagaaatatctgtgaaaaggccatctggcttgaaaacggtaaaatcagagaaattggagaagtcaatgacatttgtgataagtatttggaagaagctaaaaaggtaagcgatgataagactaaaaaattaaagcctaaacggttttaaaaaaaaaagacattgtttatcttgaattgattaaataaaaaagaaataatgttctgaataaaaaaaagaaataatcttctgaataaaaaaaaaagaagaatttataagataaataatttttaaaattatttatta

SEQ ID NO: 2584 - DNA, 25 bp, Methanobrevibacter ruminantium
ctccttaaaggagttttttagggag

SEQ ID NO: 2585 - DNA, 13 bp, Methanobrevibacter ruminantium
ctccttaaaggag

SEQ ID NO: 2586 - DNA, 36 bp, Methanobrevibacter ruminantium
ttgaagattagatttaaaaattaatttaatctttaa

SEQ ID NO: 2587 - DNA, 355 bp, Methanobrevibacter ruminantium
ttaattagttaatcccttgaaagacaagtttcttcaagaaattaaatcatatctcttaaattagcttaagaaataaaattttaaattaattttattataataatagatatattaataaaaatatataaagataatgaaaaattaaaagatttaaaaaaagccataaaaaatagataaaattaataagcaagtaaaataagtaatttaaaaatagaagtatagtaaaagtgcaggggacgggaatcgaacccgcgaagggactaacccactaggccctcaacctagcgcctttgaccgctcgaccacccctgcataagataaaaatagatggtctaaataatacagtaatacataa

SEQ ID NO: 2588 - DNA, 84 bp, Methanobrevibacter ruminantium
gcaggggtggtcgagcggtcaaaggcgctaggttgagggcctagtgggttagtcccttcgcgggttcgattcccgtcccctgca

SEQ ID NO: 2589 - DNA, 515 bp, Methanobrevibacter ruminantium
aataatttttataaaaactttaagtaaatttttattatgaatatttataatttttctaatatttataataaatcattttatgaaaatttttaataaaattcataatttgttaataagaaaatatgaaaaaacataagaaataaaagccataaaaatagaatgattctaaaaaaaagatagttaagacttaaaaatagaaaaaaaagaataaattatagagtaaaatataaaaaaaagaattttaaagtttaataaataaaataaaaactaagaataaaaagtttaagataaaagaataaggctattaatcccaaatatttgagaatggattaaacaagtcatcagcctcatctaaatcatcatcctcatcataagagtaatccccattttcatcggattcatcttcatcagattcctctctaaatcctttaagagactttagattgaaaacatttatctcatctgaagggtcatctttagaattataggaattatctaaatcattttgattaaat

SEQ ID NO: 2590 - DNA, 254 bp, Methanobrevibacter ruminantium
aattaattttataaaaaaacttatcaaaatattggcctttaaaaaattctaatttgccaatattttgaaaattataaataaatataataataaattatttattttttattatatataatctttaggttaatttagtcaagaataaggaaaaatagggggctttttattaaataaaataaaaaattagaagaaaaaataataagtagttaatttaataaagaattagaaatctaaaaatcatatgagaaaaagtt

SEQ ID NO: 2591 - DNA, 49 bp, Methanobrevibacter ruminantium
atttaatccaccttttactggccttcggccagcaaaagctggaccaaaa

SEQ ID NO: 2592 - DNA, 47 bp, Methanobrevibacter ruminantium
tttaatccaccttttactggccttcggccagcaaaagctggaccaaa

SEQ ID NO: 2593 - DNA, 222 bp, Methanobrevibacter ruminantium
ttttataaattagttttaaaactttcatatataattaaattttagttttaataatttatataaatatctaatatatggaaaaattcttatgagaatagttttttaaaaaattagaataaaaatagttaaaataataattcaaaaagaataaaataagcgaatagattgaaaataataataaaaattagtaaaaataaagaaataagtaaaaaatgttaataa

SEQ ID NO: 2594 - DNA, 21 bp, Methanobrevibacter ruminantium
tgaataatcttaaattattca

SEQ ID NO: 2595 - DNA, 272 bp, Methanobrevibacter ruminantium
ttacatttttataattcaatattagtataaaaatgaaataataataaaatatttttaataaaaaatctttaatgtttgacaattttttaaatgataaacttaaacgtaaaacgtttaaattaagtaaatcaatcaaaatattgattttaaataaataattttagctaattagtttaaagaacaaataactaatcgaatcaataaataattttaaataaaatttaaaaaaatgaaaaataataaagaatgaaaaataataatgaaaattaatt

SEQ ID NO: 2596 - DNA, 177 bp, Methanobrevibacter ruminantium
tttgttctttaaactaattagctaaaattatttatttaaaatcaatattttgattgatttacttaatttaaacgttttacgtttaagtttatcatttaaaaaattgtcaaacattaaagattttttattaaaaatattttattattatttcatttttatactaatattgaattataa

SEQ ID NO: 2597 - DNA, 21 bp, Methanobrevibacter ruminantium
tttaaacgttttacgtttaag

SEQ ID NO: 2598 - DNA, 274 bp, Methanobrevibacter ruminantium
tataagttatgaatttaatttgttaataaaatacaattataataattaaaacagtaattgttaattttaaaataaaattaccttaagcgtagaaataagattccttagcttaaaaatataaattcatatattcaagatagaacaaataaaatttattattttaataattaaagcaattacagcaaaaaaatccagtaaaaaataatcaaaataaaataatcaaaatatacaataattataaaataatgaaatattctcattaattatagataaa

SEQ ID NO: 2599 - DNA, 145 bp, Methanobrevibacter ruminantium
aaaaaagatatttgttttagtttaatattttcaatgaatattattagtttaagtaaaattagctaataatataaaatttttcaatttagtattaatgaaataaattctagagaactagacattatattgttttgtttattatagt

SEQ ID NO: 2600 - DNA, 368 bp, Methanobrevibacter ruminantium
tgttttagtttaatattttcaatgaatattattagtttaagtaaaattagctaataatataaaatttttcaatttagtattaatgaaataaattctagagaactagacattatattgttttgtttattatagtatataaatgttgccaagaaaactagtttttaaaattaaaaaactaatgattaaagatcaaagagcatacagcctgagaaattaaatcaataaaaatagtctgattaaaaaaaataaaaaaataaaaaaaagaattaaaaattatcaaaaagataatttttaaaaagtattgctctaaagagcaatgttttattctctatattccgaataagataagataaaagtaaaaacttaaa

SEQ ID NO: 2601 - DNA, 29 bp, Methanobrevibacter ruminantium
ttaaaaattatctttttgataatttttaa

SEQ ID NO: 2602 - DNA, 214 bp, Methanobrevibacter ruminantium
aatagtttataaaattagtaaacaatttttcaaatcaaatcttaacaaaaaatataaaaaatatccaaatttcataaaaaattattttatcaaattaaaaaatattgaaaaatataaaaaaaataaaagattaaaagaaaaatatcgaaaatattacaaaaacaactaattaaaaaaggttttgataatcacgaacatttaaaaaattttataa

SEQ ID NO: 2603 - DNA, 250 bp, Methanobrevibacter ruminantium
attataagtttataataaaaaccaaccttaaaataaacacatatgattaaataaatagcaataaataattgaaaatcataaaaattaactaatttgtaatgaataaaacaaataaaaattaataattatttaaaataaaaatcaaaaaattattaaaaaaatcagataaaaataagcataaaatcataaaataaataaaaattaattaattaaaataagttttaatttcaatgattttaatttaaaaaaa

SEQ ID NO: 2604 - DNA, 183 bp, Methanobrevibacter ruminantium
ttaattttttttttaaattaaaatcattgaaattaaaacttattttaattaattaatttttatttattttatgattttatgcttatttttatctgatttttttaataattttttgatttttattttaaataattattaatttttatttgttttattcattacaaattagttaatttttatgat

SEQ ID NO: 2605 - DNA, 11 bp, Methanobrevibacter ruminantium
ttaaaatttaa

SEQ ID NO: 2606 - DNA, 22 bp, Methanobrevibacter ruminantium
tagttgggagtagtcccgactc

SEQ ID NO: 2607 - DNA, 18 bp, Methanobrevibacter ruminantium
gttgggagtagtcccgac

SEQ ID NO: 2608 - DNA, 322 bp, Methanobrevibacter ruminantium
ttataaatataattttcattctttttataattatttaattaataatttaaataagttttgtgtataattctaaaaaagatgttcattgcaaataaataaaagttaataaaaataagttatatgataaaaatattgaaaaaaaatagtagaatagaaatagtagaatagaaatagtagaatagaaatagctgaatagaagttaaaaattaataaatttaaaaattaataaataaaagaaaaaataagtaaaatagaaaataacagattatctaattataactatttataaaaatattatctgctaagtttctagaaagattta

SEQ ID NO: 2609 - DNA, 29 bp, Methanobrevibacter ruminantium
tttttagggggtttttaaccccatcaaac

SEQ ID NO: 2610 - DNA, 281 bp, Methanobrevibacter ruminantium
atatattcttaataatatatagtatatttttttatttttctataatttgaataaatttgtagatattttttatgattcttttaaaagaattcttaaataattctaaaaaaaatatttaaaaaatactttttaaaatcgctataaaaaaaatccaaaaacaaaattcattccatttacttaatcaaattaagaagaatgcctttttgattaaataaaatttaattattttgaattatttacaaatttgaaatattttttcaaattgattaattaaatattat

SEQ ID NO: 2611 - DNA, 322 bp, Methanobrevibacter ruminantium
ctattaatttaaaaaaataaaacaattaaagagtatttgaagtgaatgattaataattaagtagtattatccaaaaaacaatgaaataaacttgaaataaaaaaataaagaaaaattattaaaaaatcacaaaaagttataaaaattttaataataatttttcaatatattttagaattcctataaaaattctatataaaaaaaataatataatataaataaattatagtgatattttaattaaaaaaataaaaaatagttaataatttaaatttttaccaacccaaaaaaaacactattttttaaagtttgaaaaaataga

SEQ ID NO: 2612 - DNA, 128 bp, Methanobrevibacter ruminantium
attaaaatatcactataatttatttatattatattattttttttatatagaatttttataggaattctaaaatatattgaaaaattattattaaaatttttataactttttgtgattttttaataatt

SEQ ID NO: 2613 - DNA, 19 bp, Methanobrevibacter ruminantium
gaatagtttttaactattc

SEQ ID NO: 2614 - DNA, 23 bp, Methanobrevibacter ruminantium
tagttaagaatagtttttaacta

SEQ ID NO: 2615 - DNA, 13 bp, Methanobrevibacter ruminantium
ggatttttaatcc

SEQ ID NO: 2616 - DNA, 47 bp, Methanobrevibacter ruminantium
atgtagacaagcttttttggccttcggccaaaaaaccttgaccaaaa

SEQ ID NO: 2617 - DNA, 45 bp, Methanobrevibacter ruminantium
tgtagacaagcttttttggccttcggccaaaaaaccttgaccaaa

SEQ ID NO: 2618 - DNA, 260 bp, Methanobrevibacter ruminantium
ttataaagttttaacaatatcagtaatttgtaattgttttttaacaatttaaaagttttaaattgataatttattgaaatttttattaagaataagttaataactattaattaaattataataaattaaaaaaaaaattatatttaattatattaaattttattaagttatccatataattatagatgggtttgatttactataaaaaagttttgattgatagtaaaaaatctaaaaaaagtattatcaaaaaagataat

SEQ ID NO: 2619 - DNA, 28 bp, Methanobrevibacter ruminantium
gaataaattagattgatttaatttattc

SEQ ID NO: 2620 - DNA, 12 bp, Methanobrevibacter ruminantium
tgcttttgagca

SEQ ID NO: 2621 - DNA, 272 bp, Methanobrevibacter ruminantium
tttataacttatttaaaactagttaaacttttataacttatttaaaactagttaaacttttataacttatttaaaactagttaaacttttataacttatttaaaactagttaaactttttttaaactagacagactcttttaaataaaataagcaaatcaaaccctatttaaaaaaaataaactcattttaaaaataaaaatagaaaataagattaaaataacatttataacaaaaataataaaaatagactacttttttaaaaataaaaaa

SEQ ID NO: 2622 - DNA, 131 bp, Methanobrevibacter ruminantium
aaaaaagaagttttaaagatttattatttttaataaatctttttttttttttcgaaagaactctattttttaagatttatattttttaataatttttttttatttttaaaaaagtagtctatttttattat

SEQ ID NO: 2623 - DNA, 22 bp, Methanobrevibacter ruminantium
gatttattatttttaataaatc

SEQ ID NO: 2624 - DNA, 323 bp, Methanobrevibacter ruminantium
aaaaatttttttaaaattataaaaaaagtattaagactattttaaaatagtttttatttaataaatatttaattaaaggtttaaaaagtttattaatttaagaaaaaattaattaaatttaaaaaagtttatttaataaatatttatttaaaaatatcaatagcagacaaaaaactataaaatagctaatgcaaaattagctaataaactaaaatattagcagatttagaaactgaagaataagtgtcatcaccagcatactttacagtgaaagcataagtctttttagaagacaggctcacattaacactggcaataccttt

SEQ ID NO: 2625 - DNA, 135 bp, Methanobrevibacter ruminantium
aaaaaagtattaagactattttaaaatagtttttatttaataaatatttaattaaaggtttaaaaagtttattaatttaagaaaaaattaattaaatttaaaaaagtttatttaataaatatttatttaaaaata

SEQ ID NO: 2626 - DNA, 21 bp, Methanobrevibacter ruminantium
tagctaattttgcattagcta

SEQ ID NO: 2627 - DNA, 302 bp, Methanobrevibacter ruminantium
ttgttttgttttaaaaaactgtgaaaggaaaagtttttaattgaaaaaatagaattttgataaaaaattagatatttttccaaaatattagaatgatagttaaacttataaagtagaatataaaaaatttaaaatagtattaattataatataatacttaataaaaaattgcaattctacttcgttttatctcgatataacgaagtaaaatatttttctatctaaatttttataggaattaaatcatgtcaagtcaaaatatccagatttatgttgtatcccatagtgaagaggatatcaaa

SEQ ID NO: 2628 - DNA, 36 bp, Methanobrevibacter ruminantium
ttctacttcgttttatctcgatataacgaagtaaaa

SEQ ID NO: 2629 - DNA, 122 bp, Methanobrevibacter ruminantium
aaaagtttttaattgaaaaaatagaattttgataaaaaattagatatttttccaaaatattagaatgatagttaaacttataaagtagaatataaaaaatttaaaatagtattaattataat

SEQ ID NO: 2630 - DNA, 271 bp, Methanobrevibacter ruminantium
tttctatcattaaaatcttcatttttcaaatcattattttttaatttttgaatttccttatttattttttaggtatgactaaataaaacgcccataatattttatatggttaataataaattaaataaagttaatacattttatttaggcataactaaatattttattcaaaataaactaaaatcaagtcttatttttaaaaataaccgaaaagtaagtatatgtcctagaataaaaataatatatattataaatttttatatataaattt

SEQ ID NO: 2631 - DNA, 29 bp, Methanobrevibacter ruminantium
aattcttatcacattttgtgataagtatc

SEQ ID NO: 2632 - DNA, 25 bp, Methanobrevibacter ruminantium
ttcttatcacattttgtgataagta

SEQ ID NO: 2633 - DNA, 25 bp, Methanobrevibacter ruminantium
tacttatcacaaaatgtgataagaa

SEQ ID NO: 2634 - DNA, 21 bp, Methanobrevibacter ruminantium
cttatcacattttgtgataag

SEQ ID NO: 2635 - DNA, 22 bp, Methanobrevibacter ruminantium
ttgtttcataattatgaaacaa

SEQ ID NO: 2636 - DNA, 219 bp, Methanobrevibacter ruminantium
tatacttgataaaaattctttaattatattttaaagataaattaaaaatacattaccaaatataataaaaattctttaattaatcaagaaaataataaatatgctccttttaaataattgcataatcaaattaactttaattacaattaaaataaactttatataaaataaaatacatataagtatttagttaatattcaattattttaaaaaaaattt

SEQ ID NO: 2637 - DNA, 24 bp, Methanobrevibacter ruminantium
tagttattttatttaaaataacta

SEQ ID NO: 2638 - DNA, 37 bp, Methanobrevibacter ruminantium
tatttgaaaagagagaaaattgctcttttttcgaata

SEQ ID NO: 2639 - DNA, 352 bp, Methanobrevibacter ruminantium
agtaaataataagtaaataataagtaaataataagtaaataataagcaaattataagtaaattataagtaaattataagtaaataatagataaataataggtaaacttgtagtaaataataactaaattataaataaataagaaataaactatagcaaagtaataataaagaaataacaaagatataacaatcttataagtaaataataactaagaatcagttatttatttattatagaacaaacaatacataatattataaatagtttaatatagtaaacccatatttaaaaagtaagctttaaataagtattttaaaaagggaaactataaaaatttcaaaaataaattt

SEQ ID NO: 2640 - DNA, 15 bp, Methanobrevibacter ruminantium
ttcaaattctttgag

SEQ ID NO: 2641 - DNA, 14 bp, Methanobrevibacter ruminantium
taatccttagatta

SEQ ID NO: 2642 - DNA, 15 bp, Methanobrevibacter ruminantium
tgaaatttaatttta

SEQ ID NO: 2643 - DNA, 27 bp, Methanobrevibacter ruminantium
tggcctattcttttggagaataggcta

SEQ ID NO: 2644 - DNA, 23 bp, Methanobrevibacter ruminantium
gcctattcttttggagaataggc

SEQ ID NO: 2645 - DNA, 12 bp, Methanobrevibacter ruminantium
gaattctaattc

SEQ ID NO: 2646 - DNA, 308 bp, Methanobrevibacter ruminantium
ttaaaaaaataaagtaagatttaaatgaaaaatattaaaatcataatttttaaaataataatttaattaaatatatgtcatttaaaaatacttaaaatttattaattaaattagaataataatgataagaaaaaatacctaaaacttaaaaattaaattagaacaataataagagataagaaaaaatacctaaaacttaataattgaattaaaataataaatataatgagtaaaaaatatttacatagaagaaatttgaaaataattaaagtgatacaatgacaaatacaattggaaaaatctttaga

SEQ ID NO: 2647 - DNA, 313 bp, Methanobrevibacter ruminantium
tcaattcttttaaattttaaaaatggaataaaaaatttaaacagataaatttattaaaaagtatataaatttgcctttttgaaaatttatattactttatatatttgtaattcaaatatataaaataaggctttataaaaactaaactttttgattaaagcaaggataattaaatatattaatagaaaacaaaaaataagaattataaaaagtaaagaataaaaatcatttctttaaatatactattaaaattattttgaatataattcctattttaaataataaataggataaaaaaagacaattatcttat

SEQ ID NO: 2648 - DNA, 30 bp, Methanobrevibacter ruminantium
ttaccttggattgccctttatccaaggtaa

SEQ ID NO: 2649 - DNA, 28 bp, Methanobrevibacter ruminantium
ttttgcataaaaatttttttgtgcaaaa

SEQ ID NO: 2650 - DNA, 355 bp, Methanobrevibacter ruminantium
attccttgttaaaataattaatttcattatttatttaaattaaattttattataaaactattaatttaatcaatcacataatcaatttaattaaaataatattataaataataaaatctaaaaacttgaatctatatcaagttattgaaagagaataatttattaaattttcaacaaagtagaacaattcaaaataaaaattagaaaaagttcttataaatagaaacaaaacattgaaaaagaatatgagaaatattgaaaatatcataaaaaatgaaaaaatgaaaaaatactaaaataaggagataaaattaaaaaaataaaaaaatagtaaaaaaggaaataaaaattaaaa

SEQ ID NO: 2651 - DNA, 303 bp, Methanobrevibacter ruminantium
taataaatttaattttttaaatgaaattattttgatttttatttttaaaaaaattccaaatcattgattattttgaaattttaaagtcattttaaaaaatataacaatagttatatttttcctatataatagttagtaagttttagtatataaaggttagtataataatatagaattattgtattttaaaaaaaaaaattgaaagactcctgaaaatagatcagatagaaaacatgaaaataattgaaaaaacccctgaaaatatatcagatagaaaacatgaaatatttaaaataataaaga

SEQ ID NO: 2652 - DNA, 120 bp, Methanobrevibacter ruminantium
catagcgatggggttacacctggtctcgttccgatcccagaagttaagtcttttcgcgttttgtttgtgtactatgggtttcggtctatgggaatttcatttagctgccagctcttttat

SEQ ID NO: 2653 - DNA, 120 bp, Methanobrevibacter ruminantium
tctagtgaatatatcatcataatggatgattaggattcggtttggtgtattcagtttagggtgaaagtgtatagttataaaaaaaagttatccgtctttttatcatactcataattgagt

SEQ ID NO: 2654 - DNA, 2976 bp, Methanobrevibacter ruminantium
tgctacttgtactatctgggggatagctaggcttgagttgcctatgaaggtcgtggtaagctgcgataagcttggggtaggagcagacatcttttgatcccaagattgcctaatgggacttcctaaataacttgttatttgatccgagaggattgggaacccactgaattgaaacatcttagtaggtggaggaagagaaagcaatagcgatatcgttagtaacggcgagcgaaaacgatgtaggacaaactgaatcccatattgtgagatatgggagatgtggtgttttagacttgattttaatcttcttttgttaagctgaaattgacttggaatggtcataccgtagagggtgacagtcccgtaagtatgtacttttgaagatttgttcttgtttctagagtaggatgcattggatattgcgtttgaatttgggtggcatcaacacctaatcctaaatacatctcaagaccgatagcgtatttagtaccgtgagggaatgctgaaaagaaccccgattggggggtgaaaagaacttgaaaccagatagtgatagccagatatggcctgtaaggaatgatgtccctgttaaagaggcagtggtgacgctgtagtatgattggggatggactagggtcgtatcgtccgtcttgtaacacgggccagggagttctttgttgtggcgaggataaggagttttagctttgtattcggagggaaaccgatttctcgtagcattttttgtgtgtggggagaggtcttaatagggccttttagtcacagcatgaaacccgaagccggtcgatctattcctgagcaggatgaagtcgctcttacgagtgatggaggtccgcagggttgttgttctgcaaaacactcctctgacttgggaatagtggtgaaaggccaatcaaggccggtgacagctggttccactcgaaatgactcttaggtcagcctgactggagattggtagcggggtagagcactgattgggcgtttagggagggaaacttctcggcgttctgtaaaactccgaactcgttaccgttgttgatggttggagtgcggggcgcggggtaagcttgtgtcccgaaagagaaacaactcagactatggttaaggtccctaaatgttggataagtgtaagggagtctttggcccaagacaatgggcaggtgggcttagaagcagccaccctttaacgagttcgtaacagatcacccatcgaggtcaaaggcatctaaaatggacgggaattaatccaactaccgataccatagaacacgtggttttgcgtgattgtgtagagtggcgatctgtcggggttgaagttggggcgtgagttcctttggacctggcaggtatgtggatcctggtagtagtagcagcaaagtaaggtgagaatccttaccgccggaggggctagggttccttggcaatgttcgtcagccaagggttagtcgatcctaaggccggtcgtaagtcgagccggtcgaaagggaaacaggttaatattcctgtacatagttgatacgtgcggtgacgcgtggactagtttctgacgctttgagataggttttgtatgattgtcgtcatatttaagtgtttaagccaggggagaggtgtaatggcgagaacctggtgtaggcattaacagcaacctgtatgggttgtttaactgattcatggagtccttgaaaagggaattagtatggattcaactatttcgtaccgagatccgtcacaggtgcccctagttgagtagactaaggcgttttaaggtaaactagctaagggaaatcggcaaaatggccccgtaactttgggagaaggggtgccagccatgtgaatggctggtctcagtgaccaggggggcccgactgtttaataaaaacatagctctctgctagcctgaaaaggtgtgtacagagggcgacacctgcccagtgctggcacgtgaagcttcggttcaacggagtgaagcgccagtaaacggcgggggtaactataaccctcttaaggtagcgaaatgccttgtcggataagtaccgacctgcatgaatggtagaacgaggtccccactgtccctagctagatcttagtgaacctgctgttctggtgaacaagccagagacttccattgggaagtgaagaccccgtagagttttactgcagtctgctgttgaggcttggttgttggtatgcagtgtaggtgggagaattcgatgcgtgttcgccaggatacgttgattcgtccttgagacaccaccttctggtaactgtgtctctaacatgatttttggtattgtggacatcggtagatgggcagttcggctggggcggcacgggcttgaaagtgtatcaagcccgccctaaggtcaactcaggtgggacagagatccaccgtagagtgtaagggcaaatagttggcctgactgtattttgatcagtaagaaattcagaggcgaaagccgggcctagcgaacctcaaactcctcgttgatggggggttgagatgacagaaaaactacctcggggataactgggtggtcgcaggcaagagcccatatcgaccctgcggcttgctacttcgatgtcggttctttccatcctgggtgtgcagcagcacccaagggtggggttgttcgcccattaaaggggaacgtgagctgggtttagaccgtcgtgagacaggttggttactatctaatggatgtgttagtagtctgaggggaaggtggctccagtacgagaggaacgagttgtcggtgcctctggtttaccagttgtctgataaggcattgctgggcagctacgcactggacgataaaggctgaaagcatctaagcctgaggtgtcccctgaaaatagattgcttaggacgcgagtagaagactcgtttgatggggtagggatgtaagcttagaggttttttccgatttgtttagtccgctgcttccaattgttcgcttg

SEQ ID NO: 2655 - DNA, 73 bp, Methanobrevibacter ruminantium; identical to SEQ ID NO: 2071

SEQ ID NO: 2656 - DNA, 1429 bp, Methanobrevibacter ruminantium
cagaagctactgctattgggattcgattaagccatgcaagtcgaacgaatttagattcgtggcgtacggctcagtaacacgtggataacctacccttaggactgggataaccctgggaaactggggctaataccggatagataatttttcctggaatggtattttgtttaaatgttttttcgcctaaggatgggtctgcggcagattaggtagttggttaggtaatggcttaccaagcctatgatctgtacgggttgtgagagcaagagcccggagatggaacctgagacaaggttccaggccctacggggcgcagcaggcgcgaaacctccgcaatgtgagaaatcgcgacggggggatcccaagtgccattcttaacgggatggcttttcttaagtgtaaaaagcttttggaataagagctgggcaagaccggtgccagccgccgcggtaacaccggcagctctagtggtagctacttttattgggcctaaagcgttcgtagccggtttgataagtcactggtgaaatcctatagcttaactgtgggaattgctggtgatactgttgaacttgaggtcgggagaggttagcggtactcccagggtagaggtgaaattctgtaatcctgggaggaccacctgtggcgaaggcggctaactggaacgaacctgacggtgagggacgaaagccaggggcgcgaaccggattagatacccgggtagtcctggccgtaaacgatgcggacttggtgttgggatggctttgagccgttccggtgccgaagggaagctgttaagtccgccgcctgggaagtacggtcgcaagactgaaacttaaaggaattggcgggggagcaccacaacgcgtggagcctgcggtttaattggattcaacgccggacatctcaccaggagcgacagctgtatgattaccaggctgatgaccttgtttgactagctgagaggaggtgcatggccgccgtcagctcgtaccgtgaggcgtcctgttaagtcaggcaacgagcgagacccacgcccttagttaccatcagattctccggaatgctgggcacactaaggggaccgccagtgataaactggaggaaggagtggacgacggtaggtccgtatgccccgaatcccctgggctacacgcgggctacaatggctgggacaatgggttccgacgccgaaaggcgaaggcaatcttttaaacctagtcgtagttcggattgagggctgtaactcgccctcatgaagctggaatgcgtagtaatcgcgtgtcacaatcgcgcggtgaatacgtccctgctccttgcacacaccgcccgtcacaccacccaaaaagggctgggatgaggatatggtctgtggttgtattcgaatctcggttttttgaggagggtgaagtcgtaacaaggtagccgt

SEQ ID NO: 2657 - DNA, 134 bp, Methanobrevibacter ruminantium
taattattataaattttttttagaaggcattattttctaattaaattatatatatgattttatttttaatatcaaaaaatatttaataattatttttataaaatattaatttttgcaatagtttatttttaatt

SEQ ID NO: 2658 - DNA, 198 bp, Methanobrevibacter ruminantium
ttgtttaactaaaaaataataaaaattggaaaaagttaaaaaaataaattaaaaaagattaaaatttgatataattataaaatatttaattaaattataaattaagaagttaaatgaatagaattaaaaaaataagaatttttctagaaaaatatagatcttttttaaggagtttgtcaaaatctaaaatatttgaaa

SEQ ID NO: 2659 - DNA, 25 bp, Methanobrevibacter ruminantium
taagttgggagtgatcccgacttta

SEQ ID NO: 2660 - DNA, 18 bp, Methanobrevibacter ruminantium
gttgggagtgatcccgac

SEQ ID NO: 2661 - DNA, 68 bp, Methanobrevibacter ruminantium
ttattaaaattgttaaaatttaaaattaattagacaaaggagttaaaatctatgactgatcttaataa

SEQ ID NO: 2662 - DNA, 258 bp, Methanobrevibacter ruminantium
ttatatttataaaacagtttcatatatcataaacaaaaattttttagaaatatataaataatattaattttaaagtaaaataaacattaaaataattcttaattatttatcattataaatatgataaaatacatatactatattatattataaaattattatttttcacatgtgaatttcatgtttgaaatctaaatagtaattattttagtatgcataattttaataaaatcttctaatcgttaaggattattaaaa

SEQ ID NO: 2663 - DNA, 119 bp, Methanobrevibacter ruminantium
attattaaaatttatattaaaatcaataattgaataaaaaattaataaaaaattgaatatctaattggataaaaattggataaaaaaaagaatatctgattggataaaaaaagaaaaat

SEQ ID NO: 2664 - DNA, 307 bp, Methanobrevibacter ruminantium
ttttagaatttttaatcaagaaattaaatatcttattaattcaagtttcttaaattcaatttaagaaatattatgtcctaatcatataacttaatatatcattgtaaattaagcgattaaagctctaaaacatttttttgctgatattaaaaattatattaaattctatataaattatataaattttatataaagcctaaaattctttatgataacaaatattaaaaatgtgattttgtataaatattaattggcaaattaatattaaatttaaatataaaatatgaatttaatatataattattga

SEQ ID NO: 2665 - DNA, 245 bp, Methanobrevibacter ruminantium
ttttaactattttattattttagataagtttatattattactaaatcaaatattaatatgaaaatataataattaaaaatgcaatttattaatttttctttaatgaaatttaagttaatgaaataaaaataattcaatgaataaaattaattggttctaaagtgttttatttaaatcccatttaatcatatggtttctgataaatattaagataaatatttaataatctattattcaaataaact

SEQ ID NO: 2666 - DNA, 27 bp, Methanobrevibacter ruminantium
gttcaaactttttattaaagtttgaac

SEQ ID NO: 2667 - DNA, 38 bp, Methanobrevibacter ruminantium
taaatgaagaagtaattttaaaaattacttttcactta

SEQ ID NO: 2668 - DNA, 128 bp, Methanobrevibacter ruminantium
aaattaaaataaataaaataaaaatttaaaaaaagtattatttcagtatttcaacaaaaaaatattaaaataagctatttttaataaaataactatttaaagaacaaaagttgttttttataaaacaa

SEQ ID NO: 2669 - DNA, 20 bp, Methanobrevibacter ruminantium
gttgttttataaaaaacaac

SEQ ID NO: 2670 - DNA, 24 bp, Methanobrevibacter ruminantium
gagattagattaatttttaatctc

SEQ ID NO: 2671 - DNA, 19 bp, Methanobrevibacter ruminantium
tagattaatttttaatctc

SEQ ID NO: 2672 - DNA, 365 bp, Methanobrevibacter ruminantium
cttaaatcatctaaattaggattttgaatgatgcttattaattcctcttgattttccaattctttgatttcagatagttgataatccaaagtcatattatctccttaaattagaatattggtaatttaactaataaatttatgcttataaaaaatagataattttaaataccttaaaagtcctaaaagagaaaattaatattaaaaaagtaaattgagtaaaaattccaataataaaagagaaaaaaaggattgaaagattattctaaatcctaaaaaattaaataaggctagagaataaataattttaaatcctaaaaaattaaataaggatagagaataaattattttaaatcctgaaaatca

SEQ ID NO: 2673 - DNA, 27 bp, Methanobrevibacter ruminantium
ggattaaatttaaattaaatttattcc

SEQ ID NO: 2674 - DNA, 268 bp, Methanobrevibacter ruminantium
tcccaaatttaaaaattaacatttgcaaaatttattgaaatgttaattaaattatttaaattaaattatttaaataaatatgatgatttaagtgtgtaaattaattataaaagaaatataattaaaataatttttataaaaaattaaattagatgattgaaacaatcatccatagaaaattaatctaataatcttcttttaatacttttaattcaccagttacaatatcaattataagaccatgcactggaacttcaggaattaatgg

SEQ ID NO: 2675 - DNA, 23 bp, Methanobrevibacter ruminantium
tggatgattgtttcaatcatcta

SEQ ID NO: 2676 - DNA, 19 bp, Methanobrevibacter ruminantium
gatgattgtttcaatcatc

SEQ ID NO: 2677 - DNA, 235 bp, Methanobrevibacter ruminantium
agaaaatgattaaagtctttattaattgcaactatataataatatgttttacaaactatataaatcttaccaaaagataaattaaattgattaaaattgtttaaaaagaatcaaaccaaccaagaatattcaaattaatctttaacaattttaaaatctttaaaaatagttttagcccattatatgagtcataaaaatatttaaaaaataggataaaacaatttacaaaaataag

SEQ ID NO: 2678 - DNA, 19 bp, Methanobrevibacter ruminantium
tctaggttttaaacctaga

SEQ ID NO: 2679 - DNA, 372 bp, Methanobrevibacter ruminantium
attttattataatttttgagatacaatacttttattgtaatttttgaaaaattaaaaaaataaatttttaaaatgataaaattaattaaagaaatttaaacatagttttgtctaaattaaagattaattaatcctaataaaaggtttaataataatataatataaatctttccattaaaaaaagtcaaataaaaggaatttaaagagattaaatagaatataaagactcataaaagaccctataaaaaaattatacatttataccaggagaacaattaaaataaatacaaaaataaatttttatttaaaataataacaaataataaattaaaataaaaacaatataattaggctccattagataaataaaga

SEQ ID NO: 2680 - DNA, 205 bp, Methanobrevibacter ruminantium
actaattattcttataattttaggaaatgataatcgaataaagttaaatcagacaatatccttagaaagtttttttaaacaatttaaataaataactaaataagtgaaatttctaaaaatctaaatgaataagcaaaaattccgaataaacaagcaaaatttctaaaaatttaaagaaataattaaaatttctaaaaattaaaaa

SEQ ID NO: 2681 - DNA, 243 bp, Methanobrevibacter ruminantium
tagaagagttatagagtaagaaaaataaataaaattaataaaataattaaataaaataattaataactaattaataactcattaataattaaaataaaataataaaaaaagctaattatcctttaataaataaaaaaagaaaatggataaaaattaatttaaaagaataaaaattattcttttaagtattcacagaccttttcacctgcaaataaacatacttcaacacatggagacttgtca

SEQ ID NO: 2682 - DNA, 29 bp, Methanobrevibacter ruminantium
tttaaaagaataaaaattattcttttaag

SEQ ID NO: 2683 - DNA, 27 bp, Methanobrevibacter ruminantium
ttaaaagaataatttttattcttttaa

SEQ ID NO: 2684 - DNA, 190 bp, Methanobrevibacter ruminantium
tttttaatttaattatttcttaaaatgatttataaaaatatataaacattaaaatttatattaaatataacaatgttttaaattatttaaattaataagatattgatttgaataaagtaaaatttgatttaaattaattattgagggattattatggaattagactcagaacaagttgtaaaaagaatag

SEQ ID NO: 2685 - DNA, 275 bp, Methanobrevibacter ruminantium
aaatgaacttaaaaaaagtaataacatttatatttgagtttgcacatattattaatagtaatactaagtatataaatgaactcaaaaaaaagtaatactttttattttataacccctattttttttaaaaacttcttgatttttgtggggatttttttaaaaatttaaaaaagtaatactgagtatataaatgaacttaaaaaaagtaatactttttaattaaataaaaattatggtttaatataaaatgataaagaaggtgacaaatgtgattg

SEQ ID NO: 2686 - DNA, 297 bp, Methanobrevibacter ruminantium
tatctaatttaaaatttttttagctaattattacatgaattcttcaatattaatactaatttatatagaattaagaaatccgaaattcattgaattataaataataaaaacattaaaaaaattattaaattgtttctaataataagaacaaattttttacatacattttatataaaatatgttttataaagttttgcaaaaaatagaaaaaaatagaaaagatattttattaaattttttactcaagcgaatttaaataagattaaaacatatttttaataatttaaaaaaaaatca

SEQ ID NO: 2687 - DNA, 187 bp, Methanobrevibacter ruminantium
aacttttcataaatcatctgggaaaaaatgaaaaaggtataaattattttttaaggaaaaaataaaactaatttttttaatatgaattaaaaaaaccaatttaaaacttgaaactaaattaatttttttaataaaattaaaaaaactaatttaaaatgataaaactgattcttttataaaaaaaatc

SEQ ID NO: 2688 - DNA, 41 bp, Methanobrevibacter ruminantium
ttaaattagtttttttaattttattaaaaaaattaatttag

SEQ ID NO: 2689 - DNA, 39 bp, Methanobrevibacter ruminantium
taaattagtttttttaattttattaaaaaaattaattta

SEQ ID NO: 2690 - DNA, 31 bp, Methanobrevibacter ruminantium
ttagtttttttaattttattaaaaaaattaa

SEQ ID NO: 2691 - DNA, 279 bp, Methanobrevibacter ruminantium
ttaataatttaatactttatatttatttattattacttaggaatataaaaatatttctaaaaaaagtaatacaaaattgattaatttggactataaagtaataattattactgaaattaatttattttaaatataaagtaatactaggcaaatagaataagtaatacttattagtattacaaaacaagcaaaaataggcaaaataataatacttttaaaatgcaaaaacatatattcaaaaatatgaagatttaaatcaaaaaagtaaaaaatcaatta

SEQ ID NO: 2692 - DNA, 20 bp, Methanobrevibacter ruminantium
gtaatactaataagtattac

SEQ ID NO: 2693 - DNA, 30 bp, Methanobrevibacter ruminantium
ctagttgggagtattgtactcctttactag

SEQ ID NO: 2694 - DNA, 15 bp, Methanobrevibacter ruminantium
ggagtattgtactcc

SEQ ID NO: 2695 - DNA, 34 bp, Methanobrevibacter ruminantium
ttttagcaaacttttagaaaaagtttgatcaaaa

SEQ ID NO: 2696 - DNA, 15 bp, Methanobrevibacter ruminantium
gataaaacttttatc

SEQ ID NO: 2697 - DNA, 311 bp, Methanobrevibacter ruminantium
ccaaattgattacgaatatcatagtagcaagtaaaatcaaacctacttcaagtataagttgaaaatgattttgagctatcaataacatgaaatcacacaataaaataataatttaataagtttaataaaatttttgaatttaagaagtttcttaaatttacataatactataatattaatgtttttatttaactaagtatttaaatattggtgctaagagagggcattttttatttctaggataataaattatagaaataatagtaggttggaaaataaaaatttattccaattttttaaaaaatgaaatg

SEQ ID NO: 2698 - DNA, 287 bp, Methanobrevibacter ruminantium
ctttatgattttagttatataaaaaggtttgtattttagtaactttaattaactaaaataacaattcaaaaaatgataaaaataattgtaaaaaaaatcgaaagatatggggattaaaataaaatttattatttataaaaaataaatgaataatcatattggaaaatcatatgaagaaaatataaaatttatataaattttataagttttagctataatcccttttaaaaaataaatttatatgaaatttataaaattatagttataatccatttttaaaaaaaacc

SEQ ID NO: 2699 - DNA, 52 bp, Methanobrevibacter ruminantium
tggtcaaggttttacgattttggcgaagccaaaatcgtcaaaagcttgggcg

SEQ ID NO: 2700 - DNA, 50 bp, Methanobrevibacter ruminantium
ggtcaaggttttacgattttggcgaagccaaaatcgtcaaaagcttgggc

SEQ ID NO: 2701 - DNA, 248 bp, Methanobrevibacter ruminantium
gtttataattaattaagaataaattgattaaattttattaattctcttaaattaaaatcttcaatttaagaataaattaattaattcttcttaaactaatagataatataatttaaaagcctaattcttaaattaaacaatgatagttaattaaataaaataaaaaattaacttttattaatttgattttaaattttgaaatattttatttttaaaaatataaactaattaaataaattaagttaaaa

SEQ ID NO: 2702 - DNA, 146 bp, Methanobrevibacter ruminantium
atatatttatatgggtaaaaacataatgtattattaatataaactttaaatgatttttaaagatataaaattttttaatttttaatttataagatttatttaaatctaattttaaattaaaaatttttaacttaatttatttaatt

SEQ ID NO: 2703 - DNA, 250 bp, Methanobrevibacter ruminantium
atttttaatttaaaattagatttaaataaatcttataaattaaaaattaaaaaattttatatctttaaaaatcatttaaagtttatattaataatacattatgtttttacccatataaatatatttagaaaaatagctaaaaaaatggaatttttttaaaataatttaattaaataaaaaaagaaatcaattgaaaatagggcaagaaaaacctagatcaaatagtccaaataggaaaaaatattttgaa

SEQ ID NO: 2704 - DNA, 74 bp, Methanobrevibacter ruminantium
gcagctgtggtatagtctggttattacttgggccttccaagcctacaacccgggttcgaatcccggcagctgca

SEQ ID NO: 2705 - DNA, 74 bp, Methanobrevibacter ruminantium
gcggtgttagtccagcctggttaagactctagcctgccacgttagagacccgggttcaaatcccggacgccgca

SEQ ID NO: 2706 - DNA, 14 bp, Methanobrevibacter ruminantium
tgctctttagagcg

SEQ ID NO: 2707 - DNA, 21 bp, Methanobrevibacter ruminantium
ttaaaaataaaatatttttaa

SEQ ID NO: 2708 - DNA, 18 bp, Methanobrevibacter ruminantium
tctcgactgtagtcggga

SEQ ID NO: 2709 - DNA, 331 bp, Methanobrevibacter ruminantium
aatcatctttcaaaaattggaattaacattattaaaaatatttattctataataacaatgggtttaaagtaatatataaagttttcgtttttattataaactttaggataattattattttgaatataattgcataaaaagagtaaaattttaaataaaattataaaaatttataaaatattttaacaaatatatatttttttaatttagttacaaaaatatattaaaattgatagttcctttgcagttaacatatgttcctttacggtttacacatgaaatgccacatgctttaaaaaaaaagatagttaagaaaatagatatctattaa

SEQ ID NO: 2710 - DNA, 598 bp, Methanobrevibacter ruminantium
atattttaatttttttaaaaaaccataaaatgagttaaataaagaatattcttagaaaagcttttgagttatatttaaaattagaaatcggtgaataggacgtgatttgtttttattaaaatgtggaaagctatggcatataactatgttataaatacattccacaaatttagcacgattttaacataaagtttatatattaaaagaatgaaaatgtggaaacctatatcatataactgtgttatattcaccttccacagaaagttttaaaaataagtgagataaatagttaaaataagtaaattaagaaaaattaataagggtttaatttagtacgttatactgcggtttaacgaaacttttttatttcttaaaatgagtttattttattatataatgatttaattacttcttttcgcaaaataagctttcaattaagataattgtttaaataattttttaaaattagttttttattaaaatcatctaagattcttctttttaaaattagttttgtattaataatttaatcttttaaatcgtttttaaaattagttttatatagattaagaaatagttttaatcgtttttaaaatta

SEQ ID NO: 2711 - DNA, 24 bp, Methanobrevibacter ruminantium
ttataggggatttttcccctatgc

SEQ ID NO: 2712 - DNA, 22 bp, Methanobrevibacter ruminantium
tataggggatttttcccctatg

SEQ ID NO: 2713 - DNA, 18 bp, Methanobrevibacter ruminantium
taggggatttttccccta

SEQ ID NO: 2714 - DNA, 74 bp, Methanobrevibacter ruminantium
gggcccgtagctcagtctggcagagcgcttggctcttaaccttgttgtcgcgggttcaatccccgtcgggcccg

SEQ ID NO: 2715 - DNA, 324 bp, Methanobrevibacter ruminantium
ttttaattttttttatgatgagttagtgtttttattaaactaaatgattagaagtttactatttttgtcatatattaaaccaaatatcattcaagtttactatttattacatatattaaaccaaataatccattattttaattaaaattacatacgattattctattaatataactaattccattaagattataatagctatttttaatataattgattcaatattgaaatttataaaaaaataatttatagatgtagatatgccatatgagttatagaaaaataatgtgaaaatagactagataactaaattataaaatataa

SEQ ID NO: 2716 - DNA, 29 bp, Methanobrevibacter ruminantium
gaataagataaaataattttattttattc

SEQ ID NO: 2717 - DNA, 246 bp, Methanobrevibacter ruminantium
taggttttgtttgtttaatttagttcattaaacaatagttttacgaaacactctaaaaaatcaataaaaaaagattaaaaaataattaaaaaaaagtaaaaaaagaattaataaaaaatattataatatttgtttattaatcaattcagcattcaaaatagaagcccaactgcatctctaattataattaaatttactttttatataaattttgaaacttaaaaaatacaaaaaatcaataatatt

SEQ ID NO: 2718 - DNA, 860 bp, Methanobrevibacter ruminantium
ttgtttgtttaatttagttcattaaacaatagttttacgaaacactctaaaaaatcaataaaaaaagattaaaaaataattaaaaaaaagtaaaaaaagaattaataaaaaatattataatatttgtttattaatcaattcagcattcaaaatagaagcccaactgcatctctaattataattaaatttactttttatataaattttgaaacttaaaaaatacaaaaaatcaataatatttaaattttctattaaacctttttaaatcagcacaatcctgatttaaaagataagattcagtgaagtccccttttttatttaaaagattcacaatatattccatatgagaaattaattcttcattaaaccccaaatttatatcatatttattaaataaatcttttatgtagtgcttttcagctacattaaatgactcttctttagcaatttgagataataaattaccaatttctatttgatttatttgtaaataatattctgataaaaactcataaatataaaaaaggtaatattcatcataaacaatgtctaatgcataattaaaaatttcttcaattttctccctatctaattctatacagtaaattcttagtaattgtcttaaaatcccaatatcaaatggacttattttattagctaattctaaaaagtattttgctttagaaaactcatcaaattcgattaatgtttctccataagcagctaaaataaatggatagtcatattttaagattttataatttttcaatacatcttctttttgggaaacattcacatattttgagtgaataaaaaagataaaataaaaattttcttcaaatttattattaaaataaaaa

SEQ ID NO: 2719 - DNA, 19 bp, Methanobrevibacter ruminantium
ttgggatttattttcccaa

SEQ ID NO: 2720 - DNA, 262 bp, Methanobrevibacter ruminantium
ttctaaggttaagaatcaatttatgaatttttataaatttttaaaaatacaattaagttttaagaactttaattaaataaaaagtatttatttaagttttaagaactttaattagataaaaagtatttatttaagttttaagaactttaattagataaaaagtatttatttaagttttaagaactttaattagataaaaagtattaattaagtttttataacttcaatttaaataaaaactaataatttaagtatttaacaa

SEQ ID NO: 2721 - DNA, 177 bp, Methanobrevibacter ruminantium
aaatttaattattttataacttaatacttttttataataatttattaaaatctaatgatttttttaaaaatcaatcaaaaattcaatgatttttgtaaaaataataaataagtatattaatatcatttaataataattaataattgtataaaactttatcaattttatttaaaattt

SEQ ID NO: 2722 - DNA, 200 bp, Methanobrevibacter ruminantium
atttttgattgatttttaaaaaaatcattagattttaataaattattataaaaaagtattaagttataaaataattaaattttcaatcattgatccaaattataaaaattaaaaatattaaaaagaagtgattaaaaattaaaagtttaagtaaaataagttaaattaaaaaatagttaataaaaaaatagttaattaaa

SEQ ID NO: 2723 - DNA, 389 bp, Methanobrevibacter ruminantium
ttttgataataaatatactttatatttcatattatttaaagatagttattgaaagtgtggaatttatagaaaaaattgaaactgtaaattttaaagataattacaaaagtgtgaaattaatttaaagataaaaataatgaaagtgaaaaatctagaaagttttcaaagggggaagctaaaataaattaaattttttaattctgccaatatttaattctaatttttaagcaatttgaacaaaatgagaaattgactcccaaataatgaaaataaaccaattaataatagattttttataaggttatacaaagacaaaaagcaagaatagttctcaaatgctctaataacttatttaaatacataaaccaatctaataataatgatgattg

SEQ ID NO: 2724 - DNA, 292 bp, Methanobrevibacter ruminantium
atttaaaactaatttagataaaataaagaacgaattgctcttttttcaaatactgatttttaagtttatttctaaaaattccaatcaataaatcaccaatataaaaaattagaatcgaaataaatcaccataaaaaaaatcagaatcaaaataaatcatttaatatattaaaataaaaataaataaaattaggttaaatatatttaatagagcaattatttaataataataaaattagtttaaatataattaatagaattattaaagtaatccaatttttataattaataaa

SEQ ID NO: 2725 - DNA, 287 bp, Methanobrevibacter ruminantium
atatttttattaaaaaatcattgctaaagctttttaaaaaaaattatcaaatctagttttataatatttggtaaaaaagacatgaaaattagaaaagtttctagttttctgataaaaaaaataaaacaatcaaacaagacaaaagtattatatagttctaaatataactaactattatagacatatgaaactaattaaaaaactaagtttaaaaaaaatagcttggttttaaaggaaataaattttataattatttgtattggagaaaaaattgttaaaaaacaaag

SEQ ID NO: 2726 - DNA, 31 bp, Methanobrevibacter ruminantium
cgattaaattagttttaaactaatttaatta

SEQ ID NO: 2727 - DNA, 25 bp, Methanobrevibacter ruminantium
ttaaattagttttaaactaatttaa

SEQ ID NO: 2728 - DNA, 464 bp, Methanobrevibacter ruminantium
ttctttttttaaactttttttaaaatataaaaatactctttttaaaatacttttaaaattgaaaaactgatttttttaaaatacttaaagtgaaaaaaaactctttttaaaaaatataaaatttaataaaaaaaattgataaaaaatagataaacttagataaaataagtgaaaataataaaaaagtgtcaaaacaattataattaaatatttataaaaaataagaaaagatgccatgtgccggacttgaaccagcgacatccagatcttcagtctggcgttctcccaactgaactaacatggcataaatggaccgaacgagattcgaactcgtgatcacctccatgtcaaggaggtatcatacccctagaccaccggtcctttctacttactaaaatatgtaaatgattatatataaatctttctaaaatctgagaaattcatatataaatagaaatattttt

SEQ ID NO: 2729 - DNA, 73 bp, Methanobrevibacter ruminantium
gccatgttagttcagttgggagaacgccagactgaagatctggatgtcgctggttcaagtccggcacatggca

SEQ ID NO: 2730 - DNA, 72 bp, Methanobrevibacter ruminantium
ggaccggtggtctaggggtatgatacctccttgacatggaggtgatcacgagttcgaatctcgttcggtcca

SEQ ID NO: 2731 - DNA, 23 bp, Methanobrevibacter ruminantium
ttggccagattctttttggccaa

SEQ ID NO: 2732 - DNA, 283 bp, Methanobrevibacter ruminantium
aataggaaattataaaatattacccaattaaaagcctaagaactcttaaaaattaaactttttaaaaactcttaaataagaaaataaaaggtaaaataaagttaaatttacaaataaataaaaataacagtctaaaaaaagaaaataagaaaatttttctttattttaaaaataaaagataaattatcatttaataataaaatacaaaacaaaataaaagttatttagtaaaataacaatatttaaatcattgtttaatccaattttttaaaagaattttcaa

SEQ ID NO: 2733 - DNA, 18 bp, Methanobrevibacter ruminantium
gttattttactaaataac

SEQ ID NO: 2734 - DNA, 134 bp, Methanobrevibacter ruminantium
atcttacctcctttataatcattgttaaaatcagaataaatattcttttagaaaaataaaattttttaaaacttattgttaaaattagataaaatattttaaagaaataaaatttttaaaaaatttattaaaat

SEQ ID NO: 2735 - DNA, 261 bp, Methanobrevibacter ruminantium
ataaaattttttaaaacttattgttaaaattagataaaatattttaaagaaataaaatttttaaaaaatttattaaaataagtaaattttaattattatattaatttagattaagtttaatataaacttattgtttaaatgaagtttctaaattttaaaaatgaaaaatcataaacttaaaaatgaaatttctaaacttaaaaatgaaatttctaaacttaaaaatgaaaaatcataaacttaaaaatgaaaaatcataaa

SEQ ID NO: 2736 - DNA, 24 bp, Methanobrevibacter ruminantium
ttttgccttttttaaaaggcaaac

SEQ ID NO: 2737 - DNA, 22 bp, Methanobrevibacter ruminantium
tttgccttttttaaaaggcaaa

SEQ ID NO: 2738 - DNA, 303 bp, Methanobrevibacter ruminantium
aatcatttttaacaaccatccgttaatttttaaaaatctaaattataaaaattcctaaaaaaaaatttttataaaatataaatatgaatatttttttaaattcattagcactatattaaacaaatgtctaatgatagtcaacatatttaaatgtccatatataatttattaaaataagtatttatatttattgtaaaaattgctattgaaaaaagagttaaaggaatttgtgataatatattaaagaaaaatgttaaaattaagtaaaaaaaatagttaaaaattaactaaaaaaatagttaa

SEQ ID NO: 2739 - DNA, 11 bp, Methanobrevibacter ruminantium
ttttataaaaa

SEQ ID NO: 2740 - DNA, 17 bp, Methanobrevibacter ruminantium
tagttaatttttaacta

SEQ ID NO: 2741 - DNA, 17 bp, Methanobrevibacter ruminantium
tagttaatttttaacta

SEQ ID NO: 2742 - DNA, 198 bp, Methanobrevibacter ruminantium
taatattaattaaacacaatatatcaaaataatatcattttaaaaattaattttcttattagaaaaaaactttaataaaaaagtaattctctaaattagaaataaataacaaaattttaatctaaaaaattaaactcaacaaataaaaaaatcccaatgcatgaatttttttgagtaatatattatactaatataact

SEQ ID NO: 2743 - DNA, 260 bp, Methanobrevibacter ruminantium
tatattatttaaaacatttgtataaaatagataaaaatcaatgggaattctaaatttagaaaagtatttttcttgattttaaaaaaagatgataatgagaaaaatctcaatagataaacaaagagagtaatagtaaaaaaaagatgataatgagaaaaatctcaatagataaacaaagagagtaatagaaatatataaaaaacagttaaaatataaatagagtatataaagttaagtatctatcctttaaatataaaaaa

SEQ ID NO: 2744 - DNA, 47 bp, Methanobrevibacter ruminantium
attaattcaagcttttttggccttcggccaaaaaaccttgaccaaaa

SEQ ID NO: 2745 - DNA, 45 bp, Methanobrevibacter ruminantium
ttaattcaagcttttttggccttcggccaaaaaaccttgaccaaa

SEQ ID NO: 2746 - DNA, 37 bp, Methanobrevibacter ruminantium
gtcaaggttttttggccgaaggccaaaaaagcttgaa

SEQ ID NO: 2747 - DNA, 27 bp, Methanobrevibacter ruminantium
ggttttttggccgaaggccaaaaaagc

SEQ ID NO: 2748 - DNA, 134 bp, Methanobrevibacter ruminantium
atagttataaagatgcattgaaatagatgaatggctattaatattcattaaactggtgaatagttattatattcattgaaatatatgaataagcaataaattcatctaaattaataaataaaaaataaaattat

SEQ ID NO: 2749 - DNA, 173 bp, Methanobrevibacter ruminantium
acatcttttaaatccattttattacctttctttcttttaaaattttttaacttaaacttttaaagtttaaacttttcagactttttaaacttttaaaactgattaaattcttgaataattatttaaacttttaaaactgattaaattcttgaataattatttaaacttttaaa

SEQ ID NO: 2750 - DNA, 278 bp, Methanobrevibacter ruminantium
ccatcttgattatttccggccttgttccaagtacaatagctattttcattttaatacatccttttgttagttgaaaattataaaataaatatgaatcctataatttatattaattaaagatatattttttaaataatatatattttaagtaaattttaaaaaatcgttttaataaaaaatagttttatatttttagtaaattattaaagatgtcttatgaaagaagttttaatttttttataaatttttaaagaatgtctaatgaaagaacttttata

SEQ ID NO: 2751 - DNA, 282 bp, Methanobrevibacter ruminantium
aaaagaagatattgaaagaccggcatcggagatttctatattttcaaaattactcaagaatttcattgaaaactactaaaaaaccatttttattccttttctcatttcatgtaattacatgaaataaaactctttttatttaaattgcattaaaataagtataagttaataaataaagttaaaaaatcaaaataatggattattgagtttaatataaaaataagaaaatataatatattttattaaaaaagttataattcgtgaaaaaaatcagaaatctaa

SEQ ID NO: 2752 - DNA, 182 bp, Methanobrevibacter ruminantium
tttttttattcaaatttttttaaatttcttattttttatagctgttataatttttttattcaaatttttttaaatttcttatttttatataactgttataatttttttattcaaatttttttagatttctgatttttttcacgaattataacttttttaataaaatatattatattttctta

SEQ ID NO: 2753 - DNA, 25 bp, Methanobrevibacter ruminantium
tcttaataaggcttaattattaaga

SEQ ID NO: 2754 - DNA, 176 bp, Methanobrevibacter ruminantium
agttttaaattattatttttactttaagaatttttaaagtattattttcactttaatttaagtaatttacataattcggatttaaaataattttttaacataaatttaaagaatttatatgatttaaaaaattatgggggtttatttgcaatgaataaacaaaaaatagcaaaata

SEQ ID NO: 2755 - DNA, 141 bp, Methanobrevibacter ruminantium
aatcttatatttatcctttaatttaaagcatggaaattacttaaaattaaaattataaatttgtttaaaattaatatgactaaaagtcttttaaattattttaataaaaagaatagctctttttaaactttatactaataa

SEQ ID NO: 2756 - DNA, 296 bp, Methanobrevibacter ruminantium
tttaaacaatgaataaaatatgctaataaaatatctttttattatttcttaattttgaaaattatgtgcacaaaataatcaaaggaggaaataaaatatatgtaattaattttttacttttgttaaaaattctttacttttgtaaaaaatatcttacatatgtaataattattttacatcatatataaatcttttgctaaacctgactgaaattcaacatagccctaaaaaaaacatgagaaaataagcaaaaatcaattcaaaaaaataatccaatattttaaatagatataaaa

SEQ ID NO: 2757 - DNA, 76 bp, Methanobrevibacter ruminantium
gattgaagaattagttactataaaaaataattaataaaacttatctgattttcacttattaaaatttaaaaaaatc

SEQ ID NO: 2758 - DNA, 84 bp, Methanobrevibacter ruminantium
aattaataatataaaaaaataaatattataatattatgattgtttatagaaagtttttctatagaaaatcagtttagaattgct

SEQ ID NO: 2759 - DNA, 19 bp, Methanobrevibacter ruminantium
tagaattatattaattcta

SEQ ID NO: 2760 - DNA, 32 bp, Methanobrevibacter ruminantium
gaataagtaactacattttagttaacttattc

SEQ ID NO: 2761 - DNA, 18 bp, Methanobrevibacter ruminantium
gaagtttttaaaaacttc

SEQ ID NO: 2762 - DNA, 291 bp, Methanobrevibacter ruminantium
ttaattaaattaaatagaagataaattattttatatagtttatgtaaaactattaatttaattataactttaattaaaataaacaatttataatatatatttaataaattgtagaaaagatatgtagatgtgacaattaagaaattatattttattcaaaaatagactataaaaactaagacatagtgcttgaataattattttaaaatttttaaaactatagaaaaaacaatttgaaggtgaaaatatgttaagtgaagacgacggcaaatatttacttgaattagcaaa

SEQ ID NO: 2763 - DNA, 491 bp, Methanobrevibacter ruminantium
ctacaagaatgtgaaattttagcgatttttaaaaatttcaaaattaattattttttaacattcaacaactaaatcaaaagaaataaatatgaaaataaactattttttatatgaaaaattaaagatcttaaaaaatgtatacaaatttaaaaaatgtgtacacgaatagaaaactttatatactaaaagatccatagttcaagtatacattagtaacaaaagtatactaaaagatttttggatatgaaattccctttttgggaatggaaatgtcttaaaaaaaatgttgaattttaataaaattatgtaaaggagatcgataatatggctgaagatatgagcgaaaatattgaaaccaaatctgactttaaagacaaagctgaagaattcaaagcaaaagctgaagcaagaactgaagctaacaaagaaaaatgggatgaaacctacaacaaaggtaaagacgtagcaggaaaagttggtgaaaacctatc

SEQ ID NO: 2764 - DNA, 29 bp, Methanobrevibacter ruminantium
taaatatagcaattatttgctataattta

SEQ ID NO: 2765 - DNA, 46 bp, Methanobrevibacter ruminantium
tattgttttttatagataagaaacctactgtctataaaaaataata

SEQ ID NO: 2766 - DNA, 194 bp, Methanobrevibacter ruminantium
atcaaaagttatttttaaaaaatcaactaataatttttcaaaaatttttcaatccaaacccaatatctaaattaagataactattgaaaaaatttaataataacaactatttttaactatagattaatattcataataattttaaaaaaactactttaatataaaagttatataaatttttaagaaaatataag

SEQ ID NO: 2767 - DNA, 28 bp, Methanobrevibacter ruminantium
aaaactcaatgaatagtcattgagattc

SEQ ID NO: 2768 - DNA, 22 bp, Methanobrevibacter ruminantium
actcaatgaatagtcattgaga

SEQ ID NO: 2769 - DNA, 20 bp, Methanobrevibacter ruminantium
ctcaatgaatagtcattgag

SEQ ID NO: 2770 - DNA, 20 bp, Methanobrevibacter ruminantium
ctcaatgactattcattgag

SEQ ID NO: 2771 - DNA, 38 bp, Methanobrevibacter ruminantium
gtaaggttagatattaattatttaatatttaactattc

SEQ ID NO: 2772 - DNA, 28 bp, Methanobrevibacter ruminantium
gttagatattaattatttaatatttaac

SEQ ID NO: 2773 - DNA, 245 bp, Methanobrevibacter ruminantium
ttgcatttttttaattttaaatatgataattatagcttgcatttttaaattatttgaataaatttaaattaaatgtaataaataaataatcttatatgcttatatttgtttttaaaaaagcatctaaagaatttaaatgaaaaaaaatattaagattgataatatttttattattcaaatatattataattatttatataagttttaatataaaaagattttttaaaaattaaggaaatttaata

SEQ ID NO: 2774 - DNA, 185 bp, Methanobrevibacter ruminantium
atttttttattttttaattaattacttgattaattgttttttaaagatttaaaggttattttgataattaatcaaataattaattatttataatctttttttaggattaatttctttatttgtttagttattttgcttatttagttataagttatttaattatttagttattgatttaatattta

SEQ ID NO: 2775 - DNA, 335 bp, Methanobrevibacter ruminantium
taaataacttataactaaataagcaaaataactaaacaaataaagaaattaatcctaaaaaaagattataaataattaattatttgattaattatcaaaataacctttaaatctttaaaaaacaattaatcaagtaattaattaaaaaataaaaaaataaaaaaagtttatgatttgattttagatttgatttgatttgaaaaaagattgaaataggatttttactaaaatccataaaaaaggtaaaagaactaaaggattatacttttttagttctcatgattttcatattgcctaaagcaatgatatattctacacctaagtcagtacctaca

SEQ ID NO: 2776 - DNA, 198 bp, Methanobrevibacter ruminantium
ttacggttttaagttctacaacttttgttgacatttaaataacctcacaataaaattaataataaaaaatatcgataattagataagttattaagaaataattaaattatctaaaaatttattaaaattaataaaattttttaattatcttaaattcataaaatatgagataatataatctaatatagattaatatta

SEQ ID NO: 2777 - DNA, 168 bp, Methanobrevibacter ruminantium
aaatcttcttttttaagataagtttatatataaaattaaattaatataatattaatctatattagattatattatctcatattttatgaatttaagataattaaaaaattttattaattttaataaatttttagataatttaattatttcttaataacttatctaatt

SEQ ID NO: 2778 - DNA, 82 bp, Methanobrevibacter ruminantium
ttatattaatttaattttatatataaacttatcttaaaaaagaagatttttgaaaagaatttggaaaaaaatcatcaaataa

SEQ ID NO: 2779 - DNA, 35 bp, Methanobrevibacter ruminantium
tataattagtttattttgtaaataaactaattaac

SEQ ID NO: 2780 - DNA, 33 bp, Methanobrevibacter ruminantium
ataattagtttattttgtaaataaactaattaa

SEQ ID NO: 2781 - DNA, 31 bp, Methanobrevibacter ruminantium
taattagtttattttgtaaataaactaatta

SEQ ID NO: 2782 - DNA, 25 bp, Methanobrevibacter ruminantium
ttagtttattttgtaaataaactaa

SEQ ID NO: 2783 - DNA, 274 bp, Methanobrevibacter ruminantium
tctaaatgataatatcatttcatgaaaaaattaaaattttcatgtaaatttttttaaatcaaaaaatctatttttaataaaaagactttaaaagagacttatcttaatttaattaactaaaataaaaaaataataattaaaataactttatttatttaaaaaaccacacaaattgggattaaatttataaacttaaaaaaagttttaaaaaaaaattctatttttaataatctttataaattataagtcacaaaaatatacttgaataattgga

SEQ ID NO: 2784 - DNA, 40 bp, Methanobrevibacter ruminantium
caaagtaagtcaattaaggtaaacttaattgtttactttc

SEQ ID NO: 2785 - DNA, 32 bp, Methanobrevibacter ruminantium
gtaagtcaattaaggtaaacttaattgtttac

SEQ ID NO: 2786 - DNA, 31 bp, Methanobrevibacter ruminantium
tgattttgggaataaataattcctaaaatca

SEQ ID NO: 2787 - DNA, 238 bp, Methanobrevibacter ruminantium
aaattctgattaaaaccttttgatagataaaataattatttcaaaataccaaaatcacatttaaaaaatttaaaaatatataatttatcatttcaaaaaaaaaaatgaacctcctttaaaaaatttaaaaagatataatttatcattttaaaactaaactataaaccagcatttaataatttttttaaacaaaataataaatctttaaaaaattattaaaaatttttgaaaaaaattg

SEQ ID NO: 2788 - DNA, 25 bp, Methanobrevibacter ruminantium
taataaattctttaagaatttatta

SEQ ID NO: 2789 - DNA, 25 bp, Methanobrevibacter ruminantium
taataaattcttaaagaatttatta

SEQ ID NO: 2790 - DNA, 23 bp, Methanobrevibacter ruminantium
caaggaatcgtatagattcctta

SEQ ID NO: 2791 - DNA, 17 bp, Methanobrevibacter ruminantium
ggaatcgtatagattcc

SEQ ID NO: 2792 - DNA, 297 bp, Methanobrevibacter ruminantium
ttaagaacttaaatcaaggatagtggaaaaccttttccgatttttgatgtctaataataaattgaataatattcaatataaagctacctatttttaagaaatttatatatacaattcaatgttaaaggtttacaaatttaaaaaattttttaaaagatgaattaaatgtgcaaaaaatagcattaatttatctttaaattaaaaataaaagaatttattataaatttacaattcaatactaaaggttgacaaatcgaaaaatttatataaaaaataaaacaataataaaaaatatga

SEQ ID NO: 2793 - DNA, 409 bp, Methanobrevibacter ruminantium
acttattaatttaattttaaagacttaataaatatcctctaattaatactttttttacttccaattattttctaccccccactaattttcataattaggatcaaattaactcttttaattaactttctccaaaataagtttttattcaaatttgttcttaatgataaaaaaatcaaccaaataaatagttttaatgaataaaaacaaactagacaatgacttaataaaaaagaaaaataattaaatagttttgatgaataaaaacaaattaaataattataaaagctatttaatccccctaaaaaacgatttttataagtcaaaaatcaaaaatggactaaagtaataacatttgttaaaaaatcattacttaaatgaaattgattagaaaaataggaaattttattaa

SEQ ID NO: 2794 - DNA, 274 bp, Methanobrevibacter ruminantium
atcaccactttattttaaaaaaaaagcgtagctgttttataaacagctaataatatttaatgcattactaatatataaagttaatctattaattcaaaagttttccatataaaactatataaaaactatttaaacccaatgaacaatatacaaattttatcataaaaaactatacaaaataatatgaaataatatgaaagcaatttattaggataaaaactttaaaaataatcgaataaaattaatatttagccaaaaatattgaaaaattaga

SEQ ID NO: 2795 - DNA, 196 bp, Methanobrevibacter ruminantium
aaataattatatatatgttatttctaatataaatagattttaataacttatagtaagaataaagtaatattataaagtatttttaaaaatataaaaaaatttcaaagaattagtaaaaatcaaaggaaaatataaagaatataagaaaactaaggaatatccttagaaaaaaatagatgatttttaaataaaaaaa

SEQ ID NO: 2796 - DNA, 263 bp, Methanobrevibacter ruminantium
tcaaaaatttataattttgttttgaactatagacgaccaaaaacaagcataacttgtaatttatagtatataaaaagtattatataaatctttggataaaaaaaatgaaaattaaaataggaaaatgaaaaataagattaataataagttatttttataaatagtaaactatacataaaaataatgtttcaaaaatagagattgttaacataattagaaaataaaaaaaataaaaaaagtcccaatttttaaattattaaaaa

SEQ ID NO: 2797 - DNA, 32 bp, Methanobrevibacter ruminantium
ttctcagtttttaataatttaaaaattgggac

SEQ ID NO: 2798 - DNA, 30 bp, Methanobrevibacter ruminantium
tctcagtttttaataatttaaaaattggga

SEQ ID NO: 2799 - DNA, 372 bp, Methanobrevibacter ruminantium
ctacctcaataatattaaattttaattaaataagcattagattcttcaattagaagaaatggaaaaaatctttaaatagattattaatatcctccaatttgaaaaatacaaattttaataagcattaattaatttatttcaagttctccaatacaagttacaaatttttccgtttagatttaaacttataactattgttattaactaactagtatttaagtatttctatttatttttataatatacgaacaaaatatcaataaattacgaactgttttaagaaaaataatcaaaaagcaaagaattctgaaacattcaaattaaaaataaaaaatataaagatatatttataaaaaaataagataaaattat

SEQ ID NO: 2800 - DNA, 21 bp, Methanobrevibacter ruminantium
gaattggattatttctaattc

SEQ ID NO: 2801 - DNA, 22 bp, Methanobrevibacter ruminantium
gaataaatctcttgatttattc

SEQ ID NO: 2802 - DNA, 27 bp, Methanobrevibacter ruminantium
gtttatgcataattattatgtataaac

SEQ ID NO: 2803 - DNA, 315 bp, Methanobrevibacter ruminantium
taagaatgctaataatgcaattcctaaaataattgctatttttttcttcatattcacaccataaatatttttaatttataatatattataaattagatgaaaagaaaaaatctaatctatataaatatttaagaaaatcatattatataaaatagtgttatttattcaaaaaaatatcagaaatcaacgcaaaaaggcaagttatgaacaaaaaaagccaattaaataaataaatattgtttaaattttaataaattataaaatcagtttaattttaaatgaaattataaaacaatattataaaaaaaattaata

SEQ ID NO: 2804 - DNA, 136 bp, Methanobrevibacter ruminantium
aattataaaatcagtttaattttaaatgaaattataaaacaatattataaaaaaaattaataaaaatagaaaatatagtaaaaattagttttatatcattaaaacaatttttaatctttaaaaaagttagataatt

SEQ ID NO: 2805 - DNA, 244 bp, Methanobrevibacter ruminantium
taaaatgtctaaaaataatttggttttaaaaaataaatgtttttgtatgtattaattgtaaaataaataataaattataataattataaattgaataaaaattgaattaaatttaatgaaaataattgaaatcaaaggtctaaaatcaaataataaatctaaattaaaaaaattaaaaccaaataacttaaaaccgaataataaatttaaattaaataattgaaatctttaaattaatttaatt

SEQ ID NO: 2806 - DNA, 166 bp, Methanobrevibacter ruminantium
tttggttttaatttttttaatttagatttattatttgattttagacctttgatttcaattattttcattaaatttaattcaatttttattcaatttataattattataatttattatttattttacaattaatacatacaaaaacatttattttttaaaaccaaat

SEQ ID NO: 2807 - DNA, 93 bp, Methanobrevibacter ruminantium
ttttctagaaaagggtttattttttctattttttctaagaaatggttttgtctaaagaaaaggtttaattttttctattttttctaagaaatg

SEQ ID NO: 2808 - DNA, 303 bp, Methanobrevibacter ruminantium
aagaaatgataaaattataaaccggaacattatattctctttaaaaaattgagaaagtataaaccggataatttataatttcactttaaaaaaatgataaaattataaacctaattaactataatttcactttaaaaaaatgataaaattataagtttagtaataataattttacaaattaatttttaattaatattatatataaatttttttagaaaattaaaaattatctaattaaaaaataacataaaacttaatcaagtcttaattaggttaatagaataataaaaaagaatattttga

SEQ ID NO: 2809 - DNA, 174 bp, Methanobrevibacter ruminantium
aaaataaaatatgcagaaatgaataaaaaatgtacattttagacaatattaagaaattttaaactagtaaatttattaatgattagtaataaagttaatagtgttataaaaatataaaagtttttttaaaataataaaaattatgtaaaatcaaaactttttttaaaaataata

SEQ ID NO: 2810 - DNA, 34 bp, Methanobrevibacter ruminantium
aaacagtttccagtttgataactggaacctattc

SEQ ID NO: 2811 - DNA, 24 bp, Methanobrevibacter ruminantium
gtttccagtttgataactggaacc

SEQ ID NO: 2812 - DNA, 274 bp, Methanobrevibacter ruminantium
aaatgagaattaaactttactcctttttatcattctaaatgacaattacagatttactcttttttatttttagaatatctcattttaagagcattaaatagagaataagtataaataaaactaattaaaaatatttgaagatatttgaataaagaaaattataaaataataaaaaaagcaaaaatatgaaaaacaaaaaaatagtataaattaaaaagctaaaaagaatgttaaaagtttaaaaaaaagtaaaaattagttaaaatattaaaat

SEQ ID NO: 2813 - DNA, 52 bp, Methanobrevibacter ruminantium
gaagaaatagttgaaatgttaaaggaattttaatattttaactaatttttac

SEQ ID NO: 2814 - DNA, 39 bp, Methanobrevibacter ruminantium
atagttgaaatgttaaaggaattttaatattttaactaa

SEQ ID NO: 2815 - DNA, 37 bp, Methanobrevibacter ruminantium
tagttgaaatgttaaaggaattttaatattttaacta

SEQ ID NO: 2816 - DNA, 172 bp, Methanobrevibacter ruminantium
atattattataataaattatagtctccttaatgtaaattttgtaatgaaagatttatttctataattattgattaaaaaattaataaaaaactattgatttttattattcaaaaggacttatagaatcatttaaattaaataaattacataaataattaaggaaacttaata

SEQ ID NO: 2817 - DNA, 492 bp, Methanobrevibacter ruminantium
tcatttttgtgtttttgtgcaaaaatgaattttcacagataaactatttaaaaaagagaaactcgattgaaattttagaaaaaagagtctaaatagtttaaataattagttttaaaaaaataatcacttaaaaaagagtttaaataaggattttaaaaaaataagcagttaaaaagggtataaataataattataaaaaaataagcacttaaaaaaagggtttaaagaataattaattaaaatttattaaaaaaaagaataaatggtggttaattaatattgattaaaaaaccaatattaaaagttaaatttagaaatctgcagaagagccttttccaattaaagtcattaatgcaataacaacaataaatcctccaatcataactaaactcatccaaaagagaccacttgcaatatctgctattaaattcataatcttcctccttaaatcattaatttaattaataattataaaataattataaaattaat

SEQ ID NO: 2818 - DNA, 276 bp, Methanobrevibacter ruminantium
aattaaaattaaaatacaactaattaaaacatcataaattgaattaaccattaattttaaaataagctaaatttaattaaaattaataggaaaattgttcaaaaatttcaaacccatagaaaaatagaatcatttaaagaaattaattaaatctattcaaaaaatgataaaattttaaaaactaaataaaaatcagaataataaaaaaaatagtctttaaaagtgaaataaaaaatatttaaaaaaaatagttgaaagtaaaataaaagcatataa

SEQ ID NO: 2819 - DNA, 83 bp, Methanobrevibacter ruminantium
gccgagatagtctagcctggtaaggcgcgggacttgaaatcccgtgggtaccccccgcctgggttcaaatcccagtctcggcg

SEQ ID NO: 2820 - DNA, 39 bp, Methanobrevibacter ruminantium
taatctagtttagatctcttaaagattaaaactagatta

SEQ ID NO: 2821 - DNA, 17 bp, Methanobrevibacter ruminantium
taattaagttttaatta

SEQ ID NO: 2822 - DNA, 228 bp, Methanobrevibacter ruminantium
attaaaaattataaaaaaagtagaaaagaaaattaatgaattttgaattttaattactaaaactattagaaataaatgattagaaataaaaaatttaaatctaaatcaaaaatttagaatttgaaaaattcaaaaattcaaagtctaaataaaaataattattaataaaataatattttataaaaaatattaaattaaaacattatttattatttagaaaatggatta

SEQ ID NO: 2823 - DNA, 334 bp, Methanobrevibacter ruminantium
ataaacatatgtttaattgaaatccattatattgtcattcttaaatgaaattttttaaaaaaataataaaaaattaaaaaaaataattaattaattttgaactgattctaaaataaaaccatttagaaaagtctaaaaaattaaaagatttagaaaagtctaaagaattaaaagatttagaaaagtctaaaaaattaaaagatttagaaataaaagtttcaaaattaattttatgattataaaaagcactaaaattagtgtgctgcttttgcaactctttctttttcttcttttttctgtaaagcgaaacttctagtatcttcttcagaagcaa

SEQ ID NO: 2824 - DNA, 434 bp, Methanobrevibacter ruminantium
atttaagattagaatgaaatatagaatctaaataaataataaaaaactaattgaatttattaaataaattaaaaaacatacaaatattatctttaataaataccaatagttctaacttgaattagcatataaacaaatctgctaattaattgaaaaataatattgttaaatcttatttaaataagagataaattactcataggtgtcaaaataagttatttaagatatataataactaaaataatgaatcaattcctataaaatattagatttaaaatataacaattgcacacacgttatattcaaatcaatatgaatttatctgtaaaaatgataggtaaactataaactgaaaaccatagccaaaatgcacacgaaagctattggttttttaataataaaaagattatagtcaaatattatataaaaaatca

SEQ ID NO: 2825 - DNA, 136 bp, Methanobrevibacter ruminantium
atatattagaataactttattaataaatgtttggtttttccacatttttaataagctagttaaaaaaagtttgtaaaaaatattataaaaattataaatattataaaatattattaattagaactcagaccttgag

SEQ ID NO: 2826 - DNA, 398 bp, Methanobrevibacter ruminantium
catttttaataagctagttaaaaaaagtttgtaaaaaatattataaaaattataaatattataaaatattattaattagaactcagaccttgagatcaaattaaaataaattaaaaattaatccataagattaatcagattcggattttcttaaatcgaatttttaaaaaaaaataataaaatcaaattatatttaaaaataactagcaattaatttccaaataggaaaatagaattaaaccaattagatttaaataaataattgattttataaaactttattcataaacaataatgcaaaaaaagacaattctttagcaataataattaagtccttaaataatgattaatcatcaaataaggaaaagacttattttaaaacaatattgctaatgttg

SEQ ID NO: 2827 - DNA, 218 bp, Methanobrevibacter ruminantium
aattaaaaataatagtaattattattttattaaaaaaatatataaaattttttataaaatctaaaaaatcggaaaaaatagaccttgaaaatagataaaataataaaaaataataaaaaaagtataaaagtataaaaaaatgaaaataaaaataattgaggataatatcaataggaaattctaaaatatgaaaaagtaaataaattaaaaattatttt

SEQ ID NO: 2828 - DNA, 338 bp, Methanobrevibacter ruminantium
tctatggaataataactatctaaagatccccctttaaaataataattcttcaaagattaattctcctttaaaagaaatttttccttaaaataaaaaaattcttagtttaaattaaaattctccttaaattaaagatttatgaataaattctagtagaacccttgttctattttaacgcaatacacaaaattattaaaatacgatttaaatagtgtataaattcaaagatataaaatccaaagataaaatttatagaaaataaactatgcagaatgaaaaaaaattaaaatcaataaaatagtttataaaaatatctaaatcttagtttaataaataaa

SEQ ID NO: 2829 - DNA, 74 bp, Methanobrevibacter ruminantium
gggcccgtagctcagtctggcagagcgcttggcttttaaccaagcggccgcgggttcaattcccgtcgggcccg

SEQ ID NO: 2830 - DNA, 72 bp, Methanobrevibacter ruminantium
gccctggtggtgtaggggctatcatgtgggcctgtcgagcccgcgactcgggttcaaatcccggccagggcg

SEQ ID NO: 2831 - DNA, 74 bp, Methanobrevibacter ruminantium
cccgacttagctcaatttggcagagcgttggactgtagatccaaatgttgctggttcaagtccggcagtcggga

SEQ ID NO: 2832 - DNA, 75 bp, Methanobrevibacter ruminantium
gggaccatagggtagcttggtcgatcctttgggctttgggagcctgagactccggttcaaatccgggtggtccca

SEQ ID NO: 2833 - DNA, 74 bp, Methanobrevibacter ruminantium
gcctcggtggctcagtctggtagagcgcgagacttgtaatctcgtggtcgcgggttcaattcccgtccggggct

SEQ ID NO: 2834 - DNA, 283 bp, Methanobrevibacter ruminantium
taaaagagatttataatagataaatctcttatttttttttattaaaaatttaattagttcggatagatagaaactttttttaatttaataattgtggcttaaaatatgaaaataataataaacatctattaaaagaataaataagcagtgattaaaaagttattaaataataagtaaaaattagataataaataactaagaaacaactagaaaataagtaaagaataagtaagtaataaataaaatattaataaataataagtaaaaaataagtaaaaactaa

SEQ ID NO: 2835 - DNA, 29 bp, Methanobrevibacter ruminantium
aaagagatttataatagataaatctctta

SEQ ID NO: 2836 - DNA, 23 bp, Methanobrevibacter ruminantium
gagatttataatagataaatctc

SEQ ID NO: 2837 - DNA, 23 bp, Methanobrevibacter ruminantium
gagatttatctattataaatctc

SEQ ID NO: 2838 - DNA, 295 bp, Methanobrevibacter ruminantium
caaataagttttaaaatttaatataacaacaggtgtcttaagactcaaatcaaatcctccttaaaattataaaatatcagtagataattctttttttatgataaataataaatagaataattataaaaattattactatattaataaaatatatattcttaattatatttaaattattttaaattttaaaaatctaaatttaaagaaataaaaatattaaattattttaattattttaaattatttttctaacaaaactttaaaaggattatcatgacatttactaaagaagaac

SEQ ID NO: 2839 - DNA, 27 bp, Methanobrevibacter ruminantium
aaaagaagctggcaaatagcttcttta

SEQ ID NO: 2840 - DNA, 19 bp, Methanobrevibacter ruminantium
gaagctggcaaatagcttc

SEQ ID NO: 2841 - DNA, 222 bp, Methanobrevibacter ruminantium
ctatgttcaaaaaacttcatttttctcactctaaataataagcatgaaaattttatagtaattgaattttaaaaatacttatgaatatataaaaaaataaaaattaatgaataaattgccctataaatatagaactaaattattttttaatcacataattatttgtgcttcattattattaaaattatttataaagatttcaagaaatttggaaaaaaatta

SEQ ID NO: 2842 - DNA, 304 bp, Methanobrevibacter ruminantium
tggcttttttaaaatcattagaataatatgctttatttaattcagaaaaatatttttttactttaaactttccaaacataatcttcactcttaaaacccacaatattcaaattgtttaaattttaattacttatctaataagaacctgattagaaaattataaacatttaaagttttataaaaacaaaaccccacaaacaagaatttaaaagactataaataaagacaaaaccaaataaacatgaatttcttaaaaataataattcaaataattaaaaaaaagataaaatcttgaaaaaaataa

SEQ ID NO: 2843 - DNA, 123 bp, Methanobrevibacter ruminantium
aagtaaaatatagatagatatgaattaacattaatatttatggttttatttatttaaataattttttaatatataataatagagcgtacaaaattgtacattaaaaaaagagtttttaaaaat

SEQ ID NO: 2844 - DNA, 294 bp, Methanobrevibacter ruminantium
ttattactatttaatttattctatttttaagccttgaaatattaagttttttgtaaaaatcttaaaaaaatagggtggaaaaatccaattttttatgaaaaattaaaaaacttagactaaaaaaaattaaaattttatttaaatattaaaccacttaaaagaaaaatttctaagataaaaattaataaaaatcctccgaagccattaaaatagaaaaacaattacgccaccaatcaaacaaaacaaaattttatattataataaagataaaaattaaaacataaaagataataa

SEQ ID NO: 2845 - DNA, 255 bp, Methanobrevibacter ruminantium
taaaagatttaaaaaaatatcgaataaaatattaaaaatatttcaaaaatagtaaaattatacaaaaacttattattaataaaaataataaatatataattattataacttacatcaatcaatttttaaatattttaaattaaaatgaaattttcattaaagaaatttctgaatttaaatataaaaaattgaaaagaaaatttaatattattttaattatggaggaataaccttgagtatttttggaaatgaaga

SEQ ID NO: 2846 - DNA, 187 bp, Methanobrevibacter ruminantium
agtaaaattatacaaaaacttattattaataaaaataataaatatataattattataacttacatcaatcaatttttaaatattttaaattaaaatgaaattttcattaaagaaatttctgaatttaaatataaaaaattgaaaagaaaatttaatattattttaattatggaggaataaccttgag

SEQ ID NO: 2847 - DNA, 31 bp, Methanobrevibacter ruminantium
tattatgaattgtataaaacaattcatagta

SEQ ID NO: 2848 - DNA, 31 bp, Methanobrevibacter ruminantium
gaatatttctggattaaatccagaataattc

SEQ ID NO: 2849 - DNA, 19 bp, Methanobrevibacter ruminantium
ttctggattaaatccagaa

SEQ ID NO: 2850 - DNA, 19 bp, Methanobrevibacter ruminantium
ttctggatttaatccagaa

SEQ ID NO: 2851 - DNA, 11 bp, Methanobrevibacter ruminantium
ctcttttagag

SEQ ID NO: 2852 - DNA, 293 bp, Methanobrevibacter ruminantium
cttatgaattaatatcatataattaaattgaattatttacatatctttgaaaatcattaagatttaataaaactagactatttaataaaaccaaatgatttaaaatttttacatattaataataaatttattatttttaatatataattataatgtaagaatttgtcaaaatagataaaatccaataataagataagcagataaacaatagttttttatattctcaagatataaaatttaattatgactttagaattatttggattaaaaaaaattcctttggtaaaaaaagg

SEQ ID NO: 2853 - DNA, 274 bp, Methanobrevibacter ruminantium
ttaaaaagtttttatatattaaatgaaaataatcattatgaatatatatttattatgaatatatattcataacatttaatatatagtttgtcttttgatttttaggatgaaaatgtattgtgtattgagattatagaaaaaatagtttaaaaatacttattgtcttggtatttgatgaatgggcggtgatttaaaaaaatagtgaagattttttgcttaaaatctttttaaagaatgtaatgttttaaaaaagtttggatagttttaacttaga

SEQ ID NO: 2854 - DNA, 241 bp, Methanobrevibacter ruminantium
caaacttttttaaaacattacattctttaaaaagattttaagcaaaaaatcttcactatttttttaaatcaccgcccattcatcaaataccaagacaataagtatttttaaactattttttctataatctcaatacacaatacattttcatcctaaaaatcaaaagacaaactatatattaaatgttatgaatatatattcataataaatatatattcataatgattattttcatttaata

SEQ ID NO: 2855 - DNA, 49 bp, Methanobrevibacter ruminantium
taaatgttatgaatatatattcataataaatatatattcataatgatta

SEQ ID NO: 2856 - DNA, 37 bp, Methanobrevibacter ruminantium
ttatgaatatatattcataataaatatatattcataa

SEQ ID NO: 2857 - DNA, 47 bp, Methanobrevibacter ruminantium
actagctcaagctttttgagccttcggctcaaaaaccttgaccaaaa

SEQ ID NO: 2858 - DNA, 45 bp, Methanobrevibacter ruminantium
ctagctcaagctttttgagccttcggctcaaaaaccttgaccaaa

SEQ ID NO: 2859 - DNA, 43 bp, Methanobrevibacter ruminantium
tagctcaagctttttgagccttcggctcaaaaaccttgaccaa

SEQ ID NO: 2860 - DNA, 269 bp, Methanobrevibacter ruminantium
tataaaacttattaatttttatttaaaaaaagtgagttttattttataaatgtggttcattattaaatttgcattgaattttttagttttttaatactttgggaatcttattttttctaaaaaagaatcatttttttaaaaataggttcgaatttaatattttttttaaaaataagtaaaatcaatagaaataactaggattcaaaatatgtaaaatagttttttgaaaaaaaaataaaaaataagataattgtgatggaaaaatcata

SEQ ID NO: 2861 - DNA, 34 bp, Methanobrevibacter ruminantium
tcaaacaaagttaattaaatttaacttgttttga

SEQ ID NO: 2862 - DNA, 34 bp, Methanobrevibacter ruminantium
tatctaatttaaatttctggatttaaattaggta

SEQ ID NO: 2863 - DNA, 37 bp, Methanobrevibacter ruminantium
aaagtgaattggattaatttttaattcaattctttta

SEQ ID NO: 2864 - DNA, 27 bp, Methanobrevibacter ruminantium
gaattggattaatttttaattcaattc

SEQ ID NO: 2865 - DNA, 566 bp, Methanobrevibacter ruminantium
ctataatatttaaaaactctacacccattttattacctattaagtttatttatttggttttaaaattattaaacatgaaattttgattattttaaaaatattaattaaattatttaacaaatattttaattaaaatattcatatattctttttctattttattctatataatttattagattttttaggattttttaggattttttatgaaccaaatgtaatttttcataaaaaatttttttcaaaatcttgctagtatttatattaagacaaatatatattatagtaataaattatttactaatgattatttactataattttttaattattcacttattcgattttggatgatttttgaaattttcaaaaagtttaaaattctataaatatttgggacgttttttaaaattttccgaaaggtttaaataattttcattataataattagtgtaatttaaataaaagttttggataatgtttaggaggcaaattttggcgaaaccacaaaataatcaacaagaatatagaagagtacgtactccaaagaagggagaaattccagg

SEQ ID NO: 2866 - DNA, 413 bp, Methanobrevibacter ruminantium
agattaatttaaaaacaattccaaagaggtttgaaattatggcagaagaagaaaaaagttctaaaaagaaatccaaaagagaattagaaaaggaacttaacagcaaagtagataagatcatagaaaagaacttcgaagattttaaatctcaagatgaacttgaagactttatccaaaaggctttcgacgataaagcttcacaatacaataaaaaaatcgaattaaaagaaaaagagttggataaaaagttcaaagcttcaagagaaaacgataataaaaaaatcgatagaaaaataagagaaatggatagaaaattaaaattaaggtataaaactatgttaaaataattattattttaccttaattctttttttaataattaatttactttaattcttttttttaaaaaaaaa

SEQ ID NO: 2867 - DNA, 28 bp, Methanobrevibacter ruminantium
gcctttttatcttaatgattaaaaaggc

SEQ ID NO: 2868 - DNA, 214 bp, Methanobrevibacter ruminantium
caataatcattaaaacttaattagtttatttaataaaatttaatattaattaataatataatataattagtttgtcttaattaataatattttttaaattaattagaattttataaaattcataaaaataagaaaaaataaaaaacaatagctaaaggttttaaaatgtataaagataataaaatattagttgtaattcctgcaagaggaggat

SEQ ID NO: 2869 - DNA, 19 bp, Methanobrevibacter ruminantium
gttaagactttgtcttaac

SEQ ID NO: 2870 - DNA, 194 bp, Methanobrevibacter ruminantium
tttaaatcagaattcaatagtttttgattaaattgctaaaataaatctttagaaaaattagtaaagaaaaaatttagattaaaaatcagtaaagtaagaatttagattaaaaattagttaagtaagaatttaaattaaaaatcagtaaaataagttatttagtttaaaaaagagtttaaaaaaaagaaaaaaga

SEQ ID NO: 2871 - DNA, 28 bp, Methanobrevibacter ruminantium
taaagatgaataactcttattctcttta

SEQ ID NO: 2872 - DNA, 201 bp, Methanobrevibacter ruminantium
aaatattagttttttaaaagcatctttaagaaatctaaaaaaagctaaattaaaaataattttaaaaaaccaataaataaaaataatctaaaattaataaaaatctcaaaaatatctgaaataaactgaaattatcaaaaataacttaaaaaaaataaaaaataaaatttaaagataaaaaatctttaaattaaattataa

SEQ ID NO: 2873 - DNA, 33 bp, Methanobrevibacter ruminantium
tttaatttaaagattttttatctttaaatttta

SEQ ID NO: 2874 - DNA, 23 bp, Methanobrevibacter ruminantium
tttaaagattttttatctttaaa

SEQ ID NO: 2875 - DNA, 183 bp, Methanobrevibacter ruminantium
ttaaaaaatcatatcttaataataatcttaaattatgatttaaataaaattaaataatgtttggatattaaataaaagtccaaataaagattaaaaaattaattgaaatttaataaggaattttttaaattcaatgaataaaaagaataaaaatattctctaaaaatgtttaaaactaaagaa

SEQ ID NO: 2876 - DNA, 31 bp, Methanobrevibacter ruminantium
gaattaattaaataattcttttaattaattc

SEQ ID NO: 2877 - DNA, 244 bp, Methanobrevibacter ruminantium
aagttaatctaaaaaaatgaaaatggtgaaaattttgaatcaaaaaagtgcaaaaatacaattgaaaaaaattctttcaattaagataatgaatataaaaaactgaatggaaaatattctattcaactaagataatgaataaaaaaaactgaatggaaaatgtaaatataaaaaattacaaatagaatattaattcataattcaatattatattaaaaagagaaatgtgttaatatgaaaataa

SEQ ID NO: 2878 - DNA, 348 bp, Methanobrevibacter ruminantium
taaccattgttttaaataaattaagggccttttttgattaaaatagctttttatattataaaattatatggctattttattaagtactgtaaaaaaagtttaaaactagtaaaaatagattaaataataaaaatataataaaaaataagtaaaattagaaaaataattaaaaaaagttttaaattaaaaattaaagtgttattaaaaaataaaagttaaaaacaaaggattagctttgtttttaaatttagttaagtacatagcttatataaccgctaggatctctgactaatcctaaaagtgagtcaataaagctgaagtactctccatttaatctgaataaataaa

SEQ ID NO: 2879 - DNA, 32 bp, Methanobrevibacter ruminantium
tttaaaaacaaagctaatcctttgtttttaac

SEQ ID NO: 2880 - DNA, 30 bp, Methanobrevibacter ruminantium
ttaaaaacaaagctaatcctttgtttttaa

SEQ ID NO: 2881 - DNA, 11 bp, Methanobrevibacter ruminantium
tagtgaaacta

SEQ ID NO: 2882 - DNA, 261 bp, Methanobrevibacter ruminantium
catcttggattgccataatattctctccataaattatttaaaaatctttaattgcaaatcaattagttaaaaaaaagtctctcacatttccagaacaactttctagaacctatttaattaattaaaatgcaattaaataatcaatgtaattaataaaagtaattagtaaattcaaaaattatcaaattaataaatcttttttttactttgaatataattatcaaaaaggatttgataatatgattttattaaaatataatt

SEQ ID NO: 2883 - DNA, 149 bp, Methanobrevibacter ruminantium
atcttttttttactttgaatataattatcaaaaaggatttgataatatgattttattaaaatataatttcaaataataattacaataattaaatattaaacaatcaaatatttataatttatttatttttgggtaaaattttagtaaat

SEQ ID NO: 2884 - DNA, 234 bp, Methanobrevibacter ruminantium
attaaatattaaacaatcaaatatttataatttatttatttttgggtaaaattttagtaaatcttaagagtgaaattggaaaaaatagaaaaatttcgataaaatatgaaaattttaaaaaaaaaataatcgctaaaaaaaataaaaaaagagtaacttaaaaaaaatatttaaaaaaaaataacttaaaaaatatttaaaagaaatacttaaaaaatatttaaaaaaaaagga

SEQ ID NO: 2885 - DNA, 325 bp, Methanobrevibacter ruminantium
ctttgtttcttcagacatcaatacacaacctagctaatttatggaaaaaatcaaaatgaaggaaaaactcaaaaataactctatttcttctttatctttcaagttaatttctttaaaaaaagatttaccatatataactatttataaaaataaagattgaaatgaagtttttcttaaattaatatattatatgatttttattaataaaaagattttctataaatccttaattcatcaaaataagattaaaatagcgaaattgatttaatattaaaacaatattgatttgagaatataaaattatgactaaattgaaacaatttta

SEQ ID NO: 2886 - DNA, 283 bp, Methanobrevibacter ruminantium
ttttgattttaaaaaattaattagatttttaaaaaatttcaaaaatgatataaaaaagatcaagacttaatacaatttttaaacaagaagaaaagaccagatttttaaaatactaaaatttgaaaatgttttaaaaattgaaaaatgagaaattgatatgaaaaaatactaaaaatttgaataaaaattagaatataaatacattaaagactataaaagcatttaaatgtaaaaataaaaatttattggagaataattaagaaaccatttaaataaataattc

SEQ ID NO: 2887 - DNA, 24 bp, Methanobrevibacter ruminantium
ggtgcttaacttatgttaagtgcc

SEQ ID NO: 2888 - DNA, 326 bp, Methanobrevibacter ruminantium
ttcaatagtttaaaacaattctataaaataagaataaattttaaaaaatcagccaaaaattaaggaaaacctaaagaaaaattttgataaaaaattgataaaaaattgataaaaaattgataaaaaattgataaaaaattgtaaaaaactaatagaaaaaaatgagaaaaagtgaaaaaattcaagtaaaaatcataaaaaaacaaataaaaaaatataagcatgatcctaaagaaatcataaatccaatagattcacatcatcaaataccttaaagttcttatcaaaggtaacaatataatccaagccataatatttatataaaa

SEQ ID NO: 2889 - DNA, 217 bp, Methanobrevibacter ruminantium
gttttagaataatttttcaatgaatttatctaatttttctatttttaatctattttttctttaatttatctaaatttttactaatttttactcatttttattaaaaaaatcaataagtttatatattgttttaatcataaagaattataaggtaaactaaaatttaataataaatattagtttttttaaaatggagtattatttttgagaataattt

SEQ ID NO: 2890 - DNA, 233 bp, Methanobrevibacter ruminantium
ctataatcatataaagacctctaatgaaataataaaaatatctgtttaattttgaaataaaagttaaataataattttttaaaatgaaaaatattctaaattaaaaaatattataaattgaaatatattataaattgaaaaataaatgattaaaaaaataaaaaaagtttaaaaagcttaaaaagcttaaaaaggtttaaaaagatagtttaaaatcttagaatgctttaaaa

SEQ ID NO: 2891 - DNA, 357 bp, Methanobrevibacter ruminantium
ctttctatataatatatagtattttcattaaataatataaattttgttaaaaaattttgagaataaataaactagtgtgaaaattagaaatttaaaattaaatatttgttaaaaaatgttaaaataaaataagataaaataagatagaataagatagaataagatagaataagataaaataagataagataagataaaataagataagataagataaattagataaaattagataaaataagataaaaaaagataaaaatgttaaaaaaaagttaaaaatgttaaaaaaaagttaaaaatgttaaaaaaaagttaaaaatttaaaaatataaaaagaaataatttgaaaaaagatta

SEQ ID NO: 2892 - DNA, 26 bp, Methanobrevibacter ruminantium
gattagatgatttatttcatctaatc

SEQ ID NO: 2893 - DNA, 42 bp, Methanobrevibacter ruminantium
tggtctaaataatgattattttttagtccattatttaggccg

SEQ ID NO: 2894 - DNA, 418 bp, Methanobrevibacter ruminantium
ttagttagttaagaatgaaatatttgatgaataaatctaaaaatcttaataattaaacaacgaataattaaaaagataaattttgtgaaaaacttatttcaaatctaaaaagatcacacgaatcaaatctgaaatagcatttcatgtataaaatttgcaatttttgcaatatgtgaaaaatcgcaaatcaagtttattttaataaaaataaactctaaattaattgtttttgagacaatttaatgcctctaattaatattttattttaaactacatatataagttttactaaaaaatctcgaattttatccattatttttagcaatgcctaacaatttaagcgattaatcaaaattaattgaatacatgtcaattaaattgaagaagttttttcccaaatttgcttttaaaatagtga

SEQ ID NO: 2895 - DNA, 398 bp, Methanobrevibacter ruminantium
ttattttaattctaatattaatagtttatttaatattgattttaaaaaaattaaaataaaattaatctattgaacaaaattagaaaaaacataattcaaaaaatgaaaaaagtgaaagaaaaacataataaaaaataattatattataatttattatatataatagtatttatttagaaaatttttatgaaaattagaaaaagaataaagaaactaaaaagaataaagaaactgaaaagaataaagaaactaaaaagaataaagaaactgaaaagaataaagaaactgaaaagaataaagaaactgaaaagaataaagaaactaaaaagaataaagaaactaaaaagaataaagaaactaaaaagaataaagaaactaaaaagaataaaaaaattaga

SEQ ID NO: 2896 - DNA, 294 bp, Methanobrevibacter ruminantium
aataattgataaatataattccaaattcattttcaaatctaaatttcacaatttaatcaaaattttaaaaatttataaagcaattaaatattctaattaaatatattttcatattatattatataatttattatttttatctattatttttatctcggtgaaatttaaaaaagaacatcaaaataaaataaaaaaaaagtttatcaatgcaaaaactcaaaaagcgaaaactcaaataaattcaaataaaattcaagaataaaatatattattttttatattattaataataaa

SEQ ID NO: 2897 - DNA, 204 bp, Methanobrevibacter ruminantium
tattcttaattaatttattctttaacttttatatcatatataattaatttatttaataaatttatttaattaatttaatttattcattgaattaaagtaatacatataattaattttttatatattaaaaattaaaaaaattattagcaattgttttagattaaattgatttaaagtgataatttgacaataatttcaaaaaag

SEQ ID NO: 2898 - DNA, 192 bp, Methanobrevibacter ruminantium
atttctttgccttttggcatgtgctgcatcttgggtagtaaataaataacatctttaaaacctcttttaattaatattcttaattaatttattctttaacttttatatcatatataattaatttatttaataaatttatttaattaatttaatttattcattgaattaaagtaatacatataattaattttt

SEQ ID NO: 2899 - DNA, 28 bp, Methanobrevibacter ruminantium
agagaagttaaagtaatttaacttttca

SEQ ID NO: 2900 - DNA, 26 bp, Methanobrevibacter ruminantium
gagaagttaaagtaatttaacttttc

SEQ ID NO: 2901 - DNA, 249 bp, Methanobrevibacter ruminantium
tctaaaagatattcattgactttttaatatttaatttgctaaaatagagaaatatttttctctatatctttttttattatttatatcggctttttaaatcttattttttattatttttttacctttatgaatattacttaaaaaataattataaagtttatcagtttgtattttataatttagataattatttaatatttattattatattaaatcataatttattctattttaatttttaaatgctct

SEQ ID NO: 2902 - DNA, 75 bp, Methanobrevibacter ruminantium
aaaaatatgattgatcttttcatataaaaacccctaaaaaactattaaaaatcagtttaataaatttttttattt

SEQ ID NO: 2903 - DNA, 36 bp, Methanobrevibacter ruminantium
gaaatataatgaagatttattcttcattatttttac

SEQ ID NO: 2904 - DNA, 180 bp, Methanobrevibacter ruminantium
ttcaattttaatttttttttaatcaatagttaaaaaaagttagattattcattaatatttaattaaaattagatctaatcattaaatttaaaaaaaagttaaatttatattttaataattaaaataagctatttttatttaaaaaaaagtaaaaataatgaagaataaatcttcattata

SEQ ID NO: 2905 - DNA, 23 bp, Methanobrevibacter ruminantium
taatgaagatttattcttcatta

SEQ ID NO: 2906 - DNA, 343 bp, Methanobrevibacter ruminantium
tttttaaatttaatgattagatctaattttaattaaatattaatgaataatctaactttttttaactattgattaaaaaaaaattaaaattgaaaaaaagagtttagagaatcttaaagtaaagttaaaaataaaaaaatagttaattaaaaaatcaatgaatatctactttttaaattaaaaaataaaaaaaaacaagaagcaattaattactttcttgcttcgattactgtttttccacccatataaggcactaaaacctctggaacctttacgcttccatcatcctgctgatagttttctaatatacagcacatagttctttcagttgctattgcagtac

SEQ ID NO: 2907 - DNA, 25 bp, Methanobrevibacter ruminantium
caagaaagtaattaattgcttcttg

SEQ ID NO: 2908 - DNA, 279 bp, Methanobrevibacter ruminantium
tctatcttttgaaaaaatgcaatttaatccaaaaatttcaatattgtaaaaaatatacaaaagatttattaatgtaattaatcatatttaaataactgaatgttaatataagtataaaaaaatatattaatataataatatttatcaaattatcaaaaagtaaattaaaaccaaacaattaatttacagttatcacaattaattttcactataaaaataagattttaagaaggataatctaatgagaagagaatgtttaaaaatcataggaactgcaca

SEQ ID NO: 2909 - DNA, 92 bp, Methanobrevibacter ruminantium
aattttattcttatattaacgaactaattttattttgctaaaaaaaagaaaaaagaaattaaattatttaatttctcttatcaatagaaaat

SEQ ID NO: 2910 - DNA, 35 bp, Methanobrevibacter ruminantium
gataagagaaattaaataatttaatttcttttttc

SEQ ID NO: 2911 - DNA, 21 bp, Methanobrevibacter ruminantium
gaaattaaataatttaatttc

SEQ ID NO: 2912 - DNA, 367 bp, Methanobrevibacter ruminantium
cattgatggtggatggactgcaatttaggtccaataagataaaattaaatcttaattaataaaaatcatatcaaccaaattagcaaggttatttattaataatcttgctaaaacctcttttttaaaaaaaatagctaaataagattataaaaaaatactctttttaaaaaaaaaatagtttaaataaattataaaagaatactccttttaaaaaaatagcttaatatatattataaaaaactctctatttgataaaaaaatagtctaatgaataaaaaatactctttttgataaaaaacagataataaataaaataaaaaaaataagataaagaatatataatccataaaaagaattataactcttt

SEQ ID NO: 2913 - DNA, 32 bp, Methanobrevibacter ruminantium
ttagcaagattattaataaataaccttgctaa

SEQ ID NO: 2914 - DNA, 303 bp, Methanobrevibacter ruminantium
ctttaatgttatattagttttgttataatcaataatttaataaaatctatgaataaaaaaataataaattttagaatacaaaaaaattaaacaaaaattatctaaataaacatcattagaataaattaaataaaattaaataaataaaatctaatttaatcatttttacagtcaaaagcgtcagaggagataaaatggaagaatataaagacaattttccccaagaggaattgaaaacatacactgaagatgaattaaagatcatagaagaaggtaaagtcaaaataaaatttccagactttg

SEQ ID NO: 2915 - DNA, 235 bp, Methanobrevibacter ruminantium
aaacaatcataaaaataaatctaccgaataaaaggcaacaaaataaacattaaaatttttaaaataaaaatgataaaaaaatatcaacaaaataataaaatattaagataaaaaaacaatttatcaaaatatagataaaaataaaggaaatcaagcaaaatatataaataataaaaaattaataatataacatataattaattataaaaatgtataaaaaataataaatttttaa

SEQ ID NO: 2916 - DNA, 310 bp, Methanobrevibacter ruminantium
gtattatttttagacagtttttagatttttgggtcgaaaattgcaaaaatagttaaatggtttatctttggatagtgatgatttggattggaaaaatagtttaatagcttatctttggatagtgatgatttggattggaaaaatagttaatgattatagaattattaaaatacataagaattagtaaaaaatataaaaataaaagaaaaagagtttattttaatggattagtataatttaaagaataaattttaagggagtactttaaattaaaaattaaaaagaaaaaggattaaataaaaatatttaa

SEQ ID NO: 2917 - DNA, 485 bp, Methanobrevibacter ruminantium
ttttataaatatattaaagtgtatcgtttataatagaaaattatattaaagaaattaatagaaaatatataaacatacaaatattataattgaattaaaactataggaactatagaaatagtttaactatataggacaaatttttttatagtattttataaaaaattttacaagaaggttaacaaaaatggtagtttgtctcccagacacacaagatgatgcacctagaatacctatccatttaagcagagtaggtgtgacaggtgttaagaagcttttaactcttaaaaggaaagaaaaaagaccaatcatattattacctacttttgacgcttttgtagatttgccaagcgatcaaaaaggtactcatatgtctagaactcctgaagctatcagtgaagtagtagaagaagttgctcaaagctcccaaaaaggagtggaatccctttgcgcagacatagtcacaagaatgcttgaaaagcatg

SEQ ID NO: 2918 - DNA, 262 bp, Methanobrevibacter ruminantium
ttatgctgtttaaaaacagaaatcttttttttaattattaaaaacagtttaatggacctaatattgactaagtctggaattactattagaaacagtttaataggcctaatattgactaagtctggaattactattagaaacagtttaataggcctgatattgactaagtctatagaatactattaaaaagagattaataaaccttatattaactaggtctattaattttaaaaatagtcttattttaattaatataaattaa

SEQ ID NO: 2919 - DNA, 27 bp, Methanobrevibacter ruminantium
tgatatttgattaataattaaatatca

SEQ ID NO: 2920 - DNA, 21 bp, Methanobrevibacter ruminantium
gaaattatttaaagtaatttc

SEQ ID NO: 2921 - DNA, 365 bp, Methanobrevibacter ruminantium
ctaaaacaatttaaaaaaattaattaaaaccataatatctcccccttaaaaataagctattataatttttaataaaattcaagaataaattcttataacttactttataataaatcatataaaaagttttttaaaaaattcggccaaaatttacctatttaaataaaaaaacaagaaaattaacaatttttataaaaataataaatttacaagtattaagaatttgaattcactatcttcactaaaaagcaaataattatgcaaattagataaaaattaaaatttacaacctttactaaaaagcacatatttttaaccaagataaaaaatttaaatatagaatttgaacataattataattaata

SEQ ID NO: 2922 - DNA, 35 bp, Methanobrevibacter ruminantium
atgattgttttgagtttttaactcaaaacaactac

SEQ ID NO: 2923 - DNA, 33 bp, Methanobrevibacter ruminantium
tgattgttttgagtttttaactcaaaacaacta

SEQ ID NO: 2924 - DNA, 29 bp, Methanobrevibacter ruminantium
attgttttgagtttttaactcaaaacaac

SEQ ID NO: 2925 - DNA, 27 bp, Methanobrevibacter ruminantium
ttgttttgagtttttaactcaaaacaa

SEQ ID NO: 2926 - DNA, 365 bp, Methanobrevibacter ruminantium
aaaaatttcttaaatgtttaggaagattatttgtaaacaataggatattttttaaaaatttcttaaatgtttatgaatattatttgtaaacaatagaataaattaaaaaactttatataatacaaagacaataataagattaaatacattaaaataaattaaagttattaaaatcaataagtaaaaataaataaaataaattgattaaatgaacgcaaaattaaaaaatacgaatttaaaatactgtaaaattaaaaataatcaatatctgtaaaaatatattaaaataaactaaattaagtaaaaaatataaaaatgaaaaattactaattatacgaaatatcgaaactattatatataatgca

SEQ ID NO: 2927 - DNA, 245 bp, Methanobrevibacter ruminantium
taataattttgtaaaattaaatttaattgttaattgtaaatattataaaataaatctaatggctttaaatttaaaaataattatgaattaattataattatagaaaataataataatccaataaaaaatttaaataattaataaattctaattaatttttatagagatctctaataaaaattaatcgttacaaaattagaaaatattttatgtcaggattttttcttaaatcattaaaatgaatt

SEQ ID NO: 2928 - DNA, 33 bp, Methanobrevibacter ruminantium
gaatattgttttaagtaacttaaatcaatattc

SEQ ID NO: 2929 - DNA, 222 bp, Methanobrevibacter ruminantium
tttcaaacattttataacaacaactctttttaaaaaatataaaatattgaaaaaaaaaattaaaaattcaaaacaaactcttaaaaaaaatgaaagttttttatctataaaatttttaaaatcatctatgattaaatgtacagttaatgtaaaaactattaaaataatcaatgatttaattaatttaaatgaaagaaattaaaaaaattataaaaattatat

SEQ ID NO: 2930 - DNA, 20 bp, Methanobrevibacter ruminantium
gtgcaaaaatgattttgcac

SEQ ID NO: 2931 - DNA, 27 bp, Methanobrevibacter ruminantium
cacttttgcacaaattgtgcaaaaatg

SEQ ID NO: 2932 - DNA, 21 bp, Methanobrevibacter ruminantium
taaactcctattgggagttta

SEQ ID NO: 2933 - DNA, 29 bp, Methanobrevibacter ruminantium
ttaatttagttagtttctaattaatttaa

SEQ ID NO: 2934 - DNA, 287 bp, Methanobrevibacter ruminantium
ttttgataataaatattttgtttataatattattatatattgcttttatatattataaatactcttataaaaaactgaaaaaattattaaaaattcgaatttaaaaaaggaaaccttataaaaaaaactaagaataattaaaaaaataactaaaaaaaaagttaaaaaaagaaatatgaattaataaaaaaaatagagcctaaattaaaaaaaaacagaataatgataaaaataatgataaaaataattaataaagtaaaaagaaaagaatttagagaaatcttaat

SEQ ID NO: 2935 - DNA, 24 bp, Methanobrevibacter ruminantium
taacataagggtttccttatgttc

SEQ ID NO: 2936 - DNA, 18 bp, Methanobrevibacter ruminantium
cataagggtttccttatg

SEQ ID NO: 2937 - DNA, 645 bp, Methanobrevibacter ruminantium
tttcaatgttgaagcaaaattgatgtgaagatgtgaaaaatccatgaaaattaggctgaattttacagggtcaaatcaattttgacttaagcgtgttaaaaaattgaaaatatggtatgttaaaactaagaaaatatggcggttaaaaatatgaaaatatggaaataattctaattaattaataaaaagaagataaattgaaatttaaaatagcagtcccaaaacaataaatataaaacataattagtataaataaaacaatataattaaataaaattattctaaaaattacctaaattttaaagggataaaaatggctgaaataaaaaaacaagttagaacaagagatttcataattagtacagacggattattattcgcttcaacaaactacattcaccctgaagatagaatcatttcattcttaagatacattccagacgagaacggagacagagaaaaggatggaatcaaatactcaaaggtaggctcagatgaagcttatgcctatttaagggaaaaccacccggattacttatatttctgcgatgtgacaaatgttgaaatgatgggagttccaatagataaggtcgaaagaatcatcaagcctgaagagagacttaaaggtcttagggaaacctatat

SEQ ID NO: 2938 - DNA, 30 bp, Methanobrevibacter ruminantium
taaattgaaagcctaataggctttctttta

SEQ ID NO: 2939 - DNA, 19 bp, Methanobrevibacter ruminantium
gaaagcctattaggctttc

SEQ ID NO: 2940 - DNA, 19 bp, Methanobrevibacter ruminantium
gaaagcctaataggctttc

SEQ ID NO: 2941 - DNA, 309 bp, Methanobrevibacter ruminantium
ttctaaatataatatattatatagtattattaattttttgggtaaaaatatctttttgctttaattttaataattaattttataatttaattaattgatagtgtagatatagattaacaaaataaaaaatttataattttgttcaaagattaattaaaataaatatacatttaattatattaattaagtcacaacaactattatttaaaattatcgtgaaatcattttaattataggaaaaatgtttttaagaaatagtatccttcatcccctaaataaaattttaaaataaattttaaaaataaaatt

SEQ ID NO: 2942 - DNA, 59 bp, Methanobrevibacter ruminantium
ttaataataattgttaattattgttaattattttaataataattgttaattattgttaa

SEQ ID NO: 2943 - DNA, 281 bp, Methanobrevibacter ruminantium
ttgataaattaataatttttagtgaattaaatttttaatccctatccaaaatcaatataagaattcataagaataaaaatattgaatattgtaaaaatttaatttatgagaaaatctatggaataactgttttaataaaaaaaataatgaaaaaaattaaaagagccaaagtccataaattgaaaaaaattattaattttttcgctcaagatttctataaaaaattcatttaaatttgataaaaaaatatcaaaattccaaatgattttttaaaaaaataa

SEQ ID NO: 2944 - DNA, 377 bp, Methanobrevibacter ruminantium
taatattattataaacactattatttatcatgattatttattataaatcttttcataattttatcaattaaatcccctttggaaaagattataaaaattttatatgaaaaaatagttaaaaagtaatactaaattctattaaaaaaaggcttatttgaaaaaatgcttaaaaagtaatacctctttttatgaaatttattaaaaaaaaatgaagggtctaagtaaaaaataattaatgaaaaaaattcagctaaaaaattaatgaaatatgattaaaaaaataaagattttaaaaaaatgatgatgattttagtgaattttaataaaagtgtgggagaagattaagatagaaatctaatttatttggaaataaaatc

SEQ ID NO: 2945 - DNA, 115 bp, Methanobrevibacter ruminantium
attcttaattataactattttaaaaaaataacaatgttttatttattatttaaaattaaaatataaaaactaatttttcaaaaaaagtaataactattgaattaaattaaaatta

SEQ ID NO: 2946 - DNA, 227 bp, Methanobrevibacter ruminantium
ttaaaaaaataacaatgttttatttattatttaaaattaaaatataaaaactaatttttcaaaaaaagtaataactattgaattaaattaaaattaataagcgaatttaaaaaaagaaaaattaaataaataaataaataaaatttaattaataaactatttttataaaaaaagcaatatctaactatttatttaaattaaaatctaaacagtccccaacaagttca

SEQ ID NO: 2947 - DNA, 29 bp, Methanobrevibacter ruminantium
tagagagataataattattatctcttcta

SEQ ID NO: 2948 - DNA, 20 bp, Methanobrevibacter ruminantium
gagataataattattatctc

SEQ ID NO: 2949 - DNA, 147 bp, Methanobrevibacter ruminantium
atttttctaattgttttaatttattaaaactaactttacgaaagatttataaatataaattgagatattaattttataaattttttaagtatatgaattttaagaaacttaaaaaatatactaaatttttaaaattttttaagcata

SEQ ID NO: 2950 - DNA, 341 bp, Methanobrevibacter ruminantium
taattgttttaatttattaaaactaactttacgaaagatttataaatataaattgagatattaattttataaattttttaagtatatgaattttaagaaacttaaaaaatatactaaatttttaaaattttttaagcatatgaattttaagaaacttgaaaaatatattaaatttttatagatcttatcataaaattaaaataacttttaacgattaatttttaaaattttttaggtgttgattatgtatattgtgattatgggtggaggtcgtgtagggctatcccttgctgaccgtttgattattcatggatatgatgtaacaattattgaaaataatg

SEQ ID NO: 2951 - DNA, 137 bp, Methanobrevibacter ruminantium
tttataagagcttttattttttttaaaattagtttttaattgtttattgctctttttatagaataagtttttataaaattataaattaaaaaaaaatagtttttcttgttttaattggatttaaaaaataaaaaaag

SEQ ID NO: 2952 - DNA, 30 bp, Methanobrevibacter ruminantium
gaataagataattatttaattatcttcttc

SEQ ID NO: 2953 - DNA, 72 bp, Methanobrevibacter ruminantium
gccaagatagcttagaggcgaagcggttggctgcagaccaattacacgggagttcaaatctctctcttggct

SEQ ID NO: 2954 - DNA, 258 bp, Methanobrevibacter ruminantium
tattcttcaattaaatgattaaataatgaaatcgaagaataatattaaatatttgaaaaaaatcctaatataaaaatcctaataaaaaaattatatttattattgattaattaaattataaaaaatttctaataattatcttatagtttattttttcctatttaaataaaattggtgagagcatttgaaaactaatcaaggtcaatttcaagtgtaaaataaaacagaagattaaggattagaattagaaaaaataga

SEQ ID NO: 2955 - DNA, 76 bp, Methanobrevibacter ruminantium
gccggggtagggtaggcggtcatcctacgggactgtggatcctgtgactcgggttcaaatctcggctccggcccca

SEQ ID NO: 2956 - DNA, 83 bp, Methanobrevibacter ruminantium
gcgagggtgtccgagaggccaaaggagacaggcttaggacctgttgatgcagatctaccagggttcgaatccctgctctcgca

SEQ ID NO: 2957 - DNA, 75 bp, Methanobrevibacter ruminantium
gctccgatggtgtagtccggccaatcatttcggcctttcgagccgaagactcgggttcgaatcccggtcggagca

SEQ ID NO: 2958 - DNA, 74 bp, Methanobrevibacter ruminantium
gggcccatagcttagccaggtagagcgctcggctcataaccgggatgtcatgggttcgaatcccattgggccca

SEQ ID NO: 2959 - DNA, 73 bp, Methanobrevibacter ruminantium
gccgtcgtagctcagtaggtagagcgttcggctgttaaccgattggtcacaggttcgagccctgtcgacggcg

SEQ ID NO: 2960 - DNA, 22 bp, Methanobrevibacter ruminantium
tttagattaattttaatctaaa

SEQ ID NO: 2961 - DNA, 280 bp, Methanobrevibacter ruminantium
ctaatactttaattgactccacaattccaccatctttttaaaatgaaataaaaataaattatttgtaaaaaaatatttgtataaaatttataattttaatttacagtataagtacagttttttttacagtattaacttttcagattaagttcagtattaagttacagtataaattatatactatggtaataatatatctttttaaatatttaattagataaaattttattatatgagatttaatattaatatatagttttgttttaaattttaatatatt

SEQ ID NO: 2962 - DNA, 37 bp, gaaaataagataaatttatataatttatcttttttta
gaaaataagataaatttatataatttatcttttttta

SEQ ID NO: 2963 - DNA, 21 bp, Methanobrevibacter ruminantium
gataaatttatataatttatc

SEQ ID NO: 2964 - DNA, 243 bp, Methanobrevibacter ruminantium
ataacttaaaaaattatttaaaaagaaataattcaaaaaagaataacttaaaaaaatcatatttataataattattttataattatagtaaacttttataataaaaatagtaaataaaaatttattatttttataaaaataatttttattaaattacaaaattcaaaaaaacatacaaaaggtgagaattatggctgatgctaaaaaagaaaaaatcattggaattgacttaggaaccagtaa

SEQ ID NO: 2965 - DNA, 46 bp, Methanobrevibacter ruminantium
tagaattaattctaagaaaaaacaaatttcttagacattaattcaa

SEQ ID NO: 2966 - DNA, 269 bp, Methanobrevibacter ruminantium
ttttaataatctttttcgtctatgaaataatgtttgttatttattttaattatttattatattttattattataatttaattcactaaaagtaatattagtaatttttaatatttaaaatttgtttaattagtgatttttgattagtaatttttttagttttttttttaaaaaacatgtttaattagtgattttaatttttaattagttattattagtagttttatagtaaaaatgattttatagtaaaaatgatcttgaaaaataaaa

SEQ ID NO: 2967 - DNA, 22 bp, Methanobrevibacter ruminantium
aaaggatttctttaaatcctta

SEQ ID NO: 2968 - DNA, 16 bp, Methanobrevibacter ruminantium
ggatttctttaaatcc

SEQ ID NO: 2969 - DNA, 30 bp, Methanobrevibacter ruminantium
ttaaggatagtttttaataactattcttaa

SEQ ID NO: 2970 - DNA, 283 bp, Methanobrevibacter ruminantium
gtaagccgaagacagctgctggttatttttaactagggaaactccgcacatcaaatagactgtaaagtcgaaagacttatgctgagaagtatgactctggagcagaaacgacacggcttttaatggatgacaatgatgcttgactgatggacattaaaagaatcggtgaaacggccaatctacaggatgcaagagcaaaggtgctgatgacctctatgggaagcaaagtagttcgctaagacgaatgctgtataaaacagaatgtgggttactctcggcatac

SEQ ID NO: 2971 - DNA, 19 bp, Methanobrevibacter ruminantium
gagggctaatattgccttc

SEQ ID NO: 2972 - DNA, 328 bp, Methanobrevibacter ruminantium
acacaataataaaaataaaaagaatatctttttattatatttcatataaagtctcctatgataataagaaatctttctaacaaagtaatttaattaaataattaactaaattaacgatagaataatcttattataataaatgcttatatttttataatttataaagattttgaggacagtattacttttattttaaaaatagggcaaaaagtaataactttagaaaaaagtaatactatataaaaaaaataaaagaaaaagtaataaaattttatgaaattttgatgaaagaaatagtaaataatcaaagacaaattaaaaaatttta

SEQ ID NO: 2973 - DNA, 33 bp, Methanobrevibacter ruminantium
ttaaagagtagtttgttttaaactattctttac

SEQ ID NO: 2974 - DNA, 31 bp, Methanobrevibacter ruminantium
taaagagtagtttgttttaaactattcttta

SEQ ID NO: 2975 - DNA, 307 bp, Methanobrevibacter ruminantium
aaattagaataattttataatttgttttcattttcaaaccttctggaattgtaataattaattagaattataattgttgtttaattggtaaaaactaatcagaattataattgttgtttaattggtaaaaactaatcagaattataataattggttaatttgccaatagagttttttaatgattttcaaaattgaaaaactcttcaaataatataaataataactgtcattagttaatcaagtaaataaacagcctattattaattatcatttataatatagtagtaatacttatttaaaaattagt

SEQ ID NO: 2976 - DNA, 179 bp, Methanobrevibacter ruminantium
agtaatactttttttagtttttatttagttcctttttttaaaaattattacttttttaatgaaaataagtcaattagtattattattttaaaaaagtattactttttatccttcttttacaattttagtaataaactaatttttaaataagtattactactatattataaatgataatt

SEQ ID NO: 2977 - DNA, 231 bp, Methanobrevibacter ruminantium
ttttaaattaaaaataagtcaagaacttaaattattatatttttgtataaattaatctaattagtaatactttttttagtttttatttagttcctttttttaaaaattattacttttttaatgaaaataagtcaattagtattattattttaaaaaagtattactttttatccttcttttacaattttagtaataaactaatttttaaataagtattactactatattata

SEQ ID NO: 2978 - DNA, 236 bp, Methanobrevibacter ruminantium
attgacttattttcattaaaaaagtaataatttttaaaaaaaggaactaaataaaaactaaaaaaagtattactaattagattaatttatacaaaaatataataatttaagttcttgacttatttttaatttaaaattatatcccttcgaataatttcaaaaacataaaaaaagattaaaaaatcaaactaaaaaaaaagaaaaagaatagtttaaaactattcttaaaaaaattt

SEQ ID NO: 2979 - DNA, 19 bp, Methanobrevibacter ruminantium
gaatagttttaaactattc

SEQ ID NO: 2980 - DNA, 258 bp, Methanobrevibacter ruminantium
gaattttgataaaataggaactaaaaaattgaaggaattgatataaaaattgtgaaaatatgtgaaaagataataaaattcataaatttcatataagatttttataaaaatagatgaaaaattgaatgaaaattagacaaaaaaatcatcaaaaagtataaaaaaccggaaaaaagtgcatgaaaaactaaaaaaataattaaaaaaagaaaagaattagtctaaaagactaaaaataaaaaataaataaaattaagc

SEQ ID NO: 2981 - DNA, 17 bp, Methanobrevibacter ruminantium
ttagtcttttagactaa

SEQ ID NO: 2982 - DNA, 24 bp, Methanobrevibacter ruminantium
tattttggccgaaaggccaaaatc

SEQ ID NO: 2983 - DNA, 20 bp, Methanobrevibacter ruminantium
ttttggccgaaaggccaaaa

SEQ ID NO: 2984 - DNA, 366 bp, Methanobrevibacter ruminantium
attaaatattataaaatttaattcatttttaaaaatcaatattgaaaaggcttatttaaagtctttttaattaaatcaaaacttatataatttaaaataacatttatacatttatatatctaattttattttaatataaatttaactaaatggatttttttaaataaaattaaaagacagaaatagctttaattaaaattataaagtataattatcgtttaaaaataaaatacctaactaaaataaaatagtttaattaatagcttactatgattaacacaaaaagaaaatataagatacaattggaaaaatagccaataataattaaaataagaaaatggtcaaaataagatatgataaaaatat

SEQ ID NO: 2985 - DNA, 29 bp, Methanobrevibacter ruminantium
gatataaatagtttaaaactatttatttc

SEQ ID NO: 2986 - DNA, 21 bp, Methanobrevibacter ruminantium
taaatagtttaaaactattta

SEQ ID NO: 2987 - DNA, 23 bp, Methanobrevibacter ruminantium
gaatagttaatttttaactattc

SEQ ID NO: 2988 - DNA, 287 bp, Methanobrevibacter ruminantium
taaaatccatacttttcctccgtataaaaataataaataaataaagttataaattgattaaatttgattaaaaaaatgatttatataaataaatttaattaataaaatatttaaaattaataaaatatttaaagtaatataagtaattaaactaatgaaacaattaaaattaaagaattaaattattttaacttaaaataaaatctcatctaactaattttacaaaaagaatataaaattctattttaagttaaaataatccataaactcattttttaacaatgaaa

SEQ ID NO: 2989 - DNA, 251 bp, Methanobrevibacter ruminantium
attttgaattatatataattatatactatatgattaaaaagtgtttccattaaggtttatataatgtcaaatttaatttaaaagaaattgataggagtcaatgaattaataaaaaaagtttaaaataatagataaagtgatgataaaagaagtaaaaaacaaagaatttttaaataataaatataaactttaaaaattaaaaatgggatataaatagatattttttaaaaaaattagcaaaatattgatga

SEQ ID NO: 2990 - DNA, 75 bp, Methanobrevibacter ruminantium
agcagggtggggtagtctggtgatcccgcggggctcataaccccgagagccctagttcaaatctaggccctgcta

SEQ ID NO: 2991 - DNA, 294 bp, Methanobrevibacter ruminantium
aattcaacattataatattatacaccataatatataaagttttgtatttttctaataatttcaaaaattagaatgaagcaatataaatggaaaataagaaataaaaaacgtttaatttatctaaatattaaaataaattagatatatatagaattaaatgagtgagtaaatctaaataaaaaaaagagataaaataaactagaaaaagaaaaaatattataaaaagagataaaactgactaaaaagagatatgaaaaataataaaataaaaaagaagaatgaaattattcatct

SEQ ID NO: 2992 - DNA, 174 bp, Methanobrevibacter ruminantium
attgctttttttaaaattaaatataaaataagtgtttttttaaattaataaaccttatcactctttttaaaaataaataaaaaaagaagatattaagaaaaaaagatttttaaaattactttttttaacaaacaaactatttaatagtcaatttagcagttttagtaagagaat

SEQ ID NO: 2993 - DNA, 268 bp, Methanobrevibacter ruminantium
gtgagttcgtaaaattgttgttatcgtgtgaaattgatgtggactcgaaataagctcttagaacaaagcaaattgcaaaataatgattttaaagcaaaaataaaatttttaaaaaactaaaaaaatcttatgaaagttaaaaaatatttactttttaaagagtaaaacataaaaattaaaaataatatatttctttgaattattgtatattattatattaaattttaaataatattaagaaataatatttttaatataagaatgttta

SEQ ID NO: 2994 - DNA, 506 bp, Methanobrevibacter ruminantium
ttttaaaaatatagattttaatttaagtgctgttttaaaacgtttatgcttgttaaaaaatagtaaattataaaaaagagaaaagtttttaaatagaaaaattataattatttaagtttaaaatttaagaattagcttttaatgaataaaaaaagaaaaagagaaaaattaaagtttattttgaatattgattttgaacactaagtattgagtctataggaatatcaaacaaatcggaaacttcttgaggactcatttgttttaaagctttagtgataaaatctattctatttttttccacacctttttcttcggcttcttctagttttcttgcgaagattactcctctcagtgattcttcaaaaggtctttcttctattttggacatatttaaacacctagccatgtattttaattcatcttggtcttttatatatcttccaacccataatgcaagacattctttagtgaaatttaagataaattcgtcagcagaaagcttgtta

SEQ ID NO: 2995 - DNA, 271 bp, Methanobrevibacter ruminantium
ctatataaattataaaaattaatcttcaatagtttaggaaaattatatataaattgaaattccaatattataataattaattggaaaactttcaattattcatttttaataagttattgaaaaaaagttaaattcgaaaaatattgtttaaattttattaagagcaataaagaaaaataaattattgtctaatcaaatcaagaacaataactgactcaaatttaaaaaaattatcatataataatttttcaatatcttcaaaaaggaagtg

SEQ ID NO: 2996 - DNA, 285 bp, Methanobrevibacter ruminantium
ttaagagaatatattcttatattctcaatatttttatttatttaaaagctatttttaccaaaacttactatttatcccatttataattataatttaaatattcatttttcaaacttactattttttacgatgaaagaaaaaaataaataaaaataaataactatataaatactcaaaataaattatatatattcaattttaagattcgataactaatcataaaataaaattatttgtagtaaaccacaattattatttactataaatcctttttattaaaaatta

SEQ ID NO: 2997 - DNA, 21 bp, Methanobrevibacter ruminantium
tcctaaaagagttttttagga

SEQ ID NO: 2998 - DNA, 43 bp, Methanobrevibacter ruminantium
taatagatttaatttagatttttttatctaaattaatctatta

SEQ ID NO: 2999 - DNA, 75 bp, Methanobrevibacter ruminantium
gggcccgtagcctagcctggatagggcgtcggacttctaatccgaaggccccgggttcaaatcccggcgggtccg

SEQ ID NO: 3000 - DNA, 75 bp, Methanobrevibacter ruminantium
aggcttgtagcctagcttggataaggcgttagactcctaatctaaagaccgcgggttcaaatcccgccaagcctg

SEQ ID NO: 3001 - DNA, 368 bp, Methanobrevibacter ruminantium
atgccatattaattctccataaaattgaattaattaatctttttctaaattaaattattaaaacttttagtaacaataagttattttattcttatagtttataaactttgccttttaataacaagataagaattaaaatattagaatgaaatatcaattgaaaaagattgttatataatggcctaaaataaaatataagaaaataatagaaatataattcaatgccattaaagaaaaaattaatagatagaatgagaaattaagtaaaaaaaataaaaaatcttttaaaattaaatcaaaaagagtaaaaattttataataagaattaataatccaaatattttctatatttattttgaagaatatta

SEQ ID NO: 3002 - DNA, 45 bp, Methanobrevibacter ruminantium
taattaagtgttaaattaagttttcttaatttaataacttaatta

SEQ ID NO: 3003 - DNA, 269 bp, Methanobrevibacter ruminantium
aattattaattcatatgtattcaacagtttttataagttcaactcatatgaatattaataatttttattaaattttcatatttagtaaagttttaaaaaaacagcaattttattaaactttaatttttaataaacttttaaaaaaacagtaattcttattaatttctgatttttaatagggttttaaaagtagtaattcttattagattttaataatttaataaggttttaaaaaaataattaagttattaaattaagaaaacttaatt

SEQ ID NO: 3004 - DNA, 42 bp, Methanobrevibacter ruminantium
aattaatggccaaatattattaaaatatattggccattaata

SEQ ID NO: 3005 - DNA, 38 bp, Methanobrevibacter ruminantium
ttaatggccaaatattattaaaatatattggccattaa

SEQ ID NO: 3006 - DNA, 116 bp, Methanobrevibacter ruminantium
aaaaaaaaaaaaaaatataaaaccctgtttaaaaaaatagaaaaataagaaaaattatagaaataaacgcttaaaaaaaataagaaatattaaagtttaaataactataaaaaaaa

SEQ ID NO: 3007 - DNA, 191 bp, Methanobrevibacter ruminantium
ttatattaattaaaatttttcttctattttttccaccatcatttttattgcaaaaatcatttttttgatatcttttactttgattttatagaaaataaaattcagttttttaaaattttctcttttggcagttaaatgacaaaatttatatttttaattatcttattaaaatttatgagaaaggaaatttt

SEQ ID NO: 3008 - DNA, 21 bp, Methanobrevibacter ruminantium
ttttaattatattaattaaaa

SEQ ID NO: 3009 - DNA, 47 bp, Methanobrevibacter ruminantium
ctctaatcaagcttttttggccttcggccaaaaaaccttgaccaaaa

SEQ ID NO: 3010 - DNA, 45 bp, Methanobrevibacter ruminantium
tctaatcaagcttttttggccttcggccaaaaaaccttgaccaaa

SEQ ID NO: 3011 - DNA, 278 bp, Methanobrevibacter ruminantium
cagctttaatcaatatttgcttttattaaaaaatcattaaataagataaaaactaaaaatatttttaataaaacttaaatatattttttaagggttttttaaaatttctcttaagagttatttttagaaatttcaattaattttaaaagtttatttttacaaattttaatcaattaaatttattttttttaggttgtgattatttgaagatattaatggatgaaagaggtaagaaataccttctaaaggaagatagagaattccaaactgatttggga

SEQ ID NO: 3012 - DNA, 38 bp, Methanobrevibacter ruminantium
tttttcaacttaggatcttttgattctaagttgaagca

SEQ ID NO: 3013 - DNA, 284 bp, Methanobrevibacter ruminantium
caaatttcataaaaacactccaaaaagcataccttttcaaagatcaatttttcaacaattagatacaagtctaatttaccgagtttaaagttttttaaattgacaatactattaaaatagttttaaaagagaactaatagttttttaaataaataatagcatatataaaccttaaaacaagaattaaagatttattccaagaataaaattatcctaaaagaaaaaattttataaatttactctaaaaagaaaaaaaattcataaatttattctaaaaagaatat

SEQ ID NO: 3014 - DNA, 253 bp, Methanobrevibacter ruminantium
atgaaaagataaattttattttagttttttaaaaatagttagttaattgtttataaaatctaaaaaaatttgaatgattgtaaaaactgccttattaatgtaaatctaaatgtttattataagtaaaaaaaatataaatgttgattatacataaaaaaagaataaaaattttttataaaaaagcactgaacttaaatcaaaaaaaacaagaaaaactaaaataaagacaaataaaaaagaataaaaatttttt

SEQ ID NO: 3015 - DNA, 308 bp, Methanobrevibacter ruminantium
atttaaatataattgttctattttgagtttaagtttactatatataactatttataaaaatgtctgatatttttgacttttttctaatttaaacagctttaattaaaatttgatttttcttaaaaaaattagttttttactaaacccctatagacaaaatttaataagcaaaattttattaaaattctttaaaattgactgattttttaaaaaagtttaagttatataaaaataataaatattatcatataaattaataaaccataagtttttaataagttattcataattttataaaaacttatcag

SEQ ID NO: 3016 - DNA, 20 bp, Methanobrevibacter ruminantium
ttagaggattaattctctaa

SEQ ID NO: 3017 - DNA, 20 bp, Methanobrevibacter ruminantium
ttggactttgaatagtctaa

SEQ ID NO: 3018 - DNA, 26 bp, Methanobrevibacter ruminantium
taaaatctacatttttgtagatttta

SEQ ID NO: 3019 - DNA, 16 bp, Methanobrevibacter ruminantium
tctacatttttgtaga

SEQ ID NO: 3020 - DNA, 413 bp, Methanobrevibacter ruminantium
ttaaaaaatttaattttaaattaaatcttaaaatgctatttttaaaaaagctaaattaaacttaaggcttaattttaaaaaagctaaatttattaaaatcaaatattttatttaaaaaaagactaacggtttgtttattatgttatctattggtcaatgttacttagaatttgttaataaaatccttaaggaaggtaaagaaacctataaggacagcgatcatcatcttaaggaatatcttggtaattattactatattgatgatcctcttgacttgaaattcagagctaaatatcagcatatgactccagagcttatgttagaggaaatcaagaagggaagatatgatattgacgcctgtccaattaaaggtgatgctttatatgaatatgtaaagtcttttgaaataagag

SEQ ID NO: 3021 - DNA, 25 bp, Methanobrevibacter ruminantium
gaagataaatcttgcatttatcttc

SEQ ID NO: 3022 - DNA, 32 bp, Methanobrevibacter ruminantium
taagaagataacatccaatgtctatcttctta

SEQ ID NO: 3023 - DNA, 253 bp, Methanobrevibacter ruminantium
attctcactttataacaactattaaatcataaagatttaaaaaaatagctaaaataagttaaattataaagatttagaaaaatagtttaaaaaaaataactaaaataacttaaattataaagatttagaaaaatagtttaaaaaaaataactaaaataacttaaattataaagatttagaaaaatagtttaaaaaaaataactaaaataacttaaattataaagatttagaaaaatagtttaaaaaaaaatgg

SEQ ID NO: 3024 - DNA, 72 bp, Methanobrevibacter ruminantium
ggttccgtggtctaggggtatgatatctcgcttacaacgagaggatcgtgagttcgaatctcgccggaacca

SEQ ID NO: 3025 - DNA, 72 bp, Methanobrevibacter ruminantium; identical to SEQ ID NO: 3024

SEQ ID NO: 3026 - DNA, 227 bp, Methanobrevibacter ruminantium
atgaaattttttaaaataaaaagaaaattaaaaatcagataattgagattaaaataataaaaagtctataaaaaaccttattattaagcaatatatttaaattataagtaataaataattaataaaggaattattttaataaaaactaaagaattctttaaatcaattttaaaaagcaaaatattaaaaaataaagaatttttccaaataattctaaaaaaatattc

SEQ ID NO: 3027 - DNA, 35 bp, Methanobrevibacter ruminantium
tggttaacttatgttgaatagacataagttaatta

SEQ ID NO: 3028 - DNA, 29 bp, Methanobrevibacter ruminantium
ttaacttatgttgaatagacataagttaa

SEQ ID NO: 3029 - DNA, 224 bp, Methanobrevibacter ruminantium
ttattcacctttttgattattgagatttaattatttcttattttttatattaaactttttttatcaatgttaaaaaagtcaattaaatctctttttaaaataaaaaatttataaatttaatattaattaaaaactaaagattataattttttagtcttaagttttataaagctctctaaagacttaaaaataaaaaataattaacttatgtctattcaacataa

SEQ ID NO: 3030 - DNA, 47 bp, Methanobrevibacter ruminantium
ttatagccaagcttttttggccttcggccaaaaaaccttgaccaaaa

SEQ ID NO: 3031 - DNA, 27 bp, Methanobrevibacter ruminantium
ggttttttggccgaaggccaaaaaagc

SEQ ID NO: 3032 - DNA, 338 bp, Methanobrevibacter ruminantium
gtgacttcgtaaaattgatgtcatcgtgtgaaattgctttgttcgtaagaaatttaactaatttttaaaagctttaaaataatttattttttaatttaagtttcttatatgtttaaaaaattatattaagatttcattcatgtttaataaattaaaaataaattataataaatttatatatctattaagcataaatttatagtttttaaaagattaaaaatagttctatatgtttataaaccaaataagacttaataaattcgttaaaaaaatttgcaaaaaaaagtttagttttattaaaattttaagatttttttctatgaaattataaaattgtg

SEQ ID NO: 3033 - DNA, 20 bp, Methanobrevibacter ruminantium
ttgcatattcttatatgcaa

SEQ ID NO: 3034 - DNA, 563 bp, Methanobrevibacter ruminantium
ttttctaattttagtattaaatataatgtttaatatatttaatttaatagtttataaaatttgttaatatgataagaatgaaaaaacaagctaaaaaacttaatagaataaaattagtggaaaagataaaaagagtttaaaataaaaaaaagaaaattataataggtaaataatataaacaaagaaaaattaaggtttaataaaaaaagaagaagttaagagcaagatactcccaactagagaaaaaattttggtcaaggttttttcacccgaaggccaaaaaagcttgagttagtgatgccctctcgcaatagcagtaggccctgtacgagcaatcttcttaattccaaaaggcttaagcaatctcaagaaggaatcaatcttctcaggattgccagtgacctccattgtaatgaaatcatcacatacatcaatgatctttgccttgaagatgtctgcatactcgattatctcagatctagacttttcctttgttgtctttaccttaacaagacagagctctctttttaaaacatattcaggatcaaggtccttaatcttaa

SEQ ID NO: 3035 - DNA, 371 bp, Methanobrevibacter ruminantium
ttttaattgtaaaataattaataaattcaatctagatagatttaaattaataaaaccattcaaattaaaaatctgataagttttagatttattagaaataatcctctaattaaaaattatagattcaaattagagaaatccaataaaaaattgatatttcaaattagagaatatctaatataaaattgatatttcaaattaatcaaaacagaaaaatctatcctaacaaataatttaaaaatttgtaatataataatatttatcttaagatagatataaatattaacatatattaaaaatttgaaacttaatatattatcaaatacaaagtaaaatataatgatattttctaaactggaaaataatcaatt

SEQ ID NO: 3036 - DNA, 39 bp, Methanobrevibacter ruminantium
aaattattataaagtattttaaatattttataataatta

SEQ ID NO: 3037 - DNA, 33 bp, Methanobrevibacter ruminantium
ttattataaagtattttaaatattttataataa

SEQ ID NO: 3038 - DNA, 33 bp, Methanobrevibacter ruminantium
ttattataaaatatttaaaatactttataataa

SEQ ID NO: 3039 - DNA, 546 bp, Methanobrevibacter ruminantium
aatattttataataattatttttttatgaaaaaataaatagttcgttataaatgaaactttaatattagatttttgaagaaaatagcaatatctggaaatttatttttcattcaaaaaaaaaattcgtttttatataacccttataaatgtgttcgcaatttgcgaacaatcctttatatatacatgttcgcaatttgcgaacaaagatttatatataagatttaaaaatttgcaataaaacaaaatataaataactaattttaaaaaagcacatattaaggcattaaaaaaagcaataatttaatcaaataagaattaaaaaaagtgttaaaaaatgaaaaaatagtggagagatttcctctccttaaaaaaagttgaattcccttctaaacgaagataaaaccaaataataaataaacattttgatcaaacttttgcgagccgaaggctcggaaaagtttggctacatcatatcaggcgcactcacacctaaaaggtcaagagcattcctaagagtgattctagacttttcaaccaaaagaagc

SEQ ID NO: 3040 - DNA, 19 bp, Methanobrevibacter ruminantium
tgttcgcaaattgcgaaca

SEQ ID NO: 3041 - DNA, 27 bp, Methanobrevibacter ruminantium
cttttccgagccttcggctcgcaaaag

SEQ ID NO: 3042 - DNA, 27 bp, Methanobrevibacter ruminantium
cttttgcgagccgaaggctcggaaaag

SEQ ID NO: 3043 - DNA, 21 bp, Methanobrevibacter ruminantium
ttttaattattttaattaaaa

SEQ ID NO: 3044 - DNA, 230 bp, Methanobrevibacter ruminantium
tatcaaagataatatttatattatatattgattgttttttcaatatttttgatactgatcattcaatttatataatttttaaataatttatttcaataagttattcaataagatgataagctatttgaatttttttcaataagtttttcaataagatgataagctatttgaattttatttaataatttatttaataattaatgtttattttaatatttaagaataagtaa

SEQ ID NO: 3045 - DNA, 39 bp, Methanobrevibacter ruminantium
tggtcaaggtttttggccgaaggccaaaaagcttgaaga

SEQ ID NO: 3046 - DNA, 28 bp, Methanobrevibacter ruminantium
aagctaattagatttatctaattagcta

SEQ ID NO: 3047 - DNA, 24 bp, Methanobrevibacter ruminantium
gctaattagatttatctaattagc

SEQ ID NO: 3048 - DNA, 228 bp, Methanobrevibacter ruminantium
aaaaaagattttttataaaaattgaatttttattaaaaatttattaaaaagtctaaaaataagctaaaaaaactaaataagcaaaaatttttattaaaaatttattaaaaagtctaaaaataagttaaaaaacaaaacaagcaaattattctaatcttgcaatgaaagctttaaatttctcaagtaagcttctataatgaattactttaactttttcattatataagt

SEQ ID NO: 3049 - DNA, 35 bp, Methanobrevibacter ruminantium
aatttttaataaaaattcaatttttataaaaaatc

SEQ ID NO: 3050 - DNA, 31 bp, Methanobrevibacter ruminantium
tttttaataaaaattcaatttttataaaaaa

SEQ ID NO: 3051 - DNA, 170 bp, Methanobrevibacter ruminantium
tttaagtgaatattttatgtttaaatcattttaaaatagtttattgactatgaagatttttttaaattattttaaaatggtttaatttgatttttaaggttttttattttttaaattttaaaatcattggaaaattattgtttgtcctcaaatagttctccaaaattttt

SEQ ID NO: 3052 - DNA, 183 bp, Methanobrevibacter ruminantium
tttttttattttttttttaatttctaggaaaatgtctgtttttttaataatagttttaagtgaatattttatgtttaaatcattttaaaatagtttattgactatgaagatttttttaaattattttaaaatggtttaatttgatttttaaggttttttattttttaaattttaaaatcattg

SEQ ID NO: 3053 - DNA, 22 bp, Methanobrevibacter ruminantium
taactagatttttatctagtta

SEQ ID NO: 3054 - DNA, 302 bp, Methanobrevibacter ruminantium
gaaaaagcttaaaagatcatatgatggaaaaatagtgagcatatctgcaaagttacccctataaatatgatagattaagaattttcaaataaaaaaaatttaactaaaacttcccaaaaattaaatttttttatatttaaattaatatattatataattaatatgccataaattgagcgtatataatagttaaaataataagatatttaaatctttttatatcttttttatttcaattaatacgaatattcaaaatgattaaaaaaattaagaaatatttaaacaatatctaaaaaaataaa

SEQ ID NO: 3055 - DNA, 185 bp, Methanobrevibacter ruminantium
ttttatatttaaattaatatattatataattaatatgccataaattgagcgtatataatagttaaaataataagatatttaaatctttttatatcttttttatttcaattaatacgaatattcaaaatgattaaaaaaattaagaaatatttaaacaatatctaaaaaaataaaaattaattata

SEQ ID NO: 3056 - DNA, 87 bp, Methanobrevibacter ruminantium
tcttttaaaaaagaattttaaaaaattgttagaaagaatagataagtaaaataagataaaataaaaaaataaaagttattaagttat

SEQ ID NO: 3057 - DNA, 47 bp, Methanobrevibacter ruminantium
gctttaatcaagctttttgaccttcggtcaaaaaccttgaccaaaaa

SEQ ID NO: 3058 - DNA, 45 bp, Methanobrevibacter ruminantium
ctttaatcaagctttttgaccttcggtcaaaaaccttgaccaaaa

SEQ ID NO: 3059 - DNA, 43 bp, Methanobrevibacter ruminantium
tttaatcaagctttttgaccttcggtcaaaaaccttgaccaaa

SEQ ID NO: 3060 - DNA, 25 bp, Methanobrevibacter ruminantium
ggtttttgaccgaaggtcaaaaagc

SEQ ID NO: 3061 - DNA, 269 bp, Methanobrevibacter ruminantium
ttaaaatgattaatttcttaaatgaatattttagttaataaaatattttagttaatgaaaagttttgtgatgtagacaataagtagtaaacatatttatttttatagtatttaaagctttttggataattttaaggattaactatttattataaatagtaaacctaaatgatatctaattaaaattaaaaataagattaaataataagtgttttaaaaaaataagaaatttaaagaaaataaaatctaagattatagacgaatatatga

SEQ ID NO: 3062 - DNA, 22 bp, Methanobrevibacter ruminantium
taagtagctttttagctactta

SEQ ID NO: 3063 - DNA, 257 bp, Methanobrevibacter ruminantium
tttctaagttcataaaatcccactttataaaaaagatattaataatgaattatgattattttaaaaaatatttccttgatttaaaaagataaaaagaaaatatacctattataaaaaatatttccttaatctaaaaagactaaaagaaattatacttattataaatgataatttgttctatctattataataattattcgtataaaagaaaaattaattaaaaaaagatttatcctaattttgcttgataaactatt

SEQ ID NO: 3064 - DNA, 23 bp, Methanobrevibacter ruminantium
tgggaattttaattaaattccta

SEQ ID NO: 3065 - DNA, 21 bp, Methanobrevibacter ruminantium
gacatttgtttcccagatgtc

SEQ ID NO: 3066 - DNA, 15 bp, Methanobrevibacter ruminantium
tttgttattaacaaa

SEQ ID NO: 3067 - DNA, 240 bp, Methanobrevibacter ruminantium
caatagacataaaaaagtaatactttttgagtaaaaaatatattgtaaattttttgaaaaaatagttaaaaaaaattttataaaatcaaacctataaatatacggggaaaaatttaaaaaaatgaaaaaatgaaaaaaaacaaaaatttaaaaaaataataaaaaaagatctagaaaaaatatgatgtagaaaaaaatctgttgaaaaaaatatattataaaaatctaatgaataaaaat

SEQ ID NO: 3068 - DNA, 334 bp, Methanobrevibacter ruminantium
tataaaaagtcaaagtaaaaaaatacttatcatatgctctctaaatagatttataagtataaaaaacaaaataaaattgtaacaagtttaaaatagatttatcctaaaacttgttatggaggtatgaatatatttatagagatagcgatacaaaccattatatttgtttctatcccatacctaaatataattagtttgtatctcaaagccaagttgagagtttaactctcacttggttttgtatttatcttctataatatataaatcattctctaaaaattaataaatagtttaaaaaataaaaaataatataaataattttagaaaaaaagaa

SEQ ID NO: 3069 - DNA, 43 bp, Methanobrevibacter ruminantium
ttggtcaaggttttttggccgaaggccaaaaaagcttgattga

SEQ ID NO: 3070 - DNA, 35 bp, Methanobrevibacter ruminantium
tcaaggttttttggccgaaggccaaaaaagcttga

SEQ ID NO: 3071 - DNA, 107 bp, Methanobrevibacter ruminantium
atgatattttaatgattatttttgtaaaatctgataaaataaataaaattgtataaacaacaatgtacaaaaatgtactacaaagctttaaatagtacattaaatat

SEQ ID NO: 3072 - DNA, 29 bp, Methanobrevibacter ruminantium
atagatttttggccaggccaaaaatccac

SEQ ID NO: 3073 - DNA, 27 bp, Methanobrevibacter ruminantium
tagatttttggccaggccaaaaatcca

SEQ ID NO: 3074 - DNA, 254 bp, Methanobrevibacter ruminantium
ttttttatctatttttaatctgtaaatcattttaatttttatcattttcagcatcattgagttaaaatataatccaattgtttaaaaaaattttacaagatgaagtaaaaattgaccataaagtatagcaattttaggctaattttcacaaatttttcaataaaattattagttaaagtgataagttatgagaaaatttagttataagttataactaataactaataagttaaaaaattataagaaataactta

SEQ ID NO: 3075 - DNA, 47 bp, Methanobrevibacter ruminantium
tctaactcaagcttttttggccttcggccaaaaaaccttgaccaaaa

SEQ ID NO: 3076 - DNA, 27 bp, Methanobrevibacter ruminantium
ggttttttggccgaaggccaaaaaagc

SEQ ID NO: 3077 - DNA, 19 bp, Methanobrevibacter ruminantium
tgaagataaattatcttca

SEQ ID NO: 3078 - DNA, 11 bp, Methanobrevibacter ruminantium
gatttttaatc

SEQ ID NO: 3079 - DNA, 70 bp, Methanobrevibacter ruminantium
tgtatatattttgttatatttattaattgaattgatactgttcgtaattattaaaataaaaaaatgcatt

SEQ ID NO: 3080 - DNA, 33 bp, Methanobrevibacter ruminantium
aaagatcttatcactttatgtgataagctctta

SEQ ID NO: 3081 - DNA, 27 bp, Methanobrevibacter ruminantium
gatcttatcactttatgtgataagctc

SEQ ID NO: 3082 - DNA, 319 bp, Methanobrevibacter ruminantium
tgaaaatgatagaaaaaatatacaatatattgaattttaatattgaaaaatagcaaattgaaaagagatcataatgacaaaaattcatgaaaaatataaaaattgggcctatgaaaaaagtatacaatatatttttttatggaattaaattgcttcaattaaaaaaataagtcattttattaattttttaaaaatcataattttttatattcaaaaagtatacaatatatttttttcatatcaattgcaataaatatccagaataaaattttataattttcataataaaaaaatcatataaatttcataaaaataaatc

SEQ ID NO: 3083 - DNA, 352 bp, Methanobrevibacter ruminantium
taccatttttaataaacattgttcaagaattcttaatattattagctctttttttgaaattttaaataaaaatcataattttttatattcaaaaagtatacaatatatttttttcatatcaattgcaataaatatccagaataaaattttataattttcataataaaaaaatcatataaatttcataaaaataaatcataaaaatcataaaaatcataaaaatcacaagaaaagatcatataatttcatagaatctgcaatgattctaataaaaatgaactaaaacttgaaaacgttaagtaattttgaataatattaagaataaatactcaaatttgtttgtttgtataga

SEQ ID NO: 3084 - DNA, 298 bp, Methanobrevibacter ruminantium
tgtaacaaatttttctaaagtttgtttcaagcgagatgaaatttttaagtatctagcgaggagaaaaccaatttactaaaatttgttttaaacgaggaaaaagtatgagtattaaacgaatattacttacgagtttaatgctatttataataatattttcaatttcgtttgtaagtgcaaatgaaaatgtaacaaatgacgtaagtacgaatgaactatcaacacaaactgtatcaaacgatataactactagtgaaagtataagcgatactagtctagactctggagaaaaccgggg

SEQ ID NO: 3085 - DNA, 24 bp, Methanobrevibacter ruminantium
ttgggaaaattctatttttcccaa

SEQ ID NO: 3086 - DNA, 143 bp, Methanobrevibacter ruminantium
aaccttagataaaagattttctaaaataatctaaattaagttataaattattttagattaaaatcttctaatttaatcaaaatttagctaaattaagttataaattattttagattaagatcttctaaatttaatcaaaatta

SEQ ID NO: 3087 - DNA, 128 bp, Methanobrevibacter ruminantium
ttccttatgaatgcgctaattcttctgaaaagatctttaatgatttggtttctggaaaataatattctggcaagtatctaattaattttaaatattttctagataatttattttttttttttttaaga

SEQ ID NO: 3088 - DNA, 103 bp, Methanobrevibacter ruminantium
atataaaaatatgtttttatcaaataagaaaaaataaagaaaaaaataataagctcctactttaaataagtgcaataaaaaaaaagagaaaaagtaaatataa

SEQ ID NO: 3089 - DNA, 16 bp, Methanobrevibacter ruminantium
caaggaattttccttg

SEQ ID NO: 3090 - DNA, 28 bp, Methanobrevibacter ruminantium
gttaaagaagctctttagcttttttaac

SEQ ID NO: 3091 - DNA, 19 bp, Methanobrevibacter ruminantium
gttaaagaagctctttagc

SEQ ID NO: 3092 - DNA, 297 bp, Methanobrevibacter ruminantium
ttatttaaataaatattatttgtctaaagcataaatttttacaatcagaaaacttaataaaattaaatttaagtcaataaaatataaaattttttgttaaatttcttttatactattaattatagctttattattaataaactttgttaataattagttaaattaaattaaaagtattaaaattaaagtaaaaattttaaaattagtaataactttttttaaaaaagtattaaaataaatgcaaaaaaaaataaaatagctaaaagctattttaaaattattttacgattataaata

SEQ ID NO: 3093 - DNA, 23 bp, Methanobrevibacter ruminantium
taaaatagcttttagctatttta

SEQ ID NO: 3094 - DNA, 420 bp, Methanobrevibacter ruminantium
ctgtgaaattgatgtgaaagtgtgaaagttgtttgagagtgtaaaattgatttaaaattgctaaataaataaaactccaaaaccattaaaaaccttatagtttattatagatgaaaaataaataaattaatgttatagattatttgctataaaataggcaaaaaagttaactaaataaagaaaaattaacataaataaaattaaaatttttaagtttattatataattacttaaatttcaataaggaggaatttaatgtctgatactgtaagaacatggcgtcatatccaacaaagatacaatcttattggatctaaatgtactacctgcggtcaagttttcttcccgcaaagagttatctgtcctgaatgcagaagaaaaggaaatatagaagatatacaattttccggaaaaggaaaa

SEQ ID NO: 3095 - DNA, 22 bp, Methanobrevibacter ruminantium
gagttttacttatgtaaaactc

SEQ ID NO: 3096 - DNA, 22 bp, Methanobrevibacter ruminantium
gagttttacataagtaaaactc

SEQ ID NO: 3097 - DNA, 382 bp, Methanobrevibacter ruminantium
ttaaaataataaatatgaatattgtaaaatttataaaattcttaagaattttcttatgaattttttgattgattcttaacattatatagttatgtagttcatagtataaatatttaggtatacctaaaagtaatttaaaaaataaaaatatctatctaaaaagaaataatttaaaaattaactctaaaaatgaataaataaaatacctatccaaaattgaataaaagagtaaaattagggattaaaatgtttaaaaaacataattcaatagacctaaagacacaacaattaaaattaatgttgatatagagtctgttaggctagtggataaaggtataacaatattatcagggtccaatcctcttctataagaaattgtaga

SEQ ID NO: 3098 - DNA, 242 bp, Methanobrevibacter ruminantium
aattgatgatttgaaggataaacatattgagctacttaaattaagacgtaagagtcttttaaagaccttaaaataggtttaactttaattaacatttattttaaatgttttaaggcaataataaattattattcatatttataaaattataaaattacatattaaagagtgtttaaaatgcctagcgtaaaagatattttaattgaaatgaaagatatgtcggaattaatggtcgatttagc

SEQ ID NO: 3099 - DNA, 382 bp, Methanobrevibacter ruminantium
tattaaggcttaaattttaaaaatattgcttgattggccttatttatttaataggttttatctcgtaaaacttatttttttaaaataaaaaacccttatcggaatttgtttgataatataaaaactatatggaaaaataaaaggagaaatcaagaaaattgtctaaaaaaagctaaaattttagaaagcgtaaaagatgtaaaaaagtgataaaataaagtataaaagttaaaaaaataagctattaaaaaaaaaaaaaaaaaataaaaaagcagtaaaataaaaactgtataaaaaataaaaaaaaagagttaaattaaatagcttctaatttagataagatttcccaaattaaggttctagcatgaacaggaatgttagg

SEQ ID NO: 3100 - DNA, 24 bp, Methanobrevibacter ruminantium
tagatttagacttttctaaatcta

SEQ ID NO: 3101 - DNA, 321 bp, Methanobrevibacter ruminantium
tttatattttaattaaatttgatgctagcaatgcaattcaattaaaatattaaaattgtaattataaaaaattagtaaattaattttcatatgaagtcatgaaagtcataagaaatgtgccaaaaaattccatttacttttcatgatctaaaagtaataaaaattatgtaaaaattttcatctacaatagtaaaatttcaactgtatttctataatttatttcttgaaatatttaaagtttattattgttttataacataagaacgttcttattaaacaaaacaaataagagagagtaccatttcaagtgtaaaactttaa

SEQ ID NO: 3102 - DNA, 96 bp, Methanobrevibacter ruminantium
caattcaattaaaatattaaaattgtaattataaaaaattagtaaattaattttcatatgaagtcatgaaagtcataagaaatgtgccaaaaaatt

SEQ ID NO: 3103 - DNA, 112 bp, Methanobrevibacter ruminantium
atagattccttataatctggtataatacttattttgatttttttttattatatcaggttttttctttttttttaattattttttcttattatttttgtttttcttttttttg

SEQ ID NO: 3104 - DNA, 366 bp, Methanobrevibacter ruminantium
tttttttgttttttattgtttttgtgtggttttcaatttgtattcttttctttttttgtttttttttttaatttttcccattttttaacatcttaatatttttctttttcttttttagacactcaccatcatagataattatcctaaaacttaatgtttgtaaataaatcacaaataatttaataaaaaatgaacatatattataatatttgtataaataatcaattatcggtttttcatattactaataacttaaatatattaagattaatcattttttaagatatcactttattaattagctatttttgtctagaatgagagggtattttgaattaatagtaaaaaattattgaggaaatttaa

SEQ ID NO: 3105 - DNA, 144 bp, Methanobrevibacter ruminantium
tttttatacttttaactagaaagaaatcatgattaaaagtgcttatgaataatttatttgatttatttgatgatttattattatttttattgtagttagtttggtataagccgtaaatgtttcttgattgggatttgtgattat

SEQ ID NO: 3106 - DNA, 227 bp, Methanobrevibacter ruminantium
tttaactttttctcttaatttaattgctcgtatttttaataattttttagttaattaatcttatccttgagattattgtaaaaatgcattttaagggcttaatttgatgatgaatggaaagatttataaaaagagtttttgaatgatcattcgatttaaaaattgtaagattagagtaaaaagagtttttggaattatagatatttgcttagaaaaaaaaagaaaaa

SEQ ID NO: 3107 - DNA, 10 bp, Methanobrevibacter ruminantium
taatttaaac

SEQ ID NO: 3108 - DNA, 274 bp, Methanobrevibacter ruminantium
aaaatgtttcctccattattttaaaggtatatataattattataaatatttttataactttttttaaaactcgatagtatattattaaaaaaattctaattttatatggtattagtgtgattttgttaaaatttttctaattttctatgatttttgatgtattttttttgattttgttcaatagttttgtttatgagttttgatgtattttttttgattttgttcaatagttttgtttatgagttttgatgtatttttttgttcaaaatttgag

SEQ ID NO: 3109 - DNA, 140 bp, Methanobrevibacter ruminantium
gtcttatatttagtttgtattatttgatttaaaattctttttatttcttatttgaaaaatatgaaaagggaattatttttagatagttgagcatatattttttaaatcattgattctttcttattgatttttgctagttg

SEQ ID NO: 3110 - DNA, 267 bp, Methanobrevibacter ruminantium
tctatcagtttatttctttgtttttttgataattattctattattttagattgtttaaataattccaagtaggcataatatgaggaaaataataagtaagagagctattatttttattccttctttagctactttgaataatacatagattaaaagtataatgagtaatatttcaattattgttgcaattagcatttaatcacctaaattgagtttatttttactatatttttatattattgatttaaattcattctaatgagtttt

SEQ ID NO: 3111 - DNA, 166 bp, Methanobrevibacter ruminantium
aaaagttattattgtaagttgtttatttaggaatgataatttttactatttttcaatgtttttaatttttaaaaaaggatattagattatcatacttaaagtaccttaaaataatcaaatatttatattaattaaataacaatttaaaaagcatttaagtgataga

SEQ ID NO: 3112 - DNA, 68 bp, Methanobrevibacter ruminantium
tttaagtggttttaggtctttaaaataatttttttatattttaaaccttatgatgggtaatttagata

SEQ ID NO: 3113 - DNA, 103 bp, Methanobrevibacter ruminantium
ttatttcctctagtttagtggattattaagatgtatggcttttttaagtttaactatatgattttttaattcaattcggtaattatctttttttaatttacga

SEQ ID NO: 3114 - DNA, 332 bp, Methanobrevibacter ruminantium
tttattcacctattgctttagttaatgattttataaatcttttaaagttttaaaattgttttatttctattacttttattttaattttagtattatttaattatttagtttatttttgattattttcattttatttggtcatcttttcattgattttgggattttttttattatttttgttcatcttttctttgattttttttattatttttgttcatatttcactatttttaataatcgttttcatagtattttttcatcaaaaattatttttaaaaaagcatatggaatgtatgataaagtatataaactttttgttttttgttttaaat

SEQ ID NO: 3115 - DNA, 13 bp, Methanobrevibacter ruminantium
ttaataaaaaata

SEQ ID NO: 3116 - DNA, 308 bp, Methanobrevibacter ruminantium
ttttttatttttttctatttttattatacttttactttaatcttattttaacttattttctattttaaaaactaatttttatcaaattattgatttaactttaaaaaattcccttttgattaaaacaaatatttttttatataataatttacaaatctaaaattataggattatataatcgattatttttgggcaataaattatttttaaaatcaatatattagaatttgccaggttttaaattcatttttaaggattttatcatggcttttaaataagagtaaaaaaattaaaataagggatttaag

SEQ ID NO: 3117 - DNA, 318 bp, Methanobrevibacter ruminantium
agaaaagtttataagatatggttttaataaaaaaaaggtaattacctttaaaaaatttttaaaaaatagaaaaattgatttttttaaaggccataattattaaaaatcgataaaaggatttactagaaagttaaatataatattgtgtgagaaaatagatatgaaattctgttttaaggttttaatttttaaaaaattaaaaagatttgcttttttaccgtttaaaggcaggtctttaacagtattaaaatattactttctataatgtattttaaagaagttttggggactttttttaaaaaattattgtaggatagc

SEQ ID NO: 3118 - DNA, 517 bp, Methanobrevibacter ruminantium
gggcttgtcagtaattgatactttctataaaatcatttttttctttttttctttttttattatatcttgtttctatttttgttataggcttagttatttattattatttagttgtttatgggatgactattagttatctatcgatttatgagatttagttattctttaattatagtttattctctttttaactatcactttaatataatatattcactatttaactacaactttactatattctatctacaaattaactatcattttcatatatgttatttataatttacttcataattatcaataacttagttataaatttaccatatatttaaatatcttaatgaacataatatatcatgtgaaatttaatttaaactaaaaatttaaatatttaaaatttcataaagaatgtatagataatttaaattatctaatcatgtttataaagcttaattaagttttataattttcactaaaaattagttcttctttttttggtgaatttcaaatgttc

SEQ ID NO: 3119 - DNA, 239 bp, Methanobrevibacter ruminantium
ttttttttattgactatttttcttttagtactctttttaatttgtttttatacaattggataataatttttcgattttttctatttttagatatgcatttatatcttggtgtccagtatattggatacctctttataaataggtgttcagtttacttgatatccttttataaataggtgtccagtatattggatacatttatatattaacaattttatataatttattaggtgagaaaa

SEQ ID NO: 3120 - DNA, 58 bp, Methanobrevibacter ruminantium
gattgcttttgggaagcttttcttttttataagattgcctttgggaagcttttctttt

SEQ ID NO: 3121 - DNA, 86 bp, Methanobrevibacter ruminantium
gaataaatttgattaaacttttatatggctatattttaggtgtaaattagcgtttaaattagtattatgcttcataggtgtaaaaa

SEQ ID NO: 3122 - DNA, 27 bp, Methanobrevibacter ruminantium
tctgtttaacaattatgaggcttaatt

SEQ ID NO: 3123 - DNA, 167 bp, Methanobrevibacter ruminantium
tttctgcatttcgatgggttataatcttggattgtagttttctgctttgcggaaaggatttagtcggattgtaatattttattatttagtttttttaattcctatcaattttatatattgggtaataatctgttgtttgatctttttaattccaatgaattttaaaa

SEQ ID NO: 3124 - DNA, 75 bp, Methanobrevibacter ruminantium
tttttttaatttcgaagagaattataagaaaatgaaaatggactattatctgatttaatcaataaaaaatagatt

SEQ ID NO: 3125 - DNA, 160 bp, Methanobrevibacter ruminantium
aattttcttttttaattttttattatcaattatttaaattaatattattaaaaatgagagtgtaaaattaattaaatattgaatagttaatgaaatgaaggtatttaattaattttatatttaattaacgattaacggaattaggtacaaatttaatgga

SEQ ID NO: 3126 - DNA, 132 bp, Methanobrevibacter ruminantium
atagattattatttttattttatttttttattctttttttaaaatttaattattaattctttcttaaccaaaaactttatatataacaatagttatattattatatacagcatataacaattgttatatctc

SEQ ID NO: 3127 - DNA, 252 bp, Methanobrevibacter ruminantium
tttttatgataatatgcctcctcatattatcgctcaaccacaaatcaaacacacacaaccaaggttttttttatcaacaatccgttatgattttaatagctgagtcctcgattaacttattttaagcagttattaaggtcatataatttcttttttttagttttctatttttttatttggttcaatatttttttttttaaactctcttttctttaaaaaattatattaaaaatatcggttcaatattataat

SEQ ID NO: 3128 - DNA, 100 bp, Methanobrevibacter ruminantium
ttttatttttttataaatagttttatatggtaaaccaaggattattagttattgttttttaatataaagcattaaatagaaggataaataatatttattc

SEQ ID NO: 3129 - DNA, 169 bp, Methanobrevibacter ruminantium
atttaaaaataaatagtaatacattaatattattagtaatagactttaatttatattttctttttttgagggggtagtgtttaaaaaaaataatattagtgctataatttttaagtttattttttttaattagatatttactttaaagaattacagaagggtgatatgt

SEQ ID NO: 3130 - DNA, 195 bp, Methanobrevibacter ruminantium
ttaatagtaatgaagaaattgcaggatttatatttcaaggaataggaaattttgaagaaccctttactgtccattatttatatgagaatggtgaattaaaagattcatgttatattccatttaaacctactactggatctggtaggagtagaggtgactttactattgtaataaaacctaaagggagataaaata

SEQ ID NO: 3131 - DNA, 12 bp, Methanobrevibacter ruminantium
attaattccttt

SEQ ID NO: 3132 - DNA, 20 bp, Methanobrevibacter ruminantium
tttttcaaatcctttttatt

SEQ ID NO: 3133 - DNA, 230 bp, Methanobrevibacter ruminantium
ttctttactcatatgtgcaccacagttgtgtataattagagtatattatatttgttttagtatataaactttaaaagagcatgtgaaaaatattattgtaaaaaaatttaggcaattaataaaatatttttaatctcctttaattatcattgtaaatattattttttttatttcataaaaactttataatattaaaaataaaatttttattatattctgccaattcttac

SEQ ID NO: 3134 - DNA, 387 bp, Methanobrevibacter ruminantium
taaaccccgtctgtcattgaaagcaagaattttttttattttgtccgattagttttcacacgtctctaggcaccttatttactttaaactatgcttttgataaactattatacatggaacatgttatttaaaagtgccaaacccgtaaaacctttttttaaagacatgttcttgagattatcctatgctatttttaactcttgggataatctccacccactcttttttatttttttattttttttatcctaaaagccattttttccttgatagaaagatatggatagatttaagaatttataaaacaaatattaaactaacttttattagtttttagacttttagactttttaaaatttttatttttagacacataggaggataaga

SEQ ID NO: 3135 - DNA, 303 bp, Methanobrevibacter ruminantium
ttttttttttaagtgtgaatgatttttccacttaacttttttttattttttaattttactcataatattttttttaactttttttattttttaaaaagagaagtttagatctttttgattgctattttttataaaaaaagagtttatttcattaattagctattttttaaaaagagtgtgttaatttttattcattagctggttttaaaaaaagagtgtgttaatttttattaattatcggtttttaaaaagagtttttttattaattatcttgttttaaaaaaagaaaaaattagaagtaga

SEQ ID NO: 3136 - DNA, 363 bp, Methanobrevibacter ruminantium
atcatcgcttgcacttgcaatgttaagacttaagataaaaataatcgttagaacaatgattaagtatttccttttcgttttttcacctccttttacagttaattaataaaaacagagtaaaataaatataataaaataatctactcattaatatttattaaactatttaaatataaatatttttaaaaataaggtgaaagatggaacttatcaagaaaaataaggttttaaaatacttaacatagaaaacctaattaaagaatgccattatcaatccatgtctacttaagaaatgctataatcaatccatgtctacttaagaaatgctattatcaatccatgtctacttaagaaatgctatta

SEQ ID NO: 3137 - DNA, 211 bp, Methanobrevibacter ruminantium
tatatcaccacttaatactatttttgtattttatattacttaatttataaacattggacttaggattatgagctttagataagatttaaacttaaatgattttttaacattggtgttaagattataaactttgaattagatttaaactttaaggatttttaaaagtaattttaattaatagaaagtcaatagttaataatatggtgttttt

SEQ ID NO: 3138 - DNA, 78 bp, Methanobrevibacter ruminantium
aaaaaatttgattataattttttctttcggcctactacttttccaaactgattattcaaacttttagaaaaagtttga

SEQ ID NO: 3139 - DNA, 100 bp, Methanobrevibacter ruminantium
tatgtctataatttctctcgcttctttatttaattcattattatcctcattatcctcattatcctcattattttcgtattctgacttaggataatttatt

SEQ ID NO: 3140 - DNA, 398 bp, Methanobrevibacter ruminantium
tttattcctcttttattgggttgggttctgtatttaaaacagtaattcattttattcctcttttattgattcacttccacaagcaaaaagattttattcctatttagtcatcttcttaatatcatcgggtttattgccttccatattgcaattattcaattggatatttgaaacgtatgtaaatatagctcctctttccccttctccaatgttttcattgattgtggagttgtcgatggtcagattgctttcataattgtctatcgcccctccattaattgcgctattattgcttagtgtggattcttatctaaagtgatgtctgaatctaaaatgatttccttttctcctatgcgtatcagctcatctagatatttgaagcctttagcttcatcgat

SEQ ID NO: 3141 - DNA, 88 bp, Methanobrevibacter ruminantium
attaacacctatttaatctaatatttcttttcttaatttcaactaatcttcaattaaaatttcataatttaaattattataatccttt

SEQ ID NO: 3142 - DNA, 269 bp, Methanobrevibacter ruminantium
aaaatcacccttttagtaagtcttttaataagaatttttcttataattttaagttcttttatatctactaatttttaaagatttatttttaagttcttttatatctactaatttttaaagatttatttttaagttcttttatatctactaatttttaaagatttatttttaagttcttttatatctactaatttttaaagatttattttattattaatttttattatttaaacagataccatataagttctaacaatgatttgctttag

SEQ ID NO: 3143 - DNA, 22 bp, Methanobrevibacter ruminantium
ttctgctatttcctggtcacca

SEQ ID NO: 3144 - DNA, 429 bp, Methanobrevibacter ruminantium
tatatccgatttaactttctcgaccccatgataaacacctaagtaatattaaatatggttatgatattaattaaatttatttagattatttaaggtttataaatagcatattcatagtttatatcatgtgttggcttatgaattcattatttttataaatgaatattgtttctaactatattgtatttataagtgtctatatttttcaactgcatagtctttttaagtgtctatatttttcaactgcatagtctttataagtgtctatatttttcaactgcatattataaaaacggcattgattttcatttgtagtgcaaactaatttttttattcatctattaatatatgcttttctttaggaaatgagatatctttttagcagaattgtatagaaaaaataaattatatttatgcgcacatagctaa

SEQ ID NO: 3145 - DNA, 822 bp, Methanobrevibacter ruminantium
tattctcaactcactttaaaatgttctttctaatttttcttttgtatcttggatttttgttaattaaattcgtttgtagataggaaattttttaatattttagaaaaattcttttacagatagaaaattttttaatattttagaaaaattcttttacagatagaaaattttttaatattttagaaaaattcgtttgtagatggaaaaatttcttaattataattttttctttattattatttaatatttcctatcaattatcactagttctaatgattagaaaactttctctaatatattaattctccattagcctataaatttgtttaaaatgaagcatttttaatggattttctaggataaagatactaatcagctatttcacttattgtgattaagaggaacaatttaatttttaatctattattgattatcaattgaaacagattctatatatttttaccaattgaattgattttacaatttttttttcatattttttattttgtagaaactactttgtaatggatagtatatatagtttctctattaaaaattcgttatttggctaatggtttatatataatttaatatggtaaaaaataagtccaaattgcagagaaatttataaatagttatatatggtaaaccgttctataggtttaaattaattttatttaaaaatatattcaattgttttcacctaaaaattcttccttagaatgtcttaaaaaaacacattttaatcatatgctttgatttttcaaagtgtttattaggatgttcgttttttattaaacaaaaaaaataataaaatatggt

SEQ ID NO: 3146 - DNA, 109 bp, Methanobrevibacter ruminantium
tataaaatttcttaaaataatcattttatggggatgttcttttggctaaaaagaaaaaactaaaaaagaagatgccaaatcaggcagtaagccattaactgctgaagag

SEQ ID NO: 3147 - DNA, 149 bp, Methanobrevibacter ruminantium
gtttttaattaaataatagtggattatatttcactattattattactttttttcaattttatttatttttaaacatctgataatattttttctaatttttatcttattttacttattaattgctttaaatgcttatatttcatctccat

SEQ ID NO: 3148 - DNA, 27 bp, Methanobrevibacter ruminantium
cttttttctcacctcctttttcggttg

SEQ ID NO: 3149 - DNA, 29 bp, Methanobrevibacter ruminantium
acaaaaagaatttttattggagggtgtat

SEQ ID NO: 3150 - DNA, 245 bp, Methanobrevibacter ruminantium
ttttctctctatatatgattcataaaataagtggttttagagaggataaaaaatgtttaattttctctctatatatgattcataaaataagtggtttaaaggtctttcattatcttctttaattatgcttagacatttatcaaatcaacaagcttctacttcattattaattaaatcccttcgcgaactaatttaatttatgtttttttggttgtttttatcctttctatattagatgttttttt

SEQ ID NO: 3151 - DNA, 123 bp, Methanobrevibacter ruminantium
aatgattagatagcctatctcataaactgatccgtctgtcagctctttaagttttgttagcctggttgaaataaatcctaatattatgattgcagatattattgtagtaatctcatggacgac

SEQ ID NO: 3152 - DNA, 111 bp, Methanobrevibacter ruminantium
aaagagttttattattttaaagtagttatggtaagttttttatttagaattagttaaaaagagttattattatttttaaactagttatggtaagttttttatttagaatta

SEQ ID NO: 3153 - DNA, 10 bp, Methanobrevibacter ruminantium
agtaaaaaaa

SEQ ID NO: 3154 - DNA, 32 bp, Methanobrevibacter ruminantium
ataaaaaaaaaagataatgagagaataaactc

SEQ ID NO: 3155 - DNA, 593 bp, Methanobrevibacter ruminantium
atttgcaattctccatattttttaaaatctatttagatgcatatgattatataaaaatctatttagatgcatatgataattttatttatatataaaatccgtttatatacataaataggtttagttatattattatttatacttagttttattaaagcatatttgtagaagaggataattttaattttactttgtttttattgggcatttagcttttaaaggattttcttttagttagggaagaatttgtggattttaatactttttcattttgcttgattagttcttattgtacttaatttaattaataatgaatgccaatattataattaggaagaatattctaatgaaagtctttttttagtgaaaggctattataattaggaagaatattctaatgaaagtctttttttagtgaaaggctattataattaggaagaatatttttttagtgaaagactattataattctcatttaaaaagtcttttaagtaaaagacgattataattctcatttaaaaagtcttttaagtaaaaagaacggattataattattaattttattccaaaaaagatagggggaaaatgacaac

SEQ ID NO: 3156 - DNA, 76 bp, Methanobrevibacter ruminantium
tttgctattcctagtgtaattgcggtttattatatgctttaatcctgtgctatagtaacggatataaaattaattt

SEQ ID NO: 3157 - DNA, 231 bp, Methanobrevibacter ruminantium
tatttttacttatttttaatgttcgaatttaaatcttttattttttgtttttaattaatttattaactcatcctttttatgtccatattcattttcatcggatacttatttacccatctcattaatgttggctggctgattgtttttaaatttacaattgtcctcttttaagatgcccttatttactatggcatatccgctgttgccatcaaaccttggaacttgccatct

SEQ ID NO: 3158 - DNA, 940 bp, Methanobrevibacter ruminantium
ttaaacacctttttttcacttattcctttttttattttatctataatgccctatttaaacacctttttttcatttagctatttttaagacccacttataagtcttcattgattaattgttttttatcccttgttttaatatttctttaagatttatttctttttatagttattagtatatttttatggcagttttatttataactttttaaaaaatctttaaaattattgaaatatcttcaattgatatggggtttcttaaggggtgatggtgaatttatttaaaattttcctatgggatagggattgctaatataaataaaaacaataatccaatttaggaattagaaaatatataataaaaatagtatgagaaatgtcagaacctacagccacctaattgaccataataattatggaaagtcgtcgcaagcgacaaggacttgtaggctgaactctatgagtttttaccttccaatctttcatttagacatttgtttttcactaaatataaatttaattgaatatatgggctttttataaatagttatacatattaaaccattattttggttaataaatagttatatatggtaaacttatcatttaaagagtatttaagtttgcatatttaaaaatatttaaataaaatgctttatgagaatcatattataaaggtcataagattgcaaataaaatgaaaatttagtatatttatttatactaaaccctatttagtatactttttttatactaaacgctagttagtataaatttttatactagtatacttagtatattttttatactaaaccctatttagtatatttttttatactaaaccctatttagtatattttttatactaaacactagttagtatacttttttatactaaacactagttagtataaattttatactggcctatcactatctta

SEQ ID NO: 3159 - DNA, 737 bp, Methanobrevibacter ruminantium
ggcccactcccattatatttagatttaattgcataatttttaatgttttattctaaaatgctatgaattaatttatatttattatttaggatttatttaaatattttgactacaaatattaagtcatttaataattaagtggcttaaattctttttttagggccaatatggatgggttgtttttataaggagggtttgtcttttacagttcttaaagggtgttgttttattgtcaattttttgatatgaaataattaatttaagctatcataattttgatagtaatctttttttagttgttttaattaaagcaatttttaataatttgatagttatataatatttctagtttttgtttaatcgtaatctatacattcttacactttaaactttaattaatattaaattcatatcaataagggataaaaaagctgatttagataaaaaaagtatgtatttcaatgcaatagcctagatggtcttagtgatttgcattaattggtctgtgatgtaattggtttggtttttgaaaaatagaatattttttatttttttaatgagtgatttgtgccttattagcatagttactaataaggcactgaagaagtaatttagaatacatcaatattctaaaaaatgactggattaaatatatatttttggagtttatatatttttctattatttccaatattcaaatttgtacattatatttttgatagttcatccacatcatt

SEQ ID NO: 3160 - DNA, 3 bp, Methanobrevibacter ruminantium
tta

SEQ ID NO: 3161 - DNA, 360 bp, Methanobrevibacter ruminantium
ttcctcttcataatcgtttatgatattatcgtcccccttttctttagagcagctgatatttattctttaaaatcttttttcttaaaaatagtcctataatcatttcattattgtcttgattatagcatttatcttatggatatcgtcgtttataaactcttccattttaagaataattcagaatataaaaattaaatgtctctatttcgtatgatcaagtctttggctgtaaagtgaagtatggaaaaattgtaaattaaatgtgagaaaaattgagataaagttattttaaatgattattcatttatttttttaaaaaatagttagtttagaaaaagagatttagaaattgattggaaa

SEQ ID NO: 3162 - DNA, 945 bp, Methanobrevibacter ruminantium
ttcaatcatttgttcaatatcttattgcaagaaaaaattcctgcaatacactcgatagatattgaaaaaagcaaaaattttagttagaattaaaaattccaattaaagaatttttaaactctaaataaaattatgatttaaataatatataaatttatttaatcatgatgtaaattacaggaagtgtctgttacaatataaacgggaacccaaacacatcgagtgtagtgaaaaaactaaattcttgtaatatttgtttattcctgtaatttatatctgaggattaattgttcatactagccttaaaaaaaccagcatgagcatgctgtatattaccaacaaataaagtaggtaaaatactactccaatccaaaatttcttttgaatggacacatcaatcctcctaaaatttttgctttgatggttgcgatttttaacaaaattgatttttgctcggcaaaaaataaaattccttaccataaaatcacctccagattttttaggagttaccgtttgatttaaaattctgtaattcctcttatttatactttatttttaatttaaagaagttaaaattgattttatttcgtaaaattgttgtgatgttgttaaattgatgtgaaagtgtgaaattgattttatttcgtaaaattgttgtgatgttgttaaattgatgtgaaagtgtgaaattgattttatttcgtaaaattgttcttatttcgtaaaatttactttatggtgtgaaattgattttatttcgtaaaattgttcttatttcgtaaaatttactttatggtgtgaaattgattttatttcgtaaaattgttcttatttcgtaaaatttactttatggtgtgaaattgttttcttgtataaaatcaatttattcgtatcaattaagacttaaagtcttcgaattttttaaaatttatttaagttaagaaa

SEQ ID NO: 3163 - DNA, 371 bp, Methanobrevibacter ruminantium
gattaaccccctttaaataaaaaaagcagtgagattgcaattagctattgcaatatctttttaaacagtattggtatttgctgtttataaagctttgcaaattatgctttggggaagttaatttttttgaaggaaaaaaattatgagctttggaaagattgtaaaatttatatgtaggaaaaattgtagataaagttattttaaacgattattcatttattttttataaattagttagtttagaaaaatagatttagaaattgattggaaatctctaataatttttaaatagactagagattcaatcatttttcaatattatccgaataaatgaactatccagtttaaaataatcatttcttattttaggc

SEQ ID NO: 3164 - DNA, 68 bp, Methanobrevibacter ruminantium
acctaatttcccatcagacagatttaaatctaactcatatcttgtgcttatgaactttttagccttcc

SEQ ID NO: 3165 - DNA, 221 bp, Methanobrevibacter ruminantium
atttaatctccattaattattgccttaagtataatcaatttattatcttgattatcaagggttgtaacgtcatataagagatcaatgaagtcaataattccttatttatcaattcctcaatattatttgaataaatggactatccaacctataattattgcttatttttttagaatttatgcctataaaattccccaataagttacaattattgattcttt

SEQ ID NO: 3166 - DNA, 15 bp, Methanobrevibacter ruminantium
tttattccccctcat

SEQ ID NO: 3167 - DNA, 23 bp, Methanobrevibacter ruminantium
gttagacaccttatttttgcttt

SEQ ID NO: 3168 - DNA, 586 bp, Methanobrevibacter ruminantium
gattatgatatggtctggtgtttcttcgataatgttgatcaaggtgattgcactcccatctttcttttcctacgattttgttgttatcgttttttggtgaaaatagatatttttttaaactcgtgcgaaagatagtgaaaaaagtagtaagtgtaatctatatgtcatacaactagggtacctgcttttcactatcttcattatacatagtggaaagttagaggcttaatggatagtgcttaaaaaaggtagtggggggtggtgtgtgcttgtttaggataatttatataaaaatagtgattggtaaaaagtagtaaaaatagttaaaaattgcttttttttttaaaaataaaatagagattcattaccaactggtactcagtaacgaagttatataagttgagaagaatttttagaaaaattagtaaaaattttataaaaaattagttttcgttaaattatttaacgtgctatattccattattaaaaaataagtttaaagtttactaaaaaaatctgataaactggattgattttcatcaataattagcaaatcatcttttaattttatattatcgttaaacat

SEQ ID NO: 3169 - DNA, 5 bp, Methanobrevibacter ruminantium
attta

SEQ ID NO: 3170 - DNA, 473 bp, Methanobrevibacter ruminantium
aatgttcactcattaagatatttaatattttcctatttttttattaggaatctcctatttttctaattcaactgaattattgacataatgatgattagattcaataatttcggagtttaattctcaattttttttcaaataaaattctctttctaaattttcaattgtaaactcttaatttgttttctttactcttataagttttccaggtattccaaaagagcataaacagttactagcaaggtttataataagaattatgttaaaagtagtataaaaagatttagagatagcatctgaaaagtaaaaaaagaaaaaatcaggatttataaataacttaaactttaacacccattttttcatataaagactttttataactttcaaaaataagttccttttcagcatcggatatcttagggtcatcaagaagttgcattattctattccattcagaatcatcaaagcccatt

SEQ ID NO: 3171 - DNA, 669 bp, Methanobrevibacter ruminantium
tccgttaaatttcatccaagaattttcaggacttgaactagctctaatatggttatatctatcaataaactcatcaaaatcttcataagattgaggaacatcattaaattgagttataaatatatacttattagtatgtactagcacgtatttaatattttccgacgcataaaatcccttagaaaaatctccagggcttaaaaaagttccatcttgatgattatgtaacacaattaatatgtcttcgccaaaatctttttgattaatggatttactgaacttctttttccatcagtatataaaattcttggtttataatcatttgtaagtttttcaaatctgcctttacttatattatataccattgcccattcattatcatctttaatttttagaaaaatttattaaattattaatcaagaaatttaaattttcatctttgtctaataaaggaaatcatttttttttaaaaagttttttataattgttaatatatagttaactatatataaaaagtttgaatatttacaaatatttttaataattttttctaacaatttgtatcttatcaaacattttaaaagataagggggactacttattttaaaagaaggattttgaaaagggtactttaaacgagtatccgtaaagggccaaagagcgttctgg

SEQ ID NO: 3172 - DNA, 44 bp, Methanobrevibacter ruminantium
aatcttatcagttttaaaagagataatcattaaactatttttca

SEQ ID NO: 3173 - DNA, 36 bp, Methanobrevibacter ruminantium
tatttaatcaaatcgtcattcaattaaaggtgcaac

SEQ ID NO: 3174 - DNA, 166 bp, Methanobrevibacter ruminantium
agatgatgttcatttaaggtctgtaggtgccttccccttaaatccaagtgaggatagggagaataaaaaagagatattggactttttaactcgtcagattattaagttgctaagtgtggtttagttattaagatatcaagagtaatattggtggaaaaaatttaaa

SEQ ID NO: 3175 - DNA, 59 bp, Methanobrevibacter ruminantium
tttatttttttttacttatttttaacatagtttttaagctattccattggcattgaatt

SEQ ID NO: 3176 - DNA, 436 bp, Methanobrevibacter ruminantium
ttataaaattaattattgtttttcctttatagatatgaggtaagtgtttttcataaaaatttaattttattgcattgatttatttaaattaatctataatataaatcatttaattgcattaatctatttaataaacttatctataatataaataatttaaataagtttctaaattattccggcaccttaacttttgacttgctattgtttagttaaatatggcattattattggacaatttactatacttttttaaatttcttataattgtgtataattttgttattattaattaactgttttcctaggttaaataatctttcctaaacgatattcaagccatatataaagatttaaataattatttgttcataatattattagagaagactttccattttggatgttttctatatacttttaggagataaataaa

SEQ ID NO: 3177 - DNA, 80 bp, Methanobrevibacter ruminantium
ttgtaagatttaggcttatttttgatagaatttaagctttaggcttattttagagagaatttaagcttgcttttattgtt

SEQ ID NO: 3178 - DNA, 137 bp, Methanobrevibacter ruminantium
ctttttctttttttaatctgtttttttttgtttatattaaaaattggcaaaactatatatttatgaagccatataaaacttaaatagaattcttaatttagactcttttatgaattctaattttcactgattttttt

SEQ ID NO: 3179 - DNA, 2915 bp, Methanobrevibacter ruminantium
ctttctttttttcttttactatcaatgtgtttttttgcttaaacttgaagaaataatgaattgacactctgactgtttttatctgtggcttatttaagccctggagagtaggtttttccccgacttagcttaagtttgtggtttaatgttggttttgttataacttacctattactttatatttgcttaatggtagttttgttatgacttacctattactttatatttgcttaatggtagttttgttatgacttacctattactttatagttgtttaatggtagttttgttatgacttaactatggctttatagttgtttaatggtagttttgttatgacttaactatggctttatagttgtttaatggtggtttaatcattgcttacttcttattttattataacttgactataatttatttatgatttatttcttgtttaactagtggatacttatgtctttattataagtttattataatttacttatggtttatctattgcttaattatagtttacttatagtttacctattactttattatgatttagttatagtttacttataatttacttatagtttacttattgttttattgtagtttagttatagtttacttatagtttagttatagtttagttatagtttacctattgttttattgtagtttagttatagtttagttattgtttacctattgttttattgtagtttagttatagtttacttatagtttagttatagtttagttatagtttacctattgttttattgtgtcttagttatagtgtacttatagtttacttattatttgcctattgctttgctatggcttacttataacttacttatagtttaattataagattactagtgcttagttatagtttacttatggtttaactatatgattactagtgcttaactatgtctttgctatatcttaaccataacttatctattgctttattatagcttaactatggctttattattatttgcctagttctttgctatgactttattattgtctgatctcttcactcttaaggctgagtatatttttctttaattaaagaaagattaatatattggttaaaactatatataataattagaatgttattatttattaaattacttgatatttaatggttatttacttatctgattgatataaattagttatcagattactatggctttattatgtctttgttatcacttaactattgattaattatagctttatatggacttaactatggcttaatgtatggttagttatgctttagctgttgtttagctattgcttatctattgcttaattatgatttaactatggtttagttattcctttgctatagtttactggtgatttaatcaatgctttactataacttaattataactttattatgatattgttatgggttaattatggcttatctattgtttagatgctatttagttgttgttttgttataactttgctattgtttagttattatttggttataacttgcttattgctttgtatttgtttagttataactttgctattgtttagttattatttggttataacttgcttattgctttgtatttgtttagttataacttaattgtggtttaattattatttgcttcatatttagttcttatttaactataagtttcttataagtttcttataatttgcttattgctttattatatcttagttattctttagttataacttaactaggacttgattataactttattataaatttatatttgctttataactgctttattgtggttttattacaatttactacttacttattggttattttattataatttacttataggattgctataagtttcttatgctttacttatgacttaactagtggtttattatggcttaattattatttgcttatgctttacttacaggatagttctagtttaactattgctttgttatggctttgctatggtttagttataatttaattattgctttatatcagtattattgtcatttacctatagtttagttataatttaaccatttctttaatataagattgtatttactttatgattgctttatagtggtttaattattatttactattcatttagtggtggttttgttattatttacttataggattgttataactttattatagtttagttatagtttaactttaatttacctataactttattattgttttatatttgcttaataacaacttaattgtagtttatttataatttactatatatttactagttattttattataacttacttataagattataataatatacctactacttacttatactttaactataacttgcatattacttgcttatcttttacctactaattacttatagtttaacataatttactacatatttactagttatttaattataacttacttataagattattataatttacttatattttacctacaacttatttatactttaactataacttgcatattacttacttatagtttacttattttttagctattacttacctattatttacttatagtttacttataatttagttataacttacttatactttacttatagtttacctataacttaactatcctttagttataacttaactattattttactataaagattcaaaaaaagattaatttatacaaattttaacttgatgagagggggggatgagaataagaaaaatttctaaagtggtgtatcaaaatcattttattgtatttagccctaattaaatacacagttacaaagatcctattgatttgatttcacaatcttttaaggaaaaaatactctcatccaatatgatatggtgcttagcgcataagtctatttggagcctta

SEQ ID NO: 3180 - DNA, 142 bp, Methanobrevibacter ruminantium
ttttccacttttttaaggatcttttatatattttaggacttttttgttaactttaagagtcttaatatttttaaatggtttttctatttatttgctagttatttttgtactttggatattttaagtgttattttgattgaat

SEQ ID NO: 3181 - DNA, 96 bp, Methanobrevibacter ruminantium
tctatcatccctaaatttgataagtattattttttttttatattatatgttttttattatgtgtttttttattatgtgttcattgactttttgtgc

SEQ ID NO: 3182 - DNA, 213 bp, Methanobrevibacter ruminantium
ttaggcatcaggaagtgtgcattagctcttaacaatatttgaaaaatagattaaagtttaattcacgtgaatattttcttttttaaagattaagtaattaattgcacttaaaaacattattactattaagaatatgtttaaacattaattaatatttttcgatacataatgagcttaattattgaattgcgtaactatgataggatttatatg

SEQ ID NO: 3183 - DNA, 100 bp, Methanobrevibacter ruminantium
aggttgaagatgtatggatttgtttctttagtgtttagaggttaacaattatgaaagaattatattgagggcaaattctttagtgtttagaggttaaaca

SEQ ID NO: 3184 - DNA, 38 bp, Methanobrevibacter ruminantium
taaagtccgccactttagttgctttagctattgaggag

SEQ ID NO: 3185 - DNA, 481 bp, Methanobrevibacter ruminantium
tttttatttttttcttgttttaattggaattcgttttttatgtttttattttttttcttgttttaattgggattccttttcctaactttatttttttcttatttttctaaaaaaagatgttttaaggccctattgatataattgcataaagattatacaatttttggggcctccgattgtttgatttttttaaggattccttaataaaatcagaatcatctttaataattttttggaggatatggagactttgttttcttctaactcttcatcttcagttatttttgcggaaatgctttgatatattttaagaactggttctaaaagtctctgcatgattttttgactcaataggggattattattttattattgcttatttatttcttgctcatgatttagttttattttgcaattataaaattgctttagaagaattatagtttagggagtaaagttagaatatgttttagggcaatag

SEQ ID NO: 3186 - DNA, 73 bp, Methanobrevibacter ruminantium
agtgtatatttttgttgttagtatgtattaaatgtttaatatgatgggggtggttggtggttttggggtttat

SEQ ID NO: 3187 - DNA, 685 bp, Methanobrevibacter ruminantium
ttttttctttttttagttattaaaatttatttttttaatcccctttttagggataggtatgattttttctttttttagaagtaaactattctttttatctttttttaggaataggttattatttttatcttttttaggaataggttattatttttatctttttttagaaatagatttttttgatagtgttggcactttttggcaccttattttgtgtatttttggcactttctggcactttctttcagtgtaattagagactgttccttactcctttttcctattgcttactttagataagtttttccactttcacatcaatttttacttcaaaatattaaattgatttaaaagtgttaaattgattttatcctgttaggtttactatatattataaatagtaaaccgagtattatttttttaagatatggggtaataattaatcttattttaacaaaaaaacttatataatagtttttacacatctatgtttacagatgttttttatggatttcatctttgtaatttggatataaatattagtgtaaaagacgtatttttgaaaagtatattcttaagtgtggaaataaagtttaaagatgtattttttaaaagtatattcttagttttttttgagtgaatgcgtattttggaggggcttttaatgaagattaaaggtgattat

SEQ ID NO: 3188 - DNA, 342 bp, Methanobrevibacter ruminantium
ttttttctattttggtttgttcttggcactttttggtattttttggcagtttgtggtttttgtctgttggtattttttgacacttttttaggtctcttatcaatgaattttttaagcaaaaatattgataataagtcattttattttaatgtatagtttaccatatattaccaaactcttattttatatttgtttttctaaaattttaatgtatagtttactatttataaaaatattagttttcagacgctctcacatcatttataagctattaaaatcaaaataattttgcggaaaaatgaagaatttgttttgaaaatatttttttaaagggtgatatgt

SEQ ID NO: 3189 - DNA, 196 bp, Methanobrevibacter ruminantium
gtttcgcaaatgaaatcataaaggctaaaaaccctgaagaacttgaaaaaagtgaagaactagctaaatatggggaaaagatagcgaaaaacgcaagatgtgaaatagaagctggaattgcttatagtattttaactgaagaaaattccaatcagagagtatttggaaaatgatttaattaaaaatgttttttata

SEQ ID NO: 3190 - DNA, 2 bp, Methanobrevibacter ruminantium
tc

SEQ ID NO: 3191 - DNA, 255 bp, Methanobrevibacter ruminantium
ttgcttttaaatttcctcaaaaaatgctatttcactataatctcctagtttattttattttactataatcaaactaatcgtttctttattaactattttacaccatacaaactaataatttcctttttaaattaatttaattaattcttataaaatataaatagaaatttttatatgtttatattatatacttttaattaatagtattacatttaattaatattatttgactcaattaatatcttttgatggaag

SEQ ID NO: 3192 - DNA, 433 bp, Methanobrevibacter ruminantium
tttcctttttttaagtcattttcagttcttcttttttattttttttaagtcattttcagttcttcttttttattttttttaagtcattttcatattcttcttttttttatttttttatcagtttttctgattgttttttgtatgaatttttattttttgagtttgtttttttcactttttttctgatcattttttttcagtttttcatattatttttgtcataattttaattaattttagctattataatttgttaagttcattctatttttgtaattttaaataatcgtaaatttaatataattcattcatattaaaaataatttaaaatatatttgctcgatgaggatatcagtttactatttattataaatagtaaacaaagtactaaaacatttaaaataattactaaaaaagaatgaaaatttaacaa

SEQ ID NO: 3193 - DNA, 168 bp, Methanobrevibacter ruminantium
ttttttaataaaacttagtttttatataatttcatttatagtttattcaaaaccttatctatctattcaaaaacatatagaaatttttattagatatataaaatataaattttaaatgtaattaatcaattaatctaatattacttaccaatattattttaatggaag

SEQ ID NO: 3194 - DNA, 10 bp, Methanobrevibacter ruminantium
gaatatttta

SEQ ID NO: 3195 - DNA, 457 bp, Methanobrevibacter ruminantium
ttctttatttttttatcagatttctttatatttgattatttttactgactgctcattttctaggttttttttactaatttttgctgttttataatttcataatttttaattcctctgtttattctcaaagatatttttccattatgaattgaattcgttgtatttcttggttattttttaatataatttaattaattttagcttaaataataatcataaattaactcttatctattgtttaattaatcctatattggattaaatgatattaatattattttttgacattatggggttataatatctcctcagtgacgtttgtgataattttgtattaaaacagctattgaggcgtagatttgctagatttccactataattcattgcatgataacttttaatagctaaaaaactagttttttcaaggtattttttttttgtattggcaatgattttt

SEQ ID NO: 3196 - DNA, 491 bp, Methanobrevibacter ruminantium
ttttgtgtttttgtgttttttcacaactctgtttttgtgtttttattaatttgtgtttttgtgttttttcacaactctgtttttgtgtttttattaatttgtgtttttgtgttttttcacaaaatcgcatcataataatcttttaatactattttagagatagtaaattcaccgatttttttaataaaagagatattggtaaaattagcaaaaattattgattttttcaataggaaattatggatgaatctttgcaaaaagatttatctatgactggtttttaagtaaaatcctcttttattttaaagaaaacaaaataagattttggttgtgatattatgtctaatttagaagtagtgaaatcattattttatccttcagatgatggagaagaaacagtagaagtaatcattcactgagaaacactttgggctacacagaagtctatttcagagttatttggagtagatagatccgtaatttctaagcac

SEQ ID NO: 3197 - DNA, 493 bp, Methanobrevibacter ruminantium
atcggattttaataagttcttttaattgttcggattttgataatttggattctaagagctctttaaattcgtttaggttttttatagttttttggcttttggaatttctcatataacttttagctcttctgtaacttgaactttgttttattgttcttcataattttattgttcttcataaaatcaaatataaatatatattaattaagttaagcaaattaattatcataatagtaataattttttattgttatttattcaaaatctaaaaaaagtcaaagtaattaaatttgtgaaattaattaactgattaaatatttaatcagcgaattttcaagattaattattttgaaaattaaatttaattaattatttttatattttctatcttctagagatatttttatattctctatcctctagaaagattttaatttttctatcattttgaaaattactagaaaataattattacttaatactgagtgattct

SEQ ID NO: 3198 - DNA, 10 bp, Methanobrevibacter ruminantium
gtttttttaa

SEQ ID NO: 3199 - DNA, 532 bp, Methanobrevibacter ruminantium
ttctctttttttatttggtttttaatttttttattacttattttcttctttatgcttttttttaactattttcatcgttttttacttattttcttctttatgcttttttttaactattttcatcgtttttaatcagtttttattttgtgttttttcacacttgtgattttgtgtttttgtgttttttcacacttgtgttttagtgattttgtgtttctgtgttttttcagatttgtgttttttcacaaaatcgcatcataacaatcttttaatagtatttaagagatagtaagtttatctatttttttaataaatagttataaggaatttttttaaaaaataaataattttatgaagatttgatatatagtttaaattattgcttatggtttaagttttatgaagatttgatatatggtttaaattattgcttatggtttaagttttatgaagatttgatatatggtttaaattattgcttatggtttatgttttatgggttttgatatatgatttaaaatgattaatttga

SEQ ID NO: 3200 - DNA, 927 bp, Methanobrevibacter ruminantium
tttttaattaattatgtcttagccatatcctatttatttttcttttttgttgtttattttagattttatgcgccattgggttaaaacatgtctttaaattttcataatttgaattaatattgattaattcattaaagtatttaaccgatattcaagctttaaaggcttattagggctttaagaatattttctatttcagtgaaaaaataaaatttatatactaggtaaatctaaaataaatgtggacaaggaaattacttgttctttgtttaattaattaagcaaaatgttattaaataagaatatataaaacgaatgaaatagtttactatttcactttgggttggttacaattattctttatgaagaaatggaagttataaatattgctgtcctttaagattagtttttagctactattaagggagggtagttaatgattgattttaaagattgttgacatttataaaggggatttcttagtaaggataattttcttttttagaaaattttagttcatctattattgtaggggttggtttatacttcttatggttttgcttagttaaaataattctttttttctatatttctcttattttactttattttacttattttatcttattttacattattctagtctaattttattttataatacttatttttcctaaattaattttcaagttcaattttaactctaaatctttctttttaagatgaaaaaatgcatggggaaaagtctaaaatctaattaaatttagttaaaaattaaaaaaagagtaatatataattaaagaaatttagagaaattaaaataattttttgattaaaaatagcaaattaaaagagttagaaccattcagattccttaaactcttttaatatttatttaaaattattatttttcaacaggagattaat

SEQ ID NO: 3201 - DNA, 567 bp, Methanobrevibacter ruminantium
attcttatctcccttattggtctagaaaatttatttaaatcttattaaactttctatagtttgattttgtttgttttatattttttaattcttatttaaactttttataatttaatatattaagtatttttcttattgcttgcatgattttaaaatttgaacttctaataatttttatcccattcaattcttcattttcaattttaatcaacaatatttctattcatttttttattattttatgcatatctattatcaaaaatgcttatttttttattatatgagttcaatttatccatttattaaaaatattaattatttgctttatttttagtaatattaatatatcaaaacactaaatatataatatactaaaaaagattttatacaattttataaagattaggtttatatttaaccctaatgggtgatttaatttatttaaaaaactctaatcaaattattcaaaattattaatttattataaacattgaggtgtttttatgaaattaaacataaaaaagaagcattcttctattgtccatactttctgttctatttttaagc

SEQ ID NO: 3202 - DNA, 12 bp, Methanobrevibacter ruminantium
attgactttaaa

SEQ ID NO: 3203 - DNA, 177 bp, Methanobrevibacter ruminantium
ttcttatctttttttaagctttttttagttcttttttattattttaacttgcttatacaagtttttttaactctttttttattattttaacttgtctcatagttattttttcaaactcttattctagtttttaaaaattgtttccatttcgtaacaattttgatttacttatagaaa

SEQ ID NO: 3204 - DNA, 445 bp, Methanobrevibacter ruminantium
ttttttaatggaagataatttagtttatcattatacgaactttttttaaagaattaaattttaattgctattttttcaaaataaccatcatatacttcttatttgtactattaaataatttttaatcttaaaataacaaataagttattataatcaatatttgattttttcatcttcaagtaaaaattgatttaagaatgttaaattgttctaatattaaatcaatattgttccaccttaattaaatttgtcttatttgaaatcaattttggctttaaaaattttacaaattacttttacaaaggctaataagaggccattttgactattgcaaatcaattacaactctttttttattaaccaatttaagatattttttcaagaaaaaaaatattaaaatataaatatcatattggaattaaatatataataataattaaaaaag

SEQ ID NO: 3205 - DNA, 350 bp, Methanobrevibacter ruminantium
tcaagctttttttggccgaaggccaaaaaaccttgactaaaattttttttcttaaggattcaaacacgatttttaaatgggtttgtttaagttctttttttttaaatgggctactttaaactctttttttaaattaaaattcttttattcatttactttttgtctttaactcttttttttcacttatttcttattttttaactaaacatttgccttcaattcattcacagaattttaaactttaattatattgggctaattttaaaaatcgttaataaattatattaattatttatatttgattataagactgctctttttttcatttaaatcttattcatagattttat

SEQ ID NO: 3206 - DNA, 145 bp, Methanobrevibacter ruminantium
aaaatgtaatactttaaaaagatatatataggtgtgggtactataaataatatcaataaagtataatggatatcttttcaattatgctttatggtaaggttttatttattaagggaggaaaattaagtaattatttaccctaaaa

SEQ ID NO: 3207 - DNA, 315 bp, Methanobrevibacter ruminantium
attgctttaatttatcttcttgtatcaaagtcaaatttcatcaactctctttataaatcttttctcccttaatagtaattccttattttttgtaatttgaagttgaattaaaaccttatagcgaggtggtctttaacttttaattaattagctttgtttattgatattaagcttattcattatctttttaaattgattagtagaatattttttctcttaataaaaccttactaaattaattaaaattagtttattatttttttaaagaagtttatagctttagacagtttaagggttgtttttttttcaggtatt

SEQ ID NO: 3208 - DNA, 358 bp, Methanobrevibacter ruminantium
atattaaatgggtttggtcaattaaggccaaatccctctcttttattttatttaagttgattaattgcttagtatggtataaaacacaatatttaatttcagcttttattttttattttaaaagctgattctttttatttttttatttaaacactttgattctatttattttattcttaacttaataatcgttcttatttatcgtaaatggtttaatttaagttatttaatggcttattggaagttatttatttaacctttttttaagctttaagtaacttttattcaaagttcgattctttgatacgatcttttaaaaaatacaattatcaatttataactatataggagagcttaa

SEQ ID NO: 3209 - DNA, 8 bp, Methanobrevibacter ruminantium
attatttg

SEQ ID NO: 3210 - DNA, 609 bp, Methanobrevibacter ruminantium
ttttctcttttttttaaacttattttccttttttcacatattagcttttttacttattttagtctgcatcttccttttttattttctttttacttattttagtctgcaccttccttttttattttctttttacttattttagtctgcaccttccttttttattttctttttacttatttttggctgtttttatcctatttttaattatcttatttttgttcgtttattatataactaatattattccctttattttttcaaaaacttaatataattaacttattttttgttttaatcaattgaaacgttttattatagtaatagaatcatttaaaaatatttatataaatatacttataaaaataaatttaagtatttgaataatttttcaatcatacttcaaaggttttatttgctaagacttgtataaaaactgattgaaaagattaggttttttcattaaatgttcaatgcttaatccaatttaattaggctatttctaagattaatctatctatctcttagtctaatttccttattggtctgtaaactaattaaatttaattatttatcgaaaactttcttttatcttttatttggagagatata

SEQ ID NO: 3211 - DNA, 518 bp, Methanobrevibacter ruminantium
aatcaagcttttccgggccttcggcccgcaaaaccttgaccaaaatttttatttatttaggtgttaattaggctttttatgcttaattagccttttaatttattttttaacttttctttactttttttacttttttaagttttctttatcttttttttctagtttttaattttatttttccaaattctatttttacaatgaattagtttttctctgaatcctattttgtaaattttatcattctaattttcaaaatgatccaaattattaaaaatctttaaattactttaaattaatataattattagaggttgaatttctttttaaattcaatttaacttttaatcaaattttaatttttataatcattattaagaataaataataaaaattctaatttttataatttatttaataattataatcaatggatatatagatttcattaatttaaaaattaaaattataataattctttaagtatattaaaactagactcatttaaataaggtgtttta

SEQ ID NO: 3212 - DNA, 66 bp, Methanobrevibacter ruminantium
tatttatttttttaatttttaagtttgtttcttaacttacgaactattatttcttggataaaaaaa

SEQ ID NO: 3213 - DNA, 9 bp, Methanobrevibacter ruminantium
agcaggaaa

SEQ ID NO: 3214 - DNA, 37 bp, Methanobrevibacter ruminantium
cacttcaacacataatcagtattatattctttttatt

SEQ ID NO: 3215 - DNA, 19 bp, Methanobrevibacter ruminantium
atttaaattattattctag

SEQ ID NO: 3216 - DNA, 107 bp, Methanobrevibacter ruminantium
aatttccctcattagttttttaattggataattcttagttttttaattaattaattcttaatttttaattaaaataatgcatagtcttttaattaaatgatagtttt

SEQ ID NO: 3217 - DNA, 210 bp, Methanobrevibacter ruminantium
agtaaagctcctttgttgtttattttaaaagttttctagattccagttactagaatcagggcaaaaaaaggatattttttaagtaaattagtgatttattataaatataaatataaaataaattgattaaaggtaatgctctttattttggataaaaagacctaatattaaataaaatattaaataatctatatttatttacttaaattt

SEQ ID NO: 3218 - DNA, 353 bp, Methanobrevibacter ruminantium
ttaaatatatttttattgatttaaatagttttatgtattcttttattaaatcgcttatttggacatataatattttgattaaaaaaagtctttaaaaattgttaattgtttattataaatggtaaaattaataaatttgtatataaatgccgtaatggtttttatttatgaaaatagtttaataaatgggggatttgtctattgtaggctttttaagttataaaaaagattttaataaattatataattaaatattcattggatttttaagtcataaaaagaggattttaataaataaaattatgattggattggaattttaactaatttaaaagaaaattttaaaaaaaaaa

SEQ ID NO: 3219 - DNA, 14 bp, Methanobrevibacter ruminantium
acttcgactttaat

SEQ ID NO: 3220 - DNA, 18 bp, Methanobrevibacter ruminantium
gttttctccttttaagcc

SEQ ID NO: 3221 - DNA, 27 bp, Methanobrevibacter ruminantium
attaaattattattatggaggttttac

SEQ ID NO: 3222 - DNA, 268 bp, Methanobrevibacter ruminantium
ttttaaattatctttttaaactctttctttttcttatttttctattattttatttttctataattttattttcctattttcctatctttctatttttctttttttaattaattaatttatatctttactctattttttcaattctctttttattattcttatttttccatttaatgatgcaagtaagcgtttacattcgaaaagctttatataaattcttattcaaatattatttgtagaaaagaaaaaaattaaaaaggacgatact

SEQ ID NO: 3223 - DNA, 120 bp, Methanobrevibacter ruminantium
agttatccgagacggccttatttaaaaaaatctcacattaatgttttaagatataatatctctccaaatggcagcgcttatccggtgctgctaattcttaaaaaaaataacttaatttat

SEQ ID NO: 3224 - DNA, 277 bp, Methanobrevibacter ruminantium
ttctttttttcttaaattcttatttgtattttcctaactagtaatcggcttcactaattttcattaaatgttctttttagatgtttaaatcatttttaacaattttatttaaaaaatgagccaataaggattttatgttttaagttgtttgcaaggaaaattattaaaaaaagctgtaggggtggttggcatggaagacatgataagtgttatcaatttgctcttgcaaatgattaacgtaacttttgttatgttgatgtatttcaagagctaagta

SEQ ID NO: 3225 - DNA, 58 bp, Methanobrevibacter ruminantium
taaattggtaatattattttgtctttcatatatataaatagttttttggaggtaaatc

SEQ ID NO: 3226 - DNA, 164 bp, Methanobrevibacter ruminantium
attttaatttcctttttttcttttttttaagaccaaactcttttagcttttattttcaataattgattaactcttttaacattaaatataaattctaattttattaaactattatatgtgaaaccactcataattttataaaaaaatagatattgtgatgtttt

SEQ ID NO: 3227 - DNA, 234 bp, Methanobrevibacter ruminantium
gttctttagcttattttttgtttattttagttgaacttataagttcactttttttaaatttttgcacttttgtaacttgtaagttcattttttattaaattcagtatttttgtaacttataagttcactttttttaaatttttgcacttttgtaacttgtaagttcattttttattaaaattagtatttttgtaacttataagttcacatcaaaaaggctttttttttaaaaaa

SEQ ID NO: 3228 - DNA, 247 bp, Methanobrevibacter ruminantium
cctatcaccaactataataatctttaatttttttaacataaatcttttgactttttgactaaatttaatttcttagatagtctttcggtaaaataagttaaattttttaaaactatcttttgtttttggaataaattaaatattttcaaaataaatatattaatcattgattaaatgattgatttaatgattgattaactgattgatagataattgatttaagataaaatgattataactgattcat

SEQ ID NO: 3229 - DNA, 317 bp, Methanobrevibacter ruminantium
ttgtctattgtatagtttatgtttattctttagaggggtaaaaaattaggttttattctattgtatatttattttattcaatagacaaattagagtttggaaaacttatttattttatacaataggaaaaattttaagtttttatacttttaattttttttatgcaagaaaaatttggaaaattataaaaaaaagttctagtttttaacaaaaaagtaaaagtttagtctttaaaagacaataaaaaaagtttaatgtttttgaaattaatcaaaacattattttatctagtaatatagtttatagcttatttttat

SEQ ID NO: 3230 - DNA, 16 bp, Methanobrevibacter ruminantium
tttagattagattaaa

SEQ ID NO: 3231 - DNA, 529 bp, Methanobrevibacter ruminantium
aattcttcctccaataaatattctattagtaattagtttaaattaatttatttagtttatttagtttattttgttttatttttcagttacaataataattatcctttagatttacattaccataacgataaaacttgctacagcactgaaaaccataattaagataataaatattgctgcgatttgtgctctactcatttcaaatctcctttagttttgcttaataatacattactttaatatatttatataattatttataaatgtttattttttatgattctttaagggaatttttataaaaatactggaccttaaaatctatctccaaatagtttttcttttgaactaatcataccttattctcttgaaagtattcaaatcattaatttattcaaaatcataaggagaaaaagtattcaaatcattaatttattcaaaatcataaggagaaaaagtattcaaatcattaattaattatataaatcataaagaataaagttttaataaataggataagggtgtttta

SEQ ID NO: 3232 - DNA, 126 bp, Methanobrevibacter ruminantium
tgattaaaaactttagaattgggttttatttatttatttagaattattggtaattattcggtttaatttatttatttatttttattaggattaattgaatttattttactgtttggtggattgaaa

SEQ ID NO: 3233 - DNA, 98 bp, Methanobrevibacter ruminantium
gttattttttaattggagaaattaaataagttttttatttttagattgatatttttggagaatatcataaaattataggcatttaattgctatttgac

SEQ ID NO: 3234 - DNA, 49 bp, Methanobrevibacter ruminantium
ttttacaccaatattgttttattagtttaattagaattattttaattga

SEQ ID NO: 3235 - DNA, 100 bp, Methanobrevibacter ruminantium
tttatcccttgatagttgattagagtttaattatttgaaattgtaagattagtgtgtattttaatattttaatttttaatatattttaggggttttatta

SEQ ID NO: 3236 - DNA, 142 bp, Methanobrevibacter ruminantium
ttttcaatctcctttactataatagataataagtttaaactctcgctaattttgtatttattgttatttaaaaaaataatatttatttgttttttaatatgataaatataatattttttttctttaaaatgataaataattg

SEQ ID NO: 3237 - DNA, 33 bp, Methanobrevibacter ruminantium
tttatcccctaagatggtttgtttttctttttc

SEQ ID NO: 3238 - DNA, 246 bp, Methanobrevibacter ruminantium
gttttcacctatgtttttaaaaataagttaaaatagttagttagaatgaaaaatgaatgattttattattttttaatcttttttatatttaaataaacccttttgaaatcttatatatttaaagaattttaaattaagcgtttaaaagatttgaaaattatttattccaaatcttttagctttatgattatttttatttttgttgcttttcacttggattttaacaattttcgttttattctatca

SEQ ID NO: 3239 - DNA, 423 bp, Methanobrevibacter ruminantium
aatatctccctgagtttatttttattgcattttagtaatttttaagttttatttctttaataattaaatgtttatttcttttcgtttaatagctaaattgttattttcaaaatcttttttaagagtttatttttttttttaaaaaattaatcaattcaaacactattaaatattaattaaaatagtttatacgattttatatataatctttatttaatataaatattatcagaataattttggctatttttcactattaaggcaatctaatttattttacagttttcttttgctatttttccaattagagaaaaaatttaatattttttgattaattatatattttatgaaattaaaaattatattataatatattacaacagttattacaatatttattcaaattaatttagaggaatattt

SEQ ID NO: 3240 - DNA, 53 bp, Methanobrevibacter ruminantium
tatttatttaataatttaacacatatttgtagttatatttaagttgtgataat

SEQ ID NO: 3241 - DNA, 141 bp, Methanobrevibacter ruminantium
tctgttattggagaagtataattttacttaacagaaagaagtataatctgttaattggagaagtataattttatttaacagaaagaagattagttatttaatgaaaagaataataatggctattataatttaagtgataat

SEQ ID NO: 3242 - DNA, 120 bp, Methanobrevibacter ruminantium
tgatttagtttttgattaatttagtttaatttagtttaattcagtttaatctagtttatttgatttatttatttaattttatttatttttaattaattatattttatttaaggtgttttt

SEQ ID NO: 3243 - DNA, 99 bp, Methanobrevibacter ruminantium
attttctaaataaggttccttttaatccttctttgaataaaatattattccaatttattttaaattcttcataattcaattaaaaaaaatagtgattat

SEQ ID NO: 3244 - DNA, 45 bp, Methanobrevibacter ruminantium
gattgaaataatcgaataacagaatttactcgtaggtgaaaaaga

SEQ ID NO: 3245 - DNA, 19 bp, Methanobrevibacter ruminantium
tacttgttttcacttgttt

SEQ ID NO: 3246 - DNA, 102 bp, Methanobrevibacter ruminantium
atttaaattttcacgtggaatataagattaaatgaatttataagtttaattattaaaattagtttttaaagttctttaaaaacaacctaaaagagtggtacc

SEQ ID NO: 3247 - DNA, 1489 bp, Methanobrevibacter ruminantium
ttaattttatttaaatatttcattttttatctactttttttattcaacttatttttatcattattttaaattattgttattattaaacacttatttttattgtatgactgttctccactcgctaatagttttttaatttcacatcaatttcacattctcacatcaaaattgcttttgttcgtaagaaatgatacaaatttttcaaattttatcccaatgtcaactatttttcaaggccaaaaagatactcatcctaagctctttatttttaaaaaataccctccctcttataaactctataaaattttacactttgacatcaatttcacattctcatatcaattttactccttgacatcaattttacactttgacatcaatattgatttaaaatggctaaattgacttgaaattgttaaagttgtatggaactgtcttttttttaactaaaaaagcataagtttatatatttggtcgtataatgaattagtacagattgtttttgcgaaagggtaaattattccaaaaagattttttttaaaatcattcgttgcatatactgtagtttcattgaatcttgattttttaaaaaatagccttaagaaaatcgaatttcctattagatttggtttagctaaaattcaccctattctgctcgataattaaaattttctattaaatttgatttcttaaaggctatccataagaattttcctcaaaaaatttggaatgattttattgatctagaaagattttacctttttaaagctataatcttagataaataagtataattgaattctaatggacatttttacatcatctgaataatctatctaaataatctatagtctaaatattttttacatctcatcggtctctataaaaatattatcaatttaattatgattttgaaaatacatttgtattaatttctctggtcattttttcgcttttgaaatcataaattaaattacatataataacaatattatataatagataatttttaattaatccgataagtttataaaaaacaaaaatataattctattagaatttatcaaagaatttaattgattaaaaatagcaattaatttgattaaaaattatatgatttatgaatatctatggttatatgtttaaaaaaacagtctgtgagggcaaaaactagtatctatccattttaagtgattttttttatcttcgtggttttagatgtcttttgggaaaattgcatatttttttacacttgaaatataggtattagttttcaaatgctctctcttaaacattatatatagataaaattaaattataatttacaagagaaaaattgtatcaaaataattatttgagaatgactttgattattttcaaaatattttaaaaattgcatgaaagtgtaaatcccttgaatgtgattttttaataataattattaaaaatctttgactaaatttataatttaataaaacgagggtttggt

SEQ ID NO: 3248 - DNA, 71 bp, Methanobrevibacter ruminantium
tttggttgaatcattttaaaaatatttaattggaatggtaatttgactgaatcgtcataaaaaatatttaa

SEQ ID NO: 3249 - DNA, 102 bp, Methanobrevibacter ruminantium
attattatttttttctatagattttatttattaatattttcacgattaaaacataataacaaactgacagatgaataaattaaataaaaaggattgattata

SEQ ID NO: 3250 - DNA, 337 bp, Methanobrevibacter ruminantium
attcaagctttttgagccttcggctcaaaaaccttgaccaaaaattttatcacttgttgggagtaccttgctctttaacttgtgttttttctttttttacttaatttttattctttaacttaattataactctatttttttcttaatttttattctttaacttaatttaaacccttttttcttatttttcattttaaactttttctttaacttttattttccttaattttcatttctactatttttattccatagaattcttaaattttctaattctcaaaatcattacaaaagtattttaattatttaaaataaattaaataatacttatttttat

SEQ ID NO: 3251 - DNA, 667 bp, Methanobrevibacter ruminantium
attaataaaacaatatataatatttttttaatttagttgttttatcttcatattttgcttttcatttttttttagaagatattcattttttatcttcatattttctttatcatttttttagaagatattcattttttatcttcatattttctttatcatttttttttagaaggtattcattttaatcttattattttttcaaaaattattattaattagctgtcaccttttaggttacactaaatcatagaatttgttcgtttttatagatatattaataattaagaaattcgttcagaattttttattcaattaaagggctctcgaggcttatttaaaattcattttttcaaaattaaaaaatttaggtatataaaaatctatttctaatttctatttaaagaagatttattaattgttttttatattaaacctacaattatgtttatttttacaaaagtttgttttatttctattatttcaataataactcttcttaaaatggtctaaaatcttctagtatatatactttactcctacttttttatagaaaggtttatatactctcatttctaacataaaattatctaatattttatatatataaaaatattttataaaaattagatcaaatgattaatcattttaacttgtacaaggtgattta

SEQ ID NO: 3252 - DNA, 214 bp, Methanobrevibacter ruminantium
attaagagattatttctcttattctttaaacttaaaagggaatttttattcccactcttttttctttttttttagaaattttattttgattcgtacatttactaactatttctgaatcttttatattttctctctaagatcttttcttctattttttttattttttatctttccttttttaggattctttttttcttttttttaatcttttatc

SEQ ID NO: 3253 - DNA, 168 bp, Methanobrevibacter ruminantium
cgtcctaatttttatggataaatttatatatgatgaagttcaatataattatgtggtaagttacactgctatggattatggtggcaagtactagttaagtacaaatttatctaccaaattttaggcagtagttaaactaccaaaaaaagtaaagaagggtgatatgtt

SEQ ID NO: 3254 - DNA, 366 bp, Methanobrevibacter ruminantium
ttataatcttcccaccacaccactttaatttattattgatctcactaattactgattttagatcgatatcattaaagccattttatttaattttttttttattattaaagagggtccgccaaaaagctatttttttaaaaaagtttaaaattttcaattttttaagttatttattttagttatttttttaaaattcgatgttttttctattgttttcttttaattttggtgcttgcaccttgaaaaaattttttacttgttaattattctttaaatatgaaataaagcaataatattatagtaaactttatatactactttaaacataaataatatcaacaaagggttaatattttggtgttattt

SEQ ID NO: 3255 - DNA, 78 bp, Methanobrevibacter ruminantium
ctggtgttgtcaaaattttattttggcggacaccctaaatgaatatattattaaaatttatgtaaaggaggctgaata

SEQ ID NO: 3256 - DNA, 58 bp, Methanobrevibacter ruminantium
ttattgaaattaataaactttaaactaaaaaaactataaaaaaatggggtgatatata

SEQ ID NO: 3257 - DNA, 36 bp, Methanobrevibacter ruminantium
atgagtattaataggataagaaatttatttatccat

SEQ ID NO: 3258 - DNA, 191 bp, Methanobrevibacter ruminantium
ttttcatatttatctctcaatatattagaaaagcttttcttaatttgtttagcttccacatttctaactctatatcatctccttagaaaagcttttcttttatttttatcatttttgcacctctgaattagaaaagcttttctaaatctttctctcaaatgccataataaaatcacttcaaattttagttt

SEQ ID NO: 3259 - DNA, 95 bp, Methanobrevibacter ruminantium
catatctttataattttttttaataattttttaatttgatttaatcaaaattacattaattaatcattatttaagaatagataggtgttattttt

SEQ ID NO: 3260 - DNA, 7 bp, Methanobrevibacter ruminantium
tctcaag

SEQ ID NO: 3261 - DNA, 195 bp, Methanobrevibacter ruminantium
ctttgaccaaaattttttattttggcgcatgcttaaactaggaattgttttttgagcattatgaatatttttttattttttaaattattattctttttttatcaataatttttttatttttttattattttattattttatttatttaatttcttattgtaatttttactaatattatttaattggagttatttt

SEQ ID NO: 3262 - DNA, 27 bp, Methanobrevibacter ruminantium
cattttatttatttcaatttttttctt

SEQ ID NO: 3263 - DNA, 10 bp, Methanobrevibacter ruminantium
acttattttt

SEQ ID NO: 3264 - DNA, 78 bp, Methanobrevibacter ruminantium
tatacttaaattaagaaatataaatcataataagttatgttttatattttgttccaatgctatgaaaataaactttag

SEQ ID NO: 3265 - DNA, 48 bp, Methanobrevibacter ruminantium
tgaatatatgaaaactaaatgcttaactattagaatctgagggatttt

SEQ ID NO: 3266 - DNA, 17 bp, Methanobrevibacter ruminantium
atattttttgtttacga

SEQ ID NO: 3267 - DNA, 19 bp, Methanobrevibacter ruminantium
catttatttaatttagtgg

SEQ ID NO: 3268 - DNA, 339 bp, Methanobrevibacter ruminantium
tttttttattttacttattcacaatttaggaagtttttagctatttattaatttaaagaactttttattttacttattcataatttaggaagtttttagctatttattaatttaaagaacttttattttagctatttttccttttagttttttaaatttatttatttgcttatttatctatcaattgaatgatatcatttaaaaagaaaaatacgtttattttcatgctttttaattacaaaactcattataattcgcttatttaacaaaataaataaataataattataatgatttaattatatttcacaaaaatttacatttattaggagaatcgat

SEQ ID NO: 3269 - DNA, 127 bp, Methanobrevibacter ruminantium
aaagtttttttaagttattatttcaggtaaaactttaaatcatgaaattcgcttataaaactttaatatttattaaaaaagactaaacaatcattattttatgttaattctatgctaaggtgtttaa

SEQ ID NO: 3270 - DNA, 95 bp, Methanobrevibacter ruminantium
ttctatatttttccaattatatggattcaatcatttagagattcatcatttgtgattcacttatttagggattcaatcatttacaaattcaatta

SEQ ID NO: 3271 - DNA, 188 bp, Methanobrevibacter ruminantium
ttctatttttttatttaatgtatttatattcgtagattgtatgttgtttgtttaattgattatttaataaattgccttaaatttaatcatatgatttaaatgctttagaatttattaaataattaattgaatcagtatttagttaattataggtaatagaagtttatgaaagttgtaggacgattaat

SEQ ID NO: 3272 - DNA, 12 bp, Methanobrevibacter ruminantium
aaaaagagttta

SEQ ID NO: 3273 - DNA, 179 bp, Methanobrevibacter ruminantium
ctttaattttacttatttttacttattacttattttttaaattatctttattttacttattacttttttttaaattatctttatttttcttttatttctattattattttttcttaattatcatttttctataattcaaacatttttaattttattggcttgttagtttacttatttac

SEQ ID NO: 3274 - DNA, 117 bp, Methanobrevibacter ruminantium
gttttattctataggtctttttctttttaaaaatttctttttaattctttaaagaacatttttcttaagagtttaaaagcatcttttcttagcattatctttttatttgcaaattac

SEQ ID NO: 3275 - DNA, 348 bp, Methanobrevibacter ruminantium
actaactttaaaagctttattttaactttttttctttatttttctactattttttttgaattttcattgttttgtcttcctatagtcttttttataatatttttatttgttcgtacatcataaaaccaaaactttatatacattaaaaaccatataaataaatgtttaagcatttacgaactaataatacttttattttgtagatgttaagatagtaatactttaagatttgtttttaaagaacttataaagtaaattaagataaataattcatataatttatttttagcaatttaaagataaattcaatctagcttaaagtattaacaaactttatgaggaattaaa

SEQ ID NO: 3276 - DNA, 17 bp, Methanobrevibacter ruminantium
gtttaaaagctaaaata

SEQ ID NO: 3277 - DNA, 104 bp, Methanobrevibacter ruminantium
ttttatttttttctttttttatttaaattttttaataatcctttttttcataatcatactcactatttttttagttatttttatcataatcatgctcactattt

SEQ ID NO: 3278 - DNA, 52 bp, Methanobrevibacter ruminantium
aagtttatactataattataaaacaattttgtttaatgtttatacaacaaaa

SEQ ID NO: 3279 - DNA, 37 bp, Methanobrevibacter ruminantium
ttttagatttttcttgaaatttttttgaggggttata

SEQ ID NO: 3280 - DNA, 11 bp, Methanobrevibacter ruminantium
ttcgaccaatt

SEQ ID NO: 3281 - DNA, 399 bp, Methanobrevibacter ruminantium
tttttttcttttttactctttttattatttttattctactttttttactattttttaattattattcatttattattgtttcaattcattttcatttatttttatggaattttatacattcctattcattagttcacgattccatcaatttcacatttttatgtcaattttgttttgatttcgtaacaagtttatactttcacatcaatttcacatttttagtttaattttgttttgatttcgtaacaattttatattatcatatcaattttacgaaataaaatcaatttcacattttcaaatcaatttaacacttttaaatcaatttttttaacaaatattatttttcaactgctctttctaaaagatatttatatcattaaatccaatataactgta

SEQ ID NO: 3282 - DNA, 86 bp, Methanobrevibacter ruminantium
ttttttttactactatacttaatcccctaatattttaagtgaattttttaataattttttcatacattattacttgtgttgttatt

SEQ ID NO: 3283 - DNA, 115 bp, Methanobrevibacter ruminantium
aaagagttttataaaatgagatttattaaaaagccatcttaaaaaaaaatttttaaatttaaggatttattaaaggaaatatcttaaaaatagttttatttttatggaaatttac

SEQ ID NO: 3284 - DNA, 25 bp, Methanobrevibacter ruminantium
aaatttaaataattatgtgattatc

SEQ ID NO: 3285 - DNA, 100 bp, Methanobrevibacter ruminantium
aatgctaaaagctcttaacttttttttatataagttatgatatttttttataaaaactctgatacttttttattttttctaattcagattcgtgataaaa

SEQ ID NO: 3286 - DNA, 79 bp, Methanobrevibacter ruminantium
tccttattatttatttttttcttatctttttttaatctcttttttttaaatctcttttttgcaatacttctttattttt

SEQ ID NO: 3287 - DNA, 190 bp, Methanobrevibacter ruminantium
atttttgccttttatttttttaatcttatattatatttatttttagttcttaaaatatctttttggacttttttaatcataatttttttagataatagtttcatttttaactgtttcaaatgaaacatttatatcatatgaatgccaatataattttgaagaatacttttttaattttaggggtgcattt

SEQ ID NO: 3288 - DNA, 117 bp, Methanobrevibacter ruminantium
ttttagttccttagaattattagatttgatttttctattgacagtttaagtcatgaatggctatttcggagattttatttttatgggttatttttatatattgtcaagagtgataaa

SEQ ID NO: 3289 - DNA, 162 bp, Methanobrevibacter ruminantium
tttatttattgcttgaaaaaaattatttatgggttttaaatagggggaattaagttttcattattttaattttatgattttgtgtattgattaaaaactaattataattattttaattgtcgttttgtgtattgattaaaaaacaaatataagagggatttt

SEQ ID NO: 3290 - DNA, 7 bp, Methanobrevibacter ruminantium
attggag

SEQ ID NO: 3291 - DNA, 95 bp, Methanobrevibacter ruminantium
tttttcttttttttaaaccaattttcttctttttttatttttttatttttttctatttttaaaactttattaaatatagtttctaaaataatatt

SEQ ID NO: 3292 - DNA, 36 bp, Methanobrevibacter ruminantium
attcaaggtttattctcttaaatagttttaaagaac

SEQ ID NO: 3293 - DNA, 367 bp, Methanobrevibacter ruminantium
aatatttgctatattcttattattatataattttttttaaataattctttgaatttgccagttttttaatctaaaattggtgttttcttgataaaataatatgaattatgaaaaaagagtaatgaatatttaaatttttttaagaataaatagtagttctagttaaaaaaagatattggtagtattttttatttaaaaaaagataattgggtgtagtttctatttagaaaaagatatttggcagtattttttatttaaaaaaagataattgggtgtagtttctatttagaaaaagatatttggcagtattttttatttaaaaaaaagataattgagattattttttatttaaaaaaataaaagtaaa

SEQ ID NO: 3294 - DNA, 28 bp, Methanobrevibacter ruminantium
tttttttaacttaaaaggtttattgaat

SEQ ID NO: 3295 - DNA, 172 bp, Methanobrevibacter ruminantium
gattagaatttatgttgaaattattatatatttttaattttattaacttaattaatgaattatttaaagaattctttatgttattatcttttttaagattaaagaatcatttagaaaactatttaaataacgcaaaatataggataattattcatttaaaggagggtgtact

SEQ ID NO: 3296 - DNA, 405 bp, Methanobrevibacter ruminantium
ttgaccaaaaattttattgggggttgtgagaaagtcccttttctatttttttactttttattattgaatttttatttttttgttattttaatcttatttatcttttaatttctgtttttatttttatgaaggactttttttatgaatttttatttttacaaatttatatctttcttatctagtttactggatagtcttttatatattattatctagtttactggatagtcttttatatattattatctagtttactggataaatattatattatatgatttttaataaaaaaagagtaatttaaatttgttaataaaaaggatgagttaaaaactcttatatataaaaagagttaaaaacttcccagatctatttaaaaataagttagagttaaactgcttggat

SEQ ID NO: 3297 - DNA, 233 bp, Methanobrevibacter ruminantium
tataatcacttttcattgtcttttaatgaattagttatttttttagttgtttgaaacataatatcttgtttaaaacatattaaaaatactatttatattttatttaacttaatatttaaaattattttttccagtcttttcatattcaatttaattttagttttttctgttttattcagtgatttatcgctttctaaaaaattttaaatataactatttatatataagaaaat

SEQ ID NO: 3298 - DNA, 76 bp, Methanobrevibacter ruminantium
ttccttactttacttaaaattcgcagaattctttaattccattttttattcttttttttagacctttcactctttt

SEQ ID NO: 3299 - DNA, 71 bp, Methanobrevibacter ruminantium
taattttcactatttattcctaaaagttaaggttttttctttttcactattttaaacctaatttaataaat

SEQ ID NO: 3300 - DNA, 227 bp, Methanobrevibacter ruminantium
cctatcaccaaatcaatcaacacaattagttgtttaaatttttttatcctcaaattattgcttatatttatcatcttatgaaaagtattacaaaacattatctttaattatttttttatattataaactataaatataattgtgttaaactcttattttaatcaataaattaacttaattcaattaatttaatcaattaaaaaaaaaaatttaaggagttattattt

SEQ ID NO: 3301 - DNA, 13 bp, Methanobrevibacter ruminantium
tttaattttaagt

SEQ ID NO: 3302 - DNA, 119 bp, Methanobrevibacter ruminantium
tttttttctttttattctttttattctttttaaaaaattctttaccaattttactttttgcttcttttatttaaattttttaaaaaattatttaaagacttccaaataaattaattaac

SEQ ID NO: 3303 - DNA, 136 bp, Methanobrevibacter ruminantium
tgctttttttatatatttgctccattcagatgaagttctttagttgggtgaagttatttacttagataaagttctttcattctctaaatcttttgttaaaagttcattaaaaataaaattaataaatttaagatat

SEQ ID NO: 3304 - DNA, 280 bp, Methanobrevibacter ruminantium
attatcacatttctattgttttaattaagttttttctaaaaaagctgaaacctttattaagtttattataaaaaatttaaacctttaattaatttattctagaaaactttaaacctaatagttattttatttggatttcattaataaaatatttagttttttctagtcggatattcaagttccttaaataattttatatattagtttaaatagacatttattgaaaacttatttttaagattattgcagtataattttaatattttcatggaggctaatt

SEQ ID NO: 3305 - DNA, 61 bp, Methanobrevibacter ruminantium
atggattatttaaaataggtgcttgtaaatagaaaagtacattatcaaattaggtgttatt

SEQ ID NO: 3306 - DNA, 2 bp, Methanobrevibacter ruminantium
aa

SEQ ID NO: 3307 - DNA, 192 bp, Methanobrevibacter ruminantium
ttttcttttcttcttttttttaaattcttttttttctttaaattttatttcttcttttttttaaattctttttttctttaaattttatttcttcttttttttaaattctttttattttcttaaaattttatttttaattattttttcaaattgcattttttcagacatttataaaataggattctggaaaaa

SEQ ID NO: 3308 - DNA, 111 bp, Methanobrevibacter ruminantium
gaatcttggcagttcttctttgtaaaaatctaatggacttccattaaaaatagtaaaaccccctaaaaactcctatttaaagaattaaataaattttaattaaattttaaa

SEQ ID NO: 3309 - DNA, 72 bp, Methanobrevibacter ruminantium
cctatcctctcaatttgctgattttgttagattatatgattaaatatgattttcaaatttttaaatattttc

SEQ ID NO: 3310 - DNA, 41 bp, Methanobrevibacter ruminantium
attatcataaaaataataatcagtctgaaaattgaaatggt

SEQ ID NO: 3311 - DNA, 88 bp, Methanobrevibacter ruminantium
tctcataattttgcctgtaaatttgtttgataagatatttagagtagttagattaattagaatttttaatcaatattcaattaattat

SEQ ID NO: 3312 - DNA, 153 bp, Methanobrevibacter ruminantium
ttaatcaccttaaaattagaattttaattaatccccttatttaaaaagagtcagacggtttttaagactttaagatatttcaataattataagatatttcaaaatttttttaaaataatgattgtaaaaaaagaaaagttagaatgagcaagc

SEQ ID NO: 3313 - DNA, 412 bp, Methanobrevibacter ruminantium
attttcacctctaataattgtcctcaattttttttaatctaataatatttttctctttttatattaatttgttaaacatttgttattaatctttttgtattcttattaatttttttaaattatatttatttcgagtatttaacaaatcatttttttattaatataataagtattagtttaatagtataagtattttaagtgtaaatttacttatttttaatcaaatttgattataattttctaattttattaattttttaattaatttttcagcgaatatttgttctaattttatgaaattaatttaaattaatctaataatttggtcttagaaaaattgcttcattaaattaatttaaattaacttataatgagttgttttcacttgtttttaaattaaaaaaattaaaaa

SEQ ID NO: 3314 - DNA, 44 bp, Methanobrevibacter ruminantium
attaaatctatttcttgtttctattcggattaacaaaactattt

SEQ ID NO: 3315 - DNA, 408 bp, Methanobrevibacter ruminantium
gtttttcctctatttgtttaatatttgaataataattctttaaactttgttttaaaagttgtaattattatttaaatgtttttttcaatacttaaaattcatatgaatttgattaaaagtattaaaattcttatttaagaatttttttttaatattatattaatcttattatatttttttaaaaatgaattttaagttaaacaggaaaatgattgttaaaaatagtttgttgggcataataagtttaaattaataaaattcgtagaaaaggagttaaagttagaaaatcagtttaaaagtgttagaatttaataaaataagtttaaataagtaaaaataagaaaattagttaaaaaaagtaaaaaaagtagaaaaatataatatgaaaaaggtgttgattaataaaaa

SEQ ID NO: 3316 - DNA, 40 bp, Methanobrevibacter ruminantium
tgtactcactctttattttaaattttttggagtattgtaa

SEQ ID NO: 3317 - DNA, 422 bp, Methanobrevibacter ruminantium
ttttatacctctttaaaattaattaattgtgtattaaaatataaaacccatcattttatatctttttaaatagctagtagccaataatagttatttttttattattttagcccttcggtttagctattcatgtaaaagccaatatatagttgttaatttagacttagccctaatcgtaggtttaattgactagaacatatccaaattttatatattgaaagaaaaaaatatcaaaaatataataaaattctcatatattttagtgactagatttcagcattaatctaatcttctatttttgatagtaataaagtatatattttaagatgttaataaacttattgttttttaaaaatagtttgtccttaggcgaacacttatgaagaattattatttaatataaaagaacattttagggatta

SEQ ID NO: 3318 - DNA, 110 bp, Methanobrevibacter ruminantium
ttgaattcctctctaataaatatgattaaataattaaaataagattatatctaaaatggctatgtttttaaatatataaaaacaagaatgattttatttttataaaaaaa

SEQ ID NO: 3319 - DNA, 88 bp, Methanobrevibacter ruminantium
ttctattattattggtctttttaagggtatttggattttcttattatggtcttttaaaggatatctatgatttctattattatggagc

SEQ ID NO: 3320 - DNA, 119 bp, Methanobrevibacter ruminantium
ggacataatatctgctccgatattgttttaaatgataattttaattaatttaatttttttctaaatttattgttccaagtggaacatttaatagtttatcttattaactattttgtata

SEQ ID NO: 3321 - DNA, 35 bp, Methanobrevibacter ruminantium
tttaaaatctttaatttttatttaggggtttaaaa

SEQ ID NO: 3322 - DNA, 204 bp, Methanobrevibacter ruminantium
tagtggatggataggttgtagttaattctttaatctaatcattgcttgtttaaaagttataactatttatttatccatttatcttttatccagttatcttttatcaatttattcatttatttattatttatttttcattgaatagatttaacttctattcaaaaatatttattactttttttaataattagcttgtctgataaa

SEQ ID NO: 3323 - DNA, 129 bp, Methanobrevibacter ruminantium
ttctcaataatttttgattttttttcgataataattaatcattattagttatttatttattctcagttattttcaattattctcaattttcttatttttttttaaatatcttttttaatcagtgatatt

SEQ ID NO: 3324 - DNA, 342 bp, Methanobrevibacter ruminantium
ggcttttaatcttccaatataaaaaacattattttatttaaaattttctaaaaaccgaattttttatatattactaaaaaacataaataatttacatataaataatttaattttatggatgataagttatttcaaatcaatttcataaatttaatgcttttatgaatgtgaatttacttaatttaatttcatataatttataaaaattttataaatggaattataaaatttgcttggatggattgtccctattttataaacggagttatgaaatttatttttggagaatctatctattaacaaactaaaatttagggcaatgccctatcatgaggtgtttag

SEQ ID NO: 3325 - DNA, 110 bp, Methanobrevibacter ruminantium
tttcaataatggttgtttgaattattgaattaactttcatatttttatatttatttgtaatttatttgcaatttaactgttaatctatttattttaaaggaaaaggtatt

SEQ ID NO: 3326 - DNA, 138 bp, Methanobrevibacter ruminantium
tttttttctatctttttttatatatttttttataaattttattattatcaagttacttattttatttaagatttaatttatcaatatttatttatttaaggtttaatttattaatttatattaatttggggtgtgatt

SEQ ID NO: 3327 - DNA, 52 bp, Methanobrevibacter ruminantium
tcgattcataaaagtttgataaatattatcaattcacaaagtattattttaa

SEQ ID NO: 3328 - DNA, 39 bp, Methanobrevibacter ruminantium
tttatttattttttataaatttttataaatctcatcaag

SEQ ID NO: 3329 - DNA, 399 bp, Methanobrevibacter ruminantium
tttatttattttttattctagtttcaagaagaatttcattaatttttcaatcaaatattttaaattttttaccatttatccattgacttaatcaaatgatttattataattttttactaaatttttactattttttataatttttacccattttttaccctatttttaaattaagtttatatactatgaaataaaaaaccttaattattatataattagttagattaagtcatctgcaattaatttagatttttttagcaaaaacaatttgaaatctttgctaattttttaaaattcaaaatctttcaggattaattttttattattctgatttggtagatggcaataagaaaaatacttataattaattctattctatttggtagaggaggttaattg

SEQ ID NO: 3330 - DNA, 243 bp, Methanobrevibacter ruminantium
gtaattaaacggctttaattattaggtcttatccattaaaatttatttttaaactaaaattactattagtttatattcaaataatttataattaatttatcaattaagattaattaaatcaattaaaatcaattaaatcaatttaatccttttaaggatttaattcatatttattattcattttaagtaaattgtgattttctagaaagtattaattctagattttttaagtaaggagataaa

SEQ ID NO: 3331 - DNA, 379 bp, Methanobrevibacter ruminantium
atttattttggatttcttagttattttagataccttcggattctattggctttttgtagtctgttttaggtatctctagtctattttatctaaattttataagttttttttactatttttaacaatattttccaaaaaggaaaatctttttatactatcaaattccataaattatttgtttttcataaaattttttcatagctaaagttaaatattttgccatattataaaattttataaatgatgaattactaaattttaattataataaaaatatgaaaaacatatttttaaaaaattattattaaggcattaattaattatatttataatttataagatatagcaatgcttaaattaaatcaagagatgatttata

SEQ ID NO: 3332 - DNA, 76 bp, Methanobrevibacter ruminantium
attgtttaattcatttagtttatttaaatcgattatgattagattttaaaagatgttttaaacaaaggatttagtt

SEQ ID NO: 3333 - DNA, 104 bp, Methanobrevibacter ruminantium
tttttttttattttattaattactttaatttacatttatgcacatacacataaaactttattattattaagatttattaatactttatttttaagatgatttct

SEQ ID NO: 3334 - DNA, 205 bp, Methanobrevibacter ruminantium
ataaatattaattctttatattttttatcaaaaagactcttttaaactattttttctattttaataccaaaggtttaaatatagttattaaacatatataattaatgtatctataataaagatattttcttattttaaaatatttattaatagattagatttttattaatcttataagatttttaatcttagttcaattagataa

SEQ ID NO: 3335 - DNA, 207 bp, Methanobrevibacter ruminantium
ttttttttattagtttaacaaaaaactaataactctatgtatgaataaggaaataatagatgctctcttgcttttgagatacttaaaaggttcttaaaggtttgcaggattatcctcatgcaatttagaaacctaaacagttctaagtggtatgttgtaattatatattataaaaatccgtttggattatcagataaggtgatattt

SEQ ID NO: 3336 - DNA, 10 bp, Methanobrevibacter ruminantium
ggtgatttgt

SEQ ID NO: 3337 - DNA, 164 bp, Methanobrevibacter ruminantium
gttcaaggttatttctaattaatcaattaaaagcaagaatttattcatttaatttaaatctaatgattaaattactgcttgttttttaatttcgattaattattatgtgatttataaattaagactctagaagtcttaactatttttatatttcggtgttttaa

SEQ ID NO: 3338 - DNA, 11 bp, Methanobrevibacter ruminantium
ttgtgaatcag

SEQ ID NO: 3339 - DNA, 227 bp, Methanobrevibacter ruminantium
taataggcttgatgaaatgatcttttcaatagattcattgaattgatatctctcaagattattggtcttttcaatagtttcattgaattgatatctctcaagattattggtcttttcaatagtttcattgaattgattctctcaagattattatcctatttttatttttttctatttttatctatttttatctattatgcttaattttatcctaatggggtgatttt

SEQ ID NO: 3340 - DNA, 40 bp, Methanobrevibacter ruminantium
ttttttttataaactgcttaaaacttttattttaaacaaa

SEQ ID NO: 3341 - DNA, 212 bp, Methanobrevibacter ruminantium
ttttctttttttatttttctactttttttaatctttttaagattctttatattcaataagattttcataattttcacaattgttctataacaataaaactactttttaaataattttttatacttttaaaatcaaatattatacagtattataataataaacaaaacaattcaatttaataataattaatttaaacaattaggaatgatatt

SEQ ID NO: 3342 - DNA, 73 bp, Methanobrevibacter ruminantium
tttgataattaaaatactttagaatttatttagaggatattaggatacaatttatttaaggaaggttattatt

SEQ ID NO: 3343 - DNA, 45 bp, Methanobrevibacter ruminantium
aatggatagttatatgtaaatctatcattttaatcaatcgttatt

SEQ ID NO: 3344 - DNA, 57 bp, Methanobrevibacter ruminantium
ttttttttataaaagttatatatggtaaaccaaataaaaaagttttaggtaattttc

SEQ ID NO: 3345 - DNA, 59 bp, Methanobrevibacter ruminantium
ttttattctactttttttaaatcctttttttctttattttttcaatctcgaatcaattt

SEQ ID NO: 3346 - DNA, 101 bp, Methanobrevibacter ruminantium
ttattttttaatttttattattttatctgattttaatttctcataattatttagtaaattttataaataactgtgcacatactagttttgggggagataat

SEQ ID NO: 3347 - DNA, 53 bp, Methanobrevibacter ruminantium
tcagatttagtggactttaaaaaataaatttatttatagtagggagagttaaa

SEQ ID NO: 3348 - DNA, 219 bp, Methanobrevibacter ruminantium
ttaattaactattttttatttttttaattctttttctctttcttttttaatctttttatatttcatttcaatatctatttttaaatgttttgttccacaatctaaagtcaaataatatatactgaataaaacaaatatatttacataaagattataaaattattaaattctcattctttaataatttaaaataattctaatttttaagtggagattcaa

SEQ ID NO: 3349 - DNA, 24 bp, Methanobrevibacter ruminantium
aaaatctattaggaaagggataaa

SEQ ID NO: 3350 - DNA, 187 bp, Methanobrevibacter ruminantium
ttattttttcttttttatattttaattagttatttctcttttttctattaattctttttaatttcctataaagtctatatattatttttttatattaaacagcttaaatataggcttatataacttatttttcatattaaaccactcaaatataaactatattaaatattaaatccaatataagatt

SEQ ID NO: 3351 - DNA, 96 bp, Methanobrevibacter ruminantium
aaatagttttttcatttaaaactattttcatatttttttcaatccttttgattaaaatgataaaaatttatttatttgtttttataaaataagatt

SEQ ID NO: 3352 - DNA, 141 bp, Methanobrevibacter ruminantium
ttttcttttttaattttattctttttaattttatttattttacttattttattgtttaaactatttttttagagatatttatattttattctgcttagtttatcgtttaaactattttaaaagatacttacaagctttaat

SEQ ID NO: 3353 - DNA, 281 bp, Methanobrevibacter ruminantium
attaataaattgttttttcaattaaataaatccatattctttttttactaaatttaagaaattttttaatcagatagtttttaagttatttgtaactgattttcaattaaataaacttatataatatcttaattaaagtataattaactaatatttttattagaatattctaaactattaaaactaattcaaattagaaaattagcaaactaaaaataattttttaaggttatttattagttaaagcaattaataatcatttttttatttaaggtgtaaaa

SEQ ID NO: 3354 - DNA, 140 bp, Methanobrevibacter ruminantium
ttttaattaataaaatggagaataaattagttagcggttttgttaagtttttattcaatcgttaattattatttattttcattcatttttttatttatcattttcatttttttatttattttcatttaaaaggtgataac

SEQ ID NO: 3355 - DNA, 185 bp, Methanobrevibacter ruminantium
ttctttttttcttttattttttttatttctttactaaactacttttcaagctaattaaggcagattttttaattttaggagctattaaataaattacttataaaaaacattttgattataatttttgtgattagatttaatgatttaaagtcaattttgagatattttttattaaaggtgagtct

SEQ ID NO: 3356 - DNA, 222 bp, Methanobrevibacter ruminantium
tttgctaaacttgagtttggaaaataaatcaacgtgataaaggggaatataaaactttcgaaataaatttataaaagaaatcaacgtgataaaggggaatatgaaacattcaaaataaatttaaaaaaattaaacaaaaatagataatttattataatttaaagaatatattattattagatatccttaaaaaagggtattctttaaaaaagaggtgaaaaa

SEQ ID NO: 3357 - DNA, 133 bp, Methanobrevibacter ruminantium
ttaatctatttgtcatagtttcgtaagattttggtttaaaggactaattttaataaattaagttctttaaacaatagttttactaaaacaagttttcaaaaggctttttaatcaaaatcctaaagagagtaga

SEQ ID NO: 3358 - DNA, 334 bp, Methanobrevibacter ruminantium
atagttttaattgatttttttttaacttattttctaactaaattgttcttattttatttataaacttatttactccttttttattttttagttttttttttaatttaaattttttactcattttttgtgttttttattttttttaatttaatatttttactcattttttatttttttagttttttaatatttttatatattttttaatatttaggtataccaaaacttttatatttaacttgattcaaatatttattcacaagattatttaatggattttaatttattcaaatagaatttattaatttttttaatttattataaaggtgttaaa

SEQ ID NO: 3359 - DNA, 310 bp, Methanobrevibacter ruminantium
ttttaatagggttatagttaattttataatcttttattaattatttttatttaagtcaatttcatgctttcatatcaattttacattttttaatcaattttacgagatggggtcaattttatagtttcatatcaattttacattttttaatcaattttacgagttgaggtcaattttacattttcatatcaatttcacactttcacatcaatttaacaattttaaatcaatatttaattaaatcaagtctttaataagctttaaatagcataaaatcaaatatctacttaacaatgatttaggtaatatt

SEQ ID NO: 3360 - DNA, 204 bp, Methanobrevibacter ruminantium
atggtgtcctgttctagggattgtaattatttaggggttgtcatgctctagggattgtaatgcctaagaattttgaattaaatctgtggccatagcaaattttgctttaaaaatgctcatctttatatagtggaaaaaacatatatttatttgttgaaatattagcaatttcactatttttatttttatatttcaattgtcttt

SEQ ID NO: 3361 - DNA, 138 bp, Methanobrevibacter ruminantium
tttttttatttaattacttcttttataagtagatttactggattttaattttaaaatttaattttctaaattggctttaatatttaaaaattcttaaacttaattcaatgcttattaataatttattgaggaatggct

SEQ ID NO: 3362 - DNA, 192 bp, Methanobrevibacter ruminantium
ccaccttttacgagcctacggctcgcaaaagctggaccaaaaattttattttaacttgggagtacattgctcttaagtctttttttattaattaaaatattttcatgcttctatttattaattaaaatctagatttactatttgtccatattaactaaactaaacttttttttaagaatattttattttatc

SEQ ID NO: 3363 - DNA, 147 bp, Methanobrevibacter ruminantium
attttgcccacttaaaaattagatatttaaattgatttttacttatttttttagatttgaagtacttatattatttttacttattttttttagatctgaagtacttatattgatttttacatatttttgttttttcatattgaagag

SEQ ID NO: 3364 - DNA, 118 bp, Methanobrevibacter ruminantium
tttattcgacctgattgtcattttttgaaatgattttttactattattaatattgaatttttaatatataatttttatcttacttgagttaacttagttttcatatttgaattataat

SEQ ID NO: 3365 - DNA, 56 bp, Methanobrevibacter ruminantium
agtataagaattagaatttaaattctaattattgaattgattttatatttaaatgt

SEQ ID NO: 3366 - DNA, 214 bp, Methanobrevibacter ruminantium
catgtcttactcctttaataatctttctgttcatttaaatattttagataatttttttttttaaattgaatatccattaatttattataaactttatattatattaaattttcatttaatacagatttattttttttatttctaaattaatggtttattaatttacgcttatttaaattaaatatttaatcatttaaatgattaattgctaaat

SEQ ID NO: 3367 - DNA, 218 bp, Methanobrevibacter ruminantium
agtttttcctcctatttttaagcataatcagatataaatataaatcaaagattggcaaaaggcaaggtctaaactctaaattaaaatctgttttctcttattcgtttaagataattagagtaaaatgaacaattttaatatattttttcatatttcttttccaatctaaaatcataattattatcatgattactattaattttattcaagttaatata

SEQ ID NO: 3368 - DNA, 371 bp, Methanobrevibacter ruminantium
aatttaccttatggctaatttttactcatcacttcatattgaaatctaggttatttgagtgtatttttattaaattctagttttaaatgggttaattttcatcgttttatcgattgtttcatattaactgtatgataggtttaagataaaaattgcttgggtgcttttagttgatttaatgctgatttttagttttttatcctaaagttatttttaaattattattttttttgaaaaaaattttaatttttaaaaatttttataatagaattaataaattaattatattcaaagataattttatgattgattcagttaattgttatttatgctgatttttgattaaatcataattcaaaacgagtgatttt

SEQ ID NO: 3369 - DNA, 86 bp, Methanobrevibacter ruminantium
ttagcaaaaaaattctatttttttttagtttcctaataagttattcagattattttatttgtaaaatttattaatgaggtgattaa

SEQ ID NO: 3370 - DNA, 93 bp, Methanobrevibacter ruminantium
aatactcttaaaaatagtttatttattaaaaaagtttttataagtgtttataaactaaaaattagtaattttattttttaaaaaaagagtaaa

SEQ ID NO: 3371 - DNA, 12 bp, Methanobrevibacter ruminantium
ttaaaaattcat

SEQ ID NO: 3372 - DNA, 211 bp, Methanobrevibacter ruminantium
aataatagttttgtcttttatagtattaatattaaactgttttatattcaattatattttacttctttacttattttcccttgttttaattagatggcgattttaaagagttttttaggtttaccaaaactatatattatatgtcgatataaataaatttatacaaagaaaatttatttatgaagttgataaatttttaaaggtgataaat

SEQ ID NO: 3373 - DNA, 193 bp, Methanobrevibacter ruminantium
gtaagataatagttaaaaactttttttcttatttttttatttattttactttaatctttttctttttttattggaattttatttttcaaaggttgattttagaattttctaatttttttaactattgttataagatatctaattaaatattttaaattattaaatgattattaagaattaaaggaagacttat

SEQ ID NO: 3374 - DNA, 207 bp, Methanobrevibacter ruminantium
tttttttttgatttgattaggcttatttttttaaattctttaattcatttttattttttctttttttagttttttttttaattcttaattttcattttttatttttctttttttagttttttttttaattcttaattttcattttttatttttctttttttagtttttttaatttaatttaactttagtgctctctacggattctaa

SEQ ID NO: 3375 - DNA, 381 bp, Methanobrevibacter ruminantium
taaacccaccttctttaaattcaatcttaaattaccaataatataaataaagttaggcattattgtatttatattaggtatgaagtattttgaaaattttaataattaccatttataagatttattcaagtaatatttaaatttttttatttatgcatattccgataattttttttgaaaatatgtcattataatgtatatttttgtacaacaaagatttaaatagtacattatacataataaaatatacattataaaaagatataaattaatgtttaagtaagattttaacatttatttatttatcaaaatttttaaaatttatttatctactaaaatttctaaaatttatttatttatcaaacaaaaggagattaagaa

SEQ ID NO: 3376 - DNA, 119 bp, Methanobrevibacter ruminantium
atttagatgttttttcttttaaataaagttaaaaataaagaattttaaatatttttattggatagagtttaattttatgaattttaaatattattagaaaaagttaaaaaagggatttt

SEQ ID NO: 3377 - DNA, 68 bp, Methanobrevibacter ruminantium
ttgttattagagattgtttctaagtattagggattgtttttaaatcataaactgaacagatgattttt

SEQ ID NO: 3378 - DNA, 53 bp, Methanobrevibacter ruminantium
gatttaaaaaaaatgcataatttgatattttggattgattttggagttgaaga

SEQ ID NO: 3379 - DNA, 172 bp, Methanobrevibacter ruminantium
ttttatattttgatattgtaaatgattagggagattaatcttaattttgatattgtaaataattatggggattaattttataattgtttaaaatctagataaatatagagataaattttaatgattaataattcttatcaaataatcaaaagtattcaatggagaaagaaat

SEQ ID NO: 3380 - DNA, 49 bp, Methanobrevibacter ruminantium
ttgtaggatatcgaactacattaataaatgaatgtttaagggtgataag

SEQ ID NO: 3381 - DNA, 369 bp, Methanobrevibacter ruminantium
cttctttcaatattttttatactattttttcttttgttagggtttaatatattaaacctttataaacatttttttatactattttttttgttagggtttaatattttaaacttttataaactatttttttatactattttttttgttagggtttaatattttaaacttttataaactatttttttatactatttttttttgttagggtttaatattttaaacttttataaactatttttttatattcttttttgtggtggataggggaataaaacagttacgaattatcctccttttaattattatggtttgctggcgtttttttaagggttaatttgatgtttatcatagcaaattaaccattcttta

SEQ ID NO: 3382 - DNA, 184 bp, Methanobrevibacter ruminantium
attattaatttttatatttgcttttaaatagtttttcttgaattgatttagtttggtggtggtttttattggttggtttggtggtggtttttacatgtttctttttttaagagtgggttctaactgtatggaataaaattttggtcaaggttttttgagaccgaaagtctcaaaaaagcttgag

SEQ ID NO: 3383 - DNA, 85 bp, Methanobrevibacter ruminantium
tttaatccctatctgtaataatgtaattatgatttttcttatttttaaagagtaattactcttttttatctttttaaatgaagat

SEQ ID NO: 3384 - DNA, 225 bp, Methanobrevibacter ruminantium
tgaatcaaatttatctgggtgtttgctttctttcatggtttaatcacattttgcttggttttttaatatgtttcttgggaaactgtttactgatgaacgatttttcttatattattctcttttgttttcattttatataaatgtttcctgggaaactgtttatcgatgaacaatattttttttttaaaaccaatcgttattatgtattgttatttaatattttca

SEQ ID NO: 3385 - DNA, 106 bp, Methanobrevibacter ruminantium
aaaatcacttgaatcaatctttttattataatttatagggttattggttaaattataattaattaatttttttttaattaatttttatttttataatttaatttat

SEQ ID NO: 3386 - DNA, 68 bp, Methanobrevibacter ruminantium
attttcacatcctttataagtaattcataaatcttagtttgctaattgttttatcattatctttttat

SEQ ID NO: 3387 - DNA, 411 bp, Methanobrevibacter ruminantium
gttattcccttattattcttaaaatcttttttgcttgttttttggtcattttgaaacttttatcattctaaattttaactaacacttgttagttaactctatatggtatttttgactttttaatttataaaactaacgattgttagttaaatatttgatgcttttgactctttcataaaaaactatggattagtataatttttaaaaaggttcaagattaattgattttaaaataagttttaaaatggctaaagagagtatttaaaaagaaaagttgaaatattgtttaaggggtccattaatctttctaattatttttaattattcttaattcaatttactaaaaggagaaatatggatgcgaagtttcttcatttttttaacttatgaaaaataaaaaattagttttaa

SEQ ID NO: 3388 - DNA, 264 bp, Methanobrevibacter ruminantium
taaaggcctcctaataattcatatctgtgtttattataataaattatctaaattattatatataaattatgcatcagaatttaaaaaatatatttgttcgtggcttgatgaataatatgattttgacttgatgattatttttaaacactaataaataatcttaaattatcatataaagcattaatattagtggaaataaaactgaatttacttgatgattatccttgatgataaataaaatttcatcatttaaaaaaagaaaaa

SEQ ID NO: 3389 - DNA, 9 bp, Methanobrevibacter ruminantium
aaaaagttt

SEQ ID NO: 3390 - DNA, 134 bp, Methanobrevibacter ruminantium
tttataccttcttatttaaattttgatagttgtttttttatatctaattcttattctttttagatatttttaggcattgacttttttttcttatctggatatttttgattatttggctattttttaattattat

SEQ ID NO: 3391 - DNA, 307 bp, Methanobrevibacter ruminantium
attattattttattttgggatagtatatatattaatggcttttagaattatttttttatgcttttgctattagaacaaatgatatatgtttttaaaatagaataagtcagttaaggaattaatagcggaaataagtaaaattaagaatagttgactaagataagattaaaataaaagtaaagttaaaaataatttattaagataagattaaaataaaagtaaagttaagaaaaaaagaaaaattaattatgttatctaacattctaagaattattgacattctaagaattatgtaagaatagtaaaa

SEQ ID NO: 3392 - DNA, 582 bp, Methanobrevibacter ruminantium
tcctattatgtttccaaataaatattattaggcttcttttaattgtaatttgaggaggcctttcataatcttggatgcgtttcattttatcccctattaatcttattttgctttttaaagagtttgctattaaggcaatatcttttttttttaagagttaactattaaggcattttttttaagagtttactattagacaatttattttgctttttaactcttattgtcttgaggaaatttcttaagtttttaacattccttatacaatattatatttatttttagattaaaaaaattttttgtaaatttttttagaattctttagggatttcttttaaacgaaagtaaattaatttttttgggattatggggtaatgtgtttttttgggattatgggattgttcattttagtatggatgagtatggatgatttggagcatctgtacataaaaatattaaaaaatgaagcagatgtcttatcaattaggattataattttgaaataatacttatctttatatattattaataaaatatatataaatgttttatttaacttaatttaattaaaggtgaaacaaa

SEQ ID NO: 3393 - DNA, 399 bp, Methanobrevibacter ruminantium
ataaactaactcttttttctttttttttattttatttttctatttttttttatcatgattttatcttttagggatactttttctatttttttatttttttttatcatgattttatcttttagggatactttttctatttttttatttttttttatcatgattttatcttttagggatactttttctatttttttatttttttctcattattttatcttttagggatactttttctattttttttctatttgttgattattttagggttattttatcttttaggtgatgttttttctatttttttcatagggtgcttttttatagttatttgtctttttagtaatacttaatgcttgatttattatttttgctatgggcttttttaaactaattttaaga

SEQ ID NO: 3394 - DNA, 216 bp, Methanobrevibacter ruminantium
atgaatcctcacttaaatgattattcttttttcagatagtcattatttatattcatatatagttctttcagatagtcattatttatattgatatatggttctttttgcattaagtttttattgttttaagcccaataattatatgattgattaaatttaactcttttttagttatatttattttttataatttaatttattttttggtgagtggaa

SEQ ID NO: 3395 - DNA, 11 bp, Methanobrevibacter ruminantium
aataaaatttt

SEQ ID NO: 3396 - DNA, 160 bp, Methanobrevibacter ruminantium
gtttaaatattggtggaaacttataaaaatacttattgttgctttttaagtttttattgttgttttttaagtttttattattgttttttaagactagtttagatttctttaaaaatagttgttttttgagctttttagataagttttaaaaaatagtaag

SEQ ID NO: 3397 - DNA, 109 bp, Methanobrevibacter ruminantium
atttaatttaaagttttaattttaatttcagtgtcaattcaaatttatagtttagttttaatttaaattttaatttatatttcaattaattccttttaatgttatttaa

SEQ ID NO: 3398 - DNA, 184 bp, Methanobrevibacter ruminantium
aatttaatttaaggggaaaagattaatctttttataagatcaatcttttaaatttatgggaaaagactaatcttatttatctagtaaaaatagttttaatcttatatttatgaaataagatcaatctttttaatttaagagggaaatattaaacctttaagcttttttaacttaaagatttaaa

SEQ ID NO: 3399 - DNA, 9 bp, Methanobrevibacter ruminantium
tttttttaa

SEQ ID NO: 3400 - DNA, 3 bp, Methanobrevibacter ruminantium
aga

SEQ ID NO: 3401 - DNA, 24 bp, Methanobrevibacter ruminantium
agtatttttttttatatatgaaag

SEQ ID NO: 3402 - DNA, 5 bp, Methanobrevibacter ruminantium
agaaa

SEQ ID NO: 3403 - DNA, 88 bp, Methanobrevibacter ruminantium
ataattttttaagagataatgtccggaattgcaccgaaataaactgctttgcaaacagccacctttctagtcggtcacattaccatag

SEQ ID NO: 3404 - DNA, 74 bp, Methanobrevibacter ruminantium
cataagaaagataatgaagataataatggaataattcattgattatctgattcaacgtttttattttattttaa

SEQ ID NO: 3405 - DNA, 13 bp, Methanobrevibacter ruminantium
atgatttttgaaa

SEQ ID NO: 3406 - DNA, 56 bp, Methanobrevibacter ruminantium
aattgataaattttatagggcagaattatttatcactcaaattgttgtttttctaa

SEQ ID NO: 3407 - DNA, 7 bp, Methanobrevibacter ruminantium
agtttag

SEQ ID NO: 3408 - DNA, 2 bp, Methanobrevibacter ruminantium
ag

SEQ ID NO: 3409 - DNA, 16 bp, Methanobrevibacter ruminantium
ctatcaatttactaaa

SEQ ID NO: 3410 - DNA, 49 bp, Methanobrevibacter ruminantium
tgcacaaggtgacaaatattgcatattttattaagattaatatcttaag

SEQ ID NO: 3411 - DNA, 39 bp, Methanobrevibacter ruminantium
gatttaagcttaaatcactgcattaataatttaaaagag

SEQ ID NO: 3412 - DNA, 225 bp, Methanobrevibacter ruminantium
ataagattaatttaattaatcttcatatagttgagaagctttttaaattatttcgacctgcttgtaatttaagctgtaacttatgaaattttccttaaaatttatttactttctatttcttttattaccgaaattggctaaaatttatttcattagtttaaattcattttaaggagttaaacttatatttttttttttaaatttatgaagaaatccatcttcata

SEQ ID NO: 3413 - DNA, 6 bp, Methanobrevibacter ruminantium
aattga

SEQ ID NO: 3414 - DNA, 78 bp, Methanobrevibacter ruminantium
ataattttaatatatttttgattctttctggattttttttaaaaaacacattcctgaatttgtcaagaagatgttaag

SEQ ID NO: 3415 - DNA, 174 bp, Methanobrevibacter ruminantium
agttaaaggaatatattctcatggagttgtaattatggttgagatctttattagtacataggaggaaaaacattaaatttgagatattaaagagaatatattcctaattgattaaatatagtttaaaactaattaatgggttcagtaaatttttttagtttaaacttatttaaa

SEQ ID NO: 3416 - DNA, 582 bp, Methanobrevibacter ruminantium
aaaaatctaattagtagtgataaattaagttaaaggctaattaagttataggtgtgtgttatgaatatttgtgaattaattgcattaactgaattttaaatgattttttagatgattgcgtctctaaaatcaatcgatttatcaaaatataaattaatggagttgactttgctaattttaatgattaaaatcattgattttagatttcaaaatcctgaaacttaaaaatcctttaacttaattgtaaaaatacgttttattagaactgttttaggaattatttttcccaaataaactataactgtgtggtgaatggttggtatatatggtttggtgttggtgtttgttttttgggtatagaattttcttttatgatcccaacacaaacctgtctaccacatcttcaccaatagggcaattatagctgcaggcactatcttgtgactgtctgctgctataatctccttcaatagaagatttgggattaataaaattattattactatgaattttcattttatcacgttttctttgttttttcgttgttttgttttttccatgaagataatttttatcttccag

SEQ ID NO: 3417 - DNA, 611 bp, Methanobrevibacter ruminantium
atttacttttgataatttttctcatcatcaattaaacttttgttttgtgtatatataagttgaataaagtttttgctttacttgggcctttccttttgataagatctttttacaatcttttagaaattccttttcggatatttcctattctattgtctgttttggtttatatataaattgaataaagtttttgctttattgaaagttattatttgaaaataatttctttcaagaagatttttaaatcttcatagctgcgatgggatttgaacccatgatgagactaactccacgaatcctaagtccgctgccttagacctgacttggcactacacagctatttcatcttgatgaattttcatcatcaaataaacttttattttgtggatatataaatcgaataaaggaaattctttagtgaagaaaattagtttttaaatcaatcattgattgaataataaaatagtttgataggataaataagttaaaataagttaaaaagggttataaataagttaaaaaaggttataaataagttaaaaaaggttataaataagttaaaataagtaaaattaataagttaaaattagaactaataaaatataaataaa

SEQ ID NO: 3418 - DNA, 43 bp, Methanobrevibacter ruminantium
cctaaataaaaattttgatcaaactttttttaaaagtttgaag

SEQ ID NO: 3419 - DNA, 434 bp, Methanobrevibacter ruminantium
ttaaactctcctatcctttcgttaatagaataaatattaatttttgctttatagtttatagttaagcatattatatttctaaattattttaaggcctttttaaatcacgattataacgtttaggccttgatttggatttaaattattataaaaaataaataaaattataataaaaaaatatatttagaatatacattcttatttttgaattttagattaaatatattttatcaattttataatctttgatgataaaaatttcaacatttgattttgttttataaaaatttataaataattaaattaaattattattattaatttaactaaagaaaattattttatatagaaaatattattaaactaaaatttattttctaattgaataatcattattaaactaaaaacttataatatttttaaaggggatgaat

SEQ ID NO: 3420 - DNA, 59 bp, Methanobrevibacter ruminantium
tgctttaattaatttaaacactatttttacttttttactttttttactctttttttctt

SEQ ID NO: 3421 - DNA, 239 bp, Methanobrevibacter ruminantium
ttttttttcttagttttactatttttatatttttcattaaaattttattttgattaaacatttttgatatttcaccaaaaatttctaattttaattccaaatttttccatattttacaaaattgtcgaaagatttatatatgatgtaatataattttaacatgtggaatatatttttaacaaatgtaatatatttttacattttccatattttttatccaaattgtttaaagtgatcat

SEQ ID NO: 3422 - DNA, 118 bp, Methanobrevibacter ruminantium
ggggatgattttgttgatattagacatatataaagattctttagaatattcggctaaggatttaaaaactttattgattattggagtatgttatttcttaagtttccttttccttcca

SEQ ID NO: 3423 - DNA, 28 bp, Methanobrevibacter ruminantium
atctaattttagttattttggtgagttt

SEQ ID NO: 3424 - DNA, 231 bp, Methanobrevibacter ruminantium
tcttattggttttagcttagaattagtttagaattaatatttttggtttggaattagtttattagtttaattgcttagaattagtttagaactactatatttggtttggaattgtttattagtttaattgcttagaattagtttagaactttcaattttggtttggaattagtttattagtttaattgcttagaattagtttaaaaattataatatgtaaatggtgataaa

SEQ ID NO: 3425 - DNA, 42 bp, Methanobrevibacter ruminantium
gaatataattattatttggatgaatgggggtgatgattcttt

SEQ ID NO: 3426 - DNA, 20 bp, Methanobrevibacter ruminantium
tttttttatccatagttttt

SEQ ID NO: 3427 - DNA, 15 bp, Methanobrevibacter ruminantium
aatttcacatataaa

SEQ ID NO: 3428 - DNA, 366 bp, Methanobrevibacter ruminantium
gatttcaatccttaaaattttaattgctttgatttttgagatgattttagaagtttttgaaatgattttagatagttttagaaattattataggtagttttagaaatgaattgttttaaaaagataaatttttcaaaaaaaagggcagtataataaatttatatatcattttatattaattaatatatagactattttattaaagttggatgaaaataaatttaaatttaagttttagaaataagatgaatttagaggtgttaagtgattaatatgattaatttaacagattatttagataaactatccataattaaggttctatccttctttttattagttattttggtcttaactctaattcca

SEQ ID NO: 3429 - DNA, 167 bp, Methanobrevibacter ruminantium
ccttcagagctagtatgggagtgctaaatcttttaaagaatagtttctagggctttcttcattatgctattttattatcttaaactatttttcaaatccctatttatttttaatatttcaagaattaatcataaagtatatataaaatattagtataatctatgttt

SEQ ID NO: 3430 - DNA, 83 bp, Methanobrevibacter ruminantium
ggattaaataaaagatatttgaattaaagaaaaaaggatcctttgcgataggaatcattttttcaatattttttctttttaaa

SEQ ID NO: 3431 - DNA, 38 bp, Methanobrevibacter ruminantium
tattatctaaagaattaaattatttttattgtgatatt

SEQ ID NO: 3432 - DNA, 612 bp, Methanobrevibacter ruminantium
acaatctgtttatatacctactttttttattctttttatcttattcttactatactttttttattttattttttactaattaatagtctattttaggtatcttaatcacttattagtctattttaggtcttttaactatttattagtctatttaggttttttaatcacttattgtctattttaggtcttttaactattaaccttaacattttaagttttatttattgaacttctattattttatatttatttgcgcatattgttcaattaaaaaatcttaaaattgttctggcctaagaaattattagttttcaaatgctctggtaatcttttttaaatagaaattttataatataatatgcattttcaaaaggtttttaagagatgaatttcattaaaaatagtatgcttttaattgaaaaatttcatctatgaaaaatattataagatttcaattccaatataatattagatgaaataataaaaaattaatatttttttattaagattaaattttaaaaaactgcttgaaataagaatattcagcatataaatgactttatatttatcaataatttatgtatacacgtttattttacaaaagggattata

SEQ ID NO: 3433 - DNA, 616 bp, Methanobrevibacter ruminantium
atgttaggtattctttattagatcttttaatctttattagttcttttaatctttattgatcttttaatctttattagatcttttaatctcctttaacgaggtttttagatttatttttttattaaatcttttaatctcatttaacgaggtttttagatttatttttcagtaatttttttacaagttatttaactgaactagtgaaaactatcaaagatataaatttgttcgtaacaagtcgaatgatttatatacatcttatgataaatattatttcgtgaagtaactaacattatgtttgtatacaaacagttaatgtgtttactaactttcgtatgatatcgaacagatattatacatctaattacataattatatttacttaaattaataataagctcaattttatatattatttatattttaagtatcatttttataattataaaagcaatttaattctttagattgcatttaatcttataaaaaaagcaattggtgctggttatttatttattggtcagattgcatttaattttataaaaaaagcaattaatgctggtcatttcttgattggttaaattgcttatatgtttcgatttaaatcttatagata

SEQ ID NO: 3434 - DNA, 110 bp, Methanobrevibacter ruminantium
gttcaatctacttaatttttaatttttattaagaattaattttaagcatttatattttattttaattttattttaattttattttaattttattttaatactattttata

SEQ ID NO: 3435 - DNA, 14 bp, Methanobrevibacter ruminantium
tattttccacttaa

SEQ ID NO: 3436 - DNA, 291 bp, Methanobrevibacter ruminantium
tttaaacctttatggtttttttattttcttattttttttgatttatctcttattagttctggattgtttttattactatttttcattactcttagaatgttttttattatttttcattactttttgaatgttttttttattatttttcattactttttgaatgtttttttattatttttcattatttctggattgtttttattattatttttcattatttctagatgtttttattatcatttatataataaattttataagatctttttcacttaaggtcttaattaatga

SEQ ID NO: 3437 - DNA, 4 bp, Methanobrevibacter ruminantium
aaca

SEQ ID NO: 3438 - DNA, 321 bp, Methanobrevibacter ruminantium
ttgaccaaaatttttttatggctggggagtaccttgctcctacagttttacttctttttattcctattttattttttaactattctttttattcttattttcttatataactgtttttttattcctatttttgtttaattgttattttttccttatttctctttttaatttataagctattttatagaagttatttttgttcgttattatgggaactatttatacgtttaaaaagagttttattagttggataaaagttttaatggtttattggtgtaaaaaaaacttttatggagtttggtgtgtaaaaaaaagaaaaaa

SEQ ID NO: 3439 - DNA, 9 bp, Methanobrevibacter ruminantium
tttaaagaa

SEQ ID NO: 3440 - DNA, 387 bp, Methanobrevibacter ruminantium
ctcgtttacatttctaattatccaatttattcaaaagccttatcagataattaggagtttttccaatctttttactacttatttaaccatctaattaatattcattagcctttcatcgataatttcattattccttcaataattaaggtaattatattgggttttgaaaattgaaaaaattttaacaaaaattaatttttccagacagctaaactatttataaattagaatttctaataatctatagataaatataagtcagttaccatttataaattttaatatttttttataaacaattattaatttaaataattatttttatttgttttgtaatgagttttggtatggttttttttagttgtttggggatttgtttgttttgta

SEQ ID NO: 3441 - DNA, 43 bp, Methanobrevibacter ruminantium
atcataatttaatggattttgaaaaaatagattaaaaaaaaaa

SEQ ID NO: 3442 - DNA, 536 bp, Methanobrevibacter ruminantium
ttcgctagcattaatggtgcctattaagctaaatgctattaaaatacttattaatataattaaaaattgatatatttgatttttagtcttaatagtttgacctcctatatggaatgtttttatattcgaaatttatacaataactctttttattatttttactatatatgttttatttatattcttatgagttaaaacaaatgtttttagttatgatttgtttaattaagttaatttgattaatttttttatagttttaggacgattttttgatgatatcttattgcatatggttttatgaggtggcttattttttatagctttattttttgcatatggtttttatcatatagcttattttttatagtttttataaatttttagagatcttttattaattgaacatttttcaattgtttttccaaatattagttttcaaatgctagcacaagtttaaattattatattgtatatatagaatattgaaattagattggaataattttttaaaaattttttcatatgagaatcctaat

SEQ ID NO: 3443 - DNA, 69 bp, Methanobrevibacter ruminantium
atcgattgctgtttatttattttaaagattatttcaattaacagttaaaaactagaaaggatgatttga

SEQ ID NO: 3444 - DNA, 59 bp, Methanobrevibacter ruminantium
gtataattgattgttattaattaatttgccctaaacttcttgatttttataataatgct

SEQ ID NO: 3445 - DNA, 13 bp, Methanobrevibacter ruminantium
tttcttttttttc

SEQ ID NO: 3446 - DNA, 206 bp, Methanobrevibacter ruminantium
tataaaatcaaggccgatagaattaaattaatatttatttaactaaaatatattttagtttttcatataaagcattttttaagaaataaattaatattttagttttttttaaacatactcaattaaataacttataattaatttctattgattttataatcatttggctataattttataatttataatttttatggagagggaaa

SEQ ID NO: 3447 - DNA, 49 bp, Methanobrevibacter ruminantium
acaagctttttgagccttcggctcaaaaaccttgaccaaaatttttatt

SEQ ID NO: 3448 - DNA, 411 bp, Methanobrevibacter ruminantium
tttctttttttactacactttttctatttttgttaatatttaattttcattcttaattcttttattctatttctcatttaatagttaattctattttttctatttttgttaatcttaaattttattcttaattcttttattctatttctcatttaatagttaattctattttttctatttttgttaatcttaaattttattcttaattcttttattctatttctcatttaatagttaattctattttttcattctttttgattaattttaccaaaaattacttatgtttatatttttagatataaaattaataaattaatttcttatttttttattggaggtctttttctgtataattttaatgaaaacactaattctaatcctaatccccctgctaaacgcatattttat

SEQ ID NO: 3449 - DNA, 133 bp, Methanobrevibacter ruminantium
caattttttgctattttaactcaatgatgtatggatagcaagtcatttttgatgatttgctcatatatttcttattttatcaattatttatctattttttttatgctatctttttttaggctatcttttttca

SEQ ID NO: 3450 - DNA, 228 bp, Methanobrevibacter ruminantium
taaataattttatatattcaaaataatataatattattatcgaaatataattaatttttttaaaagttttttagaaaatttttgttttttcttattatttctttgaatttaaatttgttctaatatgaatttatttatattttgtgtttattataattttttaatcgattattgttaaagaattattttttcatttttaaggtataattaatttaggtagagattaaa

SEQ ID NO: 3451 - DNA, 451 bp, Methanobrevibacter ruminantium
ttgttcttcttatttctttcattttttctatttttatttatttaacttattttagtcttttttttatttatttaactttttttagtctttttttatttattttactttttttagtcttttttctatttttttctggtttatttggtcttttttttattttagtttattttagtcttttttctattttttatctggtttattttggtttttttatttgccttcttttataagtttcagtattcttattctatttattgcatcgatttgtcctattttattatctttttttagatattatatcaatatgaataagttttcttaatcgtaaaagctctaattggccctttttattaatttatttcttattcttcgaattttagaaaattatttatattattgaaatgaaaaatatttcatgttatacatataatttaagaatttaggtaatatt

SEQ ID NO: 3452 - DNA, 177 bp, Methanobrevibacter ruminantium
ttattaacttaattgtttgagtttgatttaagttattagatctcaaactataagtttttaatttttattaattttttataattaataagtatcattctaaatgtttcgataggagtttatttgctttcttatcgattctttttttattatgtcgaattattttaaggatttgtatat

SEQ ID NO: 3453 - DNA, 69 bp, Methanobrevibacter ruminantium
tatggagagtggatttatttgcttaagaattggctattctgagtggaattaattttttggagagtttct

SEQ ID NO: 3454 - DNA, 89 bp, Methanobrevibacter ruminantium
tttgcggttgcttatgactgattattctaagaagtactctaaggattgatttggggttgcttatgactgattattctaagaagtactct

SEQ ID NO: 3455 - DNA, 472 bp, Methanobrevibacter ruminantium
tttatttcttttttttataattctattttttcttaatttttctaattctcttttttcagtatctgttattttatcatattttaaatttttttaatttttggcttttttatttattttctctatgtttatatgtagatagcatttcttatttttttataatttttatataattttcattattttaaatattcgattaattaaattgactaaataatatttgatttataaatttagtatggctatttttattttaattgcatctaaaatgaatcataaaatttatatgtattttccgacaatatttttttagaattgatggtgattgataaggcattcttttagaatatctttacaaagttttaaaatttagtcatcaaaaaatagtttaaaaagaaaaaggagtaaaatagattaaataaaaaaagaaagtaatatgtttcaaataaagaaaaataaagaaaaaaataaaaaa

SEQ ID NO: 3456 - DNA, 468 bp, Methanobrevibacter ruminantium
atttctcactttctaattatatcagatttaatatttaatatttatttttttttaaattatacaattattaaatacttaatgattatctttgcagtttgataaaaatcttaatttttgtatatattaactattgttatatttatttctcatattatataaactaatattcatatctttatatttttatttattaatctttttctataatataattaattatttttacttatttaagttaattctaatattatttttctgaaataatgtcttatttagcttaaatttgtaaaatttctttcttattggctataaaaaaaatgtatttttaattgattgtaataattaattattctgggtctgacctcaatataaccctaattttactgtctatttttgtacatttgtcttaaaagttacgaattaaaaaaacatttcttttcaaatgctcttagataatagagatttcat

SEQ ID NO: 3457 - DNA, 12 bp, Methanobrevibacter ruminantium
attttcgatttt

SEQ ID NO: 3458 - DNA, 335 bp, Methanobrevibacter ruminantium
tttttttactttttttaataaaaaccacaagcatatctacatacatcaattccttttcactgattccaacactacttttaattaaattaaatatcactgtcataattatggctactgttcatataacttatattttgataaaatatgtaattaattaaatttgcttcaacttgttttcctgaaactgtgccgaaaaacttataagtgaaactgcaatttttaacaatatgacatcaatattataatcatctcgtaatcacaaacacggaaattcattaagtttatatatgtgagtcaaaagaccgaaaattaggaaacacttatggaggttgaaa

SEQ ID NO: 3459 - DNA, 20 bp, Methanobrevibacter ruminantium
tttttattttatggaaagtg

SEQ ID NO: 3460 - DNA, 103 bp, Methanobrevibacter ruminantium
ctgaattttatatgtagcacttaaccaatattatatcatctcttggtgagaaatttttaaaaaagacagtcgaaattcttttttttatgaaggggaaatttca

SEQ ID NO: 3461 - DNA, 28 bp, Methanobrevibacter ruminantium
aattcctttttcctcctctttcatatat

SEQ ID NO: 3462 - DNA, 259 bp, Methanobrevibacter ruminantium
tttatcaccaaaatttgaataatgttatatttaaatatgttaaactatttttttaaactttactttttaaatgaaatttttacacttgaaatgcaactacccctcgggtcgggtcgggtcacgttgactgcttatatacaacctaaaacatagaataaagtagttattgttagtgaaataatttgtaaaaaatagcggttttttatgaaatttattttaagaaaatcagtcaaaatcagtactagcttcgcagagtaaa

SEQ ID NO: 3463 - DNA, 162 bp, Methanobrevibacter ruminantium
aaatctcataaagagattatttttagaaaataagaacaatttaatctctattttttatttaaaaagttttaaataccaagaataacatataactaaataaggaagattattttaagttggcgcttgataattttccttaaactaaaatttggacgtgtaatc

SEQ ID NO: 3464 - DNA, 9 bp, Methanobrevibacter ruminantium
gtgttggat

SEQ ID NO: 3465 - DNA, 58 bp, Methanobrevibacter ruminantium
caaaatttgaattttatttatcgaacaaagattttaccatattaaaagaggtgaaata

SEQ ID NO: 3466 - DNA, 97 bp, Methanobrevibacter ruminantium
aaaaaggtttatgagacccgaataagtattaatacgtattataagtataaatacgtattccataattatttgttttttcaaaaaacctttatggaag

SEQ ID NO: 3467 - DNA, 37 bp, Methanobrevibacter ruminantium
tttattttttttaaaattttttatttattatattata

SEQ ID NO: 3468 - DNA, 30 bp, Methanobrevibacter ruminantium
tttttttttatttatttatttatttaattg

SEQ ID NO: 3469 - DNA, 98 bp, Methanobrevibacter ruminantium
atacacaccacaaaatcaccatggagctattttttatgtttttattcgttttgatcaccagctccatgaatcattttcacacataaggagcattgctt

SEQ ID NO: 3470 - DNA, 198 bp, Methanobrevibacter ruminantium
ggttcaagtgtccgtactgcggaaaggtgaaggaagtcagtgcctttaaaatcttatttaaatggattttgcaccatgagcttagggtttggtgcgaaaagtgcttctacagcacccattggcacttgaagctatggaggagaaactatatccggaaggaagtcaagcaagccagactcgaaaagaagcaatgataat

SEQ ID NO: 3471 - DNA, 485 bp, Methanobrevibacter ruminantium
tcaccttcttaaattataattaattttatctttaattgttataaataaaatacatttctaattttccactatgtttgttgaagaggaacgaaggaaagactggaaagcaattctcccaaacaaacatagcggaaaatgattccattttttgctatttttacaaattgttttacatcattttttctggttttttcgtttaggttgtttcttttttccggatttcaaaggtaaaatcaaatccatcatctcgttcggttatggttatggaacgttttctttgccaatttaggagattgctttgcatattccttccttctcttcaagggttcgtgtttgtctggggacacggcagttttcatcacccctttttcctgccgtgcccttggaaaactctgtttgtttaatatatttcctagtttgaaaaaatgtagaaggtacatgacgtatcttctactttttttttagaagattttcgagaagtgatt

SEQ ID NO: 3472 - DNA, 2 bp, Methanobrevibacter ruminantium
ga

SEQ ID NO: 3473 - DNA, 85 bp, Methanobrevibacter ruminantium
gaaggttgactgggacaggttcaccaagcagtacgccgacttcatacaggacacggacaacgagaaggtccatggatacttcgag

SEQ ID NO: 3474 - DNA, 3 bp, Methanobrevibacter ruminantium
gtg

SEQ ID NO: 3475 - DNA, 10 bp, Methanobrevibacter ruminantium
agtatgatgt

SEQ ID NO: 3476 - DNA, 2 bp, Methanobrevibacter ruminantium
ta

SEQ ID NO: 3477 - DNA, 111 bp, Methanobrevibacter ruminantium
acaatcacgctctttaccaattaatctttaatctatttttagtttgctataaatcttgccctatttttccaccatgaatattgaatatactttttttaggaggaataatta

SEQ ID NO: 3478 - DNA, 67 bp, Methanobrevibacter ruminantium
aaatggatttatatcctatgaaaaacaaaaacatgattaattgctttaagatattggaggtgccgat

SEQ ID NO: 3479 - DNA, 701 bp, Methanobrevibacter ruminantium
tctcacaattcctttcccttttctattttttttaaaatattctctttttttacaacatttttccctgcttttttttcaaatttcaaaaccatttaaaaattcagcctttttttccaaaattcctcactttttcatgatttcatgctttttttccaccatgtctagtgaaaataaggaattttaaaaaccgttcaaaaaccccttcagagaccaatgagaagcccttgattcctcttcaatcggttgaattgtcgagagctgagtaatactttttaattacggtttcccaaaaaagtattactgtttttcacattctccgtcggttaaatccgttgttctttattcagacttgggctatatcaggttttttcatatagcttaatgatccaaccatctttccataccaagaccactgacgaaccggtcagattgtattattttgaccaccaaaaataatacttttttcaccaaaaaagaccggaatctcattggttagaacagaattgagttaccttacaagtgtaaaactgagcgtggttgctccaaccttcctcaaacctgtatatttgaatttattctcttaacagagcgttaatctttcttattttctccaaaacatttatatctaaacgaataatatagtttttattgtgtttccgtccgtttaggagagaaagaaggaagcacagagaggcgatttc

SEQ ID NO: 3480 - DNA, 31 bp, Methanobrevibacter ruminantium
tctcctttctcgttacttttgaggtgagaat

SEQ ID NO: 3481 - DNA, 27 bp, Methanobrevibacter ruminantium
acgagattttaaaggagacgtgataga

SEQ ID NO: 3482 - DNA, 12 bp, Methanobrevibacter ruminantium
aacggtgatgat

SEQ ID NO: 3483 - DNA, 11 bp, Methanobrevibacter ruminantium
aaggtgagaat

SEQ ID NO: 3484 - DNA, 16 bp, Methanobrevibacter ruminantium
agaggaagtgttgaga

SEQ ID NO: 3485 - DNA, 10 bp, Methanobrevibacter ruminantium
gagagatttg

SEQ ID NO: 3486 - DNA, 43 bp, Methanobrevibacter ruminantium
ctatctccattttcattccggtgagatattaggagagatttag

SEQ ID NO: 3487 - DNA, 54 bp, Methanobrevibacter ruminantium
cagtctctaccattttatcttattgttttggtgagagaacaggagagattgatt

SEQ ID NO: 3488 - DNA, 9 bp, Methanobrevibacter ruminantium
ccgtgagag

SEQ ID NO: 3489 - DNA, 625 bp, Methanobrevibacter ruminantium
atcactatctatgtatttgggtataaatcggaaattcgtaaggtcgacatgagatataagacacctgttgtgagattcaacaggttataatcataaccatatgaatctcatggcattcctttaaggattcacccacgaaatcagggttccgtctcgtgtgagaacacaggtttatgaagaatattgagatgccattcattcagggagtcaaggggtgagatagtggactctctgaaaaagtcatgtctcgtgtgacgtttgaaataaaaattaacggaaatggtctaaattggtaaattatcggtagtaaatgggtaatttagaccaaaggagttaaaaaaccttcagaagacctgtgctcaatggagcgattgggtatctgaaaaaggagttggtaagaaaaggtcatagatgggtggaacgacggtcgatgaggaatcgtgtcatagggtactgcaaccgtagactgctccatgaaaaatttctgaaattttgacggtgaaaattgggtaggtggcattacaagtgaaaaagtctgtgcagtcgctttcattgaacgatggcaaaaatcactcaccgactctctgaatgtgattttacacttgtaatggtggtatttcaaaaa

SEQ ID NO: 3490 - DNA, 323 bp, Methanobrevibacter ruminantium
ttttttcccaaaaaagaaccaaaaataccaataaaataaggtaaagaagggttctgcattaagctatctgaaggaaaccgttcagagaaaagtgagatttcgttctctcctgttctcgctggtgatctgttgtcgagagaaaaacggttgtccttttgtttagggtgtaatcaaggcaccatagagcgttgaaaaaattttcagtttttgagattttgaactgaaatttttcccaaatcactcagtaggaactcagtaagcactcagtagttagagtgaatttttaaaaaatttgatttctcaaaacttcaagtaataaatta

SEQ ID NO: 3491 - DNA, 216 bp, Methanobrevibacter ruminantium
aacttctccttctttgttttttcacttaattgaaattttaacaaaatttctataataaataagatggagttcagtagttagagaaaaataaaaaaattttagttttcttaaatttactattacagaactaaattaaatgcaaaaatttaatccatcttggtttccttttggcaattgttgcattttttgccatgacttcgcagtttaattaataaa

SEQ ID NO: 3492 - DNA, 223 bp, Methanobrevibacter ruminantium
tattaaccctctacatacaaaacaattaaaaagtaaatcgctatgttacgcttcggtttaaagaagttattaaacacttaacattaatccttatttttcttatttaaatgatttattgtaaacattataaaagttttgttaaatattttttcattttttctaattttccactatgttggttgaaggctataagcctgttcaccgaatttagctattttttgga

SEQ ID NO: 3493 - DNA, 40 bp, Methanobrevibacter ruminantium
tcatacatcaacagttttattttaggaaagaagtgtaact

SEQ ID NO: 3494 - DNA, 16 bp, Methanobrevibacter ruminantium
ttgaggagatggcaat

SEQ ID NO: 3495 - DNA, 11 bp, Methanobrevibacter ruminantium
ggagaattttt

SEQ ID NO: 3496 - DNA, 5 bp, Methanobrevibacter ruminantium
gtatt

SEQ ID NO: 3497 - DNA, 180 bp, Methanobrevibacter ruminantium
atcaaaggaaggtaggcagattctatggttggattactgtggctaccatttaacaaggtgtcaaagtgatttgaccatacttcaaacattattccttgcaaaaggaagacttgaactatatcaggaaatgaataaagtggaagaaagtaaattttagctatttttcaggagtgaaggaga

SEQ ID NO: 3498 - DNA, 2 bp, Methanobrevibacter ruminantium
tt

SEQ ID NO: 3499 - DNA, 11 bp, Methanobrevibacter ruminantium
gagttgaatat

SEQ ID NO: 3500 - DNA, 2 bp, Methanobrevibacter ruminantium
at

SEQ ID NO: 3501 - DNA, 377 bp, Methanobrevibacter ruminantium
gttactttgcacatgctctgtaacaacctttttatgttgtcgagtgcaactatattatacaggacatggctttttcctttgatattgtgaagggagtaaccatatatacaagccatgttcgatttgagattatccttagtggtttggtacatgaaggatgtaaaggataatctctccctactctcattcttattttttttcaaacatttttttacttttcaaacgctcttaggtatcctctttatatgctgaagtccaatgtattatcaggaggcatgaaagttttttttctcactacttcttgctttttttacttctgggtgtactatttttccttttgtgcctctgaagagattatccttaggaagttggttttg

SEQ ID NO: 3502 - DNA, 247 bp, Methanobrevibacter ruminantium
ttttttgggatagcaaggataatctctacccactctccactccacaaaaagtttttataccttgaaactaaatttattattacagggctaatcctttactaaacctttactcaattacatatcaccccctttacatatgtttttttataaggaggattagtccttttttttaaacttttttttagaaatttttattattaataacatttcatattataatatagttaatataatattgagggtttag

SEQ ID NO: 3503 - DNA, 2 bp, Methanobrevibacter ruminantium
aa

SEQ ID NO: 3504 - DNA, 41 bp, Methanobrevibacter ruminantium
tttgattgaataaagtattatagtttttttgagggttagat

SEQ ID NO: 3505 - DNA, 1008 bp, Methanobrevibacter ruminantium
gaacatttctttacacaagaaagatggtttgaaaataattcaataattaatattttttcagatgattttacttttgatttattaaagaaaattgatggaaataatgaaagattaattgattattgtgattttagtttaggtttaactccttatgataaatataaaggtatgagtgaggatattattaaaaatagaaaattccattcaaaaataaaacttgacgatacttttaaagaattattggatgggtccgatattacaagatataatgtaaaatggggcgaaaaagaatatattaaatatggggactggttaggagcacctcgggaagaaaaattctttaaaaatcctagaattttaataagacagattttatctatagctcctaaggaatctcgaaaaaggatttttgccgcttacacagaagaagaattatataacgctcaaattgcttttaatttagtattgaaagaaggctttgatgataaaaatttattgaaatattttttaggaataattaattctaaaatgatgacttggtattatgaagaaagatttatggataaaaataaaaagaattttgcaaaaattttgattgaaaatgctaaaaatcttccagtcattattaattcaaattttttagatgagatagtatctaatgtggattcaataatagagttaaataaagagttttatagtgtaagaaatgcatttcaaacatggcttaaaatagaatttgaaattgaaaaactctctaagaaactagaaaactattatgatttaaactttgaagaattcttaaaagagataaaaaagaaaaaagtagtcattagaccaaatcaaatacaggacttgtccgaattatttaatgaaagtttaggaaaaatagaatatctgcaaagagagattaaagaagcagacgaaaaaattaacctactggtctatgaattatatggtttaaatcatgaagaaatagaaattatagaaaatagctttaatgattaattt

SEQ ID NO: 3506 - DNA, 213 bp, Methanobrevibacter ruminantium
aaaatcaaccttttttcaacaaaactctttttatttatggatacatgtacatgccttcacggttttacagcactttcacatttttcaaaaaacataattttaaatattagttcgcatatattaaaattatatattatattattttgacaattgcaaaaattttaaatttttgttatattggggtcagaataaggataataattaattatattg

SEQ ID NO: 3507 - DNA, 137 bp, Methanobrevibacter ruminantium
ttttttcttatgaaaaataaggattggcaattgcctttaaaaaaatagtgggttttttttttttaaaaagtatcctttaaaataataagaaatatcttctaaactaataaatggaataattaggaagaataaaaaaa

SEQ ID NO: 3508 - DNA, 11 bp, Methanobrevibacter ruminantium
aaaattagaac

SEQ ID NO: 3509 - DNA, 271 bp, Methanobrevibacter ruminantium
attttttctccattaatattaaatcagattttttagatcttatttttaaaaatttaacttgtttttcttttaattaaaatgtaataaaattactttttaaataaaaactaatattaatattcaaattcttattatctttattttcaaaagataattgctaatttaattgattttatctaatgctaactagttaaacgatttaaataactttaagggaattagttaagctttaactaaaaattgtttaaattattaaacttaatcaaataac

SEQ ID NO: 3510 - DNA, 308 bp, Methanobrevibacter ruminantium
gaaatatattttagaaagatatttatatattgaataataaactacagttcatattaattatgttttaattcaagtttatatcctttttataattgttataaacttttataaatcgaatactttagggctaatttaaccatcaaatatcgatatttttctattgatttgtatcataaggtatatggttaagccaaaaaactataaatttggtttatattgaatttttatattcttggcaggagttttattattctaataaattttctgccaaattatgtattatattgttaaattaaaaaaaaggacaa

SEQ ID NO: 3511 - DNA, 315 bp, Methanobrevibacter ruminantium
taattgcttaaattagttattattcttttaaattttatttttttctttttttataaatttttacttactttttattatttttacttatttttattcatttttacttatttttatttacatttattcatttttacttatttttattcatttttacttactttttcttatttttacttagtttttcttcataatttggtttttttgcgatgattatccaaatatttatattcgagcatagaaattttatatattttcgatatgtttatataatcacattttaaatatattaatgattaaactaatatgtgattaact

SEQ ID NO: 3512 - DNA, 145 bp, Methanobrevibacter ruminantium
ttctttatttatctattaattgttaattcttttgttatttgttaattgctaattgttattattgttactttagttatattggcgaatttaattagaatttttaatatttatttatcaatttattataatttttataggtgtgaaa

SEQ ID NO: 3513 - DNA, 97 bp, Methanobrevibacter ruminantium
ttccttatattatattaattaatttggatgattggattaatttttatagcataaaatggtttattttaattatttgatacacatttaaggtgattaa

SEQ ID NO: 3514 - DNA, 399 bp, Methanobrevibacter ruminantium
cgtaaatttaaaacttttttcactatttttttattttagttcttttattatcttatttttatttttagttctttttttatcttattttatttttagttcttatttttatatggttcttttttaatattttgttatttgatttatattataaaataattataatataattgctaaaaaaagtattatttgggatatattggtgtgtttgaaaagagaaaaaaagtttttttttttaaaattgctaaaagtttaaaacattgctttaaaaagtttaaagtaagtttttttaaaaaaagtttaaagtaattttttaaaaaaagttaaaaaaaagttaaaaaaaagaatcaaagtaaataaaagaaccaataatcaaatcaattctctatttacttaacaatt

SEQ ID NO: 3515 - DNA, 15 bp, Methanobrevibacter ruminantium
aattttcctcctatt

SEQ ID NO: 3516 - DNA, 666 bp, Methanobrevibacter ruminantium
ttatgttttaacttggttttattttttaatttatcattattaatcatgataaatattagttctatttgttatttttataaaatctgcaaatgtttagtttaacctaattaatatatcgttttttatatagtgtttcatgtcgtttaatttttacttatttttagcttttaagttagtttaacaattatctaacaaatttttttttaatttttttcaattttataaaatattcttgcatatcttattttttttaaaaaaatctttcttttttgcgaaatgaataatcatatatattaatttattatcatttttatcatatttaagcgtttcattttctttattcctattatcctattggttttataatattcgatataattattatttcatatggtttaaaaagcatcttctaaaaaaataattttatcctttaaaatagatatttgttcattatttattggtatttaatcgttatgaactattttttcgttagaaaaattttacactcttcatatataagtcttttcttttgattttaatagcaaagtctttttatatgaatgataaataattataattaatgctctctttatgtgcacatattgaatatgtgttgagagtattgataattatatgggataattaaaataaagaagttgagatata

SEQ ID NO: 3517 - DNA, 57 bp, Methanobrevibacter ruminantium
atagtttataaatatttggctttaattagactaaaataaatatagactatataaaaa

SEQ ID NO: 3518 - DNA, 540 bp, Methanobrevibacter ruminantium
ttttttaaaaccaaaaattaaaaatataaataaaaaatattttttatttgtgcttttttaagtatgaataaatggcaatcgggatttagatctcgaatctttaatccttgattgcaaaatgcttattggagaatatttatcttgaaacctaataaatattctcatatcaataagtgatcttaacaattcaataattatatttataatatttataataaagtgaaatcaattggagttttttcagaatgtctaattgagttttatcagactgatcactttattatcaaatatcattacaatttcacaattcatgattataataaataattattataatattctattatatataagaaatcacaattaatttaaatcggattatttcagcgatttaaattatatcattatcatactattgcaattgatttttttgcaattttcatgattgttatttatatataaataataaataaaaaatattgtcaattatcttttattgaatttcattagacacaattcacaatactcgacacaattcac

SEQ ID NO: 3519 - DNA, 23 bp, Methanobrevibacter ruminantium
gtgaggaataaggagtagataat

SEQ ID NO: 3520 - DNA, 101 bp, Methanobrevibacter ruminantium
aagagggattattgattttatatttttaattaagagagatttatattgatttttataaatttagagagatataatttatataactagtttatggtgtaaaa

SEQ ID NO: 3521 - DNA, 12 bp, Methanobrevibacter ruminantium
atcaagatttaa

SEQ ID NO: 3522 - DNA, 102 bp, Methanobrevibacter ruminantium
ttattttatgatttaaattatttttaattttaattttaatttttttttttatttttatgaattaattttttatttttttaagttttattatggggtttatgg

SEQ ID NO: 3523 - DNA, 69 bp, Methanobrevibacter ruminantium
ttaatttcttaaaaaaaagcataatcctatttaattaattataattttcgctatttttcaattaaaaaa

SEQ ID NO: 3524 - DNA, 13 bp, Methanobrevibacter ruminantium
tttttaattacgg

SEQ ID NO: 3525 - DNA, 367 bp, Methanobrevibacter ruminantium
tttttcttcttcttttactattatttacactatttattggccttttcttaattccaaacaaatagtttttaatggccaatcctttttcaaaaaaaattattctttttctttaaaatacgtattcttattagttctctaaaagtttttcaaaaagtattttaaattttcggtaaaaataattgggaaaaaatctgattgaattttttaaaaaaaatagaaattaaatttttcggtagaattaattttggaaaaaatctgattgaatttttttaaagaaatagaaattaaatttttcggtagaattaattttggaaaaaatctgattgaatttttttaaagaaatagaaattaaatttttcggtagaat

SEQ ID NO: 3526 - DNA, 16 bp, Methanobrevibacter ruminantium
tttttttttttaaaat

SEQ ID NO: 3527 - DNA, 22 bp, Methanobrevibacter ruminantium
tctcctcgtcacctagaaataa

SEQ ID NO: 3528 - DNA, 90 bp, Methanobrevibacter ruminantium
tatttcctttaatattttttctatggttttcaattagataattttcccattttaatttaaaattttttcaagattctctttataatttta

SEQ ID NO: 3529 - DNA, 18 bp, Methanobrevibacter ruminantium
tgtacacatggtgaattt

SEQ ID NO: 3530 - DNA, 18 bp, Methanobrevibacter ruminantium
tttgattggtgattattt

SEQ ID NO: 3531 - DNA, 10 bp, Methanobrevibacter ruminantium
gagtgataac

SEQ ID NO: 3532 - DNA, 25 bp, Methanobrevibacter ruminantium
cgtaaatgggaggagttgattgatc

SEQ ID NO: 3533 - DNA, 10 bp, Methanobrevibacter ruminantium
ggtgattttt

SEQ ID NO: 3534 - DNA, 15 bp, Methanobrevibacter ruminantium
ggagagtgtttatta

SEQ ID NO: 3535 - DNA, 2 bp, Methanobrevibacter ruminantium
tt

SEQ ID NO: 3536 - DNA, 183 bp, Methanobrevibacter ruminantium
cttatagatctagaaaaagataattagaatcttgtatgatttaaggtttgtttaaattttaaagcagcataggttctaatttactcccaatctttttctatttttctattttttcttttttattctctttttttattttttttatttttttaataattatttttattattttaattatttcaa

SEQ ID NO: 3537 - DNA, 98 bp, Methanobrevibacter ruminantium
gatttgttaattaattaaattatcatttatatgaattaattatataattattatgtgtaattttaatttaaatgaacttatatgaaaatggtgtaaat

SEQ ID NO: 3538 - DNA, 210 bp, Methanobrevibacter ruminantium
ttttttattatttttttttttaacaattttttttataattcattaattagtttgattaagtacaaataattttatatattagaaacaatatactataattataaacctaatattaaaaatattttaaagcttgattttttaaagtcaagaatttaattaataataatagtagaactgtaatgaaaataattaaccttaggaggtctctag

SEQ ID NO: 3539 - DNA, 50 bp, Methanobrevibacter ruminantium
tcaaacttcaaacttttagaaaaagtttgatcaaaatctttatctccgga

SEQ ID NO: 3540 - DNA, 30 bp, Methanobrevibacter ruminantium
cagcttatttttaattcagataggattgga

SEQ ID NO: 3541 - DNA, 55 bp, Methanobrevibacter ruminantium
attccatcactcgcaagataaaaaaataaaaataaagttcaaaaaatagattata

SEQ ID NO: 3542 - DNA, 103 bp, Methanobrevibacter ruminantium
ataatctcctgctttctaaaggatttataaaaataagtttgattgaaaggttgtctttaataaagattaatcaatgttttttagttttttataaaaataaaaa

SEQ ID NO: 3543 - DNA, 98 bp, Methanobrevibacter ruminantium
taaatttaaaatacctaattagtaatttatgcctggaatatttcaagcggagttttatttactagtttacactaggaatatttcaagcagtgttttat

SEQ ID NO: 3544 - DNA, 15 bp, Methanobrevibacter ruminantium
taaatcattctccat

SEQ ID NO: 3545 - DNA, 9 bp, Methanobrevibacter ruminantium
ctaaaatta

SEQ ID NO: 3546 - DNA, 428 bp, Methanobrevibacter ruminantium
aaaaagacgtttttgattatcctatagttatgcaatggtcgataggcatgatctggtggcttctctttagtgtatagtgatatctgtggtatttttagtgttttgttttagttttttggggggttctgtagttttgtttttgggttttttttagtgttttgttttaggttttttggggggttctgtagttttgtttttgggttttttttagtgttttgttttaggtttttgaagactcaatagaaatatctattgtagatttcattgctttgttgattaaactctacattttcttactaaatataataatttttttgataacttatatattgcatattctttatattatattatataatttataataatattaatcataataatgtagacataataattttgtcttaataattcgaaggtttgatata

SEQ ID NO: 3547 - DNA, 168 bp, Methanobrevibacter ruminantium
atggtggattaatgtcaaatgaaattatttctcttaattttgaataaaaggtgaattcgtgtcaaatgaaattatttctcttaattttgaataaaaggtggatagtatgtcaaatgaaatataactcataaatttagggaattgttgttgccgtcactgcttatagct

SEQ ID NO: 3548 - DNA, 154 bp, Methanobrevibacter ruminantium
ttttagggcgttaaaaatcaggggttttttattatttggactccattggtcctttcccattcattaaatcgatatccaaattcataagaataagtttaggtatttttggtgctgtatgatttggtgctgtatgaaaaaaggggttttagaatgg

SEQ ID NO: 3549 - DNA, 241 bp, Methanobrevibacter ruminantium
atttccacattcctataaatttttttaaataattactataatttttttctaaataattcttatatgtttcattattaattatgtcttgaaatctcttattaatatatatcgtaaatccttatttaatattttatcatcatcatatataacaattgttatttttttatctcattcatggattctgaacaaatatttcatttaaaattaagtgggtttgcactggatttaaagacttatctca

SEQ ID NO: 3550 - DNA, 466 bp, Methanobrevibacter ruminantium
tgtgttacctgttgatttattaaaatatttaataattttttatttttaattttatagatattttaatattggtctttttacttaatatcattttttaataagatttttaatagattttttaggttttttataggtttttttataagataatagtgagcttaaaacttgtaaaatcatgtcttttgaattgacatttttttttaaataaagagggtccgccaaaaagctatttttttaaaaaagtttaaaattttcaattttttaagttatttattttagttatttttttaaaattcgatgttttttctattgttttcttttaattttggtgcttgcaccttgaaaaaattttttacttgttaattattctttaaatatgaaataaagcaataatattatagtaaactttatatactactttaaacataaataatatcaacaaagggttaatattttggtgttattt

SEQ ID NO: 3551 - DNA, 128 bp, Methanobrevibacter ruminantium
ctggtgttgtcaaaattttattttggcggacaccctaaaaaattaaagatttaataagtagttgaaatagattattatctataactatattttaaaaggtgcacttaatatcttatgaggtttgcaga

SEQ ID NO: 3552 - DNA, 38 bp, Methanobrevibacter ruminantium
ttgcatcaataccatttgattttataattgaactattt

SEQ ID NO: 3553 - DNA, 7 bp, Methanobrevibacter ruminantium
ttcataa

SEQ ID NO: 3554 - DNA, 175 bp, Methanobrevibacter ruminantium
ttttgcacctattgttaaatttaaaccttttcctttaaatatttttaaaaagtattactttaaagaggatatcacacggttacttattatttttgttacctttttgttacaaaaccttttaattgtagtttatttataatataatttaaaacacaaattatggaaagtgaattaa

SEQ ID NO: 3555 - DNA, 45 bp, Methanobrevibacter ruminantium
agatttgattaagatttaaatttcaatagggcgcatggtgcaata

SEQ ID NO: 3556 - DNA, 11 bp, Methanobrevibacter ruminantium
ttttgatttgt

SEQ ID NO: 3557 - DNA, 1015 bp, Methanobrevibacter ruminantium
gataattgaaaaattgatgagtatctcataacagttaagatttttatataggttaatggtttgtatgtccaatttttgtaaggcatttgacaagttatatttgtttgttaaatgtggaaacaaaattcactaaaaagtagtagataatttaaagtgtgttacgccaacagcaacatgaagctagtcaaaaggaacaaaaagttgcacaatcttgattctcctttgttgattggtgatgttaaagatgatgatgttgtaaaaaaggttagagaacattgtttcattgaaactcacgaaaaagttctaccacttatgcatatttttcaatcaactttatacaaatattttgaattaatattcatgaaaagaaaaagtagctattaattatatataatttaaaaaagtaaaatattattaattaacataattgaggtattttatgaaagggcatgcgaaagttgtcatacttatgttctctctacactactttttttagaaatcatgataattaaatattttcatctatactgggtgaaactgggatggtggaaatacaaatcctgaacatctactataatcactgacataacctgaaccaactaatgatgcaaaggtaactacttgagtattattggaaaagttgagggtaagatgctgaaattatttataaacaattgatgacaagcaattattgttacgccaactccaacatgaagctggtcaaaaggaaccaaaagttgcataatccagattcgcccttgctgattggggaagttaaagatggtgatgttgtaaaagaggttaatgaacccagctatattgattcacaaactaggttgctttgatttttagttttgcaatattggggtatgtttatattaagagaaaattacattttcaatagagacaatctctgctttacctgcattcaatactattgaactggcccacattatggaaggcgaggaagtttaatgtacaagattgtgtttaaagaaaaaagaagaagagaaaa

SEQ ID NO: 3558 - DNA, 26 bp, Methanobrevibacter ruminantium
tttaaaaccttccttgaattgtatta

SEQ ID NO: 3559 - DNA, 166 bp, Methanobrevibacter ruminantium
aattaatactctcctttgttgaaataactttaaagttattatatattatgatatatgagatcgtattaatatagttaatcgttatataaatgtagcaggtgcataatggtaacctttaacaacactatagaaacatttttaaattcactcctacaaagactattac

SEQ ID NO: 3560 - DNA, 350 bp, Methanobrevibacter ruminantium
ttacaataattggccacatttatacgggttataatgtgtcattgagaaagaatttgccaagcaatattgttttcactgttcacgaacaaatttcactatacgtatcggagaatttggttattattatgcccacgccaatatggaactggtcaaaaggaaccagaagtgacacaatcctaattctccgttgatacttgctgagattaaagagagggagttgtaaaagaggtaaatgacccagctatattgacagccaacaaacattgatttgatttcgccaataaaattattgttttgaaattataatattgttatcattcttaaatattgttttattttattttaatcgt

SEQ ID NO: 3561 - DNA, 119 bp, Methanobrevibacter ruminantium
atttataattttaaaactaaattattatcatgaaaaagtttttgagtgttgcattaaaattccaatggaaaacaatagtgtttattttcgcattaataatcattcagacattcgttcaa

SEQ ID NO: 3562 - DNA, 189 bp, Methanobrevibacter ruminantium
ttgaatttcaatcatcttgatgtctgatgtaagctcaattattcttgcaatttgaattgatgctttttttgaataattctttgaggtttcataatccgatttgccattgatgattggtgttgttgtaaaagaagtcaatgaactcagttatattgatttacaacaaaaattattttaaactaaattata

SEQ ID NO: 3563 - DNA, 228 bp, Methanobrevibacter ruminantium
acacttcctccttggtttaatttaaaaatttttataattggttttatatatgttaatgattattatatccaatttttgttagagcatttgataagtaatatttgtttaatatctattgctaaagtagtagataattccgctacttttcgcccttatctgttcgtatgttgtagaacaaatttcactaaaagtagtagataatttctatattgttacgccaacagcaac

SEQ ID NO: 3564 - DNA, 33 bp, Methanobrevibacter ruminantium
cttttagttttttttttaaaaaataattcataa

SEQ ID NO: 3565 - DNA, 175 bp, Methanobrevibacter ruminantium; identical to SEQ ID NO: 3554

SEQ ID NO: 3566 - DNA, 45 bp, Methanobrevibacter ruminantium; identical to SEQ ID NO: 3555

SEQ ID NO: 3567 - DNA, 11 bp, Methanobrevibacter ruminantium
ttttgatttgt

SEQ ID NO: 3568 - DNA, 174 bp, Methanobrevibacter ruminantium
gataattgaaaaattgatgagtatctcataacagttaagatttttatataggttaatggtttgtatgtccaatttttgtaaggcatttgacaagttatatttgtttgttaaatgtggaaacaaaattcactaaaaagtagtagataatttaaagtgtgttacgccaacagcaac

SEQ ID NO: 3569 - DNA, 56 bp, Methanobrevibacter ruminantium
caaaccccttaaaaaaaataaaagattaaaatatatgtattgatatatgtattaat

SEQ ID NO: 3570 - DNA, 151 bp, Methanobrevibacter ruminantium
gatatggattaattgtgcccatatcttttctattcttgtttttaactacttatttttttttagatatggttggtggtgaccatatcttattgttttttctattattttttaacatttaaattacagttatttatagtttttttagtgttag

SEQ ID NO: 3571 - DNA, 427 bp, Methanobrevibacter ruminantium
ataatcagcgccaagtattaattttaaaattttagaacaaagtaggtttgtaaattaaacattatatatttaaagtttgtactttatagtatatattctaatgaaaattaattatttattcttttgtattgttcattgttattttttttaatcttttttatctattttctaatctttttttatcttatctttttaaatcgttaatcttttttatctattttctaatctttttttatcttatctttttaaatcgttaatcttttttatctattttctaatctttttttatcttatctttttaaatccttaatcttttaaattcttatttttaattcttattttttttaaacaaattttaaatattactttttaaaaaaaatattaatgtctcattagagagttttaaaattatattatgggtgttaat

SEQ ID NO: 3572 - DNA, 277 bp, Methanobrevibacter ruminantium
ttcttttttctttttttttaaatctgtttttagtttattattttaaattaggtcttatctttttttttatcagtgtgttcacaataacttaattttttagggattaaacttcatttatacctttaaatctttaaaatgatgtttctatggtttagatatgtaaatctttaattattggttgaaaaactttaaaaagaagtaatgatttttttattggttaaaataaatttaaaaatttagttcatgtggtatagttgaaaaatttaaaaaaaagtta

SEQ ID NO: 3573 - DNA, 270 bp, Methanobrevibacter ruminantium
gtttttcctcctaaatttttattactcacttaagtgagaaatttaaaagcatttatgcttttaatattaattatgtaggtattaatatttaattattgacttagttatcatagtattttaagaatttgcttttataacacaaaataagcaaaaatagaaattatttattttaaaatttttatgaaaaaatagatttatttgtttaaaaaattcataagaaaaaatagaaattttgtttaaaaatcaagaaaaaattaaaattaaaaaaaa

SEQ ID NO: 3574 - DNA, 473 bp, Methanobrevibacter ruminantium
attttttaatcctccaataattatcacatttaaccgtatggtctaatataaaaatcataattagtttatgttttttatagggacattatgtcatatgtaattctctttttgtttaattaaatagttttggatattttttaaggagttgccttattttttgattttttggagtttaacttcaatattttggttgaaaacaacttactttggaaaatgaagcccttattgtatatatttatttattaaccatattattttcatattagtcttgtaaaattagtttattgttttgtcttaagtttgttatggatggttaattattatattagtcttgtaaaattagtttattatgtattaaatttgttaagaatgactaattattatattaatactgtaaaattagttaattatgtataaaatttgataaaattagttaaaaaaagagttatgatgtaaagattcctgggattgga

SEQ ID NO: 3575 - DNA, 260 bp, Methanobrevibacter ruminantium
atcagacagtaataaaatttatattgtttatagtttatatacttttggttttattcgatttttttcaataattttttatagaacttttatcataattatataatgatataataataagttgaaaaatatttggaatttcatagtttgtggagtttcattgaaaagaatatttggaatttcatagtttgtggagtttcattgaaaaatattttaagattcacttttattattaattttttaaaaaaacagaggttatattt

SEQ ID NO: 3576 - DNA, 15 bp, Methanobrevibacter ruminantium
tttcaccttcaatct

SEQ ID NO: 3577 - DNA, 84 bp, Methanobrevibacter ruminantium
ttaattttttctatttatttttattttttatttattttcatttttataatctatttgattttaataatttaattaactgatatc

SEQ ID NO: 3578 - DNA, 147 bp, Methanobrevibacter ruminantium
ggtattttctattcttatgttttaattcccacttgttggggcttttttcttattttttatggtttttattttccacgtattttgagtatttatttttttatttatttatttattttttaaaaatagttgagattgggtttaaattaa

SEQ ID NO: 3579 - DNA, 92 bp, Methanobrevibacter ruminantium
atcatccaccttaatttttcattttgaaagtttaactatttttttcttataagatacttatattcttattttactaaataattttttggcaa

SEQ ID NO: 3580 - DNA, 101 bp, Methanobrevibacter ruminantium
ttttataacttcctaaattatgataatattgtccaaaatcttattttttttaaatagtaattttaagcattattataattaaatattgattttaaacataa

SEQ ID NO: 3581 - DNA, 214 bp, Methanobrevibacter ruminantium
gtttaatctccttttcaaattaaatatcttaagaaatctttaattaatttattaaattttaataattagttttatcactaatttttatttactatttttagtttaatttttaagattataaatttatttatttaaatcttttattttaaattaaattggctaaaatcaagacttatatattaactaagttaagtattaatttaaaaaaaataaa

SEQ ID NO: 3582 - DNA, 56 bp, Methanobrevibacter ruminantium
taaaaacgatttaatcccaaattgggataatatatataatctgctatcttgattaa

SEQ ID NO: 3583 - DNA, 182 bp, Methanobrevibacter ruminantium
tttcacatctctttatgtctttaattagttaattgaataattttttctatattttaatagattattttaatataataagttttctatttgaacttatgaattgctaattttaattatctctttaggactatttgaatttttgaatttgtaattttaattatctcttagaactttaaaccttt

SEQ ID NO: 3584 - DNA, 183 bp, Methanobrevibacter ruminantium
cttatcactttaaatgttaattatatttatcattcactttaaaacttaatcctagttcatctttcattcaaatattccttttaaattttttatttttcattttacaactatagtcttaatatatatacttttccccttattctttaataaatcattctaaagattttttattcgtaattatta

SEQ ID NO: 3585 - DNA, 34 bp, Methanobrevibacter ruminantium
ttactttttttaaatttgatttggaggtattaag

SEQ ID NO: 3586 - DNA, 13 bp, Methanobrevibacter ruminantium
tttggtgatatat

SEQ ID NO: 3587 - DNA, 105 bp, Methanobrevibacter ruminantium
tgataagtttaaaaacggtaaaaaattatcaactgaagagcttttactcttgcaaaaatatgatattaattaattaaattcttttttaatttaatttttttattt

SEQ ID NO: 3588 - DNA, 4 bp, Methanobrevibacter ruminantium
ttta

SEQ ID NO: 3589 - DNA, 2 bp, Methanobrevibacter ruminantium
aa

SEQ ID NO: 3590 - DNA, 51 bp, Methanobrevibacter ruminantium
gtaatttaattaaattttttcaataaattatttttatttttatgtgataac

SEQ ID NO: 3591 - DNA, 131 bp, Methanobrevibacter ruminantium
tcaataattttctaaaatttaataaaatattttattctataactatcaaactattatttcaaattctttcttatttttacttattttacccatattaatttcaattactcttattttttaccgcaataaaa

SEQ ID NO: 3592 - DNA, 207 bp, Methanobrevibacter ruminantium
taacaattttacaaataaatgaatttttttactttatataaaattctaagcaattttaataggtaaaattcatttttactataaataacggtttattatggtcatatgttttcacaaaaaatgaaagttaagaattgtctaaatatttggctataaaaaacggttttatttaaaaatattcgaatatttaatgtacgaggattttat

SEQ ID NO: 3593 - DNA, 481 bp, Methanobrevibacter ruminantium
cgtttgttaattaaaattaaatacaaataagtaatttttataagcttttagaatttttatattttaatgagtcttataattatttacttatactttttttattttttcctttttttttaatcagattaacttctatttctttaaataactattctttttagtctattttttctaatattctattttttaagttatttaaatagattcatttttctaatcttttattaaaaagagataataactatttatccagtatttttaaacttgttttaccgtagattttatatgttaaaaatgctatagttatattataataaatttattaatgttctttgattattcccaaagaatcgctaattaaacttaaaatttaaatccaagtaaattataatcggggtttaaaatatcaattaattaaattattcatattaattcaattaaaacaaattatttatcaatcaattttataactggggagttt

SEQ ID NO: 3594 - DNA, 45 bp, Methanobrevibacter ruminantium
gcttaaatgaactaattgcataaaaaattaatcttaaaaattatt

SEQ ID NO: 3595 - DNA, 265 bp, Methanobrevibacter ruminantium
taattgtttttatttttacatttaaaccattttaagaaactattttttttagttttttctattcaaactcaaactatagaaaagttttttaaatagaaaaaacatatcttatcataatattcctcttgtactatatattataggaatatttattttattactttctttttaaattgcttaaaaacttgatttctcatcaaaatctacttttattttagcaatatattattttaaagagattatactacgtataagaggggtatgt

SEQ ID NO: 3596 - DNA, 13 bp, Methanobrevibacter ruminantium
agctcgttccgct

SEQ ID NO: 3597 - DNA, 82 bp, Methanobrevibacter ruminantium
gccattcgcttagagttacagacaccagtcttaggtgaattggattaagtgagattataacatattaattggagaaatttat

SEQ ID NO: 3598 - DNA, 87 bp, Methanobrevibacter ruminantium
atgaagatttttaagattgaattgatctagcgctttatgctttgattgattcattgaataataatttaaatttatggggattttaaa

SEQ ID NO: 3599 - DNA, 60 bp, Methanobrevibacter ruminantium
tctttaatttaaagttaatcttaattttcttttataataaattgatttttttaagataaa

SEQ ID NO: 3600 - DNA, 145 bp, Methanobrevibacter ruminantium
ttatgcaaattgcaatcaatcaatttctaattattctttaaacaaaataattatgcaaattgcaatcaatcaatttctaattattctaaaagatttaagttatttattcaaaattaagatttattatataattcgcggtgaaaaa

SEQ ID NO: 3601 - DNA, 11 bp, Methanobrevibacter ruminantium
gagtgtttagt

SEQ ID NO: 3602 - DNA, 215 bp, Methanobrevibacter ruminantium
atttgcttatgctatatttaatcatctttcaaactaactttaagaagcaataatttaaaacttttttaagtgatttaaacaacttataataatttttaagttttaataagtaatttttaagtgatttaaacaacttataataatttttaagttttaataagtaattttaaataaacttttaaaagcaatttaaataactttaagaaggaattaat

SEQ ID NO: 3603 - DNA, 158 bp, Methanobrevibacter ruminantium
atagttaagattcttttttaaagtatttatttacagatatgatgtattaattgatttaaaagattttaatcaattgattattatctaaattcaatgattcaattaagtcaattaatttagtatgatgattaattatagtattataagaaggttttatt

SEQ ID NO: 3604 - DNA, 73 bp, Methanobrevibacter ruminantium
atttttcatttatttgattttttattaaattttttaactatcattacggatgaaataatcttaaggtgttaaa

SEQ ID NO: 3605 - DNA, 84 bp, Methanobrevibacter ruminantium
aatattcaaaataaaacaattataaaacattttaaataaacaaaataatcgattttgttttaaatttttttaaattaatactta

SEQ ID NO: 3606 - DNA, 11 bp, Methanobrevibacter ruminantium
atttattattt

SEQ ID NO: 3607 - DNA, 239 bp, Methanobrevibacter ruminantium
ttttctctattttttaaaaacttattttttttaattttagtacctatttttttaaaacttattactttttctaatttcaaaatattttttaaactataaaaaatgctattttatccattttcaaatcaatctttagttcaatccatagcccttcacataaatgtccttaaattctagtttcattttattaatcctaaaataatttattttaactaattcaataatgcccttattccatt

SEQ ID NO: 3608 - DNA, 81 bp, Methanobrevibacter ruminantium
ttgggtgaaaaaggtagacctttcgatggacctcgatgaagaagaagccgaagaggctgcttaattcatgatttaatcgaa

SEQ ID NO: 3609 - DNA, 116 bp, Methanobrevibacter ruminantium
tatcaaatgttttaagtttagaaaattatttaagtatatttattaagcgttttaagtttggataattattttaatatattttttcagtgttttaagattatttagtagtgattttt

SEQ ID NO: 3610 - DNA, 144 bp, Methanobrevibacter ruminantium
ttatggattcaaggagtttctgacattattgcagcagataatcctattagcagtgcagtaatattgactttaactgtaattgtaatagtggttccctttatattcacatacctccctgcaaaaaacccagaattttataataag

SEQ ID NO: 3611 - DNA, 473 bp, Methanobrevibacter ruminantium
ttttttaattcttttttttaaaacgttttcttttatcctttttttaactcttttatcctttttttaattcttttatcctttttttaattcttttatcctttttttaattcttttatcctttttttaattcttttatcctttttttaattcttttatcctttttttaattcttttatcctttttttaactcttttatcctttttttaattcttttttcattgcccttatcaattagttggacttttttctttttggcctattttttcactttttctattttgcttaatcatttctcttgagattcaatttcaatttttaataaaattttcacaagttttttaaataagtaagttgtaatatatagtaatagtaaatattaattaaattaattaataaaaaaatgattatttaattttaaatttaattttaaattgtcaaaaccaatttacctaattcttttagaaggcaatcaa

SEQ ID NO: 3612 - DNA, 65 bp, Methanobrevibacter ruminantium
ttttggctttattttagttaaaagataacttctatatttagtcaacttaagattagtttttaatt

SEQ ID NO: 3613 - DNA, 118 bp, Methanobrevibacter ruminantium
ttattttatttttaattgtatttttaattgtatttttaattgtgtttttatttgtattttaactctcatgaattatttttaaaaaaacaacttattttattactggattgatgaactt

SEQ ID NO: 3614 - DNA, 16 bp, Methanobrevibacter ruminantium
tgtattgctttaaaag

SEQ ID NO: 3615 - DNA, 6 bp, Methanobrevibacter ruminantium
tttttt

SEQ ID NO: 3616 - DNA, 61 bp, Methanobrevibacter ruminantium
ggtatcactttatttgtttgcttattctttatctggttcttctttaaatttagattttggt

SEQ ID NO: 3617 - DNA, 146 bp, Methanobrevibacter ruminantium
ttctatcgccttttcatattttgattctttttaacttttaatttttatttataaatcaaagctttaaattggttttttaagttattttaggatttaaatttcttaatttttcaagttgattcagtttaaacagcaaaatagactta

SEQ ID NO: 3618 - DNA, 301 bp, Methanobrevibacter ruminantium
tcttttatctccttattttttatttatatattttaatcttttaaaattataaaatacttgatttattattagttttaataaattatatttatttcgatatggctttttaatagttatatatgctaaatctttattgcttggatagttaaataaaagattaaatttattcggcgattaaaattaagttaaaattattgattttgtaaaataagtaaaattaagagtttgtttgtaaaaagagaaaaaaagagaataaatggaagttaagagtaattactcccaacttgaataaaaattttga

SEQ ID NO: 3619 - DNA, 401 bp, Methanobrevibacter ruminantium
ttattttcctccaatcataaataagaattataatgcttgatttgaataatttaattttaatattaattgattatattttaatttattaaataatgtcaagctatatataaattatttttttaatagtttttaaatattttgtcggcaatttgttttctttatggattttgtaattttcattgatatctttttattttttttctttatggattttgtaatttctgtagttttgttttctttatggattttgctgtttcaatgatattttttcttatgctttttctaatttctgatattattttagtttattcttaattcgcttaacttcgattttatttagggcaatttttataaaggactttctaaagaataataattataatattttaatgaggtttttt

SEQ ID NO: 3620 - DNA, 134 bp, Methanobrevibacter ruminantium
tttagattgatagtgaatttaatggattgatttaggtaaatcattatttaaattgtcctaattattattaattttatttataatgcttttgagttatcggaattctattagaaaaacattaggtatgtgttgtt

SEQ ID NO: 3621 - DNA, 81 bp, Methanobrevibacter ruminantium
ttgttataatgtattttgaagtttagcttctttttttaactattcttaatagtttatgctttaatctaaccttttttttta

SEQ ID NO: 3622 - DNA, 108 bp, Methanobrevibacter ruminantium
tttatttaattttaatttttacttattttatttttagtttcagttctacttattttattgtaagttttgaactttcacttatttttatagagggttttagagttctgt

SEQ ID NO: 3623 - DNA, 182 bp, Methanobrevibacter ruminantium
tcctattgctgttccataattggcatgactttcagtgattatggacttttctaagcttccatttgcaagggagaattgaactgcccctcctaaatctgcagtgttgtttgtaaatatgcaattggagatgtttccggattcatagacgtttattgcacctccgcttttttcggcaaggttat

SEQ ID NO: 3624 - DNA, 24 bp, Methanobrevibacter ruminantium
ttagacgcttccccatatattagt

SEQ ID NO: 3625 - DNA, 37 bp, Methanobrevibacter ruminantium
tttaaatataattttatagaatttaaagactttaggc

SEQ ID NO: 3626 - DNA, 16 bp, Methanobrevibacter ruminantium
ttacttttcccctatt

SEQ ID NO: 3627 - DNA, 35 bp, Methanobrevibacter ruminantium
gaatataaatcaataaaaaaactgaagtgtttcat

SEQ ID NO: 3628 - DNA, 163 bp, Methanobrevibacter ruminantium
tttttaattaaaattatttaaatttaatattatttgaaatagattacttaaattagaatcatttaaaattaggatattttaaattagaactatttaaattagaatcatttaaaattagaactatttaaattagaattatttaaatcattaaggatgttttaat

SEQ ID NO: 3629 - DNA, 102 bp, Methanobrevibacter ruminantium
ttttctacatattcttttattttttgtttattttttaatttatttcttattttttgattatattatattttttaactttgtttgatgtttagggtttttatc

SEQ ID NO: 3630 - DNA, 297 bp, Methanobrevibacter ruminantium
atttttttaatgctttttttattatttaatatagtattacattggagtgtaataaaaaaggtgatttttattacattggagtgtaattaaaactagggattttattgcattggagtgtaataaaaaaggtgatttttattacattggagtgtaataaaaaaggtgatttttattacattggagtgtaaaagcatatatttactaattgcaatgaattgaaaattatttattcaattgcaaaaaaaacttttcaaatttaaagaagttttttatattacttacaatataattaatcat

SEQ ID NO: 3631 - DNA, 664 bp, Methanobrevibacter ruminantium
ataattcatactctttgtctatttattttaagttgttcttatttaagggttttttttttattaaaactcttattaagcccgcccaatgcttattcaacttttttttaactctttttattttttttcatatttttatcaacttttttttaactctttttagcttttttcatttttacatttttataacttctattttagtatttatttagtaaaataagtatctattcgtatttaattaataaaaagagcaatataattggtaaataaataaacgaattattttaaatcttataaaaaaaagaaaattattaaaggatgtgttgtgttttatattaaatctagctatgtgagaagttttagattaaatataaattcttgtttcgatttattcaattattaaaatattaaatttgggtcatttttttaaatgattaatttaatagttttttaaaataaagcggctgtgaatactatgcaggataatattcatagttttatagtattgattgcacacatcctttaatagataatgggtttggttatttataccgcgaacatttgttctaggcttttttttatgccatgaacatttgttttaggctttttttatactcagaacatttttctaagatacttttactcagatattctgaggagtgtttat

SEQ ID NO: 3632 - DNA, 262 bp, Methanobrevibacter ruminantium
tttcacctcgcctttagttaaattttttcatgtgtactaatagtaagttttaaagagtatataaaaaaagagcaagagagcatttgaaaactaatcaaggtgtatttcaagtgtaaaattgcactgatatttagagtgttttaattgttaatatgaaatttttaagagattttttcatctctttttaagccttagatttttaagtgatttttcaatttattttatatatcattaaattagaaataatattagaaactaataa

SEQ ID NO: 3633 - DNA, 375 bp, Methanobrevibacter ruminantium
gacttctttttaatctatttttatcctatttttcttaaaactctatttaattcctttaacaatcttttaagctatttttattcaatttttcttaaaactctatttaattcctttaacaatcttttaagctattttttaaatattttattaataatctatttccagttatttttattcgaaggaatttaaacaattaattttaaatgtattataaaacaaaatataataacaattaaaactataatttaatttataatttctatgcagaagttttatttaaatttaatttataatttctatgcagaagtttatttaaatttaatttataatttttatgcaaaagttttattttaattttaatcattaagtgatact

SEQ ID NO: 3634 - DNA, 48 bp, Methanobrevibacter ruminantium
ttcttaataggtttaaaaggcttaattaagaatttagtttgatttata

SEQ ID NO: 3635 - DNA, 76 bp, Methanobrevibacter ruminantium
tttttcatttactttttttttaaaactagtttatttatattaatttttcattatttatttttgcgaggttatttat

SEQ ID NO: 3636 - DNA, 22 bp, Methanobrevibacter ruminantium
tcaattattttaaaataagaaa

SEQ ID NO: 3637 - DNA, 184 bp, Methanobrevibacter ruminantium
ttataaaaatatttattttattctctttttttttattttagaactaaaatttattaattctgtcttttttagtgctatttttttttaattaggtctctttagaactaaaattttttaattctgtcttttttagtgctatttttttttaattaggtctctttttttattttcacactaattttct

SEQ ID NO: 3638 - DNA, 762 bp, Methanobrevibacter ruminantium
atcttttattttatatttttgaatttatataattttttaatgctgtttttctcattgttaattccacttaaatttataaaatgtaaaactttatatataaccgtgcccttatatcttgtaagcattaaagtttgaatattggtattgaattgattggtttcattaatctaattcattaatgaattcatttgatttggtattggtatttgattttaatgtacgccaatgatttcaccacaagtaagaatttttacaccttttaaaactactatattgtttctttcttgttcatattttaatatactctatgcaccatttaatcatagttaatcactccttgatttgttttgcattgtttgtcatttgtgtatcatcttatagggtttttcttctttcttttggtaaatcattgggatttaaatagatcaggggtgggtttcttcccaatattgtcaggacaagaaggggtagtcctgatttaaagatattgggatgattggtgggtatataattattctattaattgaagttgatttattggatggtttttgtatgaattgattatttttcggcttttaaacaattcatatgattattgttttttaaattggttttgaatctaatagattaattattctatctatttaagctcttaatatttgatttagactataatctatatttgtgagcatttaagctctaaatattaatttggatatttgggctatttagaaaagaactttctttttagaggtatttttc

SEQ ID NO: 3639 - DNA, 110 bp, Methanobrevibacter ruminantium
tttcatcttcttttaaattctttttttttgttttttaagaataaggatttttttatgaggtcaaatatttttttcaaatgagtaatgcttttttttcattccaaagattt

SEQ ID NO: 3640 - DNA, 29 bp, Methanobrevibacter ruminantium
tttatcacaaaaatttcttcttttatatg

SEQ ID NO: 3641 - DNA, 27 bp, Methanobrevibacter ruminantium
tgttgaatttaatataaggtgattaat

SEQ ID NO: 3642 - DNA, 521 bp, Methanobrevibacter ruminantium
ttttatttttatatttatttccttgttatgcgggtgtttgcctaatttatagcatttagaattaaaattaactccaactttattattttgcttttattttaggcaacactcatttttatttaatttccctctttaatattttaatttaattattaaaacctatttttatttttttttatttttttcttgttttttgggggttttggtcttattattttttaggttttttatatccttttcaattatcacattttttattttattttatcaagtctatttttctataatttttaatctaatttcattcaaatctattatgttcataatttaaatttattttatattttatataatagttaatttttgatttaatagtcaatttcctatttttttcaaatttaaataacaaactatttattataaagaaaatataaataaataataagatattattttaattgacttatttaatattcttaacttgattattaaattaattatatcattttggaggattacta

SEQ ID NO: 3643 - DNA, 208 bp, Methanobrevibacter ruminantium
ccatgtaaagatagagaatgcaggttgtgaatacggagaatatgatgatgataggactcataatgttatagatgacagataaagaatattttccttcttccatcccatatgaattggaatggggaaatacttcttattatcttttattttttcattatgagttatttttttttaaatttcatactttaattagttaagagtcgatatt

SEQ ID NO: 3644 - DNA, 69 bp, Methanobrevibacter ruminantium
aaaagcaagctttaatacccaagcttttttggccttcgggtgaaaaaaccttgaccaaaatttttatca

SEQ ID NO: 3645 - DNA, 204 bp, Methanobrevibacter ruminantium
ttttttatctcttttttatcataaatcttttttttttatagtgttttaagctggttgaatggcccttttttatctcttttttatctctttttatagtatctttttatgttaaacttctttttcaatagttattttttccaagtttttaattattcttatagtcaatattaaaaaaattatcatttgattaaaatattatcaatt

SEQ ID NO: 3646 - DNA, 121 bp, Methanobrevibacter ruminantium
tttttttataaatattatcattatgttcaataatttttaataatattaatatttcattcaataaaaaagaaagttttatataaatttttcaacaaaccattatttgtcaagctatcatttt

SEQ ID NO: 3647 - DNA, 299 bp, Methanobrevibacter ruminantium
tttttttaatttcttttgaaaatagctaagattataagactatcaatatatcaatggttgaatctattgcatatgattatagttttaagaaggtgttaatatgaaatgatatgctatttaggggcctgaatttttttatgtatgaaatcgttcagattttctatatttttattcattaccctataaaaatgtatttatttctaaaaatacaattgtattattagttatataaaaaaataggtctttaatatcgttaaatttaaataatatgctttacaaatatattattggcgataata

SEQ ID NO: 3648 - DNA, 963 bp, Methanobrevibacter ruminantium
aatcgtcaggcccctaaattattttttttatccagatttttcttatttttttaataattttcttattttttttcaactttgttcttattttttcaaataatattttgactttttcttttttataaatttttttcactaaaaatgctaaagtttattttttattaaaatgatttattttacttataaaaatattttaataattatttaataaaaatcataattttaaactttgtttttatgaatttaattattttaaaaattttataatctttttaaaagcgtttaaattaaaataacttttggttaataaaatcgaaagctttatatgctatgaagttcaactattatttagttacaaaaactaactaaaagatttgcattaataattattggtaaattttttaaaaattctttcaattctttatttggttaattaaaattatttatttaattttaaacgattgattaaatgaatttaaggaattttactggaatttattcttctaattatttattgatgattaaactgtatctctattggttattcaaataaaatgacgctcttaaaatctttagtttaattttaatgtatttatgaatatttagtttcatttgtagtctggagagatcttttatttgatgattgattggatacgacattggctgaataattttaagaataattctaaacaattgatatttctgtgcctccaataattattaataatcttttaggggtgaactggaatcaattaatttaattaaaattgataatgattttggtttatgtaactgaaatctattgattgaacaattaaaaaaattagtatattacgaaattaattatctaaaaacgatttaatcggatttaaccgatttaaaatagcatataacaaattagtcgaattattatatttacatttattattatttattcacaaaaaacgtaaaggagttgaaaac

SEQ ID NO: 3649 - DNA, 29 bp, Methanobrevibacter ruminantium
attggattaatctaagacttatagcaaaa

SEQ ID NO: 3650 - DNA, 429 bp, Methanobrevibacter ruminantium
tttttttattcttatgatttatcttaaactgtttccccttaaatagagttaatcagtttataaactcgtttatgattctcaaatcttaaaccataaacaaatatacactaaaacacctgtaaagaattaaataatggattaaagattaatttaatttatttttctttaattcattatttttttaatctatttttattcttatcatattatttttttatttaaactatttagaaaattttattagtcttctttatttaaatatttggagaattttattaatctccttatttaaactattagaaaattttattaatcaaatataataaaataattataacacacgttaataatttttttaatttagtttaattggcaaatatgatatatttattatttttaggataaacagttgattgtcaggtgtttttt

SEQ ID NO: 3651 - DNA, 8 bp, Methanobrevibacter ruminantium
gatgtttt

SEQ ID NO: 3652 - DNA, 6 bp, Methanobrevibacter ruminantium
atttta

SEQ ID NO: 3653 - DNA, 14 bp, Methanobrevibacter ruminantium
aatggagattttaa

SEQ ID NO: 3654 - DNA, 81 bp, Methanobrevibacter ruminantium
tatttttgaaataaatggcaatttgctatttttaatgattattataaaatgtatgtaatggaaattaattggaggttattt

SEQ ID NO: 3655 - DNA, 93 bp, Methanobrevibacter ruminantium
tttttttctctctttatttgtgagaaagttttttatttcctctttattttgtgagaaggttttttctcttttatttgtgataaatatatttag

SEQ ID NO: 3656 - DNA, 190 bp, Methanobrevibacter ruminantium
tattttgaaaacaatatcctttcatttttgaactatgtttatttttgaaaatattgtctttcatatttgaactttgtttattttgtttaagaattttattaaaaatatacttatatgattaaaacatatattagtatagtgatagatggataattttataatttatatttaaaaattaagtgtggaaatt

SEQ ID NO: 3657 - DNA, 479 bp, Methanobrevibacter ruminantium
tttttttctctttttttttatttcagactattctttattttttttatttctaactactatttttttatttttttatttcagattatttttttttatttttaactactattttttttatttttttatttcagagtattcttttattattttttttatttttaactactattttttttatttttttatttcagactatttaacattgtttttttatttaaactactattttccttattttttataaaaattctttttaattcttactttaattttcttaaattgtattttatctaattaaatttattgtatattcaatttaaattgatatcagttctttatttcttaattgtaacattttataccctttaagtaacaaaatatttaaatactggaaagataaaattatatttaacaaataattattttaagtaaaatttaagaaaaaatattttttactaaggttatagaggatgattaat

SEQ ID NO: 3658 - DNA, 380 bp, Methanobrevibacter ruminantium
ttcttaattgaattggcctatttttaatttctatttttttttattcttttttttaataaaaatagttttttttaggaattatttttttaattcatctatttattgttctttttttataaaaataagtatttctgctctttttttaatagaaatagttttttttaggaattatttttttaattcatctatttttgctcttttaagaggcatattttttaaaaataagtattctttttttaataaacaaatttcttttaaagcattaaaacaaatttaaatgatgtctggtgtattaaaataaatttaagggagttaaaacatttaataagctaaatagagtatatagattattcaaatgatatgaactttaatttattaaa

SEQ ID NO: 3659 - DNA, 271 bp, Methanobrevibacter ruminantium
ggttaattttgtttaattttttagtcttaattcggtatagtattattgattttcaagtttattaaaattttggttccttcctatgctttcaaactaaaattataaaacttatgttaagggagctttttaaaaaaagttttatggaatctttagttaaatgcatttaagatcagttcttatggttttttttaactattaaatgtggtttgttaaatggggtttaagctataaaaaatagttttatggggtttttaattaaataactaaaaaa

SEQ ID NO: 3660 - DNA, 23 bp, Methanobrevibacter ruminantium
ttaaaattaaaaattaattgaac

SEQ ID NO: 3661 - DNA, 469 bp, Methanobrevibacter ruminantium
tgtaattctcctttaatttaattccaattttttttaaatattggatatataattatttagttttttaattatttaaatgttttttattcattttttttgaactatgttaagttattaaacttttttccatatagttaattgttattttgttcaattttattaatttttattgaaacaagtattctttttaatcaacatatcttttttatgtcgaaaaaaatcaaataattttataaattttttagtttaaatcaattagaactatttttttgctgtggattttcaatatgttttttcaagtttcttaagttggactgttttttagataaattaattaaataataaattacatattttatattgttatagtaattaggattttttagatttaaaaaattattttaaaagattattaaactaatgattataaaagatttactaagatattcatttaaactaaggtgtttta

SEQ ID NO: 3662 - DNA, 91 bp, Methanobrevibacter ruminantium
ttagtttttcttcagttatggtttaaggtgacttttaaataatattaattaggtaattaaatctctaaagagacttttagggggttaaaac

SEQ ID NO: 3663 - DNA, 426 bp, Methanobrevibacter ruminantium
acttaaaatcttctttttttattttaattcattatttttatccattttttatctatttttcattattttttattattttttatttttatccattttttatctatttttcattattttttattattttttatttttatccatttattgcttctttttattaattttattatatttttatttgtatttttagtatagtcttattttctatcgtttttccacaatcatatcaatttcacatttttaaatcaatttcatattcttaagtaaattttacgagatgacatcaattttacgaaatcaaatcaattttacattcttaaatcaatttttacttctaatttttactcaaatcaccattttaagttagatttaaatatatcttcctaaataaagatatttactcaattttttaaaaaaggtgattca

SEQ ID NO: 3664 - DNA, 44 bp, Methanobrevibacter ruminantium
ttttttatgggacttagcatattctaatcggaatctaatttttc

SEQ ID NO: 3665 - DNA, 147 bp, Methanobrevibacter ruminantium
ttttttattttttaatttaagtctttgtcagtagcttaatataaaattatatgctatttttttaacatttatatggtttaaaaaacatattaataattataaattaaaagggggtagcatatgactatttatttaacatcttcaaaa

SEQ ID NO: 3666 - DNA, 24 bp, Methanobrevibacter ruminantium
atattggatattagaggtgaaaat

SEQ ID NO: 3667 - DNA, 184 bp, Methanobrevibacter ruminantium
atggttaattttaataaaatatttaaactttataaacaaaaatatatttagatcttaaaggtatgtatttaatttaatctttttaattaaaagtaattaataattccttattattggcaaaaaatttagaattaaatgtcatattaatttatttagttaatttaattttacaaagggtcataaa

SEQ ID NO: 3668 - DNA, 166 bp, Methanobrevibacter ruminantium
ttccatttctaattgttatgcggctgctatatttggttttgaattttaaatacttatttgaagggcttttttaataaaaatttttaaagagctttttatttgatagaaaatttatttggtggagaattattaatttaattctctaaatttacttttttttaagaat

SEQ ID NO: 3669 - DNA, 3 bp, Methanobrevibacter ruminantium
aac

SEQ ID NO: 3670 - DNA, 412 bp, Methanobrevibacter ruminantium
ttctacttgctcttttcatatttttttaaatttttttttcactatttttgctaatttctttttggaattttatttttttctttttcattatttttgctattttatttttttaattttctcattttttacaagaatttttcctatcattattttaattctagctacaattaatatatagttatatatagtaaacccttttttaatgaatcgtatttctaattaaattgattagaattaatttttttaatattatttgttccataatctacataaggtaataaattattttaaaagtagttaaaaatagtaaaaaatagattatatttgcattaaaaagttagtggaatttaaaaaatagactaatgataataattgcagaattttaaaaaatagctattggaatttattttaa

SEQ ID NO: 3671 - DNA, 274 bp, Methanobrevibacter ruminantium
taaatcaccctttaatttagttttaggtaaaaatagttctaatgaggtattttctctttaaataattattaaaatctttttacttttccagtttaattatttttatataatattttagttgaaaaatttataaacttatctatttcatttgtatgtgtttgaactttttttgagcctctttttttcatgggtatgttttttttttaatatggtaaactatgcattcttattttctatctgtttgaaactttttagttggtgtttttcttgtttt

SEQ ID NO: 3672 - DNA, 126 bp, Methanobrevibacter ruminantium
tttatcaaatcctatttaatcgttcggtaagttcgatgtcttttttctcggataatttattatttattttgatttttctttttttttaagagtatttgttcattttgagtttttttttaagagtat

SEQ ID NO: 3673 - DNA, 323 bp, Methanobrevibacter ruminantium
gcttttaccttctatattatgaaaattaaaataattattaatgaatgatttagttagttaaaattatactattattagttttattttaatagctattaaattttaagatatttttaaaaaaatcagtggtttttttattagttttagctattttttaaaaagaacaagttagataatgtttttttattattttgaaatagtttaaaactttaaaaaaagaaaaaaaataatgaatatgaatggttatttgtttatcatattcattctaagattgttttagatgaatttattcatcttatttattttaaaattgttttagatga

SEQ ID NO: 3674 - DNA, 154 bp, Methanobrevibacter ruminantium
aatactcctcacttatttttttttataaattaattgtttatttttatttaaataagcaattatctaattaatgaataattagtgttatatattcaagaataaatggttttagtcattaatgaataattagttaataagtaattattttttttag

SEQ ID NO: 3675 - DNA, 339 bp, Methanobrevibacter ruminantium
ctatgattcctccttgaataattttaattaaattttcattaagttacacaaatatttaatttctttttcattgacttatgaaaattttattttaattaaattattgacattgttttaatattactttctattcatttaaataattatttaattttttgaaatttgtttgttatttagagtattgtttgtagggcacttaactaatttaagtggaggtggtgtttttatgtttctattaatatctagagttaaatgacatattatttatattagtttttacataatagaatataattaattgatttgattaattaaattatttaagaaaaggtgattata

SEQ ID NO: 3676 - DNA, 288 bp, Methanobrevibacter ruminantium
gttttttataattctttaaatctttttttattttttctttttcaattacttttttaactttttttcttgctatttttattgttttcatttaaactgtttattttagctacctttttttaataatattttattggtgttatttttttaaaaaaagagtttatgttttataaaaaaaggttttgcttttaagtaattaaaataagttttatccgtgtttaatggtggaaaaaaagaaagtaagagaataattagatattctctttagtttgaatatattgtctgatttga

SEQ ID NO: 3677 - DNA, 22 bp, Methanobrevibacter ruminantium
attataacctcgataatttgat

SEQ ID NO: 3678 - DNA, 398 bp, Methanobrevibacter ruminantium
gatttcaccatctaaattaaattaaaaatcatttattaattgtttttatatcattagtttatgaagtaataattttactaaattaaattactattaataaataatatgaatttatatgtttataaaacttgtttttatttggtgattttttatgtgttttcttggtgtttttggatgaagtttgtgaaaaggttaatgatttgatttatataaaaagagtaaaaaggggttttttcaagtttaatttaaagtgtttgaatttttaaaagaagagtaaaaaggggttttttcaagtttaatttaaagtgtttgaatttttaaaagaagagtagaaagtgtttatttgttataaattaatttaaaatgttaaaaaaagtaaaaaaaagtttaataggtag

SEQ ID NO: 3679 - DNA, 401 bp, Methanobrevibacter ruminantium
ataatcacttttttgaaatagtttttttaaacaattaataattgaattaatttttattaaatatttatataaagttatttaaatattttatcttattttattgctttattcaatttattcttatgaaatattgtcttaaaagtagattttattgcaatgtcataaaatatggtggctatttctcttattctgaaaggtttaaaatatatcttaaaaatagaatatgtaatatgtggtttatattgtttcaaaaagtttaaaataagttttatgaaaaaagtaatgattaatcataatgttatttaaaaaggtttaaaataagttttatgaaaaataagtaatgattaattataatgttatttaaaaaggtttaaaattagataaataaaaaaagaaaaaaa

SEQ ID NO: 3680 - DNA, 752 bp, Methanobrevibacter ruminantium
ttatatcattcctctcttatttttttgacgtaattatcttatagaataattagttgttttgtttttatagtaaaacatagccacggctaatctagattgaattgatagaaaatagtgggctatgattaaatttataatccaaacttaattttagtttagacagtaaaaatataatattaaaaatcgcaggttatgggctaatgtcacttaagatatctgaagtggccttttgttaaaaatagatagaaaataacttataaattttgattataagttcatatagttttataatctatagtttgcctgctctggaatcaatccattgaatttaaaataatatcataaaagttttaaataagtttaaaacccgcccattaaggttatagttagttttaattttcatagtatttaaatatttttaatattttagtttttatttttgaaaattttaattttttataatccttttaggaatttttctttttgattaggatattatttttaaaattttcctatcatttttgaaatagtctaaaggtttatattttataagcaatatatgattttataatttcttttagttgctttaaaaagatttctcttatgggagatattaattgttttcgcttaataatttatatcctatgaatgatataagttcataaaattgctttttatcgcccccttgaaactataattttaaatactataaggaatataacaattgttataaaactaatggaggtaaaaat

SEQ ID NO: 3681 - DNA, 25 bp, Methanobrevibacter ruminantium
tgggctagcgtataggggagatttt

SEQ ID NO: 3682 - DNA, 17 bp, Methanobrevibacter ruminantium
atcctaagaatattgga

SEQ ID NO: 3683 - DNA, 112 bp, Methanobrevibacter ruminantium
attatggttattatgcttatgttttaagagcatatttatgttttagggtagaattaaacaataaatttatttatttaggtagaatttataatgcatttagtggggagataaa

SEQ ID NO: 3684 - DNA, 109 bp, Methanobrevibacter ruminantium
tctattctttaatctttattttattaattattagttatttcaattttctaaaatctattttttgttattttttatctaaactcatttttagttcttttttttattctaa

SEQ ID NO: 3685 - DNA, 290 bp, Methanobrevibacter ruminantium
tttttcacctttttcttttgaataatttaaattttagtttattggtagtttttggtttttttaaagtttttatttattggagttttttgttttttcttttttttcttttttttagagttttatttattggagtttttgtttttttaaagttttatttattggagtttttgttttttcttttttttcttttttttttaaagttttatttattggagtttttgttttttcttttttttcttttttttttaaagttttatttattggaattatttgtgttttctttttaaaga

SEQ ID NO: 3686 - DNA, 135 bp, Methanobrevibacter ruminantium
ggtttagcctcagattttcttgattattcttagaataagggttttgttttccctgatttatttttaaaataaggttttttctcttttagtttgataaaattatttaaatttgatgtttttatttatttagaattt

SEQ ID NO: 3687 - DNA, 182 bp, Methanobrevibacter ruminantium
ttgaattacctgtaaaaattggtcttataaatcgttaataaaattcattgatagtttatttttttatctctgtttttttaatgaaaaagtttttatactatcgttaattaattttatataaattgatattcatattttatattgtttaatactgtttatataatttgttttaaggtgtattt

SEQ ID NO: 3688 - DNA, 187 bp, Methanobrevibacter ruminantium
ccttttttttattttttatcttgggttttagttaaaaatattatttttttatttttcttttttaactttgtttgaaactttatattttgctttttttaaataaagatttatactataattaataaatattattttactataaaattatacagtttaaaatttaattattgaataaaggtttattaac

SEQ ID NO: 3689 - DNA, 175 bp, Methanobrevibacter ruminantium
atttattataatttaatccctttttaactaaatttatttaattttttgatgaaatttaatttttatttcgttatttaaagagataattctattaacttatttaaaaagatttgattttatttagttacttaaagagaaattttattaatttatttaaaaagatagaggaattttt

SEQ ID NO: 3690 - DNA, 215 bp, Methanobrevibacter ruminantium
gcctcaaacttttaaaaaaagtttgatcaaaatttttaatatgttatttgacttttaaactaataaaaatagtaaaatggataaaataattaatattttatccttaaaattctttttttttaacgagtgcaattcaacttttttatgaagttttactctaaagagcgttatttgactctaatttattttttatgcatttattatctactttttac

SEQ ID NO: 3691 - DNA, 332 bp, Methanobrevibacter ruminantium
cgaatcacttttgattgttttatgtaatctaaaatacgttcatatatctttattttttctaatctaatgtagattgaagttttatccttaatataagttaaaatatgttaataagttttataataatttttttatgatttgccataaagcatagtaaaaaatttgtttgataaagataaaataaaaatatttatataatgtaaaaactataatagaaatattaaaaaagtgattttggattaaaataaattttttaaaatttaatcatttaatgggattaaatatttttaaaattatttaattcgttaaaaataaaaaaggagaatgatgtt

SEQ ID NO: 3692 - DNA, 182 bp, Methanobrevibacter ruminantium
gtccattctatttttaattttattattttttataatattttataatcttttaactatttttaataattatttgtttgattaactttaattaggctattttaataattatttgtttaattatctttaattaagctatttttacttatttttaatctttaaattctaattcaatatgtggttct

SEQ ID NO: 3693 - DNA, 40 bp, Methanobrevibacter ruminantium
tattctaaatggttttgactaatctctaaatatgggtcag

SEQ ID NO: 3694 - DNA, 317 bp, Methanobrevibacter ruminantium
ttattttaaatgtcttatttttttatttaaactttatatgttgattttaactgattttactcagttttattttttattttttcttttaatatattctattctgttttaatatatttttattttcttttattctttttagaaaactggatttgcttgaataagtataaatattattaaaacaatagttatattattaactttttgtaagagaaataagattttaaattttcatttgaaatttaaataaaaagatcttaagttcttaagttcaagttttaagttaatttaattattataaaaaaaattgaggagataaa

SEQ ID NO: 3695 - DNA, 144 bp, Methanobrevibacter ruminantium
ataattttttatttttaattcgagctttagattttgttgtagtgtattaatcaaaagatttatatactaccttttacaaactctataatatctgaaaattaaacttactttttctgatttttagatataattttttttacgcat

SEQ ID NO: 3696 - DNA, 11 bp, Methanobrevibacter ruminantium
cttattttcac

SEQ ID NO: 3697 - DNA, 252 bp, Methanobrevibacter ruminantium
tttttttatttttactgcctactttaggttatctgcttaagaaatctttttttaatcaatttcttaaaatcaaagggatctgatgcttttttgattataattttacttatcttgttttgttttaacttttcttttattttttaatattttgtataaatttatagattattgtattaaattgtacattcttaaattaatatatacatttatatacttaaaagtacaaaatatttataagaataaggtggtagt

SEQ ID NO: 3698 - DNA, 165 bp, Methanobrevibacter ruminantium
tttgatttgtttggctattggccattattttttctttttttcttatatttttagttcttttaatttgagttctatttatttttcaaagttctatttttttctttatatttttagttcttttaatttgatttctattattttttttcaatgttctattttttttaa

SEQ ID NO: 3699 - DNA, 140 bp, Methanobrevibacter ruminantium
gctcttttttattatttcttcatttattttatttttttttaatttttactttctgattttttttattatttttttttatattttttttaatttttactttctgatttttgtttttattatttttttgtctttatttatca

SEQ ID NO: 3700 - DNA, 26 bp, Methanobrevibacter ruminantium
tatttaaaaaattaggagagtttctt

SEQ ID NO: 3701 - DNA, 56 bp, Methanobrevibacter ruminantium
ttggctttgcttttataattgatctattatttttatttattttttctatatatttt

SEQ ID NO: 3702 - DNA, 107 bp, Methanobrevibacter ruminantium
aatatttcttaatagattaaatacgaatttgaacatttatcagtatttataaataattataataaattaaatcaattttacgaattcaataacagtggggttaagaa

SEQ ID NO: 3703 - DNA, 15 bp, Methanobrevibacter ruminantium
atgtgattaaatcag

SEQ ID NO: 3704 - DNA, 125 bp, Methanobrevibacter ruminantium
ttttatttaatttttaattattttttaatttataaattaatttatttttaattatttaatcaattaaaatatattagaattaattttttatattttcaattattttattattgtgaggatattaa

SEQ ID NO: 3705 - DNA, 10 bp, Methanobrevibacter ruminantium
tttaaatctt

SEQ ID NO: 3706 - DNA, 423 bp, Methanobrevibacter ruminantium
ttcttttcttatattcttattaaaatcattatatgaatatatttaagataaaagcccattatcttcggcttttataattatttttatttttcaataaatagaaaaatttgaaacatttatatacttgtaattacatatctattactattatatgaatctaattttattattttaataaatattcatattttcttataaaaataataattgattcttattataaaactattcattttttgtttattttacaaaatctaattatttgctgcaatatcaatagtttaaagagataataagattcgaagaaagtgcttctatatggggtaatggaatttaaaggaaaaataaaattttaatttatataaatcaattaaacttaaaacttattaattattacaaattttaattatataggtgaattaa

SEQ ID NO: 3707 - DNA, 386 bp, Methanobrevibacter ruminantium
ttaaattgaatttaagtcataattgattattcaattgatttaaactcttaattcattgattattagaataacgggctttttatgataaatagataattattcacttaatatagatgaaattataatttaattattttacttgttctaaaatattgaattataatcgatatattgttgagatctaaagattttataaatgcttttatagattttattaattattttattattatatcatagcggacaaatgattaacatatttctattttgtccatatcaaagattatattaatattttaatttttctaaactgcttaaaagattttatttaatttgaagatttctcgtaaaagaactatcatgaacaatgttcatggaggatttat

SEQ ID NO: 3708 - DNA, 119 bp, Methanobrevibacter ruminantium
ataaaatttaaaatttatactttttaattgttttaattaaaccatagattcaatataaaaaaataatatgtattggattacttaaaaaatattttattataaaaattaacggtgataac

SEQ ID NO: 3709 - DNA, 58 bp, Methanobrevibacter ruminantium
tttattttctttttatttttctagacttttagtttagtttatttattaattcttattt

SEQ ID NO: 3710 - DNA, 13 bp, Methanobrevibacter ruminantium
tttttttattttt

SEQ ID NO: 3711 - DNA, 155 bp, Methanobrevibacter ruminantium
ctacttttataacttattttatttatttaactaatttattgctattttttataatttaactatttttataaggcttcaattaatccttaaatcatttcaataattataaatattctacaaaacaaataatattctataataaagggaggaaaatt

SEQ ID NO: 3712 - DNA, 10 bp, Methanobrevibacter ruminantium
tagatttaaa

SEQ ID NO: 3713 - DNA, 45 bp, Methanobrevibacter ruminantium
ttttttattttttctaggggaaaatttttttatctagtggatact

SEQ ID NO: 3714 - DNA, 211 bp, Methanobrevibacter ruminantium
ttggttttttagtctttttaaacttgttaaaatttgaaaataactatttgggaaaataattggatttttgatctttttaaacttgttaaaatttgaaaataactatttgggaaaataattggatttttgatctttttaaacttgttaaaatttgaaaataactattggagaaaaatatttattttacttaaaaagtattggggaaaatata

SEQ ID NO: 3715 - DNA, 53 bp, Methanobrevibacter ruminantium
atcaactttatcagtttgttatttttcttaaatattttatttatggtgtttat

SEQ ID NO: 3716 - DNA, 69 bp, Methanobrevibacter ruminantium
gttctttgttttttattataatcatttttacttttttatttatatttaggcatttatttcttcttaatt

SEQ ID NO: 3717 - DNA, 78 bp, Methanobrevibacter ruminantium
taattatgctaatttattaatgacaaatcaactttaattacgctgattaatttataaaaaatataaaaactgattatt

SEQ ID NO: 3718 - DNA, 70 bp, Methanobrevibacter ruminantium
tcttttgaataaataatttatataataaaaaggatgaggatgtttaattttctttaaagtttttgatatt

SEQ ID NO: 3719 - DNA, 107 bp, Methanobrevibacter ruminantium
ttttttattttttttcctattttgctaatttttacgaattttatttttttacttaaattcttgttatttttttttaattttcttatttttagttcagttcttagatt

SEQ ID NO: 3720 - DNA, 126 bp, Methanobrevibacter ruminantium
aaaagattatttgaatagattggagagttaaagttatttataaatttttttttaataaaaatcgattgaattttgggatttaaagtttttcaaagtttttttttaataatggattaggtgtattct

SEQ ID NO: 3721 - DNA, 41 bp, Methanobrevibacter ruminantium
cttttattttgtttatatattaaaaaatacatactataatt

SEQ ID NO: 3722 - DNA, 52 bp, Methanobrevibacter ruminantium
tgacggttcaaccgaacggtttgaagcatttattgatgcagttattgccatt

SEQ ID NO: 3723 - DNA, 195 bp, Methanobrevibacter ruminantium
ttattctttaaactaaaaatgatttgctatttttttctttttttctttttaatttgatttctaatctttttctattcattttgatttgattcattatttttttctatttttttttaatttcgattctatatttttttatttttttctattctttttaattcaatcattaattttttcattcttttattctattta

SEQ ID NO: 3724 - DNA, 33 bp, Methanobrevibacter ruminantium
ttttgtatattttatttactgaggtgttttaag

SEQ ID NO: 3725 - DNA, 8 bp, Methanobrevibacter ruminantium
ttcaagct

SEQ ID NO: 3726 - DNA, 22 bp, Methanobrevibacter ruminantium
cttgattaaaaatttttttgca

SEQ ID NO: 3727 - DNA, 100 bp, Methanobrevibacter ruminantium
ttttgttttttttattagttttttaattagttttactatattagaacaaatttattttttttcaaagaatattattgttttttattaaagggggtataaa

SEQ ID NO: 3728 - DNA, 53 bp, Methanobrevibacter ruminantium
attcgttttttaactattttaaactttttttctttaaatgctgttttttttaa

SEQ ID NO: 3729 - DNA, 173 bp, Methanobrevibacter ruminantium
aattaatgatttattttataagttatttaaaattaattaattttttaaaaaaagagtaaatatgtaagataagtgagtaagtattgataaaataagtaaaaataagtaagtaggggtaagaatagataagaattgctaaaaaatggtaaaaaataaaattattattaatggaa

SEQ ID NO: 3730 - DNA, 378 bp, Methanobrevibacter ruminantium
ttcatcatctcctatctttaagaattttttgttttattttttgttttagtttatttgaatctttttgtttttaaatttaaaaaattgctcttaatgtcttgaataaatatttatttgtgaaagtatttatatttttttgttttatacttatcaaatagtttgataatatacgaattaaatttttatcattccctaattttcataattctataatttatcgatctttcaattttttaattttttaatttttttattgaaagtttgtctaaaattattaaaatcttaagttatgtcaatttgattaataattttaatgtcaagtttgattattgtatggtttaccatattaaactataatttaatcaatcgaatttttaa

SEQ ID NO: 3731 - DNA, 125 bp, Methanobrevibacter ruminantium
tttattgcctcgaacaatttttattattttatcattatcttattttatcattatctatcttatcattttcattaatttattattttattagtctatcatttttattcttattattaatttagaat

SEQ ID NO: 3732 - DNA, 158 bp, Methanobrevibacter ruminantium
aattttaattatattgatttactaatatatatttaattagtttttaattagttttttaaaattagaaaaatattttctattttttcattcctttagataagaaatttagatgtggatattcattaatagaaaaatttaatcattttggtgaattgttt

SEQ ID NO: 3733 - DNA, 41 bp, Methanobrevibacter ruminantium
tctgttttatttagggagattggaaattcttctttcaagtc

SEQ ID NO: 3734 - DNA, 32 bp, Methanobrevibacter ruminantium
tcgtttattaattaagattaaaggttaaaact

SEQ ID NO: 3735 - DNA, 159 bp, Methanobrevibacter ruminantium
tttttttaatcaaatcccttacttttatttttttttaaacttatttttgtttatttttttaaagttttatttttaatccatttttttgtttatttttttttaaacttatttttgtttatttttttaaagttttatttttgattcagtttttttgttcat

SEQ ID NO: 3736 - DNA, 14 bp, Methanobrevibacter ruminantium
tttcttttcttttt

SEQ ID NO: 3737 - DNA, 243 bp, Methanobrevibacter ruminantium
taatttaagatttttacagttttcacgtaatttcacgtaattacttgtaatgaattcgtatattataaaacatttttacatgttgaaaaaaagtattactttttctaattttttaaatcgattttttattgtaggtgctgttgaaaaatagttttaaatttaaaagttaaagaaattgtcttggaaattttagttgtcccaaccttaaaaaaagagcagtttagagcatagccaaaataaaaa

SEQ ID NO: 3738 - DNA, 11 bp, Methanobrevibacter ruminantium
aagcttgtagc

SEQ ID NO: 3739 - DNA, 412 bp, Methanobrevibacter ruminantium
tttatctccatatcctttaaaataataattttaataagtttgataatttacttaattcattggaattattcttgttttttgataattttttaatgaataactcttttttagtaaatagtttataataaatataatctgtttttaatagtttataataatttggtgtgtttttctattttttcatcaatttttgttttttaggtgtgtttctctctttttttcacttttcataatttagttttttaatttatcatttctgtgttttttcacaatttcacaaaatcacatttgtgtttttgtgttttttcacattttggataagtttaaataagttcgagtttaatataagaatgattagaagaaaaaattcaattatgcttttttaaattaataattttttattgggattcaa

SEQ ID NO: 3740 - DNA, 174 bp, Methanobrevibacter ruminantium
ttaaaaaataataaggaaagatttattttattaaatcttttctctccattatttttatgtaaattaatatttttgaattaatctcttttttcatagagtttaattattctctttttttattctattttcttattttattttctttttctattttcttattctttttttatggat

SEQ ID NO: 3741 - DNA, 223 bp, Methanobrevibacter ruminantium
aatgtattttcctattcctaatggaattagaaaaactatgatgcttgcaatggtttctagtaagttttcaattattagttcaagcaacaatttaaacaccggttttttagtttaatttttattagtttttattagttttttctgttagttcataagatgattttttgtattatttttttatttagagagctttaatgctttaatttttatactcattaagcct

SEQ ID NO: 3742 - DNA, 498 bp, Methanobrevibacter ruminantium
tataaggaatcagaatcaaaataatttggaaaatccctatttggattttgtttttgcaaattaggtcatatgtggtatctgaatatgtttaatggcattttattccctttttgattgttttatagttctaatattggttctaaaattttctttcttatcctttttgtgccttaatttttatttgtttttaaagaatattttagaattgagtccaaagttttattagtttctataattgaaattattcttatctatactaattattttggaaattattatttaaatcatttattatttaaattagtattattttaattaattaatattttagaaagggtttcgacaagtttaaaaaatagtaaattgtatattttttaagaaaaataatattaaatattgtaatttggattaattattttctaaatttttttcaaatattttattttctaatttttattttctaattaactttatcttttaatttcaatgaggttcaat

SEQ ID NO: 3743 - DNA, 171 bp, Methanobrevibacter ruminantium
tttttttaataattagtaaaattagttctttttctaaatatcaataaattctttaaaaatcaataaaaatagtctttttttataaaatatcaataaattctttaaaagtcaataaaaatagtcttttttttataaaaaataaataaaatgagataataataaaataaacaa

SEQ ID NO: 3744 - DNA, 339 bp, Methanobrevibacter ruminantium
taataatctccaaaagataatttttatgtatatatttttgttttttatctttataacttttttatacaattttttttcttaacagaatattaaaatagatttaattattttgattttgattaaaaataagtgaagtatctttaaatagttaatatgtattaaaagagcttaagatttagctttgaatatgttataaaaataaaaataagttgaaccattaaatctatagttagcgattactataatttaatgattattttttcttttttcttttttctttttttgttttattgttttgttttattcatttgttttattttttgattttgtttttttgtc

SEQ ID NO: 3745 - DNA, 166 bp, Methanobrevibacter ruminantium
gatatcgccttatttacttatctaattatttaattatttttattagttttattatatttttatttctattatttaattaacttagttattaattttattgcttatcattatataaatttataatttttattcttaaatatttctataaatcctaataagcatttaa

SEQ ID NO: 3746 - DNA, 146 bp, Methanobrevibacter ruminantium
tttatctttaagttatttttaaattgttcttctaattgctataggctaattttatcattttatctttaagttatttttaaattgttcttctaattgctataggctaattttatcattttatcttcatttttataataattatcagt

SEQ ID NO: 3747 - DNA, 135 bp, Methanobrevibacter ruminantium
tattccacttttcttagtttttaaagtagttttaaagcaaatctattggattttcttttattctactttttttagtttttaagtagtttttcagttgttttccagtgattatttaaataattcactcacttttac

SEQ ID NO: 3748 - DNA, 84 bp, Methanobrevibacter ruminantium
tttatcatagttttaaattttatatccatacttaacttaattaataagattatttttctattttaatggatatttgttctactt

SEQ ID NO: 3749 - DNA, 27 bp, Methanobrevibacter ruminantium
aaaaataaatattattgctctcttcat

SEQ ID NO: 3750 - DNA, 485 bp, Methanobrevibacter ruminantium
atagtttcctccattaaaagcagatattttgtttttcttttttcattaattatttttactttttatatttttatatttaataaggttttgatggttttttaagtatttttactgtattccttgatgacagtaatttgattttttgatagaaattctcataatttgggaaattttttacactcacaaacactaattatatataaggtaaaaaataaataattaataaatgctatttttataaatattttatattttataagaatttttttaattattcatcattcagttgtgatagtattattgaatggatcattaagattggcggaagtttattcccaaagaaggcaattgaacttgcagattcattaaaaaaccaaagctgcctatttgttattggcggaggagagtttgccaatctgattagaaaatatgacagagaaatagaattctcagaggatgtaacccacgaaacagctattgattca

SEQ ID NO: 3751 - DNA, 169 bp, Methanobrevibacter ruminantium
aataaactgtcttttttattaattcataggtgaacttaggataagtctaggtttttatactcggattttgattaaaataagtctaagttttatgcttggatttaattaagttatcattaagtttataaattaataaatcaaataattataatatatttcggtgatatat

SEQ ID NO: 3752 - DNA, 66 bp, Methanobrevibacter ruminantium
gtttaatttggtataaatttttgtatttagaataattaattatctagaattattggaggaatgatt

SEQ ID NO: 3753 - DNA, 841 bp, Methanobrevibacter ruminantium
ttggattcttttaaatccaattatctattttttttatatttttttaaatttttatctatttttactagttttttaatttatttttattattctttttaacttattctattctttattatttaatataaatatctagttggatttatttttataattaacttattttttaactatttttaattattttatcagttatccatagatattccagttttacatcaatttcacattcttatatcaattttacactttcatatcaatttctcattctcaagtcaatttcacattttcatatcaattttacactttcatatcaatttcacattttcaagtcaatttcacattttcatatcaattttacactttcatatcaattttacactttcatatcaattttacactttcatatcaatttcacattttcaagtcaatttcacattctgacatcaattttacgagatgaagtcaatttaacactttcacatcaattttacgagataaaatcaattttacactttcaaatcaataattacttatcatactaaggttatttttatatataaagacgtctaaactatttattgtattggaactgctttaaaaagcaaaaatgattttaaagaatttttttatggctcggattgtgattctttaaaaagcaatttttaacgaatatttttaatatcctccgttatttatagtttatatgcaaatttacatccttgcattttatctccattatttttttattctttaaaatcctacaaaatgagataaggtcttatgatttcattttctctttttgtattttttttcatcagataatagaataggtaaaaaa

SEQ ID NO: 3754 - DNA, 118 bp, Methanobrevibacter ruminantium
ttaaatggcttttaaagatcttaaactgctaatatgattaataattatattttctttttatttttttattttcttcatttcttattttttttaaaacaatgatttagatagtgatttt

SEQ ID NO: 3755 - DNA, 205 bp, Methanobrevibacter ruminantium
tatttttgaatagttcttggaattcatttattctaattggtggaatttttaatataattgtgtgatgtttttgtgcaaaatatttttttcagtttttcctttttgtgacatttcatttttgcatttttgcatttttgtgttttttctatcaatcattatttcatttctgtgaatttgtgtttttgcatttttgtgtttttgtgct

SEQ ID NO: 3756 - DNA, 19 bp, Methanobrevibacter ruminantium
actttccattgccttttta

SEQ ID NO: 3757 - DNA, 137 bp, Methanobrevibacter ruminantium
gcaatttactttttacaatttactttttaagaaaaaaataggctttgcattgatttttataataattggtgtaaaaaagggtttaaaataaagtgataaaggaaggaaattggcaaatcttgtttgatgtgtaaaca

SEQ ID NO: 3758 - DNA, 55 bp, Methanobrevibacter ruminantium
tttccagatatttaatatctaaaataacatatatctggagatttttttaatctat

SEQ ID NO: 3759 - DNA, 575 bp, Methanobrevibacter ruminantium
tctttccctcatctataaagatttatattaaatatttttaagtaatttatttggaaaaagtttcatttccaatatggggcaatccccttttctaattattacaaaaatataataaatttataaaaaagtaatacttttatataatattttattactgtactattttcttatttaatctttatatgatataaaaattttgctattttttggctcatttttttacaattcatttgtagtattacttttagttctatatgttacaaagagtaataaatatctttaaatatgtattacaataaagttattattactactttgttatttagtattacttacttgaaaaaaacttcatttaagtattacttaatttccttaaatttataaaaatggcttaaatgtcttatttaaggatttaatggggttttatcaaaactttaaaattcattaattcttgagggtttcaatatttgcctaaacttaatgaagttttatgattattgaacctcagggatgtatatagaaaatttgttatatgctcttaacaaggtggtaaaatataaaggagatattttaaa

SEQ ID NO: 3760 - DNA, 676 bp, Methanobrevibacter ruminantium
ataattagggtcttgaaaaaaagataaaataagttttataactttataagttataatagttgaaatttagctcttggagaaaattttagctaccaaatatactaaagaaaataaatttaatagtcattaatctttttgtgaattttgggtttaatgctattaatttatttctttagtttcacattaaataataagttatttaatttaaaaaaggagtgataaattataataacaaattatctaatgttttaatatttatttaattcattatttatttattgttattttctttaggattttatatgattttataagattttgtaagattattataaaattttgtaagattttgtaagttttttaatctttaagctttaaatcttttaaattggatttttctaaaaaatctttaaaaaggtcttaggcttaattttttaattcaattaaagataatcagattaatattttataggttttaataaagcatttgaatgagttttataacttttaattaatcatttaaatgagttttataacttttaattaatcatttaaatgagtttatagcttttaattgtccatataaaataagggcttttacagattagtttatgcatgtaaaatattaatctaattattattaattatttattcaaatcattaatagggtgttaat

SEQ ID NO: 3761 - DNA, 214 bp, Methanobrevibacter ruminantium
agcctagcttttggctattaggtaaataatatttataatttttattaatacagtcaaatttttgccaatttttttgacttgattaataattattttattttttttaatttttcatttaattcttttatttatagttcattttttattaaagcttaaattttattgtatattcaaatttttattgaaattatttatttttatttttggtggtaat

SEQ ID NO: 3762 - DNA, 69 bp, Methanobrevibacter ruminantium
gttaaaacgaagataatcaagtattgaaatgacttatataatgataataattcttttttgatgatttaa

SEQ ID NO: 3763 - DNA, 77 bp, Methanobrevibacter ruminantium
attttacttgttgatttttatttcttgattaggtggtaattttttactgattgattttatatcgtttaggtgttaaa

SEQ ID NO: 3764 - DNA, 207 bp, Methanobrevibacter ruminantium
atatttcccatgctttcattgctttttagttttaggaatatgtgttttcagtattccttttaaattatcttaatttagaggcattgtttagtttttttttaattttccgatttaatttataattttatggttatgtgatttttatataaatggaggaaaaataagatatttttagattttatttaaaaggagaattttggtgtaata

SEQ ID NO: 3765 - DNA, 63 bp, Methanobrevibacter ruminantium
ttgttttctaaataaataaaaggagattttttagtaagctttaatttacttaaaggtgtttaa

SEQ ID NO: 3766 - DNA, 178 bp, Methanobrevibacter ruminantium
ttgttaaacagttaattgagtaaaaagagtttattttaagtagaatattattaaattgtataaaatgagtaaaaagagttattgtttttataaataatttcctttatcaaaatcttttttctaaaagtaaaaatgtaaaattatagaaattaatctataatttacataaaaactaatt

SEQ ID NO: 3767 - DNA, 9 bp, Methanobrevibacter ruminantium
ggctctaat

SEQ ID NO: 3768 - DNA, 28 bp, Methanobrevibacter ruminantium
agttaagaattaaaaaataatattattt

SEQ ID NO: 3769 - DNA, 181 bp, Methanobrevibacter ruminantium
tataattataataagagttattttatttctttttattagtttctttttttccagcattcgtcctttattctggaaaaagaagggttccttgaccttttttattaatgtcttgtattatggggggtatactattaggtaaacctaaactttatatactagtagggagtaaaataatattagg

SEQ ID NO: 3770 - DNA, 303 bp, Methanobrevibacter ruminantium
tttcattttattttatagatgaaaaattggtgagttagaaacttccaaatatttaaaatttaattttattaattttttatttaacatttttttcaaatatttaattttataaatttattagtttatgtctaatttgattcactagtctatgacttaaacttaaatttattttattagtttatgtctaatttgattcactagtctatgacttaaacttaaaaatttcattttgatttttataattaatcaaaaatatgttaaaaagcataaaaacttaaaatcaattacaaaaaggtatacaat

SEQ ID NO: 3771 - DNA, 22 bp, Methanobrevibacter ruminantium
tttatttttttttttttaaatg

SEQ ID NO: 3772 - DNA, 256 bp, Methanobrevibacter ruminantium
ttttttttaattaagttttgatcgtttagctagttctagttctttatttttctttatttgatttaatattctttatttagataatttaattaatttaatcaatttaattaataacttaatctattcattttatattggggactattaaattgaactaaagaaaagctttagtcctagcgttttaatgataaatacacttaaatcaatatattttttattattttcagttgtttaaaaattaatttaaggtgatatg

SEQ ID NO: 3773 - DNA, 473 bp, Methanobrevibacter ruminantium
taaaaatggtatggtatttaaaaacaattttaacttgctcttctttctctttttatgaaatttacctaattaagtctatcattgttcttatttttatgaacaaaatttatatctgtcttatttttcattaattgggaaaatccataattattttttccataatttatcaaatatacttgattttctatttttatctttaattctttattcttaaactaaaataattgttaataaaatgttttaaatttttattacttttaaaaaagtattactttttttattaaaatcaaaggattagtaatacaaaacaaacatttataaatgctttatatataaatagtattgtttatttgtttataaatagcattatctctatattatgttgtttattttgacaaataatggtgaattctgctttctagtaatacttaatcatttctttgttttttaaaaagtattactaaagtattact

SEQ ID NO: 3774 - DNA, 8 bp, Methanobrevibacter ruminantium
aaaaaaat

SEQ ID NO: 3775 - DNA, 11 bp, Methanobrevibacter ruminantium
agggtgaaaat

SEQ ID NO: 3776 - DNA, 468 bp, Methanobrevibacter ruminantium
gtttgttcagactataaaatttattaatttaaggttccattaaattttaaactttttaaaaagcattaatttaaggttttatcaattttaaagttttaaaaagctttaatttaagtttttatcaaatctaaacttttaaagactttttaaaggggcattttgaatttaaccgaactttaaatattagaaaaaaatcttagatattaattatttttataatttttatctaagatcacctcttttctatttctaaagatttaaagtatttaagttaagttaaatgggtaatttaagttttatctttttaagttaggttaaatgggtaatttaagttttgtctatttaagttaagttaaatatttttatttgaaaatctaatatttaattaggaattttaatttttaattaaatataattttaaaaaactgatttttactaatattaaaaaactaattttaagtgattatt

SEQ ID NO: 3777 - DNA, 575 bp, Methanobrevibacter ruminantium
tcattataattatttaatggattaattattatttcatatccaattctattttttatatcattaaaaatttaggtatgcctaaaaatttagaaagatttatatactatgaagaacaacctataattaacaataagtttaggtatacctaaatattattgtttataaaaatataatcatgttgtttattaattggttaataataatctaaaggcttataaaattacacattatgtctcaaatattgtcctcctatctttaggttattattaactttaaatgaattcacaaagcatcattttcttctcatgctctcttttcttttgcgggggttcattgattaataagaacattttgatattttaagaccatttaataacacttaagttataaacaatctccaaaaaatacatagtaactctaatccctgagtttactatgtataatctctttttactatgtatgatttctttttaatcagtttttttttaaattattttaaatttttattcttattttttttttttcaattgatccacattatctcatttatcatcttatccagatttccaataaaa

SEQ ID NO: 3778 - DNA, 337 bp, Methanobrevibacter ruminantium
atttagaaagatttatatactatgaagaacaacctataattaacaataaatttaggcatacctaaattattgtgatattgaataaaaatctgtaataatcttgttaatgataagttctttaattcaagtaaaattgtacaagaattgatttaatcatttattttcttgaattaagaatttattattaattgtttagttaaatgagttttacataaaacacatcattttcttctgcacatttaatcgctcttttctaatgtaagattcagggtccaactaaaaaagattattcttcaatatttaagtaaataattctttattatttgccatcttgaaa

SEQ ID NO: 3779 - DNA, 83 bp, Methanobrevibacter ruminantium
ttctttttttctttttttatagctttattgatttagcgattttaaaatctgtttttataaaaaatagttattgatatcttctt

SEQ ID NO: 3780 - DNA, 64 bp, Methanobrevibacter ruminantium
attttcactttattattttaaaattcaataatagtttgttctcttttattgggattttttttta

SEQ ID NO: 3781 - DNA, 157 bp, Methanobrevibacter ruminantium
agttttaacctatcttttttattatgtttaataaaaaatctttatccattttaagctataaattaaaggtttttaatttaattaattattttttatagatttttttcactttaagctataaattaaaggtttttaatttaattaattattttaatag

SEQ ID NO: 3782 - DNA, 288 bp, Methanobrevibacter ruminantium
tatcaatatatcgcctcataaaaacaattttttgagaattttgtattttaatttcgcttattttcaattaaattattaatttttaattaagattaattttcttagttaatactattttaaaatataatattttttctttatataattttgtaaaatttcagtaattttccattaattttttatctcaaatccaaagttttaattctatttttccatttcgccatcagattttcataaatccacaacctttatatattatgaagttcaacataatattgttgttactat

SEQ ID NO: 3783 - DNA, 28 bp, Methanobrevibacter ruminantium
ctattttttttatttttttctcgatttt

SEQ ID NO: 3784 - DNA, 30 bp, Methanobrevibacter ruminantium
ctttttctaattatttcaaataattagttt

SEQ ID NO: 3785 - DNA, 99 bp, Methanobrevibacter ruminantium
tattatatttatattgcaaaagaaattttaagataagaaatttaatttttataaatgtatttttgtggtgatagtgtggtaaaacattttaatgttata

SEQ ID NO: 3786 - DNA, 158 bp, Methanobrevibacter ruminantium
atagaaggtattgatttaaactctcaatttacttcaaaatagaatttatattctatacttcaaaatagaatttttattctatacttcaaaatagaatttttattctatttattttttcctttttttaatatttattcagttagatttttataatttat

SEQ ID NO: 3787 - DNA, 272 bp, Methanobrevibacter ruminantium
tataattagctccaaaattaaatatatttaaccattaaattgaacaatttttcattcagatcatgcaattcatcttgattttataaaattatattattataaaaacttattaaaatactttatggcatatcatatgaattgcttattcttattaaaatttataaatttatacttcttaatgtgttgtatgttcattttattagcctttttcttatttgttgtctatttattttataaacttatttatatgattaattgacaaattaataatt

SEQ ID NO: 3788 - DNA, 31 bp, Methanobrevibacter ruminantium
ttttaggattattaaatttttaattttagga

SEQ ID NO: 3789 - DNA, 125 bp, Methanobrevibacter ruminantium
tttttttctaattttgtcttctctaaaaaaataataatttgtaattatttatcattataaatcaacatatttatatacttttaacatataaatataatacatatgatagaatggaggaaatctca

SEQ ID NO: 3790 - DNA, 30 bp, Methanobrevibacter ruminantium
ctgcagataaaattttgaaaaggtgattga

SEQ ID NO: 3791 - DNA, 62 bp, Methanobrevibacter ruminantium
ttatgttgatatttggatagatagaatctatcgttatttataatttaagtggagaaaatttt

SEQ ID NO: 3792 - DNA, 12 bp, Methanobrevibacter ruminantium
ggagggtctcta

SEQ ID NO: 3793 - DNA, 10 bp, Methanobrevibacter ruminantium
aggtgttaat

SEQ ID NO: 3794 - DNA, 34 bp, Methanobrevibacter ruminantium
tctgaatcctttgtattttaatcttttaaatttt

SEQ ID NO: 3795 - DNA, 340 bp, Methanobrevibacter ruminantium
tctttttttatttttcattttaatatttatttatttttaactatttttattattttttaacattttttaactatttttattattttttaacattttttaactattttttaactattttttaactatttttattattttttaacattttttaacattttttaacattttttaacattttttaacattttttaacattttttaactattttttaactatttttactatttttactattttttaactattttttacattttctattttagctattttttcatttttaattaattgtcttttaactgcatcaaatttaaatatttttaaaaataatatattacc

SEQ ID NO: 3796 - DNA, 31 bp, Methanobrevibacter ruminantium
atattcaaatttaaaaaggggtagtgatata

SEQ ID NO: 3797 - DNA, 281 bp, Methanobrevibacter ruminantium
tttgaagtttcgtttaactcgctttaaagaactttaataaaccccattattcttgcttattttatatatttaaaccttatcttctttattaaacaattattaaataattggggccatctatttatttagttttattaacgacatttttaaaatttgaataattctctttcttcttatttttcttctttttataaattttaataaattatttaaataaataaattaaatattttatatagattattctaaattattattcttttaattttattcgtgatttt

SEQ ID NO: 3798 - DNA, 117 bp, Methanobrevibacter ruminantium
atttataaaatattattgttgatgattaaattttaaaaatgctcctttgactgatgattaaatttaaaaaataataatttcgatgatttttattgaattttaaagatggggaatttt

SEQ ID NO: 3799 - DNA, 135 bp, Methanobrevibacter ruminantium
gtttatttaaaattagtttttactttttttttttttacttatgtcctgatttaagggtttatttaagataggttctttttttatattccctcaataatttttttcgtgtcgctgctaaatgcaatactaggaata

SEQ ID NO: 3800 - DNA, 213 bp, Methanobrevibacter ruminantium
tttatttgtactcttatatatattttgttttacctaaatttttattttcattagtaaatctttttgccattcattaatcttttcttatttttaagagtatttcagaggcattttcattattccaatcatttttaagagtatttcagaggcatttttattattccaatcatttttaagagtatttcagaggcatttttattattccaatcattt

SEQ ID NO: 3801 - DNA, 344 bp, Methanobrevibacter ruminantium
gttctgtttccattgtatttgatttatattatttataacaatgttatatatttatttttatatttttttatttaatttttagacctatatttttttaattatttttaaatctatttttttttattttttcttagatttgttctcctgaggactttacaagaggttttaaggaatttagaattttgataatttttttcatttcacatatacattgtacaaatgcaggcccctccaaagagaaggagcaaaacaatgagtattgcaattagttttttctttttcattctatcacagattttattctattcaaattaaaaaacttaatttcgattagttttaatact

SEQ ID NO: 3802 - DNA, 112 bp, Methanobrevibacter ruminantium
ttatttactgtttattccatagaaaaattaatttatttctaccaaattaagggttaaataatttcttagcacattatgatttgaattatttctagcacgttaaggtttaaat

SEQ ID NO: 3803 - DNA, 182 bp, Methanobrevibacter ruminantium
aacttagaattctttatttctctatttaaaaacaattacttagttaaaatcagttatatttattctaatttattataagttattataattttttctattttattcaattttattcaattttattcatatttatttaattatatttattcaatttatttaatttttaaaaggatgactttaat

SEQ ID NO: 3804 - DNA, 158 bp, Methanobrevibacter ruminantium
taatcattgttctttgaacctaatgatttcatttctatttttcatttttagattttatgcaagtttaaatagtaagatttattaacaattgttatataattaaatatgatgatatattaattaaagacaataaattaaattgattggaggataatttt

SEQ ID NO: 3805 - DNA, 431 bp, Methanobrevibacter ruminantium
attttttattatccttttaactctttttacttatttttaattatttttagttaatttaagctatttttacctaattgtcttttttagaactattttaagcttattttttgcccaaattgtcttttttagaactattttaagctattttttcttccatattttttaacaatcaaactattttttcaataattttaataatttaaatcaataaatataatcaataattataaatctttaattgatataaataaatttaaaaagatattctaattttaattggtagtgatattattaaagtctattacgaatgcggtccatgctttttaaggcaggcaagagaggcgattgaactttcaacagatgatgaggagcttaaattcagacttattcaagatgtcttatcttatcttggagagaacttctctaaggaa

SEQ ID NO: 3806 - DNA, 91 bp, Methanobrevibacter ruminantium
ttttaatttgcatgattagtttactcaaatcttaattattttttaatttactcaaatcttaattgttttattgtttttaatgggtgtttgt

SEQ ID NO: 3807 - DNA, 51 bp, Methanobrevibacter ruminantium
ttattaagtaaataatcaatcttgcctttatttatctaattttcttttttt

SEQ ID NO: 3808 - DNA, 210 bp, Methanobrevibacter ruminantium
attacttattcctgaggtttttctttaaaattgacttatatttactttaattctttttatttatattgatagtttaaaattgagaaaatcgtttaaaatttgtagaaatagtttttgaataaaaaaaagattttagaataaataataattttaaaagagttctcttattattatttattcaatatttataataatttaaatgacaatcaa

SEQ ID NO: 3809 - DNA, 164 bp, Methanobrevibacter ruminantium
tatagtttgtttatacaaattctgttcctcctttttctttaaaaagttaaattaaatttattttgcaaaataattcttaaaatttttataaaatctatgaattaatattatatatttatataagtatttttatagtatagtttttttgatttaattttttatct

SEQ ID NO: 3810 - DNA, 72 bp, Methanobrevibacter ruminantium
tatatatatttttaaaatttttatttaatatgtttttatcatgactttttaaagcaaatccccatttgatgt

SEQ ID NO: 3811 - DNA, 39 bp, Methanobrevibacter ruminantium
tgctatttaaatcttaatttatctaatagtgtttgtttg

SEQ ID NO: 3812 - DNA, 9 bp, Methanobrevibacter ruminantium
ggtgataat

SEQ ID NO: 3813 - DNA, 137 bp, Methanobrevibacter ruminantium
ggaagctacaatttcctaattttttaattttttctttttttttattaacaaaaatataacattgttatatatttctcttttttcttaagttttttttcgccatgcccttaaaatgcattgatcttatttttcggatt

SEQ ID NO: 3814 - DNA, 223 bp, Methanobrevibacter ruminantium
caagtattctaatatcctattttgtacaattttatatcattttatcattattttctaaattatgaaataaaaatagatatatttatatattaaaagatttctagaattttaattttttaaattaaattttcatttccaattttttatttttaataatatggcatatttttatcatatttccactatttttttatcctttttctaaaataactattaatattta

SEQ ID NO: 3815 - DNA, 615 bp, Methanobrevibacter ruminantium
ggattttaataaaaattttgtcattagtattaattacaattttgccagaattggaaaatcaataaaaaattttaaatgatttattgcaaaatctggatgatcatcatcaatcataataatcacaataattttttcttattatatgctcctaatatcacaaattacttgttatttaatatcagttaatttaataagttaaaatttaaagatttttataaaatataataatttttgcaatagttaatttttatttttgtgactgttgtaacattgcttattagatgtgccatgtgttttatggcgttagtcttgagcaaatgtatcaacattgctatgatgactgctttccacatatggctaaatttatattcataaatttattattatagaatattaatcattggattagtattattatatattcgtgagaacctaagtttaacttagtgtttgatgttggttaagtagatgtggtgatatttgattgttatgtctgtgatgtaatgataaatatttgtgtaatatctcgtctatatttttttatgcgtacttctaagtctcaattgatttcattagtgaaattgacttattttgtattctgtcaaatctgtttga

SEQ ID NO: 3816 - DNA, 165 bp, Methanobrevibacter ruminantium
ggggaacctgcggctggatcacctccttatacttttaatatatttattattcgtatttttttatgtgattattatttttttagtgtgtaattagagtgaaattatacaaatttatgttgcttatatagcaatcaaacactaaatcatctatttaactaagaatat

SEQ ID NO: 3817 - DNA, 316 bp, Methanobrevibacter ruminantium
tcttattctatatataataaatcttttttttggttagtatttttcatttttttgtgcagcaccttttctgtggtggaattgtgtgtgaagggatgatcttttttttgattatctgtgcattagtaaccctactggcactaacaaaccgaattttagttgtttgttatgtattttgttggaaaagtatttttacgcttttatgtgtactgtactttttttcagacattttatgtttgacactggaattttctttgtagtgtttactattatttaactagattgattagtttgagtattatatttttatggaaaatat

SEQ ID NO: 3818 - DNA, 160 bp, Methanobrevibacter ruminantium
ctttattttcttatttacgaaaataattattcttttacgaattctagtgaatatattatcataatgggtaattaggattcggtttggtgtattcagtttagggtgaaaatgtacgttttaaaaaaagattatcaaattttatattgtcatgctcataata

SEQ ID NO: 3819 - DNA, 84 bp, Methanobrevibacter ruminantium
tttttatcaagaaatatttagttttaatacatacgaacaatatatttaaccaattctatctttattatttcatattattatatt

SEQ ID NO: 3820 - DNA, 450 bp, Methanobrevibacter ruminantium
tattgtcgcatcattaatttgactgatgtttatggtccttttatgagggaagctttcgctgtcgatgattagaagaaacccggcattagataggctgcctgtttcgagggttactcgtggaggaaagggtaaactacctgtgaagcaagagagttagtatacgggcaaaatcctttgtacataattagagtgttatttgacttattaatcattaatattaagttttttattaattaacttaatataacttatttcatgattttattgagcgtactatatttatatttttttaaaataagtctttttttaaggaattgatttggcctttttaggtaggtgtttatattttgtatagttttttcagtatattgacttcatttctaagtcttattatataatatttaaaatatgatgaaatcaaaatagtttaatatgaaaatggaaaacttg

SEQ ID NO: 3821 - DNA, 31 bp, Methanobrevibacter ruminantium
ttctaaaattatttggttgaacattctttta

SEQ ID NO: 3822 - DNA, 68 bp, Methanobrevibacter ruminantium
tgggcataaactgcagttaagtccgcacaatgacagcagcagatcagtccgtttaaattttttattta

SEQ ID NO: 3823 - DNA, 457 bp, Methanobrevibacter ruminantium
gatattaaatatctttttgttaagtatataattttaatggacaacacagtttaatatattccagaccatagcaaccttgccatacccatgttataagcgagccaattcgcccggccgacccccacgccggtgcgtaagtggaggcgtgtgtggggaggcctgggtgaatagaattggcgagcactactatagggaggaaccaatcctctccagtcggttctgtaaatcaagcatttgaataaaaagttaaatatcaaacaatcatcatgttccgcccaaccataggttggactgaacgccttgagcataagcgaaaggccataatattggcataacgcactttaaattatctactacttttagtgaaatttgttctataccatacgaacaaaaaattattaaaagtagaagaattatccgctactttttagttaaatttgtttaaaaaaataagaca

SEQ ID NO: 3824 - DNA, 174 bp, Methanobrevibacter ruminantium
ggtaaattctctaataatcatcatttagttagtttaaaaataatgttatataaaatttacattaacaatctccaagataacaatctaatgcaacatatgttgcaaaaatttatatataaccactaccataacaaatattaaaatgcaacatatgttgcatattatggtgattat

SEQ ID NO: 3825 - DNA, 13 bp, Methanobrevibacter ruminantium
aaggtagaatatt

SEQ ID NO: 3826 - DNA, 22 bp, Methanobrevibacter ruminantium
actctttaggggcctgacgatt

SEQ ID NO: 3827 - DNA, 270 bp, Methanobrevibacter ruminantium
tattatcgccaataatatatttgtaaagcatattatttaaatttaacgatattaaagacctatttttttatataactaataatacaattgtatttttagaaataaatacatttttatagggtaatgaataaaaatatagaaaatctgaacgatttcatacataaaaaaattcaggcccctaaatttctttttcaaataatttaaaaaaaggttttactcatggaatatattaaattaggaaactccgatttaaaagtcagtagaatatgc

SEQ ID NO: 3828 - DNA, 131 bp, Methanobrevibacter ruminantium
agaatggaatcaaatttttaatcctttgaggttgaattattcggcactgttgtaaatgaaaatcgatgatttattggatactttagagatttctgttttcggaggacattgttattataataggtgaaaaa

SEQ ID NO: 3829 - DNA, 693 bp, Methanobrevibacter ruminantium
tcatgttacatttaaaataagttttcacataacaaaataatctatgtttccaataataaattcatttattttccactttaaaacaccaaatattttgataagatttatatgaactgatattaaatattataatgtaggagctaaaagtacattatattttgtatagtatacgggcaacaaaaaatctatattatttgggctttatttaacttattattcattaatattggtttaattcttgattaacttaatatacttattttataattttattaagcattatatgttgatatttttaaaaattgagtctttttttaaggaattaatttggtcttttttagcaggtgtttatattttgtatagttttttcagtatattggctttatattcagtgtaaattcttttaaaaatttattggggaaattcaataatctggttttaatataatcagtaattcccataataatcatttcatattttttatataaaataagtaataaaattaatgtggatggaatatgaaaaaaatgatttttatgaactgtaagttttttaatggaatattctaactcttgtagaaaaattaatgataatgtaaaaataaatacataattatatatattatataaaaattatattactatttcgcataatagaaaactaacatgatataaataatgaaaaatagatttg

SEQ ID NO: 3830 - DNA, 7 bp, Methanobrevibacter ruminantium
tgtcttt

SEQ ID NO: 3831 - DNA, 167 bp, Methanobrevibacter ruminantium
tgaaaatcctctccatcaatcaaatttaaaaaattaacttcaaagaaattttattgtgaatgcaaatattttcacatttgcctataataaaaacaatgattttggactatttaaactttgctaaaatgtgaatttttattcacaaaaagtgaataatattaggtgaa

SEQ ID NO: 3832 - DNA, 122 bp, Methanobrevibacter ruminantium
agttataatcaaaataaaagcttttaactatttttgaataaatttagaactaataatttttatatggagattattcttaatggattttagatcattaagtctaatataaactttttttaaat

SEQ ID NO: 3833 - DNA, 144 bp, Methanobrevibacter ruminantium
gtaatatcctttataatttttattatattttaaatcttttgttttttcgaagattatgatatttttcacatcaaaattgatgtgacttcgtaaatgtttagtgcattataataattatttttagtttttatgaaattttaataa

SEQ ID NO: 3834 - DNA, 274 bp, Methanobrevibacter ruminantium
attattcctcaaaattgataatcttttgttttatggggattgtaactaattatttttgattctcttgctttcttttagtttaaacttttttctttatttttccttttagtttaattttcttttagtttaaacttttttctttatttttccttttagtttaattttcttttagtttaaacttttttctttatttttccttttagtttaattttcttttagtttaaacttttttctttatttttccttttagtttaattttttccattactaatct

SEQ ID NO: 3835 - DNA, 280 bp, Methanobrevibacter ruminantium
aagatctcctataattgtgatttatttgtttaaattctattttattagtaattatttttttatgattttgctagtttttgtttatttaattttattttatttttttttaattcttattaaataatctaactattaataaatctgttaattttgttatatacatatttttatcaaaattaaggattgaagtccgattctagattatttagttttctaatctagattaattctttttaaaaaattgcaaaaatatttattttttaaaattcaatttcatatt

SEQ ID NO: 3836 - DNA, 136 bp, Methanobrevibacter ruminantium
tttgaatatttatcctttgaatctgtgtagattgcattaggtagttttaaaaatagttaaataaataattatttaaaaaaaataatcttataattagctttttttttttaaaaaataaaaaggaaattaaatagac

SEQ ID NO: 3837 - DNA, 108 bp, Methanobrevibacter ruminantium
tttttcacctttatgtcctttttatactttaagtatcttataattaaatctttttttactataattatgacttattttgataaagctttttttaactttgatttaaac

SEQ ID NO: 3838 - DNA, 121 bp, Methanobrevibacter ruminantium
ataatcacatttttcttttttgtaattagtaagtataagttctttcagtgtttttttttcaaataataattgtaaattattatttatttagttaattaattattagatcgtttttttttac

SEQ ID NO: 3839 - DNA, 145 bp, Methanobrevibacter ruminantium
ttaaaacgccttttaatagtaaaaataaataaaataattaaaataaattgttcaaatcaaatctattaaattgtgctgattaataatggtttcatatgatttaatagagatttggctttttaaaaaaataaaagagaaaaaagag

SEQ ID NO: 3840 - DNA, 534 bp, Methanobrevibacter ruminantium
tttatcgccttctttatgattgaataaatataattaaattaaatgctttaggatagtttatatcttattattttaaagttctaatttatttgtatggtttttaaagcatttaagttataaaaataattttttaaagtttttataatcaaatagttttctattaaaaagatagtatttgagttatattaatataaattatatattttatcatttattaagttaatgtatataaatgatttaaatggaattatttggttaagtggaattatttggttaagtggaattatttggttaagtggaattatttggttaagtggaattattaattttgttaaaataggtggcaattatttttaaaataattaaaaagagttaggaattattaattttgttaaaataagtgctaattatttttaaaataattaaaaataagtaaattattaatttagtaaaaaaggaataaagaaataaaagtaaaaagaaaaaaaaagaaaaatgatttatttaaaatgctctaatcaaatgttttaatta

SEQ ID NO: 3841 - DNA, 36 bp, Methanobrevibacter ruminantium
agtatactattctctatatttaatattataaaagtt

SEQ ID NO: 3842 - DNA, 6 bp, Methanobrevibacter ruminantium
acttct

SEQ ID NO: 3843 - DNA, 169 bp, Methanobrevibacter ruminantium
tctttttttattttttttaatcaatattttgctatttttatggttttacttatttatattaatttttaatttattttataataatttttaacttatttttattaattttattaatttaatggatttttatttattatgtattaaagccttttttattatttaaaaggaa

SEQ ID NO: 3844 - DNA, 157 bp, Methanobrevibacter ruminantium
tttgatacatcctttttaaatattagttaattatcggttaattattagtttattattgattattcgttgtttatttattagtttattattgctttattattagtttattattacttatttgttgtttatttattagttattattaattgaaacttat

SEQ ID NO: 3845 - DNA, 325 bp, Methanobrevibacter ruminantium
tttagtcacttaaatgattgattttaaatagttcttaaagttaaattaataattcttaatttagaaaatataattctaataaaaatcaaatttaattatttgttcatagacatataaacaattgttttcttttaacattaataaatttgtttcacattcattatatattttgtctgaatcggttcctttttttataactttcttaagttgcttattgtttttttccaattttcaattttccactcaagtttaataataaaactttataagtttataattatataatattaattatctgataattattttgttcaggagattaaaa

SEQ ID NO: 3846 - DNA, 171 bp, Methanobrevibacter ruminantium
ttttctactttttttagttttttttcttatttttatattcttttattttctatttttctttcttttttttgactcttatttttctatttttctaatttttatcattttaattagttcgtatggtataaaattatttttttttagaaattcgttcctatttttgaaaaacta

SEQ ID NO: 3847 - DNA, 157 bp, Methanobrevibacter ruminantium
aattataaaaatgtagtttttactttaatagattataaaaaaagagtttttactttaatagattataaaaaaagagtttttagtttaatagattataaaaaagagcttttctattttaaattattaaaaaatttatttaataaaaaaagagataaaa

SEQ ID NO: 3848 - DNA, 11 bp, Methanobrevibacter ruminantium
aattaattaaa

SEQ ID NO: 3849 - DNA, 353 bp, Methanobrevibacter ruminantium
tgaatcacctaaaactcaaaattattactttctattatctttattaatctttatttttcatataatttaaaggttaatgtttttttttaaatttaaaatgtgtttttcattatttaaaaaggataagtgagttaatatttttataaaaataataattgggataatgtttatccggtctttttaaataagattttaatcagttaaataaaaattaaaaacagatttataaaaaagaaagaaaaaacgaataaaaaaattttctctaaaaaagaaagaaaaaaagtaataaatcaaagatagaaaaaaagaaataaaaaaagggaataaaaagataaaaatttaaataaataatc

SEQ ID NO: 3850 - DNA, 24 bp, Methanobrevibacter ruminantium
tttttcacctcccaattattttgt

SEQ ID NO: 3851 - DNA, 18 bp, Methanobrevibacter ruminantium
atcacccttttattggat

SEQ ID NO: 3852 - DNA, 277 bp, Methanobrevibacter ruminantium
tttatcacccgctaataaaatttgtttttaagttttcactaatcttttcgttttttgtaaaattctccattctttaattaatttttcttaagtgaaataagatatattttaatagtatttaaactttcttattttattttaaaagtttaatatattaaactatatatgtttttatttattctaagaattctcctatatttaaatttactctaattggattaaaatgcttatttttagatatcatatattaattttaagttattttttgcttttttta

SEQ ID NO: 3853 - DNA, 315 bp, Methanobrevibacter ruminantium
agtatcattttatggtggcttttattgatttaatttttcggtttttggttatatttattttataattcatttattttatagtttggttttattaatttcaaagtagtttattttatagtttggttttatttatttgaatagtagtttattttatattttgcttttatttagttcaaattaatttaaatattagtttttacttaaatagtattaaatcaaaaataatattgtgttttaaatattttttaagataattaaatactattgtgtttaaatacttttttagtttaaatatttttttaacgaggatttatt

SEQ ID NO: 3854 - DNA, 313 bp, Methanobrevibacter ruminantium
tctttttttttatctttttttttagcatttctgctcttttttatgttttaggtttatttttttcataattttattcatttttactctttttactctatttattctatttactctatttattctatttactctatttactctatactccttttatttattttagattttgcactgtcatttttattctaataaatattttattggactatttggtctttaattaacctaattaagttttatatgggctaataaagttatatattctttaaaaaattatttaaactaaaaatagaaagataaatctagggatact

SEQ ID NO: 3855 - DNA, 99 bp, Methanobrevibacter ruminantium
aaggatgattgattctttaatctataaatatcaaatctttattttacattggtgcatataagtcttatcttattcttttatttttctatttttttttaa

SEQ ID NO: 3856 - DNA, 218 bp, Methanobrevibacter ruminantium
tttaacaccttgatttgcttattttatgattttaagttttataagttctgttttagtttaatttcaatatttgacatttaattagtttattaaaagaagtaaataaaatagtttaaaaaataataaaaaaagttattttcaatgcttttaatgcattggaaaaaatataaaaaaagaaattattaaaaaagtagaaaagttaaaaaaggattaataga

SEQ ID NO: 3857 - DNA, 398 bp, Methanobrevibacter ruminantium
caaagttttaacctcctacttttttataacaataatctttatatcttaaataatatttaaatatttttaattttagtataattttttcctagtttttaaaatcaatttaatttaaagactttttagacattttagaaacagattaatttgaggaggtttagtttttcttcaagtattttggtaaatttttttagtttttctttaggtattttgataaattttttcttagttttatgtaatcaagtttttggtaaattattttatttagttttaagaaaagtataattaatcaaaaattattataatattagaaaggttctaaatagattattaatgatttttcataaatattcgttataaaagtgatttaaatttaaaataagcacaatgtgataatt

SEQ ID NO: 3858 - DNA, 71 bp, Methanobrevibacter ruminantium
ttctttagtattttttatctaaatagtttatttaaactttttatgcattctacaaacgctgatttgatatc

SEQ ID NO: 3859 - DNA, 9 bp, Methanobrevibacter ruminantium
atatattgt

SEQ ID NO: 3860 - DNA, 29 bp, Methanobrevibacter ruminantium
aataatctaaaaccttttcatcttgtttg

SEQ ID NO: 3861 - DNA, 362 bp, Methanobrevibacter ruminantium
tttatcagttttattgttaattatttaaatttttctttgcttatcaaatatttgtttttggattttataaacttatttgatttattatgttttgatttcattttttaatacttttttaatccatttttgatttttgtattaactgagataaaattattttatttaatttatgtgatgggagttaagcttatggtcttaaaaatagtttgacaagttcagataaagtttattttctaaaaagaaggtcttgaaaattaagcattaaattacttttaaaatatatgattttagttctatcttcatcaaacatttactttatatataatcaattatatattattaatagttgggaatttgatatt

SEQ ID NO: 3862 - DNA, 218 bp, Methanobrevibacter ruminantium
cttgctttttcctatatttatttttataacttaatcgagttaaataaactcttttaaatgattttaaacagatatatgatagaaaataattttttatttaatccttttaaaggattattaaacagataggataataaataataattttttaaatccttgaaggatttttgaacagatatgattatagataataatttttataaggcggttttttaaat

SEQ ID NO: 3863 - DNA, 138 bp, Methanobrevibacter ruminantium
aaatgctagacaaagctaattggggcttaaggattaatccatttcttttaattttataataattgatctatttttattattttaacaaatcttatttttatttagataattttaattcattttaaaggaagttttaaa

SEQ ID NO: 3864 - DNA, 106 bp, Methanobrevibacter ruminantium
atattagtagttaatttttaactgaattctactagataaaagtagttaatttaaaagagttaaatttttatttattttctaaattattaatttttcaggtgttttt

SEQ ID NO: 3865 - DNA, 134 bp, Methanobrevibacter ruminantium
tttaaaaaaggttttatacttactagtggacttagtttaaaaaaaggttttatacttactcacggacttaaaaaaggttttttaactgttaaggacttaaaaaagttcaaatcaattaattaaagaggattaat

SEQ ID NO: 3866 - DNA, 97 bp, Methanobrevibacter ruminantium
gtttaatcttttttcttctttatttttttattaattcattaaaaaatttctatttttctataaaaatgatatattaaacttatgattctttttttta

SEQ ID NO: 3867 - DNA, 91 bp, Methanobrevibacter ruminantium
agtatccgtttagtagtttctataaaaatagatggttttaataattgattgatagttttagttcttaaaatggattaaatctttaattaga

SEQ ID NO: 3868 - DNA, 41 bp, Methanobrevibacter ruminantium
gcgatttgatattaaatattaaaaaaagaataaattaaatt

SEQ ID NO: 3869 - DNA, 240 bp, Methanobrevibacter ruminantium
tttatcactaaaaatacttgtttaaaatgatattttcttatttgttgttttataaagaatttcttctttaataaaaggtttttgtgaattttgggtttaataaagaattattcttatgattatgaatattgttgtttttaaatatattttgtttaaacttaatattatatttatgtttaataagattaagtagtttagtcatatttttttaatttgccgtaaacttgcttttagcggata

SEQ ID NO: 3870 - DNA, 93 bp, Methanobrevibacter ruminantium
ttttgctcctctttggggggggattactccttatctttgctctttaatgataatttatgcttttcattgtctaattatttaaggatattgtat

SEQ ID NO: 3871 - DNA, 274 bp, Methanobrevibacter ruminantium
atgatcactagattttaatttattaatcgattcggttttattccattatttggatttaaaataatttttttctcttatttttaatttttgttaatttaaatatataaactataacaactaatatttatttaagtaaaatatttagaaaatatttaatttatctgtttaaatatttttttcgattatgtaattcttaaatatttaaatctttgagtactatttaattcttagaaatattagttattcttatttaaaatttattattggtgtaaag

SEQ ID NO: 3872 - DNA, 154 bp, Methanobrevibacter ruminantium
ttttatctgtttatttcaaattttatttattttcttatattttaaagactttataaagttcttgaagctatatataagtctttttccttaatggatagtaggaaattttatatattttattaattaatttaatattaagctttgaggtgataac

SEQ ID NO: 3873 - DNA, 72 bp, Methanobrevibacter ruminantium
ataaaatctatttttcatatttttattttttttattctattttttgaagatttgctttttttttattgctca

SEQ ID NO: 3874 - DNA, 606 bp, Methanobrevibacter ruminantium
atgattagatatgattttaaatgtattaaatttttcaacttctgattttattatgattaaaaaaatggcttctgtctaattgatttttcaacattttattttaataattcccataaaaaatcataatttaaaaagggttttttcttatttaataaagcattaaaattattgactttagatatgataattcatatagtgtaagttctaacttaacaaattattaatcataaaatcaatattatgcgatatctttatatattcctttaaacaaatatatcattacatctagatatgtaaatgaatttttggatttttttaaagtttttattaaaaaatcatttaatctaaaattttaaaattttaattcaattacttatcatgatttatatgagaattaaataaattttattaatattttattttcagtgaaattcttatagatttcggatgaaaattttgaaaattttcttaagatcttttataagttttgctgatttgtggagtattgtttttaaaatatcattctttatagatatttttatgaattgcattgcattgcgagttgaattaataaaattatttaatttctattatggagtcgtaaat

SEQ ID NO: 3875 - DNA, 299 bp, Methanobrevibacter ruminantium
ttcttcttctcttacttttttttattttttataattttatctacttttagtaattattttttattttaacctattttaggactatttttttattatcactactttttagggctttttttactttcagaattttcagatttatttttatttaaattttaaatattgcaaaaagtaattaatattgaaaaaaagtaattaaatatcacaaaaaagtaattaaatcattaaaaaaaagaagaaaaaaatgaagatttaattgtgtagagatataaaaatcttcatttgttgtatgggtggtt

SEQ ID NO: 3876 - DNA, 223 bp, Methanobrevibacter ruminantium
tccacgggaatcctgtgcaaaatacctgaataataaatctctttaggggcctgaatttttttatgtataaatcgttcagattttctatatttttattcattaccctataaaaatgtatttatttctaaaaatacaattgtattattagttatataaaaaaataggtctttaatatcgttaaatttaaataatatgctttacaaatatattattggcgataata

SEQ ID NO: 3877 - DNA, 78 bp, Methanobrevibacter ruminantium
aaaaactatcaaatcggaatcagcaaatacaaaatcattccttttatttttccaaaagaaaaattcagcagaacccga

SEQ ID NO: 3878 - DNA, 74 bp, Methanobrevibacter ruminantium
attcatgggaaaaatttaaaccaataaggggcaaaatagaagattttttcaaattattaaaacaaggcttgaat

SEQ ID NO: 3879 - DNA, 307 bp, Methanobrevibacter ruminantium
aatcgtcaggcccctaaataattgtcttgatttgttataggaatatcttttctctttaatttctctttttttaccaacatttttttatttttaggcttcttttagttttttctatttttttattattttttgcagttgaggaaatagttgtgatggggttaaatagcctatgaaaaatagtttgtatgctttatggtggagttctatgaataaaatagtatcttcacttttaatggtggtaaaaaataaaataaaataaaatgttttttattcagttttttttaactaaataatttaaaagactttt

SEQ ID NO: 3880 - DNA, 248 bp, Methanobrevibacter ruminantium
ttctccacactcctaaaatttaagcattttttttacttttaagttttaattaattttaaatctttttttaaacttatataaatattattattcttttattaatttgtttaagtgttttcttgattttattggtgaaatcttatttttttttaagaattttttatgattttttgatgaaatctattttgagtattttgtttttttttaaggtctaatttatttattaagttattttctttacttaagca

SEQ ID NO: 3881 - DNA, 240 bp, Methanobrevibacter ruminantium
tttttatcctcgtaaattatgatttgttcttgttttggtctttaatttctttttgatttaataagtttgaatttttttttaattctacaatcttttggtttttttggtttaataagtttgaatttttttttttaattctacaatcttttggtttttttggtttaataagtttgaattttttttttaattctacaatcttttggtttttttggtttaataagtttgaaagtttttctaatt

SEQ ID NO: 3882 - DNA, 258 bp, Methanobrevibacter ruminantium
ttaatcacctttttaggctaattgtcattttttcattccatttttttattatatttattgttttatttatttaaaactatcttaaatctttgtgctttgtttgaaactatcttggttttttcttctttggcttgttttcttatttaaaattttcataagaatgttcattttttcttattttatctaaggaatttttaaaaaaaattgtccaataataagaatctttattaataataataaatatataattacactagg

SEQ ID NO: 3883 - DNA, 35 bp, Methanobrevibacter ruminantium
tcaattttattatttattgtttaaggagtgattac

SEQ ID NO: 3884 - DNA, 378 bp, Methanobrevibacter ruminantium
ttttattattctactttttttaagaaataacttgtttatttcttttacttttttttagttttttttaagcttttttttatttttctttttatttactttttttaagcttttttattatattctaacgttttttctattttttttaaaataattaattttagtaatttattttatcacttgagaagtataaattctttttttggaaatatttaagttattcaaaaaaagggtattggctgataaaaaaggggtgtgtcaatataaagtcattgttcaataaaaaagagaaaataataaagtttaaggagtttatttgcatccttaaactgtgttttgataaagattgttaaaatagaaaaacatttataaaaagaaaaa

SEQ ID NO: 3885 - DNA, 173 bp, Methanobrevibacter ruminantium
aatattgcctctaaaatcattaaacaagaatagtatttttttatttacataagtacttttctatatgatcgttattttgaagattaaatgttaattcacttaagaatggaaatgtttatgctattttgctttgaagaaggggtgtggaactatttttcttctaggggattaaa

SEQ ID NO: 3886 - DNA, 96 bp, Methanobrevibacter ruminantium
tatttcaccaccttctaacttaaggggttttcatttgtttaattctttttgcaagaaactggttgaaaatattttaaaagtgctaaatcatttttt

SEQ ID NO: 3887 - DNA, 923 bp, Methanobrevibacter ruminantium
ttgtaaataattatttggttctcattatatttaaatctttttctaaaccattatttttaaataaaactcatttattgacatcaaaattgcttttaagttgttaaaaaattgatttcaaaatgtgaaattgttttaatttcgtaacaatattgacttgaaaatgtgaaattgttttgatttcgtaacaatattgatgtgaaattgttaaagttataggtgcggttaaaaccattttattcagttaaataagggtgtttttttaaaatatctatttaaatcatttaaatgttgaaaaaattagttttaatatctgtatttttgttgatatggtttattagaatttttaaaaaaatagaaaaaatagtttaaatcatgaaaatatgataatttggattaaatgctgtctaatttgaaaacactgaaattgatttaagtttgataatctttaaatgaatttttaatcttaatttcattggattttttagcttttcacttcgttaatattactttaggcaactgaaaagatttaataatgtattagaaccataaaatataattagatgtctattccccattctttttttctagagtatggtttagaatagatgggcttgtgaacttgaggtgagattatggatttaaaaacaacagatataatttatattatttgcggtttggccttatttattataggaatgtataaaatcataactggattattttagattctttttttttttaatggatttttcttctccatatcattaaggaatcaaaagattttattattaaatatgatggagaacaatatgctgtttaactaggaagagaacttttgcaggaattaggtgcataattatagaatatctctaattagtgattattaggtctatttaaacatatgtctggctttggaggataag

SEQ ID NO: 3888 - DNA, 449 bp, Methanobrevibacter ruminantium
gggagacactcttgccctttattattctgtttttattaatatttcttattttaaaagcttatttgaattttaatatttctatttttaaaaatactgcttatcttttcttattttataatttaaagatgcaagtaagcacttacattcgaaaaactatttatatgttcttgaataaaataaatattgtgtttgtgttttattgaattggtagatggtcatttttaccatctattgattcttaaccatgtatgcctatattttatttgattagatcatatattgtttgttgattaaattatttggaggtgaaatgatgctttttttaggagatatgggtatgttttttcaaaaatttgatgattttatagctgatttatatttttaaatgacttattaaaaaattcgcaaagatttttttgtgtgattatgggaattaatttcctatttga

SEQ ID NO: 3889 - DNA, 111 bp, Methanobrevibacter ruminantium
ttttatgctttttttgactatttttactagtttttgtactattttagaattattttcgattaatcgttcggataattcaattataatctttttttaaattattataatctt

SEQ ID NO: 3890 - DNA, 513 bp, Methanobrevibacter ruminantium
tattccacccactttatttgttatgcattcaaatattaaaaattggatgaatacgattaaaaataaggttttattttcagtacaatatctgactgaacctttaagcatttgatttggcatattgttctcctaaaattaatttatctcattattctcatcattaagatatttttcactaattttaattttatctgaactgtctaattaaatttttgataatttctagttttaatttatgaaattcataatttcctatctaaatgtttaaaaaaatgaatgtgggattttggttttggtgattttaaagattaaacaatatgatttatccagattgatttaataagaattatataatgagtattaacataatatttatatgaattaattcttaatattcaaaacgcttattttaagaattatttaagagggatttaataatttttctttattaaggtttatttattatttaatgcctatttgcttatttcagattaagttctatggagagttttt

SEQ ID NO: 3891 - DNA, 2 bp, Methanobrevibacter ruminantium
tt

SEQ ID NO: 3892 - DNA, 72 bp, Methanobrevibacter ruminantium
ttttttagactttaatttgctataatcacttagaattctttttttcctttttttaatcaatggaatgataat

SEQ ID NO: 3893 - DNA, 3 bp, Methanobrevibacter ruminantium
att

SEQ ID NO: 3894 - DNA, 96 bp, Methanobrevibacter ruminantium
ttgtaattaatattgaaataatggataatttattaggtttgtttcatagttagttttaattaattaattgcacatattaattaaataggggataaa

SEQ ID NO: 3895 - DNA, 95 bp, Methanobrevibacter ruminantium
ttaaataaatcctttaattcctatctattcattttatctgattttaaaggaacaggtctatttttatttttgttaattttttattttttttttat

SEQ ID NO: 3896 - DNA, 342 bp, Methanobrevibacter ruminantium
ttaaatctcctatttttagttcttattttaattatcttattgattctgcttatataattagttattttttcttttatacttcattaatcctattctttatttaattatatgataatttatttttaggatttataagtgaaataaatattttgttttaatcaaggttttatcaaggttttatcattccttttgtaaaaggattttcaaattttaagatttaaaaaaaatttagaaaaacataaaaccaataaagtaaatataaaaattaacgaattaactaaattggttctttttttatattgcgcaattagtttaattcttaaaaatttattaggtgatctt

SEQ ID NO: 3897 - DNA, 29 bp, Methanobrevibacter ruminantium
ttaatttggtttttttattttttaattca

SEQ ID NO: 3898 - DNA, 57 bp, Methanobrevibacter ruminantium
tgtaattcctgaaaaaggattaagaatattttttaaataatctaggagggtgggaat

SEQ ID NO: 3899 - DNA, 198 bp, Methanobrevibacter ruminantium
ctaatttattatcaaattggtattattttcaaataagtttttatttaagaggtattattttcaaataactttttattcaaaggagtattattttcaaataattattttttttttttattaaaatggattttttaaataagtatttttattaatcactaaatcaaaataactattattagaattattaaggggttttta

SEQ ID NO: 3900 - DNA, 2 bp, Methanobrevibacter ruminantium
tt

SEQ ID NO: 3901 - DNA, 121 bp, Methanobrevibacter ruminantium
ttttttttattgtctaaatttcttttgatgggtaaattgattctttttctttttaagtaaaaatagttgtttttttttttaaaaaagatggttaaatattcaattgaaaaaaaagagaatt

SEQ ID NO: 3902 - DNA, 74 bp, Methanobrevibacter ruminantium
tttgaatttttattttttatatcttattttgattttaaggattttccttcttctttgctgcttttaatttagaa

SEQ ID NO: 3903 - DNA, 426 bp, Methanobrevibacter ruminantium
attgaactcctctttacagacggggcatttgattggtatttcatttatagtggtcaatttatctctcctttaagtggtttttaaatatgtaccttgattatagacatgcttgcttataaagttttcttaatttgattttttattataattaaattaagtttttatgatttttatggattaaatttatatggtgtggcttttatttttttgggcattatatgtagtggtttttaactattttggctattataggtgtggcttttatttttttgggcattatatgttgtggtttttaactattttggctattataggtgtggcttttatttttttgggcattatatgttgtggcttttaactatttgatacaataattttatatactaggacttataaaatatacctaacgaacggtaggtaggtaac

SEQ ID NO: 3904 - DNA, 86 bp, Methanobrevibacter ruminantium
tgtctaataaatttataatgaaattgatatgttctctcgaggtgaaataatggagggcatttttaaaataatttggagggaagttt

SEQ ID NO: 3905 - DNA, 248 bp, Methanobrevibacter ruminantium
ttagtttaaattatagtaataaagaaaattttataaaaaaagatttaaggggaggagaatttaaaacttaaattaagtttaaattcacttaaatctactgcataaaccattcctgcagtgaagattagaatcattaataatacaattattcttgagattttcataagaaacaccatattataatatattttgtaaatatttaagttaactaaatataattgattatataaaaataaaatggttttttt

SEQ ID NO: 3906 - DNA, 30 bp, Methanobrevibacter ruminantium
tttattttattaaacaagggaagagttaaa

SEQ ID NO: 3907 - DNA, 266 bp, Methanobrevibacter ruminantium
ttgagttgtactcatattttttattcttttctctttttttcatttttttaataatttttattgttttagtttatttgctgtttttttatagtttttattctttttagacaatttgctgtttttttatagtttttattctttttagacaatttgctgtttttttatagaatttagttaataaccaacttttttttatgagtatttactcattttcaataatgggctgcttttcacaagactattcttatctttatggctttaataaa

SEQ ID NO: 3908 - DNA, 399 bp, Methanobrevibacter ruminantium
ggtatccctttttttaaactttaatcttaattattattttgttttttatttctcttaatttttactgatatgtttattttcttataggggattagttaaattatttgtcatatggcaatattgcctttattttagtaaattttgctatcttcacatcaatactgaattcattttagtaaattttgctatctttacatcaatactgaattcattttagtaaattttaccatctttacatcaatattaatttagatatgtaaaaagttattactttcacatcaaaattctttcacttttgtagcaattttgactcaattagaaagttttttatataacttaatgaaaattattaattatgtatttgttttggaatttttttttaaaacagtactttcgaac

SEQ ID NO: 3909 - DNA, 308 bp, Methanobrevibacter ruminantium
taatcttaattgttctaaggcataatagaggctttatggcttttatgtgattttttagatgatttatgatgaaggcattttaatagtttttgagtttgaaatctttgatttgttaatttttagctatctttttagttagggatttatttaaacttgggtattttttatatggagattattttactgcaagtattttctttattttttaggaatttattttatttcttaaaactgttggccttttaaagtttgataaattttcagattattttttgtttttttttaaaaaattagggagaagaattaag

SEQ ID NO: 3910 - DNA, 231 bp, Methanobrevibacter ruminantium
aaaatctctttattcttttttgggttttttttgagctactatggtttggtagtttctggttcttttcggtggtttggtagtttttggcactttttggcactttttggcactttttggtggtttggtagtttttggcactttttggctactttttggttattttggtgttttgatattttttggcactttttggtggtttggtagtttttggtcttttacggtggtatgata

SEQ ID NO: 3911 - DNA, 160 bp, Methanobrevibacter ruminantium
aaatttaaatggcttagacttgttcaaattctttaatttcttaaaaagatagtttaaattcttttaattctttatttttcaaaagaatagttcaattgttttaatcgtttatttgcaaaaatagtagttttaaattgttatgggttaaaaaataaaaaaa

SEQ ID NO: 3912 - DNA, 96 bp, Methanobrevibacter ruminantium
tttgtcttatgcctgtttaaacttaattaaagttttaaattatcataaaaacttataattaaagttttataaagttcttatttaaagaccctaatt

SEQ ID NO: 3913 - DNA, 200 bp, Methanobrevibacter ruminantium
tagtatatctccataaatgtgatttttttatttaattaatagattttggcttttaagtattctttttacggttttttaaaacgtttttttttatctttattttaacgttttttttttaatgattatttttttctgaatctttacgttcagttgattttttttatgattattttttttctgaatctttacgttcagttgat

SEQ ID NO: 3914 - DNA, 77 bp, Methanobrevibacter ruminantium
tctttagcctctattaattttataagaataatttatttaagattttttaattaaagtaaaataagtttaaaagagaa

SEQ ID NO: 3915 - DNA, 240 bp, Methanobrevibacter ruminantium
tgtttaaccccttataaattaccttgtgtttattatatgtctattatttgcttatattacatttatattattatattaattccattattctttttatttcttttgatatatgttattaatcttattcaattcaagttttttattttttttaatttttgcagttttttttattcaaattttttatttatttttttagtccaagttcattgctaaaagtatttatttctctttttttaaaaa

SEQ ID NO: 3916 - DNA, 131 bp, Methanobrevibacter ruminantium
gttatcttttggattttttcttttgaataaatgggttataattctttattgaatcgtatcaagatttatgatttgatttttattgtttttattgtttttattgtttttttttaaaaatttattaaaacagc

SEQ ID NO: 3917 - DNA, 76 bp, Methanobrevibacter ruminantium
agcaatccccatgtaaattgtcttaaaaattatttttatttgaatctaattgtttatatcacttaatcttagctat

SEQ ID NO: 3918 - DNA, 35 bp, Methanobrevibacter ruminantium
gtttaaaattagttttttgctcaataggtgatttt

SEQ ID NO: 3919 - DNA, 125 bp, Methanobrevibacter ruminantium
tttactttttttttttattttattggattatttgtggtcttttatttgctttttttattagtttttcacttgattttctaaaaatagttatttcgttaaatttttaaaaatccttttttaacctt

SEQ ID NO: 3920 - DNA, 13 bp, Methanobrevibacter ruminantium
ttaaataaccttc

SEQ ID NO: 3921 - DNA, 349 bp, Methanobrevibacter ruminantium
tatttgaatgattaatctctttcttttactttattctttttttcaagttctatttttttaataaggtaggatttttatttattttattatatgaattctattttttttagttatttcatttctgaatttcaatttcagtatctgttttttgcattttagtatatttattctgcttcttgtttttctctaattcatttcagtatctaatttatgcatttcatcaatcaaatcatacctcttgttaatttggataactatgcatttatatagtattcaactaagtaatattatctaaaaacaaatggaatttcattatacttttagtaaaaaattattttggtgttaaaag

SEQ ID NO: 3922 - DNA, 279 bp, Methanobrevibacter ruminantium
attttttaatttgttaaatatttcttttattgttttaatgattattttgcagttaaatattttattaaattgataattttgcttcgattttatatattattgtttttatatgatctattaaaagttttatttcattggcaagtgctataaatttcaatattggacaatcattccgataattttttaaacaatcaagataaaaatatctttacttatttaatataagataaatttaagataagttaaaaaatattaaataaatgtaaagaggttttaaaa

SEQ ID NO: 3923 - DNA, 89 bp, Methanobrevibacter ruminantium
tacaatgatagtttataattctaattgctaagcaaaatggttcataatcctttaatcttttattttttaatttaaattgtggtattgat

SEQ ID NO: 3924 - DNA, 19 bp, Methanobrevibacter ruminantium
taatggtgattttatgaaa

SEQ ID NO: 3925 - DNA, 290 bp, Methanobrevibacter ruminantium
tgatttataaattattaattgttattaattttatagaaattttcagatttttaaaacaatcttcgttttatgatttttataaaattaactatctattgatgaatggcaatgaagattataataatccttaaagattattagtgtggcaggaataaattcattaagagatttaaattttcattatttgtaataaaaaaagtatttcattaaaagatttaaattttcattgatagagattattaattaatattcaagattattaaatgattttaaccttagaggtgttttag

SEQ ID NO: 3926 - DNA, 149 bp, Methanobrevibacter ruminantium
ttttttatctttattttggttatttttcagttaatttttatggaatgcttattttatttgattttcataattgttttatatcttacaaacggttaatcaaattatttatattctttttttgtcttagaaacagttgttctaattattaa

SEQ ID NO: 3927 - DNA, 172 bp, Methanobrevibacter ruminantium
agttttcctcaaattgatttataaaaaaattttattattcatttttcctaatcaatttttctcactgtctttcttattaatttctatgggtaaataataaattaacaattgttatataatttatattatttaaatttttctatgaattttaaaaattgaatataaaaataat

SEQ ID NO: 3928 - DNA, 3 bp, Methanobrevibacter ruminantium
gat

SEQ ID NO: 3929 - DNA, 142 bp, Methanobrevibacter ruminantium
ttttatatttttttagcctattaatttgttttataacattcgaactatttttatatttgattgaagtgctaatatttgtttaatagatttaaaaagagagtatttctaaaaatagtaattttgagttaaaaatagcttaaaa

SEQ ID NO: 3930 - DNA, 710 bp, Methanobrevibacter ruminantium
atttttctcatcataaaaaaacggagttgaaataactcttatgtaatattatattcttaagatatataatgtttacttttttgaaggaaagagttaccctataaaaaatattaaaacaattatcctttttaattcaacagccgggttcttggttatttcaggaccattatgaaaatttttaagatctctaatgaatatcctaatatatcttcataatggtttttaaagatatcaaataaatatttgaagaaatcttttagttgacatttcatttctatgcctccatttttttatttttttgatgagaatatttttttgcaggcacaaaaaccttcaaatattattttattttaatattaaataaatattttggtttatttcgcattaaaattgattttaaagtgttaaattgttgtcatctcgtaaaattgacttcaaaatgtaaaattgttgtcattttgttaaattgttgtgggaatgtgaaattgatttgaaagtgttaaattgttgtcatctcgtaaaattgtagtgggggtgtgaaattgattttaaagtgttaaattgttgtcatctcgtaaaattgtagtgggggtgtgaaattgattttaaagtgttaaattgttgtcattttgctaaattgatatgaaatggctaaattgatgtgaaaaaaactatgccatttattaataagtaaatctagatattcaaca

SEQ ID NO: 3931 - DNA, 47 bp, Methanobrevibacter ruminantium
ctaaagtctagagaaatatttttaagtttctttaaattttcaaggag

SEQ ID NO: 3932 - DNA, 278 bp, Methanobrevibacter ruminantium
ttatctttaatttattctcttataatttttctagttgaacggtcctttgataattggattaatcattttttctagttgaatggtcatttgattattggattaatcatttttttctagttggactgatattcgatttttggataaaaaatattaattataaaattaaaaattaatttaaacaaaactttaaaagaactaattataagaattctttattaattaagataatcagttaaaattagttaaattaatcaaaatcaattttaaggagagttatg

SEQ ID NO: 3933 - DNA, 177 bp, Methanobrevibacter ruminantium
ttctttaaactttttttaaattttattttcttcatttaattctgattttaaaaaactattaatttaatgaaaaataaataaagaaatagttaggaaaaatatttgatttcaaaaagttaattttaataaaatcattattttttaaaaataaattatcatattcatggagagattaat

SEQ ID NO: 3934 - DNA, 341 bp, Methanobrevibacter ruminantium
tctgccttatttttttatttaatctttttttactttttctcttttcttattttttttttacgttatttctttttttcatttttcttttttcactgtttttagtttattccttttttaatattcgttctaatcattacgaatcatttcatttttctttttatttttatattcgtttcattatttgcgaataattattctagtttttaaaaattaaccttgttattatcaatgttattgtcagattctccactatttttttatggctttttagatattacattgatattatcaatttttcaaatattttttgctgtaaaattttaaaatttttccattacctc

SEQ ID NO: 3935 - DNA, 227 bp, Methanobrevibacter ruminantium
tatttatattagcaaatagacatataatatataataggcttaattaatgtcaatttgtttacttgaaatgaaattttccctaatctcaagtacataaattcattttccaagttaataattcattagtgtataggctatgtagatatcaaattaaaggatttttatattgttttctagacaagcaaaacaattctgtttcgatttattaatgtttaatggtgaaaaaa

SEQ ID NO: 3936 - DNA, 174 bp, Methanobrevibacter ruminantium
ttcaattgcttcttaaaatatgtttttaattattgattatttttaccatatcctttgattatagtctatataataaacgtatttctttgtggaaacatattttaaagtaacttctttagaacttttattattatttttttatatactattttttaacaatttttcattcaacta

SEQ ID NO: 3937 - DNA, 179 bp, Methanobrevibacter ruminantium
attaaataaagattaataaattatatagataaaaaatttaataatattttatatttcaagattaaaaaaatattataatatattttttttaagattaaaaaagtaaacttatcttttaaatatatttttaaacttctaatttgatttaaatttaaaaacctttaatctatggtgagaat

SEQ ID NO: 3938 - DNA, 67 bp, Methanobrevibacter ruminantium
accactttttatggtacatagattaagtttttatggtgcatagattaagttattattaggtgaaaag

SEQ ID NO: 3939 - DNA, 186 bp, Methanobrevibacter ruminantium
aactaatttagatggaatttattaaattatttaaattttaattgtttattgaattgtatttatttaaattttttaaatttttatcgtttattgacatatttattaaattatttaaatttttatcctttattggattgtatttattaagagtttattaaacagatctttatctttagaggaattatt

SEQ ID NO: 3940 - DNA, 34 bp, Methanobrevibacter ruminantium
taattctttgatgggtttaaaattagactcaata

SEQ ID NO: 3941 - DNA, 64 bp, Methanobrevibacter ruminantium
taattaatttttaattgcttatttttaattttattttattttatttattttatttacaatctgt

SEQ ID NO: 3942 - DNA, 293 bp, Methanobrevibacter ruminantium
tatttcaccattctttaattgaaataagtttttaagtaaatttaattgttaatcattttttgattcttatcaaaactatgattcatagtttaatctatatttcagattcttatctacattggttcatagtttgataatttgtaaaaatgtttaaatgacatatgatatgatatggcattgacatatgataaaaaatatgattatgcattataaggaacttggatgaaattaaaattgtattttttcggatttgattaaaaccaagcaccttataatatattaattatatctaa

SEQ ID NO: 3943 - DNA, 59 bp, Methanobrevibacter ruminantium
actcaagcttttttggccttcggccaaaaaaccttgaccaaaattccaccttttactgg

SEQ ID NO: 3944 - DNA, 57 bp, Methanobrevibacter ruminantium
gtcgtgtttattatttttaatgaagatttggaatttaaaggaaaaaatatatctcgt

SEQ ID NO: 3945 - DNA, 158 bp, Methanobrevibacter ruminantium
agaacatttatggaaagtgttttaaatatcctattgttatattatatattgtagatattttttaaatattaaattcaatatcattttaattatcaattttttaattttcaattaaaatctattttgtatttatttttttatttttttaaggtgaaaat

SEQ ID NO: 3946 - DNA, 295 bp, Methanobrevibacter ruminantium
ctcaagcttttttgagccttcggctcaaaaaaccttgaccaaaatttttatctcattttgcttgagatttgctattttttgctagtttattttttaatgctcttaattttttcattgcttaatcttatttttttagttccttgcacaatttattttttaattctcttttttgactttagttaattttaaatattttaaacaaataaaatttatataactattgttataattttttataaattattatgcttattttaatttttcttaaatttagtcaaaaaagagtggtgattaa

SEQ ID NO: 3947 - DNA, 42 bp, Methanobrevibacter ruminantium
aatatttccatctatcaatattttatggttctctcattattt

SEQ ID NO: 3948 - DNA, 207 bp, Methanobrevibacter ruminantium
atcaattctcctttctttaaattctttacgtgaaattgcatgatttttcatgaaatcgcatgtgatgtataattttgtacattttattctattgtttgtacataataaaacaactttttttcattggatttttctatatttatttttgtttttctatattttttctaaggtcatttttttttttttttttattgtggattaaagaat

SEQ ID NO: 3949 - DNA, 20 bp, Methanobrevibacter ruminantium
aggattacctcgtttttttg

SEQ ID NO: 3950 - DNA, 11 bp, Methanobrevibacter ruminantium
aattggaagat

SEQ ID NO: 3951 - DNA, 46 bp, Methanobrevibacter ruminantium
tttttttctaatagtctgatttaattcttattttttttatagtttt

SEQ ID NO: 3952 - DNA, 323 bp, Methanobrevibacter ruminantium
cttaaattaaagaaagtcttagttaatttaatataatcatttgaatcatgataattcgtgataattcgtgataattcgtgatagttcgtgataattcattatagattcatattaaatcattaaatcatttttgattattattttatgaataactgctttcgatatttatttttatttagtttttatacaattataggtgggattttattactgatcaatcttcacatccatttagggaaaaaacggatagagcaattaaaaagagacctccatggaaggagtataacctccacattgttgtcttccttttggttgttatctcc

SEQ ID NO: 3953 - DNA, 133 bp, Methanobrevibacter ruminantium
ttagcttaatggggtctttaaaaatagtttttgctttagctttttttatatatttttttatattttttaattccaaaaatttttttaaatttttaattttgacattttaatcttattttaaaaaaagtaaaaa

SEQ ID NO: 3954 - DNA, 55 bp, Methanobrevibacter ruminantium
taaaattgtttttcttcttattttatttttcagactttaacttattctagttaat

SEQ ID NO: 3955 - DNA, 2428 bp, Methanobrevibacter ruminantium
tttagaatatcttaaaccatttttattataataattcttattattatcattattcttattgccattgctttgatgattgtttggattattggacttattggagtcatctgaatcatcagtaacattatctgaattatcatttgaattattcggattatctgattcatcattggagtcatttgaatcgtctgaatcctcggaatcatcatccgattcattgttttccaaaacatctaagctgacaatctcattatccaaaattgcatttactgtctttgcaagcttcatatcagttgaagtggaagctgaaccattaacaatattcaaattgtacttaattttactgtcttcgcttaccacttgaatacttgattttaaaataggcaatttatctggattctctaatttgaagctattgttgtttttatcctttccattaaggcttatggtcaaattagagacctttttttgcataaggggggttgaattggtaaaattcatttcaatccatttgaagtcttcatcaatattgaagtttaagagttcatcaaagtttggattgttttctccccaccaattattgcttattaataagtaatctccgctatcataaagcccatctccctctggagcggaattatccaatatttggcaatactctatatttgtatcttttctagagataatggctccgccgtagttttgagcggtattgtttactagaacggatccgctcatataaagcttgccattattgtcaatcgcccctccgttgtttgtgaccttattgtttgtgaaagtggagtttgtgacagtcaaatctcccccattgtcaattgcacctgcaccaaatgccttgtttctgctgaataaggagttttggattgtcatgattgcgctattatcaattgcagcaccataacttaaggcattgttcaatagaaacagtgaggagtctataaatatattcccttctcttgtaaagattactccgccttcatctgctccgcttgtttgcttaaatatggaatctttaatcttaatgtttccgtttacgcttaagatgactcctgctttgtggcttacagattgtttggtaaagttagagctctctattaaaaagtctcctaagttatagattcctgcagcttcataggctttatttgaatcaaaagaggatttgtttactgttaggttcttttgattatagattgctccaccgtaattggcttcatttgagtttagggtgcttttttctataatcaattttcctttattgaatattgctcctccagtttctccagagttgccatttaaggtggaatcacttatttttgctgatatgtctcctatgaagactccgcctccggaatttccattattgtcctttatattagtgttatggatttctgcagggtgcttgtcagcatagattcctcctccattgcttttagcattgttgtttataatggaagagttatttacagtcagataagcttgctttgcatcaattccccctccaattttagcattgttgtttattatggtggaattgatgacaatcaatctgctgtctgcatctgcaaaaaggcctcctccttcatctgcatagttgttttctatcaggcaatcatttacagtcatcttaaattcaaaggtgtataatcctcctccgtacatgtctgcagtattgtttttgattgtggaattgtatatttcacagcttccccaatttttaacagtacctcctaattggcttgcagagtttaagaacatctcacaatcgtatattgatagggttccatgattattgtagataacaccgccacgagctcccttgttaaaggaaaaggtggaattagagatagttagctttccaatattattgtaaatggctcctccgtctccattgcatctgttgcctttgaatgtggacttggatattattgcatttgcattttccaaatccaaggctcctccaagaagtccgctattgttttcaaagagactgttgtatatttcaatttctgagccttcagaggagtatactgctcctccgccagcattattgtttgaaattgaacagctatctatactcaatagtccattgttatagatggctcctccatcctcataacttgtatttccattgataaggcttaatccataaagatttaattgaattcccttattaatgataaatatgtttgatttggagtttccgtccagtattgtttttatgtcaagatcggataaatttttatagccatatccataaatatttaggtttttatttatgataattggacttccattgcctatatatgttttgtcttctaagaatattgaatctccatctttatgactattgatcaactcttgtatatagttaaaatcattatttgagtttccatcatttagtttttta

SEQ ID NO: 3956 - DNA, 183 bp, Methanobrevibacter ruminantium
ttcatttgttttaaatcttatttatactatattatttgattctagcaattttttaatctcaatgaatttttttaatctatttttttaatcttaatctatcaacttacttttagacttgggcttaagtttaaacttaagtttaaaatataaatcttattaaatagtaagaataaaaataagatt

SEQ ID NO: 3957 - DNA, 463 bp, Methanobrevibacter ruminantium
taaaagatgatggtctttttgatgaaaagtccaataaggaatatgttttaaaaattaaagaaattatatcaaagataaatattatctatgacaaggatttggatgatttggctcctcaaatgcgtccttctcaagtgacaattaaattcaaggacaattcaagggatagcattaaacatactgtctattatcctttgggtgaagtggaaaatccattaagcgaagaggatattttagaaaagttcaagcttttaaatcctaagtttaatattgataaattacaaataattaaacatatggaagaatattcaattgatgagctttttagggagctagatttgattgattagaatttttaaacaactagatttgatggattgaatttataaacagtttaacaaattatatttttataaaatttcatatttcaattattttcataattttacaaagtgattatatg

SEQ ID NO: 3958 - DNA, 108 bp, Methanobrevibacter ruminantium
aatttaacattttattagattatcagattttcagattatcggattatcagattatcagattatcagattatttacttattgcaaattgttctaaagagatgtattttt

SEQ ID NO: 3959 - DNA, 374 bp, Methanobrevibacter ruminantium
aaatctctttttgtttttatcttaaaaattctttgcatatttgcaaattaatttttttttttgattttttgtatttttctaaatttctttttttctagatttctattttttctatttttatattttttattttttgttccatatcatatgaattgtttcaagcaagcaaaactttttacttctattgtttgtgatgtagcagatagttctaatccataaaaacttttcatttgttctatattgtcctaattgtttatatttaactaaactattctgttttattcaataaaaattgttttatgactataaaatcaactgttttccattaaattttttaatactttcctatataattatctgcccatatatatctg

SEQ ID NO: 3960 - DNA, 166 bp, Methanobrevibacter ruminantium
aaaatttttaaaaaaattatcaattcttttaagtttattattttgcaaattgatttttctatatttgacttttaagtttattattttgcaaattgatttttctatatttaacttttaagttttctaaatccaaatttgaattttcaaaacctgactatgtgatact

SEQ ID NO: 3961 - DNA, 158 bp, Methanobrevibacter ruminantium
tcatatttgtgaaatgtattggctaaaataatttttctgcaattgaatataattcatggaaatttattaaaatgcttgattttaattaaataatcatatacttgattttaactaattaactacaaatcattataaaaatgcttttaggagtaatttat

SEQ ID NO: 3962 - DNA, 101 bp, Methanobrevibacter ruminantium
attaatttaatattttaatttattggtaatctgtaaagattaaattgttttaattctttatttttattcctttttagttgattgtttgtttagatgataat

SEQ ID NO: 3963 - DNA, 180 bp, Methanobrevibacter ruminantium
aaatattcttataattatttatacttctttaacaaaaagtttaatatatagaattttatgaacttattgaatttattgaatttattgaatttgtttaatttattcattatagaactttttgaacttatttaagttgttttattttaaattattaaattggggatattaatgaaatttaca

SEQ ID NO: 3964 - DNA, 299 bp, Methanobrevibacter ruminantium
tatttttctattttttttaactttagttttcattttagctttttttcaactttttctattttattatcttatttttcaaaattttcataggtgttttaaaaaaatttcatttcatattttacgaacttttttaatagattcttcaagtttttccctgaaatttaccttaattttcccttaattttcccttaattttcccttcaaatttttatgaatatttctcattcaaaggactaatttttccttaattattttcatgctctttttcaagtgatattatcatgttattatcatatttt

SEQ ID NO: 3965 - DNA, 17 bp, Methanobrevibacter ruminantium
taccatggtgatttatt

SEQ ID NO: 3966 - DNA, 9 bp, Methanobrevibacter ruminantium
tgtgagata

SEQ ID NO: 3967 - DNA, 375 bp, Methanobrevibacter ruminantium
tcaaaatcaaatttactagttattttatttagaaaaacttttaaaatctgtaatattgaaaaatttaattaaatttttaaatgaaaataaattcaaatgttcttttaaaggtttaaaacttaaagatttcaatatgatttcattcaaattaaaataattatttggaaatgataattaattttaatttaaattaagcaaatgcttaaaataagaactttacgttctatttaaagaaatataattaacaattatatttaaattcattaaaatataattaaaaagtttaaattatatttaaaatcattaaaaatataattaaaagtcaaattatattttgttacaattttattaatcaatttataggagatatattat

SEQ ID NO: 3968 - DNA, 12 bp, Methanobrevibacter ruminantium
gaggtcaattta

SEQ ID NO: 3969 - DNA, 11 bp, Methanobrevibacter ruminantium
gaggatgaatt

SEQ ID NO: 3970 - DNA, 2 bp, Methanobrevibacter ruminantium
aa

SEQ ID NO: 3971 - DNA, 139 bp, Methanobrevibacter ruminantium
gtctgatatcttgaatttaggattaattactcaattggagagttattctttagattcaaatcaattattctattaatatttttcatttttaataagttcatcatgttttatgttgaaatattatctttaggaggatagt

SEQ ID NO: 3972 - DNA, 51 bp, Methanobrevibacter ruminantium
aattaaatacaaacgttttaaataacaaaaagacttaagaattaaatgcaa

SEQ ID NO: 3973 - DNA, 316 bp, Methanobrevibacter ruminantium
ccaatctcaatttaaatttgttttttagagatttataaagcatactttatatattataaaataaaaaatatagattattatatattaaataattaaaccaatattatttaaataatagattgttaattattattaaattaaacaataaaggtttagttattgtaatttttctaaattattagaattttatattttcttattatggaaactattagattctaattattcttagaaaaatagcagttgaaattcatttaatggaggataagtattgaaaaataagatcttaatatccttttctcttattcttttatta

SEQ ID NO: 3974 - DNA, 431 bp, Methanobrevibacter ruminantium
ataaaattaattaaaattttcgggtttaaatagaatttttagaaaaaatctttaattgattatttattaatttcaaaggaattaattgatttcaatgaatattaattaatttcaaaggatgtccattttagttttactttaatttgtaattattatagtttttctaaaataattcttttaatccttcttttatttttttaaatacttgtttttgttctgtttttgtttttcaaatcatatttaagtaatttttttatagatgtattttaaattaatagttttagttcttgatagttttacttaatattaataatcattgagtaattcattgatttatttaaaaatattaatttaaaatatgttttttttacaagtgaacatatctattttatttaatcaaaatttttatattctaaggaggtttaattttt

SEQ ID NO: 3975 - DNA, 36 bp, Methanobrevibacter ruminantium
tatttgtttagttggctttattagttaggtgttttt

SEQ ID NO: 3976 - DNA, 140 bp, Methanobrevibacter ruminantium
ctgtttttttaatccctttttcaatcattttttattttattttctttacgagaaaagtttaaacttgaagattttttttcagaatttgaaattttagttaagtttatatataatgttttacatattataatatgttgtat

SEQ ID NO: 3977 - DNA, 19 bp, Methanobrevibacter ruminantium
tttttttatccaagactat

SEQ ID NO: 3978 - DNA, 299 bp, Methanobrevibacter ruminantium
ttttactttttttcacagattttattgattttattaatttgatttttttatatttgcattttaattagtccattctttgttttacttatgtcaatttttcattattctatttttaaatctttataaaacttttattccctaaatcaattctataatgagtttttttaaattttatcaaaacaatttatatataattttatacaaaataataatatacttaattttaaaagttttattccaattcaaaaagttatttttatggaggcattttaattttaacttcaaaactagctatcctt

SEQ ID NO: 3979 - DNA, 136 bp, Methanobrevibacter ruminantium
acatttataaatagtttcatgtgatttttgaatcaaaaatgtgtaatttgaatcaaaattcaaatgtataatttgaatcaaattcaatcaatcttttaaagataatttcattttattcttaaaataggtaattatt

SEQ ID NO: 3980 - DNA, 406 bp, Methanobrevibacter ruminantium
acatattttatagaaacggtctatttagtgatataagcatattataaaaaaagttataattagttgtatggtgattatatgagaagagacccttacagtcagtttattaaagatccagacaataaagcaaaggtattcatgctgattactgctgtgatgataatgaccactttttttagttgtcataggcactataatctttattttaactctggtgggaattatacacttttagcaaacttttatcaaactttaaaaaagtttagatcaaaatttttatttttatctgcttttaactgctaattttattctttttctagagattttctatctttatctatttttacttagctttttacttattttcttacatattttcttacttattttatattattatttatat

SEQ ID NO: 3981 - DNA, 91 bp, Methanobrevibacter ruminantium
attatcacaaaaataagctttaacaaataaatttaaattaaattaatgatttaattattataattttaaatttaactattcatttcgaaat

SEQ ID NO: 3982 - DNA, 178 bp, Methanobrevibacter ruminantium
tttaatccctttagatttttaacccattatctattattttggatgaaataagtttatatggtgatttttaggtatttttagaagtttgattataaacttatttatttttaattttctacttcgttataccttcctacttcgttatacctattttacttccttatgccttataaatttt

SEQ ID NO: 3983 - DNA, 44 bp, Methanobrevibacter ruminantium
tattttaagtttaatttaataaacagattcagtttttaaccagt

SEQ ID NO: 3984 - DNA, 183 bp, Methanobrevibacter ruminantium
attaagcctcctttgagctttaattaggataatttaaggctagtcattcgtagaattgtcatcatgttaatatcttattttaatcataatagatttcttttataaataattctccttatttgaataataggttaagcataattggtctaatatttattaatttgaccaagcgtaaggtctttt

SEQ ID NO: 3985 - DNA, 490 bp, Methanobrevibacter ruminantium
ttattaaactaagtcttctggattatttttcatgtttttatagttccaattgtgattggaattaacataatcaatccaaagggagtttaattttaattaaaattagatactgcataaaaaatcaataaataaataactaattcattgaagtttattagtcataagaaaaaaagatatttagtatttttattaaataaaaatatatattaaaaattaagttatttaaacattacttatagcttttttgattaattaaatattaaatcgctttttaattaattaaaatatttaatcaattctagtttcatcttttagatttttataaactatttagctttatttggccttataacatttaaatggtttttaaataattttacgataaatatttgaattatttttttaaaacaggtaaattttattagaataatagatctttgctttgtttaattaaatcttctttaatattttatttaattaaatcattaat

SEQ ID NO: 3986 - DNA, 884 bp, Methanobrevibacter ruminantium
atgaatctctattctatttttcaatagattagagattaaatcatcgttcaatatcctattgtaagattctcttacaatatcccgatggatattgaaaccaaaaacaaactaagtcggaattaaaaaattcatagtgaatttttttaatttctattaatgattatgcaaaaaatattatatatagtttttcataaatatagattaagggatgtgacaattagaagctaaacggaactcaaataacgggaattattggaaactaaatacttctaattatggttggttcccttaatctatgaaggaggaaaaggatgtctttataatagcttagccagagccattataatgagacagtaaatacaccccaaataaatgaagtataagactatcccaatccaaattttcatttggatagacataacttctcctcctgtcttgtttttggtcatgtgagactttattctgaaaaatcaaaatatcacctcccatgttaggagttaccgtttgactaaatgtatataatttctaatatttatactttattttcgatataacgatttataaattcttattttaatctaaaattgatttaaaattgttaaattgatgtgagagtgtgaaattgatttaagattgttaaattgatgtgggagtgtgaaattgatttgatgatgtgaaagttgtatgattttgaaatatttattttatatcccttatttttaaatcagactttatttaaagcgttttctaaaatataaattcttgttttgaaatattatttttaattcaattagaaaattttattaaatatcttttagatagtttaagtatcaaatacttaattaattcaaacaaatatttttatttttatcgattatttttac

SEQ ID NO: 3987 - DNA, 13 bp, Methanobrevibacter ruminantium
cggattttttaaa

SEQ ID NO: 3988 - DNA, 139 bp, Methanobrevibacter ruminantium
ttttaaatatatttgtgttttggattttttagaaatgctttttaataaagaaattttttatatataaatgcatcgaaacatttatatattatgaaatcattatactactatgtacaccatttatttttaagatgatttt

SEQ ID NO: 3989 - DNA, 293 bp, Methanobrevibacter ruminantium
tttttatttattcaaatcaaataatttatttttttattttaagaaacaaaaagcagtacaatataatttttaaaggagaggagagtacgacaggtccaaaaagtcaattaacaaaagaggatattgaaaactctaaaagaagagctagcagaagacaagcagatgaaaatgctgaacctgaaacaactaatgtatgtcctcaatgtggatccactgatttagttgcagactatgaaagggcagaagtaacctgcgctaactgtggtttggtagtagacgacaacctagtagat

SEQ ID NO: 3990 - DNA, 222 bp, Methanobrevibacter ruminantium
ctcaagcttttttggccttcggccaaaaaccttgaccaaaatttttatcactagttgggtcaaaccaactaattttttctattttttaacttaattattttttaaagtgttatttttacttattttattaattaaacactaatctaatcataatttatctacggtttaatcatttcatagtatacgaactatttatccttttaaaaaaatataagaattaga

SEQ ID NO: 3991 - DNA, 296 bp, Methanobrevibacter ruminantium
tttatcatctcgaagataaaggtcatttggggctttttagtttaatttgattaatttagaattattttgatagaataaacataatttacatatttaaaaatcatttagtggaataaacataagcatatttaattattaagaatatttttaattttttaaaaacttatatttatctaaatctttcaggataaaaataatatctgctttaattcgtttttagctgtgtttaaagataagaatagatattccagcttaatgaataccaatcgcattttctatctaagctaacagccaaa

SEQ ID NO: 3992 - DNA, 353 bp, Methanobrevibacter ruminantium
aagactctcctcattaaaaagacatttcaatagtttaataagtttttttttatctaaaaatcattttctaattcttttatctaaaatcctttgctattctgattttacatcctattttttttaaatatttatttaaaagataaaattcaatattaatataagtttatagtaagtttattttaataagtttattttaataagtttattataataatttttatcgattatatgatttataaatttttattggaaggtattagatgtttccccttagtttttatataggattggttttaatcggaatctttgcaggatttgcttcaggactccttggagttggaggaggcttcctt

SEQ ID NO: 3993 - DNA, 202 bp, Methanobrevibacter ruminantium
aaatagtttaaatatttagtttataaaaatagtttttttgttttaacctttaattaggtgtaaaaaaaatagtttttagttttaatcctttttattatgcttataaaaatagtctagtttttaatagtctttatcaaataaaaaaatagtttaaatagctttaacagccatttaatttattaattgtttctaaaaaggaaaa

SEQ ID NO: 3994 - DNA, 72 bp, Methanobrevibacter ruminantium
ttattcactcttgaatttcttatttttttatctttaaaacttataggtctctttacttgctcgctttaagct

SEQ ID NO: 3995 - DNA, 177 bp, Methanobrevibacter ruminantium
tttatcactctaaattgataattaaaaaaaaataaaactttgatattattttttgagtcttagtccttttatacgtttttagtcatttataaatctttaaattctttttaagtcatttataaatctttaaattcttttaagtcatttaaatcttttagtttaatttattcacattat

SEQ ID NO: 3996 - DNA, 149 bp, Methanobrevibacter ruminantium
tttttcacctttttattcgtttttgtaaatttatttaatttttaataattattaatacattattctattatttgtttaatattatataaatgttgattttgatataaatcttaaaaaagtcttttctgatatgataagttttatttagt

SEQ ID NO: 3997 - DNA, 166 bp, Methanobrevibacter ruminantium
atattcacctttaattaaaatatcctttttaagataaaatcaattaatttgattaatctcgtttattatatttatttatcttttttattttatttaaatttacttttaaattccctattttttaattttaaagttaatttatattatttcattttttaaattttct

SEQ ID NO: 3998 - DNA, 380 bp, Methanobrevibacter ruminantium
ggtgtttaaatgcatttaaaatctattttaataattgttttactgattttggcagttattgtaagtttatatgatcgttatgctgcagctaaatatatgggaggtacaaataaaaaattacttttaatatctttttttatattattacttgtattaatattaaaaaggttttaatatatcaaaatttcatcggaattcaaaaaaaaagaaatttgggcttaattaatagttatggttaaatttgttaatgaatgttggaaaatagcataatttttagaaaaaatttctttataattcattttaaagcacaatactgtattttgaattagaaatttttggatttttctatcatataataggattaattataaattcaaaag

SEQ ID NO: 3999 - DNA, 59 bp, Methanobrevibacter ruminantium
gttaataatttgtatttttttagtgggtttattattgtttggtttatgccaatggccct

SEQ ID NO: 4000 - DNA, 235 bp, Methanobrevibacter ruminantium
ttttcattttggccgtgaggcttatggcgatgaagatgctgttaaagccttttatttggcttgttcggctagcttttcaccgattgagcattatgttggagagactctatttccaggaattagcgatttaggttctgtgactagctctttaggttatatgctgaatcataattgttttatgtactgcactaaaaattagttaaatgaaaaataaattggcatttcaattatctat

SEQ ID NO: 4001 - DNA, 299 bp, Methanobrevibacter ruminantium
tctttaactccaatttgcacttgtcttaaaaacagttaatctttttaaatctttttaatatttttttaatatttttttaatatctttttaatacttttttaatatcttgttatataattatagtcctttattaataataatttttattattttctttgactacttttctcttttaaaatccttttatatagttttcctttttatatagttttcctttttatatagttttctatttaacttttagtataatctttatattagatattgaacaaataaaagtttatcttggaggataaatg

SEQ ID NO: 4002 - DNA, 406 bp, Methanobrevibacter ruminantium
tttcaacctccaccttttactggccttcggccagcaaaagctggaccaaaatttttttctctagttgggtcaatccaactgcttttttctttttttctattttccattattttttatattttaatctctttcatcaatagttttttcttgatttctcattattttttcacagttcagccccaatttcatcactagttttataaatgagtaatgccatatataatatatgttataaactttacattatttgtaatatatgaaatgaattaattatttcaaacagttaacgattttttattattttatcaggaaatgattctatttatttcaacgattaacaatcattcttataaaagccaatcggctaaattattcaattatttatcaattttatcaggtgttataa

SEQ ID NO: 4003 - DNA, 6 bp, Methanobrevibacter ruminantium
ccaaaa

SEQ ID NO: 4004 - DNA, 6 bp, Methanobrevibacter ruminantium
ccaaaa

SEQ ID NO: 4005 - DNA, 6 bp, Methanobrevibacter ruminantium
ccaaaa

SEQ ID NO: 4006 - DNA, 16 bp, Methanobrevibacter ruminantium
ccaaaatttttttctc

SEQ ID NO: 4007 - DNA, 88 bp, Methanobrevibacter ruminantium
ttttgtttctagttgggtcattccaactgtttatctattttttttaatttcaatcattaatttattcttaattttgcttctttttaaa

SEQ ID NO: 4008 - DNA, 221 bp, Methanobrevibacter ruminantium
tataatcaactttaatactttttaagtggctttttacttttaatatggtggaatattattcttatctactataatatttaatttctttttataaatagtttaattaaatccctaatcaaatctctccataggcgatttaattaagtttatatatcaaaatcactaataatatattttataaaagttttataaaatttataaattattttttaggtggacaa

SEQ ID NO: 4009 - DNA, 209 bp, Methanobrevibacter ruminantium
ttataattttcaatcttttttcctaattttaattttttaagctcttttttaaaaattcaaaaaactttatcttattttgcaataatcattttaaatctttaaagttttatcttattaaagtaataatctttataaatcttttaattttaagacaattttacattttttaagtaataatctttataaatctttaaaatataatattaatt

SEQ ID NO: 4010 - DNA, 52 bp, Methanobrevibacter ruminantium
tcaagggacatagtttagattaaagactctagcctagtttaaattagttttt

SEQ ID NO: 4011 - DNA, 60 bp, Methanobrevibacter ruminantium
ttatcaatttacttatcaatttatttatcaattatcatgttaattttgtaaaatagtttt

SEQ ID NO: 4012 - DNA, 18 bp, Methanobrevibacter ruminantium
taatcgaagatttatttt

SEQ ID NO: 4013 - DNA, 64 bp, Methanobrevibacter ruminantium
ttttcttttttttttttaaattgttagcaattgcactgaatttttttttatttaaggagttctt

SEQ ID NO: 4014 - DNA, 77 bp, Methanobrevibacter ruminantium
tttcatttattttaataatttggccttctaaacagattacaatttaattattactcttatttttatccagtgatatc

SEQ ID NO: 4015 - DNA, 181 bp, Methanobrevibacter ruminantium
aggcttattctattaagtaattcaatcaaataatgatgttagactatttttattttaggttttccttaatccaaataaatattagaaatatttattaatgtttaaaactaaaatatttttaagtagtaaaactactaattattcttaattttattaagatgtattattttaggtgattaat

SEQ ID NO: 4016 - DNA, 27 bp, Methanobrevibacter ruminantium
gtttgttctttttaattaaactttaac

SEQ ID NO: 4017 - DNA, 103 bp, Methanobrevibacter ruminantium
acttttttttatttttttcaatctaacaactatttttttaagaatttatctcagatttgctattttttataaatattcagattttttcaataagggtgatgaa

SEQ ID NO: 4018 - DNA, 52 bp, Methanobrevibacter ruminantium
agattcaaatgatttggctaaatagagttaatttatggttttaggtgaaaaa

SEQ ID NO: 4019 - DNA, 86 bp, Methanobrevibacter ruminantium
tcaatcgacttttcaattaaattaagtagtttttgacattaatatttttctaagaatttatcttaggaaaaatggtgttaaattat

SEQ ID NO: 4020 - DNA, 43 bp, Methanobrevibacter ruminantium
cttatcactaaggctttttttcttttaatcttattaattgtta

SEQ ID NO: 4021 - DNA, 520 bp, Methanobrevibacter ruminantium
gttatcacataatcattttaaaaagatatttaatttatctattgactattttttcatattattgaatttatttttccgttaagtagtttttttaatcaataggattcgtttttcaaattaaagaatttttttaatcaataggattcgtttttcaaattaaagaatttttttaattaatagaaattatgtatattttatctaaaatagttttatgaagtaataagatttcaatttgaaatatgaaaattagattaatttagaaaaactttttatatttaaaaacaataattatattaaggactaattctaagcaaaaaaaccttttttttaacttatcaccccctttacatattataaaaatagttttcaaaattttagattagtccttaaaggttactctaaactttaaaataattgcgcaatctactttatagagtaacctttcccttttttaaacttatttttatcttgattctatttttatgggtttaattgctacttaaaggccttaggttatcat

SEQ ID NO: 4022 - DNA, 440 bp, Methanobrevibacter ruminantium
attgatatctttaatccaagtaaaatataattctcttaagttttcagttattttaggcataaagtttttatattaaaagagttaatattaatactgtagaactaatcctatctaaaatttttttaaacctatcaattacatatcaccccctttacatatgtttttttttttcataataggattagttctttaaacctttttttaactgcttttttttacaaattattattttactaggtcatttgctatttttttagctgcttttttattaattattattttactaggtcatttgctatttttttgctgtttttttattaattattgttttgcttggtcatttgctattttttaattcaaaacttatattaattaaaatcaataaacctttaatcacacttttttaattataagtctttttatagctaggatgtgattaa

SEQ ID NO: 4023 - DNA, 6 bp, Methanobrevibacter ruminantium
tttgtt

SEQ ID NO: 4024 - DNA, 281 bp, Methanobrevibacter ruminantium
ttcttttattttttctagaattagtttattttactttaattactctctatttttataaaattagttttttttattaaatcagttttaatttttctagaattagtttattttactttaattactctctatttttctaaaatcagtttattttactttaattactctctatttttctaaaatcagtttattttacactctatctggctatttataatctattggatatttttctatccaataaacatataaatatccttattattaataaaccagagttatag

SEQ ID NO: 4025 - DNA, 446 bp, Methanobrevibacter ruminantium
aataggcttttaataaagataaagtaaaaattagaaaataataatcatttaatctttaagatattctctatttcctttcaatttctcacaagtctccatggggattgattttaaatatgagtatagttcttaattaatcgaaaggtttttattatataaaactaaatattaaaatgagaactaattctaaaacttttacccttaaattagtttttaaacaatatatctttttattcatttcatttaggattagttctttttcttttaaaaatatgtttttaattctttttttattatatctttaataaatcatttcttattcttattttattcattagcctttatcgaattcttattttgattattgctcttttttaattattttctcactttatccacaagtttgattattaattgagagttaaaaaagtttaaattaaaaaaaa

SEQ ID NO: 4026 - DNA, 263 bp, Methanobrevibacter ruminantium
aatcaattcccccttaaattaattggcaagtgaattatccttccccctaaaaaaagaaccgtgtttgcggataattcatttgctagcgcaaaagccattgaatttcatttccccctcaacataaaaaaagcattaattttattatataaatccccctttacataaaaaaagcaatagttttttttcatgtttaaacccaattaacttctacactattatatatgtttttgtaatatataaaggtttcgaataaattaattttc

SEQ ID NO: 4027 - DNA, 5 bp, Methanobrevibacter ruminantium
attat

SEQ ID NO: 4028 - DNA, 503 bp, Methanobrevibacter ruminantium
attttcaccactttttatggctttagcaatgtttaaaaaagaattatgagttatttcttattttttttatactgttctatagtattggttatttttttatccaatcttttatatactattggttatttttttatccaatcttttatatgctattggttatttttttatccaatcttttatatagtgttggttatttttttatccaatcttttatatgctattggttatttttttatccaatcttttatatagtgttggttatttttttatccaatcttttatatactattggttatttttttatccaataattaatatatttttcgaaatctcttatatcctaaggaaatctaatggtgtgattaaataatataaatttttaaaactaataaagtagaaagaattaaaaaaagtactatgtggtggaaataagaaaaagtaagggataaattaaaaaatcaacatttatccaattaatattctaaaaagtaatttttatgtct

SEQ ID NO: 4029 - DNA, 1161 bp, Methanobrevibacter ruminantium
attattaagtctcaataaaatcttatttataatttttgatttattttagggatttaggttttattttaagtttttcttatcttccttaagtattttttgctcttttctatcccttagcaatcaaaagaatcttatatttggctttagttttatttagttttttaaataatttgagtaataatgttttttcattttcatttttaggaattcctcacttcaattaaaaggaaaaaattaataaatgagcatacgtaggaggaactaataaaaacctgttcctaataacaaagggaatacatattctttcatgatattaaattacttatttatctagttggtggctagttctaatatgattagaattaaacctaagataatataggcaattgcctctttgatatcgcccattctttctcacctccttttgaaagaaaagactaggagacttgtcgaagattccattagtcctttcatggcggaaaaaattcatcttaatgcttcctttagtatttttttatttaccaaaaaaataagataaattattaaaagaggtgaagaactccgaattatactttatttcttatataatttatattttttcccccatattaaaaataaagcaatattattataaatagttatatatagtaaacctaaataaaaaatacttttttttagttattttatttaagaaatttttaaaatatttatgggcaactatttaagtcttaaaagaagtaaaaaggaattaaattgtaaaataagtttttttttaaataaaaatagtttttctaatttatgggttgttgtttttgcagttataaattaactgcaaaattaacaacaaaatagttttaagcaatgaatttttgctcaaagactaattgaaatcttcgacaattaatttatattatctaaaaactaatatataaaattatctttttatccatattttttcattttaatgtgtattttcatctttaaaagctaaattaagtatttggtttactatatattataaatagtaaactctccttttagaaattaaatatttaatgtgttaaattagttgcttttcctataataaaaataagtataagtaaaataagtgaaaagagttaaaaaaaagagtagtggaggaattaaattcctcatttaaat

SEQ ID NO: 4030 - DNA, 167 bp, Methanobrevibacter ruminantium
aattatcacatttgattaatctctgcaaatagagttattggtattaaatatcttatccttagtagtttaattaccctaattaataatatttttattttagttaatacatttttcttagagtagtgtttaatttaagggtaatcattttcgagcacttttttatgcat

SEQ ID NO: 4031 - DNA, 371 bp, Methanobrevibacter ruminantium
atttatcccctaaaatatatttttaatatgatcttttttaaaataattattcatattcttcaaattgttcagttttttcaatgaatatctaattttatttttatatggaaaaaacatttgaagaaaaatataaataaatattggacaatattatatatttaataaatttgtatatatagatttgtaatacaatagggacaaattgggataaattgggataaattaggataatttagttaagattttttaaattaggataaatttgaatagattgggataatatggtaaaagattgtaaaaatggatttaatcttattgcatttagatgtcaactctaatattaaacaaattatggattgggaggaaataaa

SEQ ID NO: 4032 - DNA, 56 bp, Methanobrevibacter ruminantium
agtttcacctgattattttttatgtccatcatatgaaccttgattctctttttatc

SEQ ID NO: 4033 - DNA, 3 bp, Methanobrevibacter ruminantium
atc

SEQ ID NO: 4034 - DNA, 4 bp, Methanobrevibacter ruminantium
ttca

SEQ ID NO: 4035 - DNA, 64 bp, Methanobrevibacter ruminantium
aatatcaccccatttgcttatgctattttagatattttaaaaagtttatttttattaaataagt

SEQ ID NO: 4036 - DNA, 432 bp, Methanobrevibacter ruminantium
gttttcgctctcctttaaaataaagtttttatccacaaccaataggaaaagagcaagataatatttaaactcttttatccttggccactacagtttcttattcttgaccgtgcaggttctatcattcttggcctagcaatcctaaatatggtgtattgaaagattagctagccaagagggtgatgataagaatttatgctggcagtgacaatgtttggtttttagtgggtttgtattagtttgtataaaatctagtgtttggggaagtatgatcaaattacatggtggttgtttttaatcggtacaattacttttagcattactcctatataaatctttcggttttgttattacaattttcattttttcaattttcttaaaaaatttaaataactaatattaattcattaatcaaaaaagcaatgcatagaa

SEQ ID NO: 4037 - DNA, 312 bp, Methanobrevibacter ruminantium
aaataataaactttatatgaaacaaatagaaaaaattattacaattttatttgatgtgttgcagtgttttaaaagtatttaatccacaaaatcaagcatcttaaaaatatattacatatatttttaaccctcttaatataattgaatttaggtacaatatttttaatacttattaacacaacatatcaaataatcaatcataaaatcaattaaatcgatacctttaaatactaccaaaacaaatatgattatgtagaaacttaatggatccaaccaataggttttcaattttatgtaaaggaggttatatca

SEQ ID NO: 4038 - DNA, 261 bp, Methanobrevibacter ruminantium
aaacttttttaaattccttttttcttagttttcactatttttcacttttttaaattcttttttttttgctgttttttctactttttttatttttttattaatttttttttattttttttcaatttctaattttccatccattaaatttttataagtttcaaaaatacaaaactttataaataagcaatcccttaaaactattgaaaaacactcttttggagttttttcaaaaaatcaatttaaagtaaaggaggaaaagat

SEQ ID NO: 4039 - DNA, 341 bp, Methanobrevibacter ruminantium
attctagatgagtggaatcattcaatggccaaacaaatcgtttggcatcattcattcataaatcttttataattcctaaattctttttttttttaattaaaaatataaaataaatactaaacacttcttttattccaatattttttttaccttgtaaaattgctttttaaaaaaatgtttgagtaatttaataaaaatagacatttccgttgccagtcccaaaacaggtattgggtaaaattttataattaataaaaaatataatttattaagcctaattttaaggttatatttttgaaaagtttttttttcatttaggattattgattttggaggcaatc

SEQ ID NO: 4040 - DNA, 303 bp, Methanobrevibacter ruminantium
ttattgccgtttatagaatatataaaattaaaacaaactaattattgccgtttatagaatattaaaatgaaacaatctaagaatttacattagattgctctccatacttaatatatagaaaaaaataaaatcaaaataaagcagtttctgattctgctgcttatcatcctttcagtgagctgaatcaactaattctgaaagtgagggtgaaattagttttgaatatgattataagtatgataaaaaatacactgtcaatgtaagctacaaaaaagacacaataaaaacagctgttaaagtcaa

SEQ ID NO: 4041 - DNA, 122 bp, Methanobrevibacter ruminantium
ttcctttttatttttttcttatttttttatttcttttttcttattttcttcttatttcttattttcttcttatttctcttatctttcagatattttagacgtttcctaatattaggaaacat

SEQ ID NO: 4042 - DNA, 605 bp, Methanobrevibacter ruminantium
agtgtcctcttctacttattcttataatttgatgcttttctattagtcgttaataaatttgagttatttatttttatttacattttcatattttataattatgtcagaaaatagcttataattatttaaatttggagttggttaatttttcactttaaaatccgattactatttttcataaaagagttcttattgacagtttgctcttttagtttctatagccatagtttgctaagaaaatttaagaattaatattttaaaaccatattcaattttagcatttttgcacaaaaacacatttgtgttttttcattttttcacagaatcacattttcataaaatcattttatcgcatttaaaatacctttattaagtttgaaaataaatatatgtttgtttgaataaatggaaactttctcactttattcaaaaaaattaatgatggatagattagtgctattgtaggagaagggtataggattgataaaaagcagaattatcctaataatgactagagagttaattcctttactcataagttttcattattaaatagatacaaaaagttaaaaattgttattcttttggatggggagagtatatat

SEQ ID NO: 4043 - DNA, 316 bp, Methanobrevibacter ruminantium
gtgaacaagttttttgagggatttgttaaaattttttagaggaaaatagattctgaataaataattttaattccttatttctattttttaagatattttaactttttttatctggaagtatgaatttctattggtttttgatgcctaatttttactaaatttttaaaatttaatctatgaataaactttatatttagttagacattttaaaatgagtttaaaaaaagataaggtgtccgacgaagattggaccctcgacaacaaggttaagaaccaagcactctgccatagtgagccacgctcagtttaaaaaaaa

SEQ ID NO: 4044 - DNA, 151 bp, Methanobrevibacter ruminantium
aattataatattttcctttacaagatttaactattttgtttttttgctaatttgacgaaaatttctatatattatagggtttgaattgaaaatctattcaatcaaatatccctacttataaataaaataattattcgcaattaagaaacat

SEQ ID NO: 4045 - DNA, 216 bp, Methanobrevibacter ruminantium
gatatcctctttcgtttattcttataattgaagtgcaaaccacaaaagaagtttcgcccataagttttaacttacttagtttaactatttatattttcataattttaaatttatctaaaaggagattaatcattcatatctaagattaagtttttaacttattttaaatatattaattattatgcattagataagcaattagtgaaggcgttattt

SEQ ID NO: 4046 - DNA, 113 bp, Methanobrevibacter ruminantium
tgttcaaaatgattgttattagtaggggatagatatggatataactctttaaaaataaattaattatcaatacatttattttaatatcaaatacacttcattaaatctatact

SEQ ID NO: 4047 - DNA, 52 bp, Methanobrevibacter ruminantium
agaaattttattattaaaccattgtttaatcaaaaatatatttttaatatat

SEQ ID NO: 4048 - DNA, 212 bp, Methanobrevibacter ruminantium
tatttttcctccataattttttagaataatttaattattctatatttatatttctaataagcagtatttaaattttatatagggctgtatttttcaatgattttattctaattctataaattttttcttatttcttctaaaataagtttcattgatttcgtttcgttaaaccacagcataatgaactataagtctattaaatgaataaaaaa

SEQ ID NO: 4049 - DNA, 51 bp, Methanobrevibacter ruminantium
tcccttttttaaaattgggtttaataaaaccagtcccttttaaaaactatc

SEQ ID NO: 4050 - DNA, 313 bp, Methanobrevibacter ruminantium
tcaatcaccttttacatagttttattttaatttaagattatttcttaatcatattttatatttttagtcataattaaacagtacaagtacaatattagttataaaattattccatatttatcatttttcaaattatttttcaaattagatttatagtaattaatttaagatctttccaaagaaaattcataatattctttaccactatctttaattaatataatcatttaaaaagttttcctatcagttgataattttaacattgccaaatcaaatagaaagttttttatcaaagcaaaaaaatattatagtt

SEQ ID NO: 4051 - DNA, 35 bp, Methanobrevibacter ruminantium
aaaatagttttgtttaggtgatggcataggtagaa

SEQ ID NO: 4052 - DNA, 274 bp, Methanobrevibacter ruminantium
ttttagttttaattaattaaaaatttcttaaaaactatttttcatttaataattttcaatttccatccaattcttgtttttctgtagataaattttaatctatttaataagaagatttatttttatgattttacttttcttgcctatatttcgccattaaaagatttatttctaaactaaaatccttaggctcttaaatcttctttattagaaaattttatattaatctccaaccaaactataattatctaatttttatattgtgggtgataat

SEQ ID NO: 4053 - DNA, 73 bp, Methanobrevibacter ruminantium
gccaaaaagagcattcctcttattataagcatatgtttttttaatccgtattttccttattttccttattcga

SEQ ID NO: 4054 - DNA, 457 bp, Methanobrevibacter ruminantium
agtcaaaattgttacgatatcaaaacaatttaacactttgaaatcaatattgtagcgatatcaaatcaatttaacattatcgcatcaattttacgaagtaaaatcaatattggggcgataaataccgtttaatttataaataatgaactttaaactaatattgaaggtttttcttacttaaataaaaattacaacatattgtggagggttaattatgaagttcgaccggaacgaaatcataactatacttctcgaattggtcaagatcatcattttgatgattaaagactaattccgcacttagacagtcgaatgccaaaaaatattaagttttttttaattttttctttggtaagctttttccttcatcttttaagaaaagattatatattattattcttataatagttattgtgagtactcaaaaagtgcacgcaatatgttgtagaaattatta

SEQ ID NO: 4055 - DNA, 421 bp, Methanobrevibacter ruminantium
ttttagtttttaaattgaatccttttttttaaatccttattttcttgttcaattactgatttttttaatcattatttctttatataataactattttttctcaaattccctatttctttaacctaatgataaaaatattcattctaataaatgttcaaggtattttgcatatacatttactgaaatatcaatctcctttggcctctaaaaccccggaggatgagtaaaactatttaaaactaaactatcttatttctattcaaataatctccaatataataatcctccctttttattcgatttcttccataactttaatttcattcttaaaaaatcataaaaaatacaaagatttatatgtgactatgtccttatactttttgaaaaagtgaaatatgtaattttgattggaggtaaagtt

SEQ ID NO: 4056 - DNA, 66 bp, Methanobrevibacter ruminantium
ttggataatttatttaaaactagagctaatattattatatttaattaattgggtgaggtaatgatt

SEQ ID NO: 4057 - DNA, 152 bp, Methanobrevibacter ruminantium
cttttttttattttatttatttttattttatgccctaaaacaatgtttatgaacttaataaaaggattagtaaaaaaaaattatcgataaaagttaattagaggaatttgcaaagaaaattgaaaaaataagcaataaatcgtgataagatg

SEQ ID NO: 4058 - DNA, 95 bp, Methanobrevibacter ruminantium
attaatatccattctcttttgatacatctagttaaatatcaatatataaatattaaaatcaacatacctatgattaatgaaaggagttgttttta

SEQ ID NO: 4059 - DNA, 324 bp, Methanobrevibacter ruminantium
aagctttagtcttcaagaatcaactttatgccaaaattatctttagagatgtcttaggaatcatttgccttaaggcgctctagattgagttgcttatcaaaatcaaataaacttttcatagcttttttttttattttcgctattttttatttattatttatttactcattttattttttcattttatttattcattttatttatttattttatttattcatttattcattttttcatttagttttttttatctattaattcttgcaaaacttattttagcttccaaaagcctattttaaactaatttaagctttaaattaatgt

SEQ ID NO: 4060 - DNA, 143 bp, Methanobrevibacter ruminantium
gtatttttccccctatttttagttatttttagttattttagttattatttaattaattttatttattttttaagcctttttccctatatttctttttttataagccttatttactattatattatttcctttttcccaatata

SEQ ID NO: 4061 - DNA, 423 bp, Methanobrevibacter ruminantium
gccatcccccttattttattttgttttataaatatcgtaaactctgattaaaaatagattaaaattaaataaaaactaatttaaatgtttaagctataggattttagattaatatttacccatcgttctattgtttaattctattttcttataagtatttatttttttatatttttattttctaaaatagttacaagcctttcgtaaaatacttatttaatatttaatgaactgaattaagcggaaattaggtgaataactgaattaagcagaacttaggtgaaaactggattaaacagaacttaggtgaaaactggattaaacagaacttaggtgaataaattaaacaaaagtttatttaaaatgtcttaatcatatcaatcagtaaaattcagctttaaatttcatcaaaaaaaatagaaa

SEQ ID NO: 4062 - DNA, 90 bp, Methanobrevibacter ruminantium
aaataatgctttttaagaaatcactttttttagtatggtgaattggttaagtgattcctatttaatattgtgttgtcatagtatataaat

SEQ ID NO: 4063 - DNA, 616 bp, Methanobrevibacter ruminantium
ttttttcccaattttttctcttttatcattttatttttttatctttttctctttttatctttttttaatttaaactaagttcaataatccttttttctaatttaaattttcgatgattgatcaaagtccttgttttgatatcaaatcaattttacagtttgaagtcaatattgttttgttattaaatcaattttacagtttgaagtcaatattgtagcgatatcaaaacaatttaacgatatcaaatcaattttacgaagtaaaatcaatattaaatcgaaataaaccgtttaatttataaataatggaatttaaactaatattgaaggtttttgttgcttaaataaaaattacaaaacaaaatatggagatgtcttatgaaattcgaacggaacgaaatcataaccatttttctcgaattagtcaaaattatcattttggtttttaaagactaattctgaactcagactgttgaatgccaaaaaatattaagttttttttaattttttctttggtaaactttttccttcatcttttaagaaaagattatatattataactgttataatatttattgtgagtactcaaagagttcacatattttgttttgtaaaaa

SEQ ID NO: 4064 - DNA, 89 bp, Methanobrevibacter ruminantium
gtttttaattaattctatttatctaaaaaactatttttattaattaattgttaattttgctttttttttattttaaactaagttcaaat

SEQ ID NO: 4065 - DNA, 504 bp, Methanobrevibacter ruminantium
ttcataacctcacattaaataaatatagatatgttcattttgttataaaaaacttcaccaaagtaaagtaaatagataaatgagttaaataataagtgaattatctatttaattatcattgttttgtttagagcttgtattttttcgccccttcatgtaaactttaggcattatgtctttgcctagatattgatgatttatgttttaaaaaaatagtttaaatgagtaatattagaatatcagaaatggaaaaataaaaaaatagaaaaaattaataaagaaaaataaattttaaaggattattaataaagaaaaataattagaatatcagaaatagaaaaaaatagaaaaaaaatagtaaagaaaaataaattttaaaggattattaataaagaaaaataattagaatatccgaaatagaaaaaaaatagaaaaaaatagtaaagaaaaataaattttaaaggattattaataaagaaaaataaattttaaaggattattcaa

SEQ ID NO: 4066 - DNA, 263 bp, Methanobrevibacter ruminantium
aataacacatctgtttatttgaatctagttaaaacttttaaatcttagttaaaactttattgttcttattatataatgatgattatccgtttttaagaacagactaaatatttcgtaaaactttggtttttcaaatttcaattttcaaaaaatcttggaaatcaactttcctttctcaataagtaatatagcactattatgcgatacttttatatattacaaattaaaaatattatatcaatcatgagtatggaggtgaaaat

SEQ ID NO: 4067 - DNA, 677 bp, Methanobrevibacter ruminantium
actttttgctttaatctaaaattatttttaaaatttttttctattttttctattttttctatttttttatcatttatggattcatggctatgcatggactaacattcttgaattaactgcagaaccttccgcaaatcttttattggttcagctatttctggtgaaggtttggtaaacgtttaagtggaaccagtaagatacttatggcacctttaaccggcaaacttctattaagggatttgcctaaatccgacaaataattggggaaagtttttaaaaattctttaacaggctactttggatatctttttaatttttcgtatcctgttagttaaattatttcttttaaaaaaaatttagggtccatttgaagttttatcaaagaaaaatcaaatgatatatatcttaataaatcaaatctaattctataatatagttaaaagaggtgcacttagtaagatatctaagttaattaagcattatctttatattatgggaaatagtcttaaaaaaaaaaattaaacctttacaaataaactttatctttttttttattaatgattagttcccatttttactaattttctatttttgagtgctttaataatatggatttaaatagtctaaaaagagcagcactccttaaatgcaaaatttctattttgattaattctaat

SEQ ID NO: 4068 - DNA, 308 bp, Methanobrevibacter ruminantium
ctaaacacgtcccatatatatgataaagtatttaattaaacttatttaatattaaccataaaatttcaaatcatataatcttattcaaaatttagttttagattccaagtacaaaaaagatcaaatccggagagtttgcatggtctaagctttgtttaactagagttaagtataaacaatttttataaaaaggaattcggtatgtgggattattatttcctcgggataggaagtaacaagaaaagaagtggttctttaagttaatctgattaatttattatagaataattataattaaaatgggaaaa

SEQ ID NO: 4069 - DNA, 177 bp, Methanobrevibacter ruminantium
gttatcatctccgtgtattttttataaaaaaagctttggtgtaattgttaaagcttgttacaagatatggtgttactcttgtaacataatatatatctttttcatagtatatatacttttcggtttttcatataaaaaaactatttaaattaagaaaattataggggcctgacgatt

SEQ ID NO: 4070 - DNA, 488 bp, Methanobrevibacter ruminantium
tattatcgccaataatatatttgtaaagcatattatttaaatttaacgatattaaagacctatttttttatataactaataatacatttgtatttttagaaattaaacttattttttaggagaatgaattaaaataaggaaaattcgagggaattttcacatcaaaaaattcaggcccctaaaaatatattataagcatttctataggatattcataaaatcatgctaaaaactgaacatatttcaaatgataattgagtttctaagtttagctgtgttggttgaagactattaagtctctttctcccgaattaagattagagagtgttctaatttatgggacttattacaaaatcaagagattcaaacattttttaaatgaatgtccctatttccatacacaactcctaatcattttaaaatcaataatcaatttataaatacttaaaattataaatcattaattataatttcattaagaggatacc

SEQ ID NO: 4071 - DNA, 87 bp, Methanobrevibacter ruminantium
taagtaaaatttatagaataattattataatgatataataagattaataggtaaattttaagaactattaataaatcagttgatatt

SEQ ID NO: 4072 - DNA, 605 bp, Methanobrevibacter ruminantium
gaatcaggaataatattcttaattatgcttttaaaaatcatatcaattgcaagtattcttagcaaaaaatcaaaagattatattccaatatcatcaaatctaatattatagttttatttacttaattaattttatattatgggaactagtcttaaaaaaaaattaaaccttttcaaataaactttatctttctttttttattaatgattagttcccatttttataattcttctatttttgtatatttttttaagtattgggattttaatacattttaaaaaagattataactaattttctagcaatataataacggaaggggttctaagttattttgaaaagtttgaagtgatgatatttgataatctacaattccgtgcagataatgttcaactaagcaagaaagtagggcttctgacatgaaatgtcttgcagaagacagaataataaaggtgagtaatgtacattggaataataagttaattgattagttggtggattatataggtgagatggttgggaagatggaatagtagacaccataactggttcttgcaggttctgacaagacctagaagaagagttaaggcataatttcaagattc

SEQ ID NO: 4073 - DNA, 426 bp, Methanobrevibacter ruminantium
actatcactctctctactaactaatttttaatctatttttatttatctataaattttattattttctctttaattttccatcatgattattgaaaatgactgttttttaggagaaattattattgggtagaaatgccaagcggacgcctttgttgaaaccgctgaggatggtgcctatgacattgcggggcagatgtcttaaagtatattaaaaagtaggttttaaaaatttaaaacagtaaaaaaagataacaagtttattcaaattcaaaaacaagaggcaaatgattacttaatttaatctattctcttccatctaaaataggattttcagctttacaaatagccttaaagtcttctctaaattttccgttacagttccaactaacaattttaattttttcacctacaaaacatttaaaatag

SEQ ID NO: 4074 - DNA, 67 bp, Methanobrevibacter ruminantium
tttaaatcttttttttcacacattaaaatcacttcacatatgataattaattcaaaattttaaatca

SEQ ID NO: 4075 - DNA, 71 bp, Methanobrevibacter ruminantium
tagcatcttcttataaatttccaatgcttcatcataatttcctaatttaaaaagagacaatgctttagagt

SEQ ID NO: 4076 - DNA, 182 bp, Methanobrevibacter ruminantium
atgatgcccccataatattagatattctttggttataaataaaggtttcgaaaccatcttttgtcaattaatcaaaactaaagtatcctttatcttgcattatatcttcttattatattggggttaaaggataatcccaatccatctattctcattgaatagtatacttattttaaaagaag

SEQ ID NO: 4077 - DNA, 99 bp, Methanobrevibacter ruminantium
aacattatttatttgttttttctattatatatactttatggtcatcgacaagaaattatttaaatcaagaaaaatagataaagattataggtgataaag

SEQ ID NO: 4078 - DNA, 20 bp, Methanobrevibacter ruminantium
ttaaatgttttaattaaaaa

SEQ ID NO: 4079 - DNA, 322 bp, Methanobrevibacter ruminantium
ttttcttttggttttattttgctcagtgaattaatatcacaacaagcaatgttaaaacaatggaaccaattaaaacaaactgatattatgtggaaaacctaaagaatgcaaaataaaacttaagatacaatcaataataaaccacaaaaatataatgccaataaatttaaatacgagatagcatcctcgttgataaaaactagcttaatcatctatatggggtttatcaatttgttttctacagtaactacaaaattcagaacattccttgattctctcaccgcaaaaaggacatcttaaaactgctaaaattagattccat

SEQ ID NO: 4080 - DNA, 476 bp, Methanobrevibacter ruminantium
tttgacatatctcccttttttttttgttttgtaaaataagctaaaaagtaattaaaccttttattcactcattaaaacaatttatattccttcttttatataatccttttgatgactactgttgtatatacagtttcaaatgctgttctactcatgctgttctactcatggtataatttatatgaaaaaggagtaatttctgaggaaagatttggaagaaaaaggaattattacaactctttttaataatttttaatatcatttttttttaaaaagcattctgtataattattcacttattttattattttttatcatattatctaattttcacaatcttaaaaaaattataaatatcttaaaattaaatattaattataaaacgattatttatttagggtgatattttgactaaattttgtattgagtgtgggtttgagaatcaagatgatgctaatttctgtgcaaattgtggc

SEQ ID NO: 4081 - DNA, 178 bp, Methanobrevibacter ruminantium
taatttctttatgtttttaataatttatagtaagtgataaaaattagtggaatcgaaatttagtgtatttatgatttaataagagtaaggaattaaatttagtgtaattatgattttataagaataagaaattaaatttagtttatttatagatttaataagagcataggttgtttat

SEQ ID NO: 4082 - DNA, 51 bp, Methanobrevibacter ruminantium
gaagttctattcttcagaattaaagagttattaaagaaaaggtgttcaatt

SEQ ID NO: 4083 - DNA, 102 bp, Methanobrevibacter ruminantium
tctcttttaaaggtttttatcgaggatatatatttcaattagactaatttataatatgtttttttttaaacttattactaatctataaaaaagagggttatt

SEQ ID NO: 4084 - DNA, 6 bp, Methanobrevibacter ruminantium
atttat

SEQ ID NO: 4085 - DNA, 175 bp, Methanobrevibacter ruminantium
ttttttcttcttttttaatatttttctttaaaattacgaatttcagctatttttcatattttttttagtaggattaaattttcaaatagaaacttttaatagaaacaaagtttaaattattaattaagtataataatttttatacactttttattaaagtaattgggggctgcat

SEQ ID NO: 4086 - DNA, 922 bp, Methanobrevibacter ruminantium
tatttgtacaatgaagttctagttaatgatgaaagttccttagatgaagatagaattattattaagatttctaatctttttgattttcaaattatttttaaagaattattttatgaagttgatgatgggagattaaaatatcctaaaatgaattatttttatcaaatttataacaaggagttaactggagagaatggtatatttaatggttttagttcaaaaacagttaatatattttcaaaatataaagataatattttcagttttatttatgaagcgaattttgatgcattaaataaaaatatgattaatacaattgttttaaattcattaaccatttttcaaaaaaattctattaaaaaatctattagatttgaaattgttaaaagattaaattattggtttatgtttaaaaaagaatttttaggagatactatgttattaaatgaaaatgttttaaagttaagacaaatatttggacatcctaatattactactggtgaaaataataatgaaaaaattgaagtagtctttgacgatgttgagaaaaaacaagttttagatttaattaaagaggataatgccattaaatattatttgataggtcaattaattgcatatattgatgatttcaaatatagttctggcaaaaaaagagaggtttttactaattttattacaaatgctcataggaataatattaaaaaactttttgcaactgaaatattacaaaaaaatgttttttatattaatcaaatgaataaaaaaggaaaatttttatttactatgctagaatctgattatgggtctttatttaatgaggaagatttatcttatgaagattatattttgttgttatttactggatattacacaacaaaatttttgaaaaaaaattatgtatacaatggagatgaataaa

SEQ ID NO: 4087 - DNA, 34 bp, Methanobrevibacter ruminantium
aaaaggtcttttctaagttatagtttgtgatttt

SEQ ID NO: 4088 - DNA, 635 bp, Methanobrevibacter ruminantium
acttattatgataatgtttctttagatataaatgatgtgcatgattctatggatcaatcattcttgcgtaatgatagaagaaatatcgtgttttggaataaaatgaagtattctaaaattcaaaaaaagaaaggcattcatattatattaaatgatttaaagcaatattctatatttattccattagatattaaaatttatgatgattctttaaatttggataaaacaatagaggatatggatttgaatgagttaagagagatttatgacgaatttgggaaacattttattttttcattgaatgagattttatttatgaaagaaaatagtgattttttaatagaaggagattatgttataggggaggaggtattaaaccattttcaaactatggttgctagagtaaaagatgattataatcaaaaattattagttgaaaaggtattttcatctattttaagcaattttattatgaatatttcttttaataattccgatcttgaggaacaaattaaagaattagataaagaaagttatttctatattttagagaagaatatgattggtgattctgaggagcatttctattctgaagaatatggttttaattttaaacctactataacaaatatatt

SEQ ID NO: 4089 - DNA, 60 bp, Methanobrevibacter ruminantium
atttattgtatttttattatttttaatttatttattttttattttaaagggggaaaataa

SEQ ID NO: 4090 - DNA, 2 bp, Methanobrevibacter ruminantium
gt

SEQ ID NO: 4091 - DNA, 5106 bp, Methanobrevibacter ruminantium
ttttaatcccaaaatggtctgattttaacatcaatatctgaatcaatattgatattattcttgaaatttcaatcccaaaatggtctgattttaacgctccaaacttatcagcattttcagatttataataaatttcaatcccaaaatggtctgattttaactcatcatttccatctacgattggttcgttaaaaaatttcaatcccaaaatggtctgattttaacttacgagagtaacattcttctgaagcacagttggtaaatttcaatcccaaaatggtctgattttaacaggtaataatatgaaattaccactactgttggagtagatttcaatcccaaaatggtctgattttaacaaaaccattctccaataatatcttctgtgcatattgatttcaatcccaaaatggtctgattttaaccacacttttgacaccataatggactctttcttgatttcaatcccaaaatggtctgattttaacattcattcccccttactaattctacaagtttaaaaatttcaatcccaaaatggtctgattttaactagagacagtacaactcaatatggattaaatagtgagatttcaatcccaaaatggtctgattttaacagaatctacgagaattattctatcataactggttatatttcaatcccaaaatggtctgattttaacattctgctgatggattaagttgcactttatctgctaaatttcaatcccaaaatggtctgattttaactaatcctaacctttatcggtaacttgatattgcaaatttcaatcccaaaatggtctgattttaacccaaaaaaaacataaaaaaaagactcggtagtatttcaatcccaaaatggtctgattttaactcatctatgtctgccccatattgtatgattccgttatttcaatcccaaaatggtctgattttaactcatctatgtctgccccatattgtatgattccgttatttcaatcccaaaatggtctgattttaactatttggtagagtcaaaccacatcggacagtcatctatttcaatcccaaaatggtctgattttaacacaaagtagaattaaatcttggtaactgggtaacatttcaatcccaaaatggtctgattttaacgtttgactatcactatcgtggatgatattgagcatatttcaatcccaaaatggtctgattttaacataaattattgtttaataaagaacctgataagtttaatttcaatcccaaaatggtctgattttaaccttagtccagtattggcacctatgactagtgttaatttcaatcccaaaatggtctgattttaacggtgctgagttatatgatgtggaaattgattttaaatttcaatcccaaaatggtctgattttaaccagaaagcgatgtttggagagttctttgaagatgctatttcaatcccaaaatggtctgattttaactatgtatgttccgatgattagtatcattgtgttgaaatttcaatcccaaaatggtctgattttaacacggacatataatttatgatacaagcaatgtatacaaatttcaatcccaaaatggtctgattttaaccagcttacaaagaaataatcgctgatatcagtaatagatttcaatcccaaaatggtctgattttaacaatgaccttatggataatactaaaacagttaaaaaatttcaatcccaaaatggtctgattttaactgtgctagttaatgctaatcctgctccttcatatatttcaatcccaaaatggtctgattttaactagaacctttcaaggaagacatagtctgctattgtaatttcaatcccaaaatggtctgattttaaccttgcagaactggacttgctcctagaatacaattaatttcaatcccaaaatggtctgattttaacatacatatcaaagaccctcatatccgaaacaatgtaatttcaatcccaaaatggtctgattttaactcttcgatttcgtggaataattgtgtgaaatcgaatttcaatcccaaaatggtctgattttaacatgtcaccttgtccttaagtggtgtcttaagtcctaatttcaatcccaaaatggtctgattttaaccagtagaattcgatgcacaaaggacaatgagtagatttcaatcccaaaatggtctgattttaacgctccaaacttatcagcattttcagatttataataaatttcaatcccaaaatggtctgattttaactcatcatttccatctacgattggttcgttaaaaaatttcaatcccaaaatggtctgattttaacttacgagagtaacattcttctgaagcacagttggtaaatttcaatcccaaaatggtctgattttaacgcacttggaactgccgatggtgtcggaaacatcttatttcaatcccaaaatggtctgattttaacgaaaagacatcatgtcaacaattatgaattggaagaatttcaatcccaaaatggtctgattttaacttgatgattttatacattcttttagtttagaacgtatttcaatcccaaaatggtctgattttaacccagagttgataaaaaatgtacaaaacagttattaaatttcaatcccaaaatggtctgattttaacgcgaggagtgcctaaattcacattcaagcaatactaatttcaatcccaaaatggtctgattttaacgacaatgaaattaagaaattaaaatcattattggatatttcaatcccaaaatggtctgattttaacccttaccatcgcttcagattagcagaaactactgaatttcaatcccaaaatggtctgattttaactccaaggttggctacttcaatgatactgactctttgatttcaatcccaaaatggtctgattttaactttacgttgtcctgtaccgctttcatcatcaaccatatttcaatcccaaaatggtctgattttaactcgcaataacaccgaaattatctaatacgaattcatatttcaatcccaaaatggtctgattttaactgcagaagcccagttccaaatcttcaacttggacaaatttcaatcccaaaatggtctgattttaacttgtaaatttatagggaataagactactgaagaaagatttcaatcccaaaatggtctgattttaacctttagtaaatggggggggcaaacttttagtaaaatattcaatccccaaaatgggtctgattttaacctgtgtgtatagttgaagttgcaattgttgatatatttcaatcccaaaatggtctgattttaacgtgcaagtcctccaatagattatttcctcccctatatttcaatcccaaaatggtctgattttaacccatattctctcacccaaatataagaataggattttgatttcaatcccaaaatggtctgattttaactcctctggagcataataattgaatcctaattttaaatttcaatcccaaaatggtctgattttaacaattcaaatccaacgatgtaatttccatcgcttacatttcaatcccaaaatggtctgattttaactatttaggattgaagaaattgttaatgattgtattgaatttcaatcccaaaatggtctgattttaactgaaacaagttcaagccaagtataacaccttttcaagatttcaatcccaaaatggtctgattttaacaaatttattgatatcttatttttatgcctttttttaatttcaatcccaaaatggtctgattttaactgttcagtctctacaattaagtcctctaggtttatatttcaatcccaaaatggtctgattttaacccgaaccttactttgaagatgaggaaacctttgaagataatttcaatcccaaaatggtctgattttaacaaacaagaaaacactgcaactagtaatattttctatatttcaatcccaaaatggtctgattttaactatgttgatgcgaaataccctaacagcttcaggatttcaatcccaaaatggtctgattttaacaggcgagaattttcgcctaaataccccttttacacattaatatttgtccattttttaatttaaaattttcgaatggtaaaaaagaatttatttaaaacaatcaacatttaacttaaatctcttaaaattattaaataataacatattcttatttaaattttattcaaattatttttataatgatatttttcatttagataattaacaagtttctaaaagttatttaaaacaatttttaaaaattacttaactaagtttaattataaaaacacttggatcgacagaattcttaacataaaattatataaaaaccaaaccacaaactattaacaacaaaacataaaagggttaacaatatggtcttttgttctagctgtggaaaggaaaacacctctgaaagcatattctgcatcggatgagaatccatcctaatcaaacaagaatgcctcaatataaaatcatatcacgactttaacgatcttctgactgttgaaaattaaaaagctcttgaagagctgtccttcatataatcataccaaacaatcttaaatcaaggcaagtcaaactatgaggaactgctcgaagacatgccagagcaaaaaagacaacccatggacatactctcaaagattgcacttaaaacacttgtttttacaaagataaactacaagtcacgcggagctgaattaggcagctattcattcaatctcataaacataggcaatagattgaacaaggccaatcagatatccgagcttatccacgagattacaaccacatcgttgctgaaatatacgagcaggtacttatgtatcttcttgaggcaaagactgatgtactagaggcattcgtatggtttgctatggaatatgggaaattatgcactttatgtgacgcaacatagtcacttggagtgatgttgatacaatgcttgaacttgtttcaaattatggattagatattgaagaaggttaggatgttcgtgtagaaagcgttgatgaaactgcaatgaatattattaaatcatatatttaattttaaccaaattaaagagattaaattataaaaagtgattatc

SEQ ID NO: 4092 - DNA, 232 bp, Methanobrevibacter ruminantium
atgtcattttaatttactttcctgcgagaatctgacatcatatgctaaatcactcatttagattattgtatctagcaggcacttctcactaaaattcctaaaaaaattaaatttttattcgctccaagtatcgagtgcctatgttttggcctcgttaatttgaattcagtgaatgatggcttttaagagccattgaatctttagactaaataaattatgtaaggtgataata

SEQ ID NO: 4093 - DNA, 61 bp, Methanobrevibacter ruminantium
ttgggtagtgattaattgccttttgcttttttttttaattcattttaagatttttttttag

SEQ ID NO: 4094 - DNA, 554 bp, Methanobrevibacter ruminantium
ttgattttttttttatttagttgctttcttataggaatcattttcttgatttttttatttagtgctttctataggatgcattttattaccctattcttctgttttttttacttattttgcatagtttactatttattataaatagttaatagttcgttattattttaattttaatgtataatctgccatattaaatcattttaaatgattattagttttaaaatactcttttgagttaaatttattatttgaggataaatcactatctataaatgatttttgttgcgattaaaaaatttatttgaaaggttgatttatttttaattgaaatttatagtgattttgttatgtagttttcattcaactgaaatttatagtgattttatgatataattttcatttaactgaaaactaaatatgcgatgaatttaaaatttttcaattttctcatattttcttaccttatccctttttttaattttcacattgcaaacttttttataaagatttataaaccccctaataaatactactattagtaaaagggtgttagc

SEQ ID NO: 4095 - DNA, 10 bp, Methanobrevibacter ruminantium
tgattttata

SEQ ID NO: 4096 - DNA, 511 bp, Methanobrevibacter ruminantium
ttcttttacttttttcattttttactcatttttttttatttttttaagctttaagaatttcttattaattttaaatattgataatccttatttaactcacaatcccatttaagcctttttaatttccctatttgtttcatacattactaactttttataaatagttatatatggttaattttatctataagctttttatataacttaattttttataataagaattctaaattagttatatttatataacataaaaataataagttatttcagtaattaatttgctctagcaagttattccagagtcaggtcaattttgatttcaaaatgtgaaattgatttgaactcgtaaaattgttgtaatctcgtaaaattgatgtaaaattgttaaattgatgtcatcgtgctaaattgatttcatttcgtaaattcaaacccttaaaatcggaatatttaaatataagtacttatagactaaatttacaatttaaagataaaagaggtgacaatc

SEQ ID NO: 4097 - DNA, 36 bp, Methanobrevibacter ruminantium
taattttaatttagattaattgttggatgtggataa

SEQ ID NO: 4098 - DNA, 170 bp, Methanobrevibacter ruminantium
ttaattaggatataattttcttcttaaatttgaatatcctaaaaagatgtggaaaagtatttaaatggcgaaacttatagaactatgtagaacttttctgtttttatttattggggtgataataaatttaagcatatttcttagaagttcatattaaatggggggtttaa

SEQ ID NO: 4099 - DNA, 92 bp, Methanobrevibacter ruminantium
ttttgggggtgtattattaatgataggcacttttttaatgataatgggagcaatcttcttgcttttattatgtgctggctcttgcagcgatt

SEQ ID NO: 4100 - DNA, 178 bp, Methanobrevibacter ruminantium
tcaaattctttttttatttttaagctcagattattttttaagcatagctgttctaatttatctctttaatcattttttaactgcaattttaatctgatttttcaaaataaatcaacaaattatataacttaataattaaataactataagtattattataaaaacctaggtgataatt

SEQ ID NO: 4101 - DNA, 26 bp, Methanobrevibacter ruminantium
gctttaaaggctattattaaatatta

SEQ ID NO: 4102 - DNA, 78 bp, Methanobrevibacter ruminantium
tcttttttttatttttttttatcagaacaagcactatttttaaatttttcatataaattaataatcttattttattct

SEQ ID NO: 4103 - DNA, 248 bp, Methanobrevibacter ruminantium
tgctctctgattaagtttatatgtctttaaaacaaaacaatattcaagcacaatttcagatgtcccaaaggaattttcaagataatttccttattttggttctataagaataaaacaaataatactttttcacacgcctcttggatttgacttttataaggtaagaaagtttcataaaattaatctgcatacacatcctttatacagattcggtttgtttttaaaaaacaattttatgaggttaaatc

SEQ ID NO: 4104 - DNA, 136 bp, Methanobrevibacter ruminantium
attgatttaatctgtgccaatattgaaatctttcccaattatatttgaattgattataatgcccatattttaaatcttttcaatccaaataaaaatatatttaaaataaattatatagattaatatctataagaag

SEQ ID NO: 4105 - DNA, 196 bp, Methanobrevibacter ruminantium
atttaatttaatcagttatgtgcttaattaaagatggttttaattattaattaatacttttaattaatcggatttttaattattttatatcattttcactttctttttggatgataaaagactatgttgatgaaggatttttaaatgctgacttagggattttaattttcacaaagtatagattaaaggcagaatt

SEQ ID NO: 4106 - DNA, 129 bp, Methanobrevibacter ruminantium
tcttttagacttatttaattgttggaatatttaatttagaacttttatatgtattattaaaaggttgaattaatggtattttagtatataaatcatattaaagataattgttattattggaggtctttt

SEQ ID NO: 4107 - DNA, 98 bp, Methanobrevibacter ruminantium
ttaagtttattgtactggaattaggcggatgtgaattgtttttgtatttaatgcttagaaattgatgaatctgcagattattgatttgggtgttgttt

SEQ ID NO: 4108 - DNA, 92 bp, Methanobrevibacter ruminantium
aaaacttatttaaggactaatacaaaaacaagaaagtttataaaggatcatgtttataatatgataattaaattaaatacatgggggatgag

SEQ ID NO: 4109 - DNA, 43 bp, Methanobrevibacter ruminantium
taaaagttaatttttaagttttatagttttaaaaggtgatatg

SEQ ID NO: 4110 - DNA, 42 bp, Methanobrevibacter ruminantium
tatttctataattcttctattaaattttaataataaaaagag

SEQ ID NO: 4111 - DNA, 90 bp, Methanobrevibacter ruminantium
ttttaatctatttttaatatataagaagctttttatcttcttaattaattctatttttataaaacagccaatattaactattttttttac

SEQ ID NO: 4112 - DNA, 607 bp, Methanobrevibacter ruminantium
attatcattgattccttcaattaatataaatattaaatagattttattttgcttaattaattatttatctttattttatataaaaattaatattgctttggactaggtgaattatctttgaaatcttgttttggcctctttttggaaatattgtactttttattctacatttcctgagttttgctttgccataattttatttatccattaaaaaatattttcatttattcaatttatcattatattttttgccaaaatactatattttctaatatttttctatttttgtttacataaatgcaatttttataagtattcttccatatattttgacactttgataatttttccattttcaaacttaactctattaagattaaatcttttttagtttataaactttttagttctttattcgtttcatacttaactaattaatttttatatggtttttaaataaattagatagcttattattccataagtttttatataataaaaaataaaaatcttaacaagtgtgaacttttagagagaaaaatactcgacatagactatttttttcagctatagataaataaatatgaaaaaataaagaggtatctca

SEQ ID NO: 4113 - DNA, 490 bp, Methanobrevibacter ruminantium
ttttttttacttattttaatattttccttattttcctaatcttattttttacttattttacttattttcctaatcttattttttatttattttacttatttttctaatcttattttttatttattttacttatttttctaatcttattttttacttattttacttatttttctaatcttattttttatttattttacttattttaattattattatgtattttttttaactaatttactcatattaactattttcttaagacttttttttaaaatttcacagattcaaactatcaaataattaaagacagctataatttaatgacaagttaaacactaattgtcctattaggttagcctaaaaataaggaaaaagtgtaacctaaaaggtgacactacaaaaattttacaaaacctttatatactatactattataactataattaaggacgtgaggcttaccctatgattgtcctaggtgtgtttttca

SEQ ID NO: 4114 - DNA, 21 bp, Methanobrevibacter ruminantium
attgattaaggagttattatt

SEQ ID NO: 4115 - DNA, 440 bp, Methanobrevibacter ruminantium
ttttttcttttttttatttattcttattatttttactttaattctatttttaaatgctttttaagttataagcaatttttctctaattctatttttaaatgctttttaaatcttaaagaaagttttttatcaatttaaatttagttctattctttacgaatattatatgaattaaaatatttttcttattttatttctccctatgaaactatttttcagatgatcgaatttttaagttaattttaatatgtacaaatatttttatataataaaaataatagttatattataaaagattttttactatctaattaaatatgttttaggtaaggaaatatccaattagattaaatctttgtttaaaattttataaaaattgatttttttataaaaatcattcttatttaataatgacattataatatattggagcgatattt

SEQ ID NO: 4116 - DNA, 352 bp, Methanobrevibacter ruminantium
aaaaaacaattgttttttctcctttttattttttttacactactttttttacttattttcttatcatttttaactatttttacttataattattatttcgaacttattttacaaatttactagttttatgatagcttattttacttctatttttactctttattagcagtataaataattttaaattaaacttgttaggaatataaaattaatttattccattataacccatttccactaaaaagatatagttaaatttataatatttaaggtattataataaattataaactatttaataatttcatatttattgaattgattattaatcaaatatttaggttgttttata

SEQ ID NO: 4117 - DNA, 261 bp, Methanobrevibacter ruminantium
gttaactcttgattaaggctataattgtttttattatagctttaacttttctttttttttaaaatcagttatttaaaatttatttaactctctttttattttaattattcttctctattctgctttttttaatacaattgtcttaatataaatgcttaatttagttatttagtaaaacttatttattttttatattaagtttatatctatttttaaattaaaatagattaatttatatggtttaaaattaaatttaaaatt

SEQ ID NO: 4118 - DNA, 347 bp, Methanobrevibacter ruminantium
cttatatatcttctcttttttttaattttatcttatttttataactttaagacaatctttttattatcataaaatcttgctttaaggcaatctttttatagttaaaaaatctggctttagacaatctttttattatcctaaaatcttgctttaaggcaatctttttatagttaaaaaaatcaaatataaaactttataaaatgttaaatttaaatattaataatagttaatatactatattaattaatattttaaaagctattttttatattaaatccctatttgggttttattttaataaaaaatattttttaagagcttttttaaaaaatctaagaggtgaaaat

SEQ ID NO: 4119 - DNA, 13 bp, Methanobrevibacter ruminantium
agtaaaggatctg

SEQ ID NO: 4120 - DNA, 263 bp, Methanobrevibacter ruminantium
ttgttctattttttaatccactaatttttatttccttttgtttgttttaattcattatgctttttttttaattttattattcttttggtttgttttaattcattatgcttttttttaatttttattattcttttggtttgttttaattcattatactgattaaccgccttaaaattcttaagtttaatataatcaaaagtttggaaatctaattttgtggcataagtttatataagagtaaatagatattatatagtggctag

SEQ ID NO: 4121 - DNA, 57 bp, Methanobrevibacter ruminantium
tagtcttttagataaccttgattgatgaaaattgtccactcctttatgtgccgtttg

SEQ ID NO: 4122 - DNA, 256 bp, Methanobrevibacter ruminantium
ctttttcaattttcttatctatttttgtaaatttattatcaatttattattctttcacgttttattaaattttaagctatttttaactattgaaagactatgattttaattgtttgattttaaaaaaaagaaaaaagtgattttaattaattttcctaaaaataaatatttgtattaaatagtaattatcttttagagatttaattaattaaaatcaaataaagaacttattttataaaaagaatgtcaataacga

SEQ ID NO: 4123 - DNA, 521 bp, Methanobrevibacter ruminantium
ctcactttaattcaaattctattttactattattcctctattaaaaaaatctatctagattaaaaatataagcgtaataaaaattattttaatgctttattcttaatttaaagatagataatcattaattagtcttttaatatttataaaactatttgagatgcgattttgtgcaaaatcacactttcttagttgtgttttttcatttttgtgttatttttctttttcattttttcatttttattttaattcacttttgtgttatttttctttttcataaaatcattttttcatttttatgcatttgttttatttcattttttcactttttcatcttttacaaaattacacaaaaacatttttgtgtttttgtgcaaaatcacaaaaatgcaaaagtgaaaaatgattaataaactaaaatttattatatttgtatttacaaaatttatattgattttaaaaaagacaattcatttcaagtattcacatatttatttttaaaaaactaaaggaccaatagc

SEQ ID NO: 4124 - DNA, 399 bp, Methanobrevibacter ruminantium
tttcgaatgttttaatccttgtttgaagtgatcttgattagtttatccaattctaatccttatttaaaaattatttttttttcattatggtggttaaaaagattaattttaattttattaaaaaatatatattttttcattttgatggttaaaaagattaattttaattttattaaaaaatatatattttttcattttgatggttaaaaagattaattttaattttattaaaaaatatatattattaaggacaatattataatagtaataattttttataaaaatttattatttgtattgtttgtgtgatttattaaaaaaatgtttgtttatttataaaaactgttttaaactaatattgtgtgattatatttttaaaaaataaattgtggtgttaaa

SEQ ID NO: 4125 - DNA, 88 bp, Methanobrevibacter ruminantium
aatgctttatttctcacgatttcaaaaagtttatatgttataattataaaactaatattttatagttttagaataattttattagaat

SEQ ID NO: 4126 - DNA, 211 bp, Methanobrevibacter ruminantium
atttataatttaatgttttttcatcttcatttattttttaatttaatttttttatttttcttcatttatttttttaatttaatattttcatcatcttcatctatttttctatttgaatttcattaaaattccactctaatttcaagctagaattcacctaaaattcaacctcatttcaagttaaaatccaactgaaatctgaccctaattt

SEQ ID NO: 4127 - DNA, 419 bp, Methanobrevibacter ruminantium
gttattattttatttattcatttaatattctattaaattttaataaaataactagttttaaatctttattggacttaatattgtataattgcctttttttaattttatttcgattcaactgtttatttgtctatttaatcccattctttgttcatttattcaatcggaaaattactattttttagatttgaaaatataaaaatattaaggttcagatatcaaaatcaacaattataatcaattattttttaaaatttttatgggaaatatttatatgctattaataattaattatatattaacattaaaaaaaaattaatccttaaatggataaaatttcaaaaataaagatttttttagtgtattgaggtgaaaaaatttcgttagttaaaaaaacatttatcctagcaatattctgc

SEQ ID NO: 4128 - DNA, 39 bp, Methanobrevibacter ruminantium
caaacttttagaaaaagtttgatcaaaatgtttagttcg

SEQ ID NO: 4129 - DNA, 224 bp, Methanobrevibacter ruminantium
ttttatgtaatcttaagaattttaatttcatcttcaattcttctgactttttcttgcaatctaataattttcaaatttctcacatttctgcctatttttaatctaatttttcattaaatttatataatttaaaaataaactttaattgtaggttaataatttaatcaaataatcttaaatactaatttttttattaatatactaaaactaactgattgataatt

SEQ ID NO: 4130 - DNA, 382 bp, Methanobrevibacter ruminantium
attagtttatattaaccctgtagaaaccataatcaaattcttggcattttcttttttcacgcttctcttttttgatttttattttaaaattcctttttgaattgcttttaacagatttttaaacaaaattaatagtaatacatattgtcatttttttattattcgttctatttaacatattcttttttttattaattaagttaattatatcatctaactttaaaaaacagtaattttgataatcataattaggaaaatataagattttttcataaattttaaggttggccttaaaattaaatcgttatgtttatatatgcatgtcgataaaataagtataatgataattaaaaataataataactattaagttgtgattgtt

SEQ ID NO: 4131 - DNA, 541 bp, Methanobrevibacter ruminantium
atattgaattttatatcttttttattattttttttattttttatttttatagttttattagttttattagttttaatagttttatttgtataaaactgtttatttagtttttattttttgattttaaagatagttatattatttttatttctcatagtttttaaaaatctaaatttaattattagttatttcttttgagggttttgaactaactaataattatttttaaattgcatatttttagatatctttttttactaattttaaccttataagaattttatattcagtttaagacttaaaatggctttttatctataagtgtgatgggattatttataattttattgtcctaaattaataatcggtgctttttaagtaattttattgtccttaattaataatcgatttttaaaatgttttgttaatctttttacttatttttaaaataaattcagcttttttaaaatattggcttattttatttgaaaaaaatgaatatccaatttaataattgacttattttattctaaaaataaat

SEQ ID NO: 4132 - DNA, 79 bp, Methanobrevibacter ruminantium
tctacagtcatctcttggttttctaatattaaaatatccaaccaacagtttcattctagctattgaacttccaaatttc

SEQ ID NO: 4133 - DNA, 763 bp, Methanobrevibacter ruminantium
tccatttccagattcaaatatttctatttcattagcgctcatggctttgatttgatttttcttaatttcatctaaaatattatcacctcaaggcttttgtgctaatagtttttttgacattatatttaaactattagtttttcagcgttttttctagtttaagagggtcaaaattgttttgatttcgctataatattgatgtgagttcgtaaatttcagtctaattctcctatgttttttattgagtcaaatcaatattgatgtcaaggtgtaaaaataaggtttttccttataaggttttcctttttgaaattctagtcatacaaaaaccttaacctagataaaaatattgacaaatcaatggcaaaaaataatttcaaataatctcaagttttgatttcaataaaaatatatgtatttttatctaaaatttaatcatatattttaaattttatccatttttttatcaagtctatttatttaattattatttagatttttaagatattcatagatattttctaattttattagcattttagcccttaaaaaaacataattatataaatgattaaatctatagtaaatattaataatagataacatgttattaatttctttaattaaggataattttaattattttgttattttcatttcaaaaaatatctttaatttggattttttacttttatctttttgtttagacaaattaatttattttcattgtttgatatagtctcaaaaattaggtgggtacata

SEQ ID NO: 4134 - DNA, 144 bp, Methanobrevibacter ruminantium
atcttaaatttgttgtagatttgaattagcaatttaaatcaaagcgtaaaattgaactaattttaattattttataatttttattattttaaaagtcttttttaaagcaaatttttattgaaaaaactaaattaaggtgtaaat

SEQ ID NO: 4135 - DNA, 66 bp, Methanobrevibacter ruminantium
ttgttcataagcttggatttttctaaaaaaagcatttttattatttttttatttttttctactttt

SEQ ID NO: 4136 - DNA, 19 bp, Methanobrevibacter ruminantium
tttcattagttttaaaggc

SEQ ID NO: 4137 - DNA, 130 bp, Methanobrevibacter ruminantium
cattttcttttctcctcgtgagtttttttatttcaatctttatttttttctcttagtgagtttttttatttcaatctttatttttttctcttagtgagttttttttatttcaatctattatttgtttaag

SEQ ID NO: 4138 - DNA, 165 bp, Methanobrevibacter ruminantium
aataatacataaaaattataattctaaatccttgttaaaatatagatttgatttatatataaatcggctaaagaaaaaactttatcccatttataaaaataaatctataaaaaagtatttgaaagaatattgataatattcaattttaattattggaggttttaa

SEQ ID NO: 4139 - DNA, 108 bp, Methanobrevibacter ruminantium
tgatgggggaattgaataaaaaaacagtttttaattaaaataagaaaaaataagaaaaaaataagtatattgcttgtttgaaatttaaaaattaaaaaatagttttta

SEQ ID NO: 4140 - DNA, 15 bp, Methanobrevibacter ruminantium
tcttttttatattaa

SEQ ID NO: 4141 - DNA, 85 bp, Methanobrevibacter ruminantium
cataatcacttaattatcgtaattgtttaaaattaatttctcactaatttttgagaaattctatgatttaggagaattttttttt

SEQ ID NO: 4142 - DNA, 45 bp, Methanobrevibacter ruminantium
aaaaattataatttcttttatttattttattttggaggaaaatta

SEQ ID NO: 4143 - DNA, 197 bp, Methanobrevibacter ruminantium
tttctcttttttttattttttatattttaattattgctctttttttattattttaacttatctttctaatttttatctatagtggacttttttttatttatttttcattcatatcttgtttggatacttctttttattttatactaattttctagatattcatttttattttatactaattttctagagatttcttt

SEQ ID NO: 4144 - DNA, 64 bp, Methanobrevibacter ruminantium
tttattcccctcattatgaataaaacttttaaaatgactttataattataaatttattattttt

SEQ ID NO: 4145 - DNA, 177 bp, Methanobrevibacter ruminantium
gggatatcaaaaaaaatagttcatttaaagcagggaattaaaagaatttttatttaaagtagggatatcaaaaaaaaataattaaaaaaaagagaaattaaaaagggctaattcaaatatcagaataaaaaaatagcttgatttaaaattaggattataaaaatccctttaaatcaa

SEQ ID NO: 4146 - DNA, 223 bp, Methanobrevibacter ruminantium
taataatcataccttttgttttttagttaaattagtatttaatctttatttaatatttctttagtcctttttggccattctttaaattttatatagtatttgcttaagtttttcatgtgcttactttacctctaaaagattaaacttttatataatttaataaattattatatattatgattgataaaaatagtactacaatttagcacaaaaagactaatta

SEQ ID NO: 4147 - DNA, 150 bp, Methanobrevibacter ruminantium
ataaaaactaattaattgataattaattaatttatgtttttatgattatttattttattaatctaaattgtttctagaagatctttcttctttataattattatttaattatggtattttttataaaaaagaatttaaagagtttttaaa

SEQ ID NO: 4148 - DNA, 355 bp, Methanobrevibacter ruminantium
gtggattataggcttttaaatcttttacacctttttctttttatttttatattattttaatttttattctttttttaacacctttttctttttatttaaatcatttaaatttttatattttgtaattttcttcttttttagctttttaaccttttttagcaattttttcttcttttcacctttttaagcattttttggcaattttttcttcttttctggctactctcattgcttttcatttttcaattttatctaattgttattacttttttaccatttttcagttattttttattaactataattatataataaaatattttaattatattaaacataaataaataataattta

SEQ ID NO: 4149 - DNA, 146 bp, Methanobrevibacter ruminantium
tatttgctttataaaagttattatgcttattaattaaaaaaatagtttcttattagttttttattataaataggaactatatataaattatttattaaaaataacaattttatgattcatattttaaaaagataggagtttttata

SEQ ID NO: 4150 - DNA, 17 bp, Methanobrevibacter ruminantium
ttcttatttttcctatt

SEQ ID NO: 4151 - DNA, 292 bp, Methanobrevibacter ruminantium
ttcttttattttaagtttagttttttttcactagttttcccaagtcaaatcaattttccattaataaattattaaaattataaagatttatatatcattttttttaaatatcataatagaattattttaaaaaacttttagataatttttaaaaaatatttttatttttataattggaaaatagatataaattttcataattaattcatttgattcttataaaaattaaaatattgattttattttactaaaatatttattagattgattatattaatgaattggtgataat

SEQ ID NO: 4152 - DNA, 15 bp, Methanobrevibacter ruminantium
tcttttttttttgca

SEQ ID NO: 4153 - DNA, 105 bp, Methanobrevibacter ruminantium
tttttcttttttatttattaatttatttatttaaattgcttattttttatttttatttaatttaccattctaatttaattttaaagtttattataggtttttatc

SEQ ID NO: 4154 - DNA, 63 bp, Methanobrevibacter ruminantium
ggacttgatttattattaaaagcagttttataagtttctgtaaaaaatagcaaatatttttta

SEQ ID NO: 4155 - DNA, 157 bp, Methanobrevibacter ruminantium
ttttttttattctttttttaaaatagtggtatttatacttatttattcgaataaattattttttatctttttctaaaaatagtagtttttatacttatttattcaaataagttctattagttcttttttttcaaaaatagcagattaaaagaggtaa

SEQ ID NO: 4156 - DNA, 60 bp, Methanobrevibacter ruminantium
aattttttcatatagtttggtgaaaacaatatgaataaaacaaataatattaaaaagaac

SEQ ID NO: 4157 - DNA, 192 bp, Methanobrevibacter ruminantium
tataatcacggttataatcgttattttaattttcaattagttttaattgataagatttaattttatcattcggatagcttttatttaaaaaataataattaaagtaaaaattaaatttaatcctattttatttttttagatagcagttatttaaaaaaaataatcattaaatttaaaaataaatttaaaata

SEQ ID NO: 4158 - DNA, 88 bp, Methanobrevibacter ruminantium
tttttacctcttttaatcttttaaaacgaataagttggttaattcgttatttatttcatcaatcaatttatttaatcaattaattatt

SEQ ID NO: 4159 - DNA, 137 bp, Methanobrevibacter ruminantium
tttacccataaaatgagggtattgttcaaataatgttatattttcatcttatataatattatctatgaaagaaaaaattacctaagaaaaaatattaaaaactactatttttttttagttcaactgccgattacaaa

SEQ ID NO: 4160 - DNA, 137 bp, Methanobrevibacter ruminantium
catattcttgacctcaattttatgcggatatttttattcaagcaataaaaaaccttcattttattctttgttttcttaataaataaatatattggtttttttcacctcattattgatttaaaagtgttaaattgact

SEQ ID NO: 4161 - DNA, 372 bp, Methanobrevibacter ruminantium
aaccataaagttaatttaaatatatttaaagaatatatattcattaattatataaataaaattcatatgggtaatattttactctctaaagctctcagctatgttcaagttgttttttttagtttttcccaattttatcatgaaatctgtagttttttcacaaaattttaaaaaaatggcctataatccattttttttaaagaatttactcatttttatacaaaacctttatatactataaaatacttaaatattactaatctatatgtctacaatttgtaatttataagaaatttttaaattttttattatttttcataatttattttggtattcgacatctgtctaatgttaaatatcatattcaaaggt

SEQ ID NO: 4162 - DNA, 109 bp, Methanobrevibacter ruminantium
tttaattatttttttattttacgcgattatcggtaatttagtgctttttttgactaaatactttaatcaatgttgcatatggattaaaaacttaaaaaaaatgataaat

SEQ ID NO: 4163 - DNA, 909 bp, Methanobrevibacter ruminantium
gccaatagttcattgttggctttcgctttcatgcagcgtaatgcatgatgctttcatgtggcaagacacatgatgctttatgtggcattacacataatttttataaattcattataaaacatatagatatatagctttagctactgttagctttagctttcaaggatttgctttataattagacactataaagtttattcattggttaagagtagttgcgatttagaataggcattagaacgaaattaattggatgaataaagatattttaaagttcaaataaactttaactttaagatagaataatctttgagaagtaaaataaacaagtttgagcttgtttttcatgtttatctagctctatttagctttattatgcctgtttaaattttttggccctctaccagtcctgtatcctaggataatttactaaaaggtagactgtatgccgaatctagatatttagttaaggagacctgtatgctaaattatttgcctattatatatgaataataagtttaaacagtgtagaattttagcgatttgctaaaagagcaaatatggctatttattctagatttattgatttttatgatttgatcaattacttttagaattaatcttaattctttttaattggattaatgttcttaataattgattaatatattaattttgcttattcattgaatcgataaatcaatcttaaattcggtaaatattgtactcgcaatttaagaaaattgaatagatttagatgataaaaaaatattttaaagtttaaatctatgaaatttgtagatttaaatgataaatagagaatatttttttaatttgaatctattacaatctattaaatatagattaaactgattaattataggaaattataaataacggaggaaaaga

SEQ ID NO: 4164 - DNA, 10 bp, Methanobrevibacter ruminantium
aggggtttaa

SEQ ID NO: 4165 - DNA, 44 bp, Methanobrevibacter ruminantium
atcgaagacagatttatatggcatagttaagaaggtggatattt

SEQ ID NO: 4166 - DNA, 12 bp, Methanobrevibacter ruminantium
ggaggattgatt

SEQ ID NO: 4167 - DNA, 17 bp, Methanobrevibacter ruminantium
tttaaggagatgtgtca

SEQ ID NO: 4168 - DNA, 12 bp, Methanobrevibacter ruminantium
ggagaggatgat

SEQ ID NO: 4169 - DNA, 3 bp, Methanobrevibacter ruminantium
tta

SEQ ID NO: 4170 - DNA, 23 bp, Methanobrevibacter ruminantium
atgaccttaagtgagttgaaata

SEQ ID NO: 4171 - DNA, 90 bp, Methanobrevibacter ruminantium
tcagactcttaggagtgagacactagtcagactcttttaaggagaagacactaactaagtttattatctttacacatactgaggcttaga

SEQ ID NO: 4172 - DNA, 10 bp, Methanobrevibacter ruminantium
tggtgataat

SEQ ID NO: 4173 - DNA, 13 bp, Methanobrevibacter ruminantium
gtatggtgattaa

SEQ ID NO: 4174 - DNA, 53 bp, Methanobrevibacter ruminantium
atgatgatgattgttattcgctcagcttatgtttattaagaatatgtattaag

SEQ ID NO: 4175 - DNA, 14 bp, Methanobrevibacter ruminantium
aaaaggtgactatt

SEQ ID NO: 4176 - DNA, 10 bp, Methanobrevibacter ruminantium
gtgattaaat

SEQ ID NO: 4177 - DNA, 61 bp, Methanobrevibacter ruminantium
ataggattgttttaaatttattggtgttatttagttattagttatagtaattatagttata

SEQ ID NO: 4178 - DNA, 20 bp, Methanobrevibacter ruminantium
atttttaatttatagaattt

SEQ ID NO: 4179 - DNA, 84 bp, Methanobrevibacter ruminantium
ttgatagatgatgaaactgaagttttttcatttcctaaaaaatttgttaagaaatttaattataaaaataaatggctttaatca

SEQ ID NO: 4180 - DNA, 406 bp, Methanobrevibacter ruminantium
tttttaaatcaaaatttgaattaattaaaattataaaatttataatgcttactacttagaaaattaggggcgttaaataaagttggcaagggattatggaatacgtccttaacctcatgtcacaacctatttaacaatttgattcaatcaattaattgatcaaagggtttaataactaaactcttgattactggataaataattaattgtgtgtaatttaatgaggggatttatggaaaattcgctttttaaatatattggccaaaagtcaagcaaggaatccattttctaagtaagagcacgataaacgattaaattaacaaatgaatttaatttatcaaaattaaagggaagcttgaaaaattttgattcaagtttatcagctagttaaaatggaggattatta

SEQ ID NO: 4181 - DNA, 11 bp, Methanobrevibacter ruminantium
gaggaattgac

SEQ ID NO: 4182 - DNA, 11 bp, Methanobrevibacter ruminantium
gcggtggtatc

SEQ ID NO: 4183 - DNA, 12 bp, Methanobrevibacter ruminantium
gggtggattaat

SEQ ID NO: 4184 - DNA, 86 bp, Methanobrevibacter ruminantium
gaatatttggattattctaagattgatttattccatttagggaaaattcaatttttaagaagtctaaagcaaattaaaaagttaaa

SEQ ID NO: 4185 - DNA, 19 bp, Methanobrevibacter ruminantium
ttatttttcatttttttaa

SEQ ID NO: 4186 - DNA, 255 bp, Methanobrevibacter ruminantium
tttatatcgaatactttatatttaatgaaaattataattattattaatctgaaatattatagtattactgaatgttttatattatgctaacattcaaaagataatttattctgatgtttttattcaatgatattttggatcatatttattaaaaaaacttaaagaaaattcagtgattgaatatagtattcaattgagaatatctatcatatttaataacatgaatttagtagataataatttaatggggaaaca

SEQ ID NO: 4187 - DNA, 167 bp, Methanobrevibacter ruminantium
ttcctttgaatttagtttaaacatttttataatgataattcttaggacgattagttcctttgaatttattattttctttttaagagttgattaagagcaaaatattttttattttaaaattattttataaattgatttattataaatgatactttgggaggatttaa

SEQ ID NO: 4188 - DNA, 41 bp, Methanobrevibacter ruminantium
tttttaaaataagaataatatctatattttttcttaatttt

SEQ ID NO: 4189 - DNA, 43 bp, Methanobrevibacter ruminantium
tataatttactattatatttaattaaacaatgtgaggaataaa

SEQ ID NO: 4190 - DNA, 467 bp, Methanobrevibacter ruminantium
ataaatattaatgttttatttggatagcctagttggtttatttatttattaataaactagcattaaaacaatattttattaaataaatttaatttattttatcatatatttaatttaatgatacttattcgctaacattagatgcagtatattttatatgtacatatcatcttagatatttattaatctaagttattttctgtttcgaattatttatttttaaaaaatcccagaaagtaacgatatcctgtaatactaaattttagcaagcttgtaatgatttgggcatgttaaagtggtgaaagactacttaatttgggttgttataaattgctaggattttaaaattttacttcaaatctacaagtttagacaatttgccatcttattaaaggtatgattgtcagattaatatttaatcaatttataatttgtagtacttttaaaaaaacaaattaggtgagaac

SEQ ID NO: 4191 - DNA, 60 bp, Methanobrevibacter ruminantium
gtgtgctaatttactttattttacatttttttattaatttatacatttttactttttata

SEQ ID NO: 4192 - DNA, 30 bp, Methanobrevibacter ruminantium
ttatattttttctttttttctaatcttttt

SEQ ID NO: 4193 - DNA, 373 bp, Methanobrevibacter ruminantium
gtaatcctattttttataaaagataaaattgatttaatattggaaattgatttaatattggattaaacatcatttatttcttttaaaaaattttatccattgtggaaacctaatgcaataatgttgttatttcaccattccacagaaagtttaaaatataagtgaaattaatagtttaattaagtaaaataagaaaaatcataaaggtttaattttcatagctaaacttttatttaacgaaacaattgttaagatggttttgtaaactgtttttataaattaatgttctaaacggtttttatttaactaggaatgttgtaaactgttttgatttaactaagaatgctgtaaattgctttaaaagaataatttt

SEQ ID NO: 4194 - DNA, 419 bp, Methanobrevibacter ruminantium
ttatgctattgtttaattttcatagtttaacgtttatttatcgaaaatatagggcttaattttcatagttaaacgtttatttatcgaaaatatagggcttaattttcatagttaaacgtttatttatcgaaaatatagggcttaattttatagtttaacgtttatttatcgaaaatatagggcttaattttatagtttaacgtttctttaatgaaataataatgcttaattttattgttaaacgtttatttaatgaaaataataagcgaaaataagcataagtttataaaaataaaattatatgtttaaagttatgtgatgaataggtgtttatttaaaaatgatttgaagaaagtattaaaacaattattaatacttaattcatcaaatgtataaaaaattcttgttttattaaaaga

SEQ ID NO: 4195 - DNA, 329 bp, Methanobrevibacter ruminantium
aaaatcactaaagaatcattatattgaataaaaatttataaaaagtcttgtttttttgttaactgaataaagttgttatttggatgttaaattttaaaaagtcttttccacttttttagttaaattcattttagaatttaagttattattttataaaaagtcttttccacttttttagttaaattcattttagaatttaagttattattttataaaaagtcttttccacttttttagttaaattcatatttgaatttaagttatttatttataaaaagttttggtctaataagtataagaataattttaaggtataaaaaaagaaaaaa

SEQ ID NO: 4196 - DNA, 10 bp, Methanobrevibacter ruminantium
attaatcacc

SEQ ID NO: 4197 - DNA, 226 bp, Methanobrevibacter ruminantium
gttttatttcctccaaatattaaaataaaaaaatattattttttaattcactatatcatataatgagcatatttatatatgctcaaaacataactttattaaagtattgctagattttttagttgttgctatgcaatgcaactgaaaatacttcaataagtatatttatataataagttatacttaaacttatttgacaacatataaaatttagttgattttgatt

SEQ ID NO: 4198 - DNA, 8 bp, Methanobrevibacter ruminantium
gtattgaa

SEQ ID NO: 4199 - DNA, 74 bp, Methanobrevibacter ruminantium
aggcattaatgattaataaaatcatttatttccttacattaatttcaatttaaaataatcctttggagattttt

SEQ ID NO: 4200 - DNA, 119 bp, Methanobrevibacter ruminantium
atttatttattcagttaatatataggcttaattaattttcaattattatatttattatttatcaaattataatcattaaattatcattaaaattatttaaaagtaaaaggagaaaaatt

SEQ ID NO: 4201 - DNA, 61 bp, Methanobrevibacter ruminantium
gaattaaaaccaatcaaataatcaatgcttatttatagaatttattgcacaagaggtaaaa

SEQ ID NO: 4202 - DNA, 231 bp, Methanobrevibacter ruminantium
ttaaattgattatgttcttatattggattgattaggtgatcatgttattttataggattgattaggtgatcatgttcttttatgggattgattaggtgatcatgttcttttatgggattgattaggttgattatgtttttttatgggattgattagattaaccattatcttaaggggaaaattagaataatgtttataataattatttaagtgtctattggaggaaaaata

SEQ ID NO: 4203 - DNA, 16 bp, Methanobrevibacter ruminantium
cttagaaggtgtgatt

SEQ ID NO: 4204 - DNA, 39 bp, Methanobrevibacter ruminantium
tgttgatgaggctaaagaggccataaggagtaaatgctt

SEQ ID NO: 4205 - DNA, 112 bp, Methanobrevibacter ruminantium
acttaaattatttttttagattagattatctaaatttaaattagatattttttagattaattaaattgatttatagagtaattattgaataaaaacaaatcgaagtgatagt

SEQ ID NO: 4206 - DNA, 33 bp, Methanobrevibacter ruminantium
tcttaagagatcaaatgaaatagttttattctt

SEQ ID NO: 4207 - DNA, 257 bp, Methanobrevibacter ruminantium
tttttttttaatttatttgtctttttttatttattatcaactcttatataattgatatttttaatattttttcactctttctttattttcaactcttttataatcaatatttttaaatatttcttacaataaagtataatttagtgattttaaaattttctttagttgctttgattataagttctttagaaaattataatttaaacgattaaattgttatttagaaataatattttttttaaagaaaggatgataat

SEQ ID NO: 4208 - DNA, 123 bp, Methanobrevibacter ruminantium
tttcttctttaattacttctttaatttcttctttatttttatttatgcatataaaagatttatttagttaaaaatcatatttataattaggatttgactttctaattattctaaggtggttaa

SEQ ID NO: 4209 - DNA, 159 bp, Methanobrevibacter ruminantium
gtttataagacttattttcacttatttttttcttattttaatttttatttcttattttaacttattttttattttcacttatttttttattttaactttttttcttttattttaatcttaatttgttattttatcaagttcttatttaacttattttac

SEQ ID NO: 4210 - DNA, 230 bp, Methanobrevibacter ruminantium
cttattcctcttgatttaatggtatttttgtatttaattaaatatttgactttaaaattaattaaatttatttataataaaaatcttaatttatattagaaagaattttttaggattttaagaatcttaaattatcttagaaatgtatttttaaaaaatcttaataatttaaaaagttccattttataaacttatttttaaaagcctttagctaaattggagagaaaacc

SEQ ID NO: 4211 - DNA, 67 bp, Methanobrevibacter ruminantium
gatttgattgaatatatttttcataatcattttaagatttaatgatttaattaagttaggtgataag

SEQ ID NO: 4212 - DNA, 169 bp, Methanobrevibacter ruminantium
tttcatttaattctttttttaattttttttaatctattttttcttattttttatttttagctatttaatttaatctattttttataatttttcttattttttatttttagctatttaagttattctattttttaaatttttgcttattttcattttaaagatatttaat

SEQ ID NO: 4213 - DNA, 125 bp, Methanobrevibacter ruminantium
gttaccgccttatttagttctttaatgtatcaataattttaataattcttttttagatattattttaaaattggattaaaattaataataaaattttaaatcattattttgatgttggattaatt

SEQ ID NO: 4214 - DNA, 58 bp, Methanobrevibacter ruminantium
ttttaaactttcctttaaataatatattttcctatttttccttatggtttaattttat

SEQ ID NO: 4215 - DNA, 32 bp, Methanobrevibacter ruminantium
catctcaccccatattttggaaataattttta

SEQ ID NO: 4216 - DNA, 75 bp, Methanobrevibacter ruminantium
aattaataggataataatctaatttaataaataggataataatctaatttaataaatagttcatttggtggtagt

SEQ ID NO: 4217 - DNA, 64 bp, Methanobrevibacter ruminantium
atttttatccctttttttgctttacaaccgtctttattgattgttaaacattaatcagattctt

SEQ ID NO: 4218 - DNA, 13 bp, Methanobrevibacter ruminantium
attggttagatat

SEQ ID NO: 4219 - DNA, 497 bp, Methanobrevibacter ruminantium
tttattagtatatagcaatttaatataattctattgggattattttaatgaactattaataataagatgatttttgtatttttatcaattatcattaattaaatctaattcaataagctttacgattagatttaatgtttttctattttttttaattagttaaatcataatctagctatggctataaaagtttattagtaatttatcgagtattaagttactctatcttttagtaagctgaggtagttattatttaattagaattattaaatgtgcttataaactgatattgatgaactcttagtttaaggggaacggggattgattaattagagattcatttaatggagtctttaattcataaaaccgccattcgctttttgctaagttttacattgttgaaaaaactgtgctttaaaaataaagcattcgaatccgctaaatttttaattaacgtctcgtgggttcgctctataaattatatggaggttacttta

SEQ ID NO: 4220 - DNA, 128 bp, Methanobrevibacter ruminantium
gttcttttataaggcttattaaagaattaagcctttttaaaaataactttttaatttgggacaagggcaaacatgaaaattatatttaaacttataaataatttaatctaaattaaggagatgtgatt

SEQ ID NO: 4221 - DNA, 11 bp, Methanobrevibacter ruminantium
ggtgattaact

SEQ ID NO: 4222 - DNA, 12 bp, Methanobrevibacter ruminantium
gaagggtttaat

SEQ ID NO: 4223 - DNA, 2 bp, Methanobrevibacter ruminantium
ta

SEQ ID NO: 4224 - DNA, 20 bp, Methanobrevibacter ruminantium
gctaaaggattggtgttaaa

SEQ ID NO: 4225 - DNA, 121 bp, Methanobrevibacter ruminantium
atctatagatttaaatataatttcaatctataattctatcttatttaatttaaaacatagattagggaatattctaattaggattattatacgaattatttcaaaagatggagtgtaattt

SEQ ID NO: 4226 - DNA, 270 bp, Methanobrevibacter ruminantium
ttgtattttttatacatgattttgcatttaattaaaataaaaaagatcattttaataatttgaagtcttttcgaattatttgaattttctttatttattttcttaatgtaaaatttaaatttctgtatgaattattttaatcgattaaattaattttaataatttgtttttatttcaattaatttttattgattatatagctgtaaaattaaaattgaattattttcatttgaaaataatattttatattaaaaaggaaatgatgattat

SEQ ID NO: 4227 - DNA, 250 bp, Methanobrevibacter ruminantium
tcaatccttttttatattttttaattattttatttagtattggattattcaaatttcaatgaaatcattcaaatgaatcattttatttttaaaatgatcattaaatgagaatttttatatttcaatggaatattctatatttcattgaaaacttcattcaatgatttagagaaattaattaactattaaattttattaatagtttattattatgctattgattatttttataataattaggagttaaata

SEQ ID NO: 4228 - DNA, 659 bp, Methanobrevibacter ruminantium
tttaattattctttatctttattcttttttttatttataaaagaagagtaaatagtttacagaactttaaactgttatgcaagttttacagaactttaaactgcaataataatatagttttagcaaactttaaagttaaaaaatcaatatagcaaaaattgctataaatttataattaagtatttaaataataaaaaacttaatataattataaataaattatttaaatcatttattgaatcatatttaaaatttatttatttatctcttaaattaagaatatcatatgcaatctataaatcaaccttctagtttttttatgattatatttaatccattatagattttatggtaagacgaatttggcagattctttaaataagtaggaaattaatttattaatttatttaattattgaattaacttaattaataaaaataataattaagattagttcatattaggtcttaataattgaaattaatttatttaatgaattagtttgaattaggtccggataattattataatctaataatttcaaaattagattatcagatgtttagattaataaataaatgccattgtctaaaatatagtctaaaaaagcttgtgcatattatttagatacactttaattaacctttagaggtgttatt

SEQ ID NO: 4229 - DNA, 402 bp, Methanobrevibacter ruminantium
atagggcttttggataggaaagagtttatcagattctaaagaaaattcaattttattatttactcaatatgtgataataaagatttatatttattatttacttatctgtttataataaaaatcattaaaatcatataattttaattgtaagttattgagcgattttttacaattaaaacaagtgtaatttattggccttaagaaatttaggctaataaaaaaatagttaaatatattaactttaaaattaaactaaaagtaatattactttaaatgtatttttgtaatattatggtttatttttaagtttacaggtaatttattaataggctaaagcattattcaatgtatcaagtttattaattaaattataattaataaaaagaagaaaatggtgtaaaa

SEQ ID NO: 4230 - DNA, 197 bp, Methanobrevibacter ruminantium
atttgttatttaaatagggttcatcaatctttggattataaattcattaattgaattataagaaattcattaatcctttcgattagttgaattctatttataatttttttattaaaaaattaattataatttaatttattcatttaaagactttataatttattaataaaacaaaaaagatttatataggtgatata

SEQ ID NO: 4231 - DNA, 18 bp, Methanobrevibacter ruminantium
ttcaagcttttcctgcaa

SEQ ID NO: 4232 - DNA, 244 bp, Methanobrevibacter ruminantium
tttgaccaaaaattttatcacggctatgtgataaaatcctttttttattttaaactttaattcagattaatttttagtttttttccgctttttttataaatttttatttaaatattctttggaaaaattttttatatttttttcaattatcaacgagttttttctttaacattgaacattattcattctgattttctaaaaaaaattttttattttctcataaaatccttatttttatttttta

SEQ ID NO: 4233 - DNA, 26 bp, Methanobrevibacter ruminantium
atagtttattaaagaaataaagtaat

SEQ ID NO: 4234 - DNA, 108 bp, Methanobrevibacter ruminantium
tcttttttattttcattttttatatgccttttttaagttttttttcaatgatttaataatattttttttatttttcttcattttaaagtttattagtagaaacttcga

SEQ ID NO: 4235 - DNA, 187 bp, Methanobrevibacter ruminantium
tctttttttattttttttttatttttttatttattaatgtctttttttaactattttaatctttttttatattttaattagttaaatttttactttttctatatctgcaatcatatatctaattcaaattaaacatatttttatattactaaaacaaatttataattataaaatccaaggtgaaaat

SEQ ID NO: 4236 - DNA, 4 bp, Methanobrevibacter ruminantium
aagc

SEQ ID NO: 4237 - DNA, 280 bp, Methanobrevibacter ruminantium
ttttatttcaacaggcttgtataacgtattttaattatttgttcaatagagcctaaattttatttatttgcttattttaattattttgttctaaaagcagtcttattttaattatttgcttatttacttctttattttcttttaacttaaatctcttttttttcccaatcattacagctgtcatattgattgattaatttttcatgaaaaacgcaataatactgtgtacataaatttaagtcaaattccagatatttgcagttatagcattccttttctt

SEQ ID NO: 4238 - DNA, 132 bp, Methanobrevibacter ruminantium
ttttttatattatttaagatataattataaatatactaaaagtttaatgatttttgattttattagttttaatcaatattgattttatttaaaaaaggcattgtccttttaatgattatttggagaaatttg

SEQ ID NO: 4239 - DNA, 212 bp, Methanobrevibacter ruminantium
tcctttttaatgggttctttttatttagttatttatttagttattttatagttattttatagttattttatagttattttatagttattttttaattagttttatttattgtttttttctaaaattttatttttcatttaaattaaatattaaacaatttatttcttgaaatatattatttttatctttaattaattcttaagtgtgatttt

SEQ ID NO: 4240 - DNA, 185 bp, Methanobrevibacter ruminantium
tctttttacaattcttttgataaaattaagtaattgagattattttttcacattaattgtcgtttaacacttgtttaaaaatttctagttttgatttatttatattcaatcttttaaaaatggttttttcaatatgtggtaatttttgataatttcatactcaatatttaaatactatgatgatt

SEQ ID NO: 4241 - DNA, 562 bp, Methanobrevibacter ruminantium
ttaaatttatcataattttcaatattttattttaggatttatcatttggatttaagttaattagagttaatttcatattttaatagataatttagcttattaaatgatttaattttcattttttaaaagataataaaatttatattttatgttttatattttatgttttaaataatttttaagggtattaaattattttaagataatttaagtaatataataatttttatcaaaaaatcttcacttaaattaaatatctgttttttaggtttctgtttttatttaaataatcataaattattattttataataatttcaatggtttttatttacttatcataacttttatttttttaaaataatgctatgatttttatgtacttgtcgtaagttgttatttttttaaaataatgctatgatttttatgtacttgtcgtaagttgttatttttttaaaataatgctatgatttttaattgttattttttaaaaataactctaatgatttatattttacaaatcaattatttattatacttattcaatacaaaagaggaaagaa

SEQ ID NO: 4242 - DNA, 53 bp, Methanobrevibacter ruminantium
ttttagcaaatagataatctcgagtatagttttagctaaatagataatatagg

SEQ ID NO: 4243 - DNA, 66 bp, Methanobrevibacter ruminantium
aaacggttaataatttatttatcatactaattaattacgggaaaaaataaccaaaggagaaaataa

SEQ ID NO: 4244 - DNA, 95 bp, Methanobrevibacter ruminantium
atttttttcttggctatgcttgtaatcgcttagggggctatctaataattgcctttatatgtgctttaatttaatacggcttatttttgttcatt

SEQ ID NO: 4245 - DNA, 171 bp, Methanobrevibacter ruminantium
ttttttttattaggattaattataattcataatttattaacccatttaagagttttcttatttttagggacttttattttaagaaaataactatttaatatagaaatagcaattaactatttaattaagtttaaataaatctaataatgtaaaatattaatttaaaattat

SEQ ID NO: 4246 - DNA, 45 bp, Methanobrevibacter ruminantium
tttttatatttatactaattatcattctattttaagagggaaact

SEQ ID NO: 4247 - DNA, 103 bp, Methanobrevibacter ruminantium
tcttattcttttttaatttttttaatttttttaatggtcttatttatatctaaaacaatttttatttttattaatatctttcttttatagaataagtgataat

SEQ ID NO: 4248 - DNA, 189 bp, Methanobrevibacter ruminantium
tccttattgtggggattataaggcttttttttatgaattttatccttttatttttcatatactactttttttaaattatcaatttttttacttttcatatacttagtttttttaaattatcaatttttttacttttcatatacttagtttttttaaattatcaatttttttttaactttttctcaatca

SEQ ID NO: 4249 - DNA, 4 bp, Methanobrevibacter ruminantium
gtaa

SEQ ID NO: 4250 - DNA, 160 bp, Methanobrevibacter ruminantium
ttttattttcttttgttttaggggaggttaatttgtgaatctaaaacgtattttactagtggttttagttgctgttgtagtgattggctctactgcattcctattaaattatgatgaaactgtaaaatacactacatataatttatccaaaacatgcatg

SEQ ID NO: 4251 - DNA, 281 bp, Methanobrevibacter ruminantium
ataggataatttattttatccttttgactctttttttcattactaggctatttgccctatctttaagactttttattttattttatttcattactggactatttgtcctttctattttattttatccatagatttcctacttattattttatcaattctctttttattaagctgtcacactttttttaaaaatatcttgtcacatagatttagggtgtgtcatataaatttagaacaaaacatttatatactagtttgttcataataataattgtgattag

SEQ ID NO: 4252 - DNA, 933 bp, Methanobrevibacter ruminantium
ttttaatttttttcaatcattggatttgtcattaaaattaagaacattatctcataaaaatactttgacctcttcattaataaaaatccataataaaacacataaatcgaaactcattatgcaaatttggtggttgaaaaaatctaatccttatcaaatgaaaatttgattattccattgattatatgataagataaaaaagctcatgtttattcatataacacctataattaattgatgggatctgttaagtttcttaatcaggtcttgtcatcgaaatagtaatatattgtttctggattctaagaatcattttgatactttattttactaatctgttatttggaataagattctggattttagattttaaaatatcgtcttttgattcttattatttggaaacaatattatttaaaaacggagaagatatgaaagttttaaaatgataaagaattattgtttaatatccaaataaattgtttgtcaaatgtctctaaaagattcataatatcatcatgcttatgaaaaaataattgcattcttgggggtgaattatgcaataatgaaatatgaactggggtgattcatatttcatttttcataagaaataagctggggtgatcttatttctttttaaaaaagaattgagttcgggggtgagctttattcttttttcctagaagcaagtcatgatgaacttgattcaaatattatatgattcttgggggtgaaaattaaggaaatatgaattgggggtgattcgtatttcattcattgaataggcctgggggtgagcttattcatttactcttatagaataactcatcatttaactcttattgataagcttgggggtgagcttatccttatggattgaataagttatgggggtgacttattcaattaccaattataatctcatatgcgctt

SEQ ID NO: 4253 - DNA, 247 bp, Methanobrevibacter ruminantium
ttctttaatcctcttttaaactgcttattttctatttaaaaatccatcttatttaaatagttttttttgaatcttaaacaataattttcgctgttttataaatcattttttaaaaacttcttttaatttttccactaaaaatccttaagtttaagaacaataagatacataatattatatattcttaaattttagaacattcatttaatatttatttcatcaaatgatgaataaggtgaggacttag

SEQ ID NO: 4254 - DNA, 133 bp, Methanobrevibacter ruminantium
agactataaaagatttagttttttactattgaggtttatttttactattaacgttatttttatattgaggattatttttactattgaggtttatttttactattagctttatttttattattgaggtttattt

SEQ ID NO: 4255 - DNA, 726 bp, Methanobrevibacter ruminantium
tggatttcatataagtttcataaaacgaaacagaattattagttttcacacgctcttggacaatccatttatatatgcctatccaatataataactaagaacaattattttggtaaggcttttaaaaagcccttattggaatggttctttatcggaaaacatgatttaaaattaattttcattaaattattttggattatttggataattgtttggacatataaattctggatgtcaactcctaaaactacattcttattatttggaatcaaaatgtttgaattagctttttctaaatgcaatctggattaatttaaatgattttagttttatcggattattctaaacctaatattttatcaatttattcggctcttttatttctcgtttagaataatctccaaattccattttccgtttttctttttttatgcatgttcattatttttttagatttccatgatccgtttttatgtatattcattattttttagattttagtcatttttgcaaggttaattttttatgattattatatttatccgactattttatcaattttataaggagtttttccaattaaagaaaaattataaaaagaattaattaaataattaataaatggtaaaactaaaagtttaatcaatttataaatctataaaacttaaggttttattatcaattataattataataatttatcaaaaatatttaaaggtgatataa

SEQ ID NO: 4256 - DNA, 40 bp, Methanobrevibacter ruminantium
tctttttacttgattattttttattaaagggggttttttt

SEQ ID NO: 4257 - DNA, 103 bp, Methanobrevibacter ruminantium
ttgataaatagggtggtagtgtttttataaatgaggattgctttattttaatttgactgattaaataaactgatgtttttaaatagatattaatagtgttctt

SEQ ID NO: 4258 - DNA, 305 bp, Methanobrevibacter ruminantium
tcatctattttcatttatacattatttttaaactctttcccctatttttttctatatttttaactttttttttttaatattttttctaatttttttttaactgttctttttttataattttttcttatttatttttctaaacagtttttttttcaacgattttattagcatttatccattaaatctatttgccaatttttaattagctatttttatatattctttttaacaaaaattatatgtgtgattaagattatattttttaaaattaaatattaggcaaatcctaatagaaaggtgtttga

SEQ ID NO: 4259 - DNA, 152 bp, Methanobrevibacter ruminantium
tttttataaatttttccatgaggaaagccagtattgtttggctttcatttattttctttttcagattctttttcagattcttttaaatatttttaattatttttacttatttttattactttaaatttttactattattttttatatttaaa

SEQ ID NO: 4260 - DNA, 83 bp, Methanobrevibacter ruminantium
ttattcaccgattaaactttttttagcttgtgcttttgttttttgataatcttaaagtttttttattcacatcttgttgaaat

SEQ ID NO: 4261 - DNA, 98 bp, Methanobrevibacter ruminantium
aatatcctcttttcgatgctttattagttttcagttgtcttagtattttgaataacgcttctattttttcagttgtcttagtattttgaataaatatt

SEQ ID NO: 4262 - DNA, 51 bp, Methanobrevibacter ruminantium
attaacgccacggtttcttttgttaattccattattttcacttaataatta

SEQ ID NO: 4263 - DNA, 40 bp, Methanobrevibacter ruminantium
tctatctcctcattctttaagtcagtaaaatataatttgt

SEQ ID NO: 4264 - DNA, 785 bp, Methanobrevibacter ruminantium
tcacttattgtttttattatgcaaaactattttttcccatatttttttgctattgtttggctattgtagaactatttttttcccatatttttttgctattgtttggctattgtagaactatttttttcccatatttttttgctattgtttggctattgtagaactatttttttcccatatttttttgctattgtttggctattgtagaactatttttttctcatatttttttgctattgtttgattctagctgaactatttttttagaatttttccctatttgttttatagattataaacaaatttccctattttgttcgctatatattaaataattttatttttagttaaatcactcttttttctatcaatagttcaattttagttatttctttaaaaagaaaacatattctattgaattatttttagtataatcctaaaaagtgttatttgacaaaaaattttttctattgtatacttggagggagaggtgcatttctactgtaactcgttttttaattctttcttaaattaatttttttcttaaaataaagaatattcatattttctttcacttgcatttattttttaattaatattttttataaattttaactaatgtccattattttttctattccatttatttttattcaaatatcattattttactataatttgtttctttattcctaatttaatccttttatttaaattatccgtatatttttttcttgatatatgtgtaatggacttgaaatttttatattgtattttcaaaatat

SEQ ID NO: 4265 - DNA, 167 bp, Methanobrevibacter ruminantium
ggataaatttgtttattttaattcaatatgattattttcataatctgattggtgatatgtagatagaataacttataaaatatattttattatattttggtcatacaaatcacatcttaattatgcgaaaggaatcttttataatccgaatttaagtttgaaaaaag

SEQ ID NO: 4266 - DNA, 972 bp, Methanobrevibacter ruminantium
aatttctttggtattcataaaaaagtatatattgttatgatagatatattatattagtaagaacttaatagaatttaagtagtatattagtattgttttaataagttctaacaaataatcatatttttggccttttgcctaatctatattataattattttttaaaaatatatttaggggttattgagtacattttagatgtaggcgtcttgattttttaatcaagatgtattacatccttttttctctttttgctataattttataatgtctttattattgtttaatcatgtttttagtatagttttataatgattttcttattgttttattaagattttattatagtttcattattgttttattaggattttattatagttttattcttctttagtttggtttttattctactttaattgcaataagttattgttttattttgacttaatagattattttgcctattttttaaataatatttgccactttaataattttttaggtaaaactaaattaaatcaactattacgaaataatcagtctttatttttaaaaagaaataatattttagaataatttaaatataaagaacattaaaactaatattgtctgataaagaatgggttaaacctattatttatgagatttgccattctaatatgtttgtaatgatgattaatttctgatttatgaacatattagagtatacctatctatttttcttaaattttattttaatgattatcttttaaaataaatgatgatttaatcgattttaactaatctaattgatttaaattgtttaaaagattgattagttttataatttattgatttaaattgttttaaaagattgattaattttaaataattttaatttcataactaataaataatttaagtttttaaaaaatccttggatttttaattttataaaattattattgactgacgattatagtgattata

SEQ ID NO: 4267 - DNA, 153 bp, Methanobrevibacter ruminantium
attgattactttaattctctttaataattattttttctttttttttagagaattatttctattctcttttcattattttattttaaagcaattattttactatttttttctatctttttttatttatattctttcgccctctattttttcttt

SEQ ID NO: 4268 - DNA, 29 bp, Methanobrevibacter ruminantium
ttatttaattcggtattttaaagtcctag

SEQ ID NO: 4269 - DNA, 549 bp, Methanobrevibacter ruminantium
atatgttcaccgaattaatctttattttttattaagttatacaacaaataagtatgaatttgtttggtttactatatgcataatatataaaattagattatgctatcttatagtattataattatatattttttattttatatatacattgtttttttacgaattttttttaaaatttttattattttttccatatttttttattattttttattatttttgcttaattttttatatattccttctaattgtctttatttatgttttcattaaatattttttactctagataattatattatttttatagctcatattgctaaatgattaattctatttaagtcaaataactgtctattgtccctttgactatttttctacatcagttttatataatatatttaataaataattaattgttaggtgattttaattttttaaattaaatctctaaagcattttaaggtttaaaatttaaacatttaaaggctctaaattcaactatcaaaattatttaacttgattataattatttttccaggtgaaaaa

SEQ ID NO: 4270 - DNA, 177 bp, Methanobrevibacter ruminantium
tttagattcccttattctctttaattttattttttattagttatttttattatatttcttattagaattaattaagattcttaattcttatttaattcttattagatttctatttatttctttattagaattcttttcaatttattatattttttaatttattattttggtgatacg

SEQ ID NO: 4271 - DNA, 103 bp, Methanobrevibacter ruminantium
atcggattctttagattaattgggataatttactgtattttagttaatcgaatttatattattcttaaaagggttcattttttaattttctggctgtgatctt

SEQ ID NO: 4272 - DNA, 125 bp, Methanobrevibacter ruminantium
gtgtttttgtaaacttagaagattaagtgtttttgtaaacttagaagattaagtgtttccgttcaattaataggtttaaacttttttttattcaatttaacaattttaactttgttggggattaa

SEQ ID NO: 4273 - DNA, 93 bp, Methanobrevibacter ruminantium
taatttattttttagattattttcattttcaatcaattcaatcaattttattaattttattttataatgtcaaacttttattatggtgtattt

SEQ ID NO: 4274 - DNA, 105 bp, Methanobrevibacter ruminantium
gcattttaggagaggcttaaacattttaggagaggcttagacattttttggtcaatatgtagaggttcgtttttttaacttattctaagagaaattttaaaaatc

SEQ ID NO: 4275 - DNA, 25 bp, Methanobrevibacter ruminantium
attaatatataaaaggagattttag

SEQ ID NO: 4276 - DNA, 396 bp, Methanobrevibacter ruminantium
ttttttctttttaaatagtttctttctttttttatttttagactcttattttttcttctttcatcattttttaggtgcttatttttcttttttttatcattctatttttatataataatttttcctagtttttttttaagtgaatttagactctaattttgatatttttagttattttttatatttttacgaagtatttgtgatttagataaaaaagtaaaataattattcttttaaaaaaagataatttattagttttaaaaaagagtttatctatttaaaatataatatttaaaagaagaattttgcttgatttagaattaaaagtaaaatatcagttatataaaaaataaaaagagtaaagttttttaaaaaaagaaaaaaaggtttcgacat

SEQ ID NO: 4277 - DNA, 355 bp, Methanobrevibacter ruminantium
tttaactgctccttaaaatcaaaaaacttttattgtgattatactccataacctattaactttatattcattcaattatatatatgttaagtttttcaagtttttcttttagtttctcatcagttttttaagtttttcttttagtttctcatcagtttttttaagtttttcttttagattcttatcagtttttcaagtttctcattgggtttttctagaacttttctaaatcctttccattcgttctattttaattctaatagtctcaatttctaatgtatcaaataactttcttaaatccagtattacttattttacaaaaattatatatattttattaactataaatttaagc

SEQ ID NO: 4278 - DNA, 273 bp, Methanobrevibacter ruminantium
tttttacgattaatttttaaattttttaatgcttttcttgcatctaaaaaaaatattttaacttttcttcgtctaaaaaaaattttttatagcttttttttttaaaaaaattacactaacaatcataccaaaaaagtgtccaatgttagcatattggtgcatgatttctcgtttttgtaactttaacggtacatttatgtaagcatatcagtgtcttaacaattgttatacattcttaattaagccaatatattctttttattcatatttatt

SEQ ID NO: 4279 - DNA, 137 bp, Methanobrevibacter ruminantium
ttttatataaatggctatgtatgattggagtaaaaaaatctcttcaataggcataggccacattttttgttaaataaatttatatagaaattaaaaaagacaattttttgtttaatttttaaattaaagtgattttt

SEQ ID NO: 4280 - DNA, 29 bp, Methanobrevibacter ruminantium
atttaagtctttaaaactcccttaggttt

SEQ ID NO: 4281 - DNA, 177 bp, Methanobrevibacter ruminantium
ttttttcttttttttatttttttaaaaaacatttattattttcattattttattattttattttatttaattaggctatttttgatggttctgtttcagaaagcagtttattctagcctatgcttttattcattttaaattgacattttttaaatgccaaattatatatataataga

SEQ ID NO: 4282 - DNA, 132 bp, Methanobrevibacter ruminantium
tttgccagtctgattctcatatttgtattttaaataattattggtgttaattatcagtattaattttattggtgttaattatcaatattaaatttattagtgttaattatctgttttaatttttattaaaag

SEQ ID NO: 4283 - DNA, 287 bp, Methanobrevibacter ruminantium
atttttatttcggttgtttcgagtcaagcttttagttttggctgttttcagataggccttttggttttggaaaaaaaactagctgaatttttattagagcgtttccaacttatcttttttaattttatcaattttttttattagattttttaattgtttgtatatttgcgaataattcttatttttaaaaaatgtgcccaaatttttaaaaaatcttttttaagttatttatttctttgttaaaaagagtaatgaaaagaactaaaatgaatatttaatctaaaagg

SEQ ID NO: 4284 - DNA, 133 bp, Methanobrevibacter ruminantium
aatatcatctttaaaaatagtttttataaaaaaataggtttaatgatttattttaaaatttattaaaatttattaaaatttattaaaattattaaaatttataaaaattcaattgtttaatttttaattttgt

SEQ ID NO: 4285 - DNA, 52 bp, Methanobrevibacter ruminantium
tttcattcctcttaatatattttagtccggtttttcctagttgtaaaaaaaa

SEQ ID NO: 4286 - DNA, 169 bp, Methanobrevibacter ruminantium
attatcaccataattaaataataaatctgaataattgattgtttttattaaatataatttttaagcttatatttgaataaatgattgtttttattaaatataatttttaagcttatatttaaataaatgattgtttttattaaatataattcttgttatattgaataaa

SEQ ID NO: 4287 - DNA, 55 bp, Methanobrevibacter ruminantium
aaattaacatgctttaaatttatgaagataattaaaaatttataaggagaataat

SEQ ID NO: 4288 - DNA, 94 bp, Methanobrevibacter ruminantium
ttaaaaggattggtgaataatttatatttaataatttaatgtattctccttaagtttaagcatgttttaataaacttattggtgatgattattt

SEQ ID NO: 4289 - DNA, 222 bp, Methanobrevibacter ruminantium
atgatttattgattgtttaatggataatcgattaatcaacgttttcaatttttatatttatagaatttatagatttcattgatttatagattttatagattttattgatttatagattttatagattttatagattttatagattttattgatttaatgaaatattgattttattaattttattaatttttttgatttttattagggattttggtgtttatt

SEQ ID NO: 4290 - DNA, 312 bp, Methanobrevibacter ruminantium
ttttttattttttcttttttttttaaaaagcacttattaccttattcaatatttgagctattttttcttattttcaaaaattcatctctttttaagccttaaattttatcaatttcttatttaacctatttaactaattaaactataaataagataattaagataaatatagtataattctaatattcaatttaaacaattatttttttaatcaatcattgattttaattattaattattcttattcatacttattagaatgtttatatatttcaactaactaaaaaatcaattttattgggatttgagtaa

SEQ ID NO: 4291 - DNA, 142 bp, Methanobrevibacter ruminantium
tttttacctttattctttctttttttaaatattttttataattttttaattttagcaatgtttttagactaatttttgttttcatttatttttgcaatatttattttttatttttgtttaattttatcatttttgaatattt

SEQ ID NO: 4292 - DNA, 284 bp, Methanobrevibacter ruminantium
taatttcataaaaaaatgctaaattttattactattctcaattatttcatcaaaattagtttattaatttttcaattttttaactatatttgcaaactttaccttttatttttgtagaatttttaataaaaatcattagttatttatataacggataataaatattatagtgttagatgattagtttttatatataaaatttatataaaaattcattaaaaatcaatttaatctatagactttaagtctttaataattaataatattttagaggagtgtttatt

SEQ ID NO: 4293 - DNA, 184 bp, Methanobrevibacter ruminantium
ttaatttttatttatttttaatatttattcattaattaatgtttaagttaaaattgcaatgtttaatttttagtttaaacatatttcttaaacattttaaaaaaataaattcaattcaaatatccaaaattaatcaaataaattctttcggcggagaatttataaaagtcctcacggtgatatt

SEQ ID NO: 4294 - DNA, 141 bp, Methanobrevibacter ruminantium
tctcttttttatggatttttcttattcatttttttgttttatatttttagttgtgatttgaatttcagaaaaataatttttatctatagtttgtgatttaaattttagaaaaataatttttatctattatgggtgcattat

SEQ ID NO: 4295 - DNA, 273 bp, Methanobrevibacter ruminantium
tttttttatttcctttttttttatttcctatataatattacttttttttttaaattatgatataaatttaattttagttttctaatttttatacataattactatctttttatttttttcaacagcttttcaagtattttttaaaatttttatttgtttctttaaaattcctttcatataattgaaaggatattaatttatttttactttgatatgaaacgaataattttaattaattatcatttttattattttatattttctctcattttc

SEQ ID NO: 4296 - DNA, 606 bp, Methanobrevibacter ruminantium
tcaatgcttattagcctttgaattaattattcacttattcaatttcattattggatctaatttatgggagtctattagtgaaggtattgctttgaatatgatgctgatatatgggagtctattggcgtggagtaattaaatcatgaattaatcattgtgagattttgctagaattaatttatttaaagaaatagacagaatttaaaaaatcaattaatccagtacttctggtaaaaaagtgaaaaaatcagtaatcctgatttaaatgtgaaatcattttcactaaaactcattttttgagtttaaagtttagttctgatttcaggagaaattatatttctaaaactcattttttgagtttaaagatgaaatcataatttctggagaaattatatttattatataattaaagatgttgaatttatataaattgtatgggctttaaaatatatagctgcagaggattttactatcacagtcaaatatctggtttaagaagaattcagtcttacagaatatttcttaagctattgtttgattaaaatagttctattcttataagctaaggtaaaagatatgattttaaagagtgtataattttcgtac

SEQ ID NO: 4297 - DNA, 492 bp, Methanobrevibacter ruminantium
ttaatgattgtaaaacaatcatataataagttcaagttatatgatttaaattataattaaaggagataaaatcagattatatgtttgaatattgtaattaacgggttaaatttaaaataaaaaactaaaataatatcaattcgaatatgcatcacaaatgaaaagaaaatttattaaatgtgtgtgtaagacttggcatattcaaaattatttgatattattggttttttctgtgtataaaggaaagataataaagttaactattataaaaataggtgttttaaaaattaactaaaatggtgtaaatgaactaaatgatgtgtatcaaatacttactttttgggtatttatcacatttttgaaaacgagtgttacttataataaaaaatttatcaaaatttgaatgcttagttttatagtatttatcacattttattattttgttgaattaaaattttattaattaaatttttattaaaggagggtaagtaa

SEQ ID NO: 4298 - DNA, 24 bp, Methanobrevibacter ruminantium
gataatcctacctataacattaca

SEQ ID NO: 4299 - DNA, 113 bp, Methanobrevibacter ruminantium
tttatctttctatcttttttattcattttttattcattttttattcattttttattcatttttttattttttcagtttttcatttattttttctttttcttttctaaattcat

SEQ ID NO: 4300 - DNA, 383 bp, Methanobrevibacter ruminantium
aattttttactcaaaaagtccatatttttcatccagattttttcaagaaattttactatgaaaataatcaaaataaggtttaattattttatggttattttaattcttttaattttaattaactatttctataattaaattaatagcactataaaaaatatttcattgctttttagatagtaaacatcaatttattaatatttctaattttattcaatttttaaaattttcttttataggattattggttttatattttgaaaagttatcagattagtcaagtttttttaaaattttataaaaagtttatttaataaaagaaatataaaataatttaattaagatttgaaaatctttatttaaagatgattgtggtgtttaag

SEQ ID NO: 4301 - DNA, 377 bp, Methanobrevibacter ruminantium
atttgcctattttctttaaattcattttttataatattttttagttttttaatctgtttttaattttttacttttttccagttttttgttctatttttcttgttttttgttttcactgtttcgaacgttttatatatagttttatatagtttacaaaaacgcttctggtttactatttataactatattaaacctatagttctttattttaaaaaataataagtttaaataaagaaatatatatatatataagataaaatacaaactattttatgtaaatattttataaataaataaatttttaagaagcagtgtctcataaatgacattttcagttgattttttttaagaaattaattagtataagaggtgataat

SEQ ID NO: 4302 - DNA, 348 bp, Methanobrevibacter ruminantium
acaactaagtcaatatataagtagaatgtttgtttaggattctgcttaataattttttctaatttttcattaatttttttctcatctttttttaaacaagtaaattgatttttttcaacataaaaatcatatgcttttgcataagcgtttacaactatgaatcttacaccaacataattttcagatattattttaatattttttataatatttcttagtatgtgagtacctaatcctttattggaatatttttcatcaattgcaaatctacctatttttattgcaggaattctttttttattagtgctgtctaattttccttgtattatggttcttactccttcatct

SEQ ID NO: 4303 - DNA, 57 bp, Methanobrevibacter ruminantium
attaccatcttctagaaataaacttttttaattaaaattcaattcattattattttt

SEQ ID NO: 4304 - DNA, 83 bp, Methanobrevibacter ruminantium
tttatcatcgattttttttagtttactttcttttcatttctaattcttcttgcctttattaattgcagtttcctatatttgcc

SEQ ID NO: 4305 - DNA, 446 bp, Methanobrevibacter ruminantium
gtaattttattttattgttctattatttaaatatttgctaatattttgggtaaatattgatttaatagtgttaaattgacttgatagtagtaaattgttttgatttcgtaataatattgactttaaagtgttaaattgacttgatagtagtaaattgttttgatttcgtaacaatattgttttagtttcgtaacaatttttacttgaatgtgtttatccgttttcttttgtggaagtccagaaaaaaggcttaaaattgacttttaataaatcagatttatcataaatttgctcattatttgatttttaattaatcagagttatcataaaaagattatttaaatagaatgaataaaatatttaataataaatatcaaatatttttaaaaaaaactatattctatcattaaacttattgtcttttaacagaatcgggagagaaaagc

SEQ ID NO: 4306 - DNA, 318 bp, Methanobrevibacter ruminantium
ttgattatggtttttttataggaataatctttcctaatttcactggttttcttcttctttttttgtactgctttttttttcagttttaaattttattttatttaactttcaatttttcacaatttttctatcattttaatttagtaagttttatatagttattattaaatagatatgcatataaaaaaaatctaaatttgcttttattttaattaaattaattcttttttaaaaaaatcatttttagattttaataacttaaaacaattgaatatgatgcttgttttattatttttttcttaatcttgaggtgaattg

SEQ ID NO: 4307 - DNA, 60 bp, Methanobrevibacter ruminantium
ctaagtatatttaatcattttaataaaacttagttaaatatccttattttttcattttat

SEQ ID NO: 4308 - DNA, 294 bp, Methanobrevibacter ruminantium
ttaatctcctccctgaatctatatagtgattttccttcaaattaggggctgctaaaggtatgttattagttcaatccaattttctttctttgatagtttttatctttttttaggaatttttctttaaaattagataatgcgtactctaataggttctgtttttattattttgttacatgtttagtgtaaattctagtgtaatgtttctaagggagaattgctttaacattatagtctgtatgactaaatttaaaggaatgcttgcgttcaattattagaattttttattttatt

SEQ ID NO: 4309 - DNA, 93 bp, Methanobrevibacter ruminantium
atgaacaatcctttatttttttcttttggtgaataaagtatttaaatcttttcttttttgaattcaagtaattttaacactctaaagtcaaaa

SEQ ID NO: 4310 - DNA, 90 bp, Methanobrevibacter ruminantium
tttgctattttcaagtaaaaattgatgtgaaagtgtgaaattgctttgttcgtatgaaaataaacaaaattccccttccattttcatctt

SEQ ID NO: 4311 - DNA, 294 bp, Methanobrevibacter ruminantium
ttaaatcatccttaacttgtttttgcttattttgaatctgtttaaatcaattattttcttttaatttgtttttgcttattttgaatctggtttaatcaattattttcttttaatttgtttttgcttattttcaatctaattaaatatgattaaatcaatcttttttacatgaaaaacttagtttttcttgttttataataagttttaagtattatataaatcataaatatttttaagtttttaaggaaaaaatctgtttttttaaaatgaattaaattattaaagagtgatttc

SEQ ID NO: 4312 - DNA, 333 bp, Methanobrevibacter ruminantium
cttttgataattttcattattatttttattatttttatttattttcagtctcaattttattatttttatttatttttcaatcttaattttattatttttattatttttttcattctcaattttattatttttattatttttttcattctcaattttattttttatttattttccaatctcaattttattatttttattaaatttttatttattttccaatctgatttcccataatcctgatttggatttaagattatggaaaattatattaaatcttaaatacttgttttgttataaattataaataatgaacattaactaaggaggttaatc

SEQ ID NO: 4313 - DNA, 417 bp, Methanobrevibacter ruminantium
tctctttttaatcttttaacccatctttttatttttttttaaacttttattcttattttattttttattcaagctctttttcatttagaattttttagacatttaaaactttatctgcttttttttaagatttttagtttttttttaaacaatttttttcactcatttctcaatttatcctatttttaatatttgaattttgactttttcattttttaaattatattttttaagcttgttttattgactaattttagtaatgtatatatagtgttatgaatatagtataatcaagtcagttttataatttttaaaatagtatttatggtgtttattcgaatattccatatcaaacatgatttaatttttataaaatagatttgatatgacttatttaatagttttaagggtgaattt

SEQ ID NO: 4314 - DNA, 215 bp, Methanobrevibacter ruminantium
gcagcaatcaaaactcccaagacaattctataattattgatgacacaaattataacactttttttgataatcaaggctttttaagcagtgatattgaagccaactctctcatttactttggaaatctatcaaacagatacataaaaatagacattccacttacactctcctccttaaatgagactactatttttaattccactatagaggtttta

SEQ ID NO: 4315 - DNA, 17 bp, Methanobrevibacter ruminantium
taaaaggagtagagatt

SEQ ID NO: 4316 - DNA, 731 bp, Methanobrevibacter ruminantium
aacagtcaggagctaaataaactgaaatctaaaaatcattaaagaaaacatattcggaattctcataatcatgtttcataaaaggaaacatatttggaatttcattaacatgttttcaatcgattttaaacttctattattttatttattatttttataaacaagtttttggtaatttaagcttgtttataaaactaatgataaaaaaagcaattttttttgaagttttaaaaaattcaactttgttttattatatataaaataaatttaatgatttaattttattaaataatggaataaggcagtttaagactattttattaattatttgatttgattgaatagaaaataaagtagtttaagactattttgttcttttttgatttaattaaatcatcattttaaaaaattgtaagacctttaaaaaagctatttaagcattgttaatctagcttttagagttattcgtaaaaaataatctcttttattaaaattatttaattaacatcatatatggataaaaaaatgaaagtattagattactcaatagttcatctttgtttaatttaaaaaaactttcataaatctttatctcacttatttggttaattattagtttgaatattcataaacctcgtaactttaataaatgatgtttaaatgctttttaatgatttttcaattattagaaatatttaaactatttaattaattgaggtgaaaatatttta

SEQ ID NO: 4317 - DNA, 19 bp, Methanobrevibacter ruminantium
attaattgacaagtttgta

SEQ ID NO: 4318 - DNA, 152 bp, Methanobrevibacter ruminantium
tactgtcaatcttgtaaatgaggatgttttatttggatgattttctaggaatttttaaaaaacaagttcttttttagaaggtgattggtgattatagattgccttcttatttttttattttattttaataaattttaagcttttaaatgtat

SEQ ID NO: 4319 - DNA, 377 bp, Methanobrevibacter ruminantium
aaaatcagcattttatcatccaattattattttaattcatttaataaaataaatcaaattttgccttttatattaacttaaaacaatcaatattcaatacccaatcaatacatcacttctaaacagccattccacttttaagtcaatattgttttcatatcaaaacaatttactactttcaagtcaatttcatatccttaggtcaatttcacattatcacatcaatattgttttgatttcgctataatttactattttcaagtaaattttgatttaactgtgttaaagttgtttgatttaagaatagataggtttaaatacttatttgtacaaaataagattacttgaaaatttttgaaaaatatggagtcaataaa

SEQ ID NO: 4320 - DNA, 64 bp, Methanobrevibacter ruminantium
cttttctattcctttatctttttaaaatcattttttttttaatttttctaatttaatctttttt

SEQ ID NO: 4321 - DNA, 613 bp, Methanobrevibacter ruminantium
actcaaaacatatgtaatgggtgacgtaaagagggtgaatatgtattgattatatatttagtctcttgactaggcttttaattttcatgagagttatatttagaataaaaaacttcattttgttctttataattaagtttaaatatccaacccccccccacttattatttaaatttaatataatctcatgaagattattagttttatttattacaaaatgcatttttttatagaaaagattatttttactcaaactttagtcttttcatatctaatttcttcatcacatcatcatttcaattcaattcattggctgagcataattttttcgtatctaatttcttcatcatcatttaaaattcacatattttcataaaaaatattagtttgctaatgctctctcacttcatttatatatgaaaactattataacataatataatcaaaagttcattaatttttaacacacttatttgtctaaacatatcaaataattaatcgcacttttaaataaatcaatagaaaaaagtcattattttattaagaaaaattttaggcataaaagagtcaagataattatcaaatcaacattaattttaaataaataagagtc

SEQ ID NO: 4322 - DNA, 653 bp, Methanobrevibacter ruminantium
acttcaattttgaagactaatgtttttttcttctgatttttcatctgaaatttttaagggaataattgatttttttattttttttattaaatttacttgttctaaatttttagaacacaaagtttatatactttgatacatataatataattgtggataaaaagtgtatgaaattaattttaactatattttcatatgtcttttttagaaaaaaataaataaaaactttcaatttaaaattttatcaataatttaacaataattttcatttttggataaatttttattgattaaatttttatggtttttattatatttttttcaataacaaattaaaaatgtcattgtccaatgaagaaagaacaagtttatatactatgaagttcaatataatattgtataagaaaattaaaatttaggaataaaaattatttggattgattgtatagaaaaattaaatttccgaataaaaataattaaaatttcaaaatatcaatagagtaaaagcaattaaagtttcaaatacgatttaagatcaatggtgtgataagatgttttgtccgaattgcggtggctggattgatgaaggggatgtgatctgtccccactgtggaatccaggttcgctaatatcaatttcataaagggggttag

SEQ ID NO: 4323 - DNA, 54 bp, Methanobrevibacter ruminantium
ttttaattacatccataataattttcattgtatcatattttcattcttggaagg

SEQ ID NO: 4324 - DNA, 32 bp, Methanobrevibacter ruminantium
ttttcccaaaaaaacaattgagggggtttaag

SEQ ID NO: 4325 - DNA, 76 bp, Methanobrevibacter ruminantium
atcattttatggatttttcaggggaaaaagtcttaaattatgattataaattaaaattattcaaaataaaacgaaa

SEQ ID NO: 4326 - DNA, 109 bp, Methanobrevibacter ruminantium
ttaaaaacaaattgatgttttaactaaaaaaatattctaaaacaataaaataattatttgatctcaaatatccttttaaaggaaaaaattataagagggggaatttatt

SEQ ID NO: 4327 - DNA, 229 bp, Methanobrevibacter ruminantium
ctttttatttttttaattctcattcatttttaattcttgttttttatttaaattatttttaattttaacacttatttttcattttaacttcataaaatcttattttataaattcaactctttttattaattctatattaatttaaacaataattcataatatttctatttaaataacaattctcctaatggtttactatttattataaatataaaaacgattttcctta

SEQ ID NO: 4328 - DNA, 163 bp, Methanobrevibacter ruminantium
tttatatatggtaatatattgtaaactctttttatagagaatttagacaatttttcatagttaattttatatataaagaaatctaaataataatttacgaattaattgataaaatgaattgaaattaaaagggtcgataagtaattgaaaaaggtgtatttct

SEQ ID NO: 4329 - DNA, 244 bp, Methanobrevibacter ruminantium
aatttaaccttttttatttttttatccatttttctatttttaatcgttttttatttaattaaagagttttatgattgttttaattataataaaattagaacagcaactattccacttatacataaaataatgaattacttatctttagaacaataaatctcttaatttttataagaatttttctaaaattataaaactaataagaatcataatttaaactagataaactaaaggaaaaattaca

SEQ ID NO: 4330 - DNA, 238 bp, Methanobrevibacter ruminantium
tcagtcttaaatgttttttttttaaattcaatggcttttaaatatcttttaaagtctatttaacccatattcttttttttaatctaatcttttaaagtctatttatcttttttaagtttaaatctttaaatttctcttttattttcccttttttatctttttttaagcatcttttttattttcatctaagttcttaaatgagttatttttaaataattgattaaatatatattaattg

SEQ ID NO: 4331 - DNA, 181 bp, Methanobrevibacter ruminantium
atatttccttcttcatttcagtttatttttgatttttaacgatatttttattctttttaattatcttataatttatatcctttttttaattaattattaaattaatacttaacgaaatttagaaatgtttattttttagtttatttaaaaatagtactataataattaaggaggaaaatca

SEQ ID NO: 4332 - DNA, 31 bp, Methanobrevibacter ruminantium
atagtttattattgattttctggtgatttaa

SEQ ID NO: 4333 - DNA, 401 bp, Methanobrevibacter ruminantium
gcctttttattaattttttcttttttttaattctctttttttataatttttttcttatttttttttcaattctttttttcctttttttaattctctttttttataatttttttcttatttttctaattctctttttttataatttttttcttatttttttaattctctttttttataattttttttcttatttttttaattctctttttttataatttttttcttatttttttaattctttttttttaatttttttcaattctcattttttataatttttcttcttaatttttattctttttatatttttttaaataattattactcatttgtttaaactattgatgatttttattctattgggattttgctaataattatatcgattttattaaactgtc

SEQ ID NO: 4334 - DNA, 143 bp, Methanobrevibacter ruminantium
ttaaaatttttatttattcattcttttaatttctttttttttattcattttttttatattttaatttacaggtctaattttcataatcagtctttttttcttaattatgggtgtccgccaaaataaaattttgacaacaccag

SEQ ID NO: 4335 - DNA, 352 bp, Methanobrevibacter ruminantium
aaataacaccaaaatattaaccctttgttgatattatttatgtttaaagtagtatataaagtttactataatattattgctttatttcatatttaaagaataattaacaagtaaaaaattttttcaaggtgcaagcaccaaaattaaaagaaaacaatagaaaaaacatcgaattttaaaaaaataactaaaataaataacttaaaaaattgaaaattttaaacttttttaaaaaaatagctttttggcggaccctcttattttttgttttttaggttttaatctattacagattcaaggattcattaatttattcaaaacttttattatcctcttttcttaaactaatatt

SEQ ID NO: 4336 - DNA, 22 bp, Methanobrevibacter ruminantium
tggtttgtttatttttaatagc

SEQ ID NO: 4337 - DNA, 26 bp, Methanobrevibacter ruminantium
ttttattttataattaaggtgatttt

SEQ ID NO: 4338 - DNA, 93 bp, Methanobrevibacter ruminantium
aattaaaaattatgttattagatgaaaataaagtaaattttgactttttccaagtcatcttttattttttaacagatttaaatttaaattgac

SEQ ID NO: 4339 - DNA, 952 bp, Methanobrevibacter ruminantium
caaattcctcatttttctttttagatatctatatgtttgttttagtttaataatctatatgttttgtttatcgtattttttcttttttaatcttgattttcctttaaaattattttgaacaaatatttttatatgatttctaatttctttttatattttatctttttttcttaaaaagcgaatatttatatataatagaagagaaataaaaaatcaaaggagagaattagtctctccatttgatttggagatacaaactaattgtgcttatcatcaatgagataataggcattagagtttgtatctctttctccgctataatatatatcaccccctataacagttttaggataaattccttggaaagttccctttaggatttaatcccttaggaaagattcttcagaaaaaatccattctaaacttgctacaatattattctgtttttttctttatatatggattttgagagcatttgaaaagtattattggctaattttaatgtatagtttactatttaaaattttaagtgttttggtttactatttataatatatagttaatttactgcctttttttaatcatttttttactatttattccatatggtttactttggttttggttggtttactatttattttatatagtttacttggattagggtcagtttattatttatttcatagggtttactttaatttgaataatttttttctttttccatcattagatttatataataaaaactataaattatattcatagcataaaaaaatacaacaatgtataaaaatatacatcagataacatttttttatagttttatcaccggttttaaaataaaaaaccggataaaacaatagttttaataaagattatctatataatttaaaatgttataaaaattttaatataattattttataaaaaaatataggagactaatctt

SEQ ID NO: 4340 - DNA, 49 bp, Methanobrevibacter ruminantium
atttatggattgaaattaaatttagattttaaaatttcaaaaatttatg

SEQ ID NO: 4341 - DNA, 84 bp, Methanobrevibacter ruminantium
tttatggaattagaaattaatttatatttattttttataaaaatcaaaggagattaaccattgccaaataaattcgcttggatt

SEQ ID NO: 4342 - DNA, 367 bp, Methanobrevibacter ruminantium
actcaagcttttccgggccttcggccgcaaaccttgaccaaaatttttatctctactttgctttatatcgtcttttctttttttaaaactttattagaacttattttttttaaatatctattttattttttctttttttatttaactttattataacttatttttttaaatatctattttattttttctttttttatttaactttattataacttatttttttcataggtttgccctctttttctttttttataactatttttatgtatacgaacaaaatatgccacaattaattaaaaaatatataaatcaataaaactaaaaataagattaattaaaactaaattaaattaaaggactaaatatc

SEQ ID NO: 4343 - DNA, 254 bp, Methanobrevibacter ruminantium
ccaagcttttttggccttcggccaaaaaccttgaccaaaatttttttttattctatgcttgtaacaggatatatattacaagtggttaaatcttaattaagtcctttttttcaaatttaagctaatggaaaataatatattgaataaattttaaatataaaaacagtaatatttttgatatacattttaatgtataatttttttatgaatcatatttattgttcatattcttaaaattaacaaagggagagatt

SEQ ID NO: 4344 - DNA, 135 bp, Methanobrevibacter ruminantium
ttttttttttattttttattccatgtctaattttatttttttattatttgaactgatttttttatacattttttaattattctcatataatatttttaattttaaaaaattattacttaaattaggattgattta

SEQ ID NO: 4345 - DNA, 206 bp, Methanobrevibacter ruminantium
tattctcatccaatagttttttttttttaatcagcatgaaaaaattttttagttattcaatttctttatttctatttttctaaattttatttattttcaataatgaataatcattctttaatttgaataaaaataaataatacattttactaaaatatacatagtaataatcttttttttaatttttaaactataggtgtaaaatt

SEQ ID NO: 4346 - DNA, 234 bp, Methanobrevibacter ruminantium
ctgatactgaataaagaaaatgatattttttcttgaaagaaagttattttgaatggtggtgaaagtagttattttaactattattaacccctaattaaacttagctcgtttaaaaatgttttaagttttgaaaagacttataaataagctaaaataaatattataatagttatttaaataatagattatttttttcattatttaaatattattttacgttttggaggattaaaa

SEQ ID NO: 4347 - DNA, 241 bp, Methanobrevibacter ruminantium
caagcttttttggccttcggccaaaaaaccttagaccaaaatttttatttaggtaatgctttacctaaaatctatttttttctttctatttattatttaatcattcttttaattaaatctcttatttctttatttttatttattgttaaatcatttttctttaaataattcttattttcaattatcagtttctaattattttcataaaactataaatcaaataataaataaatcaactatt

SEQ ID NO: 4348 - DNA, 358 bp, Methanobrevibacter ruminantium
tctgttcagtgatttaaatcattagatttataatctttttttagtaattttttattcttagttcacattatatctataatctttttttagtaatttttattcttagttcacattatatccttcatctttttttaaataatttttaattttaatttcttcttaatctatcgaatactttaatttttcaaaagaaatataaaactatttaaatttatttgtctatatatattattaataaaaatatttgattgggaaaaaattaacaatcaatcgaaatataataagaactgtcctaatcaagtaatatctaataaaatcaaataagaatttaataaatcaattttttcgaggaatcatt

SEQ ID NO: 4349 - DNA, 174 bp, Methanobrevibacter ruminantium
tcttatttttgaactcttgtaataggatatttaaagttttttagacttttttttaaattttttcactagttttcaatgcattttttttaaaaataacgagtaaaaactattttttcttatagtttgggataaagaatcagatattattattttacagcttaaagggatgaaatt

SEQ ID NO: 4350 - DNA, 133 bp, Methanobrevibacter ruminantium
ttttaaagtaaggattaattaaattgataagtgttaattataattaatttatttacctctgaaattaagaattggtatatgattttttgtttatttttttctacggattaacagatatttaaggcatgataat

SEQ ID NO: 4351 - DNA, 151 bp, Methanobrevibacter ruminantium
gtaaaaagtctattgttaattttaatgaagtataaggttttaaaataagtaaaaagtctattgcttaattttaatgaagtataaagccttaaaataagtaaaatgtctactttattaattaatgaagtataaagccttaaaataagtaaaa

SEQ ID NO: 4352 - DNA, 923 bp, Methanobrevibacter ruminantium
ttttagtttaattgtccatgctaaaatattttttttttaaatattctcaaatctttttattaattttcagactaaatattgtttatttaatcaatatcaaaattcgactgcttaattaattagattagggctaactaataccttgtttttttatcgcttttttatcttttttatttacctcctatttggagatatttaggaatttttttctttttttctttgggtcgatagtattcattttttacgagtcgattttcgacgcgtgagttatcctaaatatcagttgatttattatttgttttaatagtatataactgttttgatatattcaaacatttttatattatactaacatttaggcacacctaaacatttatatatgataaaaacatactatatgtaaagatatttaggtatgcctaaatttttaataagtcggaaaaaaatcaaaaaataaaataagaatactgtcattaatcactccaaaacaagggcttattagattgctgcttaaatagtctttttaaataatctcggaggtgaatgtttgggaagaagcaaaagtggtatttgtggaaagaaacaaattaaacccaacaaacgcgaaagaaaaagagatcctaaagtagtttcctttaggagatgaacttttactgtcctctaaataaaataaaatattaagtatcttcagaacaaatcaaatcaaatcaaatcacaacacacattatccaaaatttattcactatgtattagaccaaatctaattagaggaaaagttgagtttttattcaaatcaaatcaaaattaatcaggccaatcaaaaagaatcgtttctttttggttgctgtcattgattattagatattttttataatttttactaattttataatttttactaattttacaattttgtactgttt

SEQ ID NO: 4353 - DNA, 126 bp, Methanobrevibacter ruminantium
attaaactgaattagctattttttcaaaaacaattaatttatctcttttttaataaaaaaatagtgtttttctttttttttaaaaattattcttgttttagtaaaaaagaaagtaaaatggcttaa

SEQ ID NO: 4354 - DNA, 31 bp, Methanobrevibacter ruminantium
atgtaagtcaattcttttatgagtcacttat

SEQ ID NO: 4355 - DNA, 56 bp, Methanobrevibacter ruminantium
gttataaaagtctaaaagaattgtataattctataaaaattgttagaagtgttaaa

SEQ ID NO: 4356 - DNA, 83 bp, Methanobrevibacter ruminantium
taaatctggagaatttgatttttataggtgtaaactgagaaatttatgttattaagaaataataatttatttggggtgaaatg

SEQ ID NO: 4357 - DNA, 40 bp, Methanobrevibacter ruminantium
acatttattttggtaaactgttttttaatcctttttaaga

SEQ ID NO: 4358 - DNA, 71 bp, Methanobrevibacter ruminantium
ttttttttaatcagcccatttttttattcagctcatattttttttaatttttttttttaatcaagatacta

SEQ ID NO: 4359 - DNA, 38 bp, Methanobrevibacter ruminantium
ttattcatttatttatgatttttattaagaggattagc

SEQ ID NO: 4360 - DNA, 7 bp, Methanobrevibacter ruminantium
ttattat

SEQ ID NO: 4361 - DNA, 226 bp, Methanobrevibacter ruminantium
ccttttttattttttattatttctattatttaattatcaactttttttattaatttttattatttttgattttctgtttttcttattttatttagtttcttataatacgaactaatttatcctttaaaaaaattaagatactatttttaaatggtttaaatagtatctttaggggttatttaatttattttttgcttaaatgatgaatgtctgtttttgattattt

SEQ ID NO: 4362 - DNA, 146 bp, Methanobrevibacter ruminantium
gttattaccttgaatttagtcttaattttttaattttaatttttttgtttttataattgaataagtatgattgatttttattatttcattgaaaataagaaaaatagaattgttttaatatgtttttagttttaaaaaaagaaaaa

SEQ ID NO: 4363 - DNA, 144 bp, Methanobrevibacter ruminantium
tttaattttaattgcttttgcaattgtttttaaattgtttttttttttccgattaatttaatttaattgcttttgcaatttttttttgattgtttttacaattgttttgttttaattgcttttacaattatttgctcaaatcaa

SEQ ID NO: 4364 - DNA, 215 bp, Methanobrevibacter ruminantium
tttatcgcctctaattattatagttttttaaatatctttttaattataatcttattttaaataagtattttaaaaaagttattttaaataaattttaaataaatattttaaataagtatttcaaataagtataattgtaatttttattagtttctattattttaattattattttaaaaaaataataatttattctagttcgtttttgcttataa

SEQ ID NO: 4365 - DNA, 726 bp, Methanobrevibacter ruminantium
cgaatcactcttggataataagtactgtcaaataaaaattatttaataaacaattaaaattatatgctgattgcttttatcttatcttctcttaagttttgatttgatatgctgattgcttttatcttatcttttcttaagttttgttttgatatgataaaattccttttattataatatcttatattgtttattatgaatatttttatacattattaattttaacattcatattttatatagatattgttcaaaatagggttcatattagtttttatctctaaaaacttttttaagaatattaaaattttaactagtttaacaaaaagatttatatttaaattcttacaaagaataaaatataaaaatttatatagtaaagggtaaattttaaatataattttgattaaaatagtaatagcaaaatcaaaaaggccaggtatcttaattgggataagtagtatggatttttaaaagttattaaactcaatttgcaccatccaataagtgagaggtaaaaggattattggataggctgtttgttttagggtatttgggttttgttttgttgtattgttttaaattttaatttatctgttattttaattctaattaagcagcatttgtttaatttttcataattaagctacatttgtttaattttttaattaaataacttattatttatttttattagaaattttaaaatatagggtaaggtattat

SEQ ID NO: 4366 - DNA, 49 bp, Methanobrevibacter ruminantium
ttctttcttttttttatttaaactattttttcttttttacttaattttt

SEQ ID NO: 4367 - DNA, 259 bp, Methanobrevibacter ruminantium
cttaattaaattaattattatggcttctttcaatatcaagtcaatttaacactttcatatcaattttgatgggagttaaattggattttatcaaaaaaagcaaaataatttatattaaaaagtttaactaatatatataatttgaggaagtttgttttaaaagtttaattttgtagtttttaaacgatattttgaatattaccataaatctattgagataatgtgatttaaaaatagttaattaataaggagaataatt

SEQ ID NO: 4368 - DNA, 167 bp, Methanobrevibacter ruminantium
ttaactctttaatttctattaaagatgtttaaatgttaatcataacttttctatttcaattatttggtgaaatggggtctaagattcttaattatttggtgaaatggggtctaagattcttaattatttggtgaaatggggtctaagattcttaattatttggtgaa

SEQ ID NO: 4369 - DNA, 28 bp, Methanobrevibacter ruminantium
tttaaatcattaattctttttatatgtc

SEQ ID NO: 4370 - DNA, 16 bp, Methanobrevibacter ruminantium
aaaaatccctcgaatt

SEQ ID NO: 4371 - DNA, 240 bp, Methanobrevibacter ruminantium
aaactaagatttttaatatttgctcaaaaatgggtcaaatatcttattaaaataatgaattaaattccagaagattttttcaatgaaatttatggaattaatgcttgcaaattttaatatagtaaaatcaaatgaaaaaatatttaatttataaccataaattattaaaatgataaaaatatttaatttataaataaattattaaactgataaaaaatacaaatatctaaagaactttta

SEQ ID NO: 4372 - DNA, 258 bp, Methanobrevibacter ruminantium
ttccttattgggaagatagttagaaaagaattctttaaaaatatctttttaggaaataaatattttaattattttttaattaatctatttattctatattttattaattttattttaaatcatatttataaacaaggaatgttaatttatatcatttaaataagacatttaaataagaaaaatttgtttaaatcatttaatttatcagaaattaatttatatctaatcatttacttataactggaaggaggttagaaa

SEQ ID NO: 4373 - DNA, 181 bp, Methanobrevibacter ruminantium
tttgattttttttaataaatgattttagattatgcttaatttaaaatggggttttatttaatttagaatggctttttagtttaataagataaattttagggtttatttaatttagaatagactttagatagatttagtgattaattttataattaatttaagaaattggattggtgaattt

SEQ ID NO: 4374 - DNA, 293 bp, Methanobrevibacter ruminantium
atccttgcgtttattttattttaaattttaaacctatttaatatattaaatgatttgttttaaattttaaatctatttaatttcttaaatatcatttattttaaattttaaatctattttatttcttaaatatcatttgttttaattttattattcattcatttgattatttatttttaatatattttttaatttgatttttaagactttttactattttaaaaaataattttttagctcctagagggaagatatcatggtctaatattaaaggttatttgaagggaggaaat

SEQ ID NO: 4375 - DNA, 30 bp, Methanobrevibacter ruminantium
tctgatttattttttctttttttttatttt

SEQ ID NO: 4376 - DNA, 214 bp, Methanobrevibacter ruminantium
ttttttttattaaaaactaataataatttaatttgagatttaaatatttttaatcagacgattaaaagttttaagtttaaatttatgcttattaattaatacaactaaaaaggaggattatcatggctaaagttaaaggtactaacaaaagaaccagacctaaaagatcttacaaaaaacctggtagtaaaaaaggaagaggagttagacaaac

SEQ ID NO: 4377 - DNA, 299 bp, Methanobrevibacter ruminantium
tttaactgttttccttatttttatttaaatctataagatttcatctatttttattctatttagtaaattatactatatacttttttttaaaaatttttttaattaaattaattaggaggttttattttgactgaagatgataaaaatccaaaagaaaaatcaaaaaaccttctaaaaagttactttatattttaatcatacttattgttattcttgctgagtgctttatcatctactatgactatactaggaatgccgatgacaatctaatcactgatgttggccagcagattccattt

SEQ ID NO: 4378 - DNA, 241 bp, Methanobrevibacter ruminantium
tttaattggttttatataatttttaaccattttttatgctttaatttttttttattatttttgctatttttaatttattttacttatttttatttattttatcttttttcacttatttttagttatttttagtattttttagttattttttcttatttaacttattttatcctcttttaacttttttgattattcagttctttatttaatttattcgttattatgtgaattataatttatt

SEQ ID NO: 4379 - DNA, 109 bp, Methanobrevibacter ruminantium
tgtttttattataaattgatgtttctgcttatttaaaagatatctattttaattaatgttttttttagctattttaaatagtgttttttacttatctaaataagcgttt

SEQ ID NO: 4380 - DNA, 349 bp, Methanobrevibacter ruminantium
ttttctcaccttctacttttttttaatcttagtttattttaaaagcatataaatggtctaaagcttttcctttatggaaggcttttgcaaaatttataattaaattgcttttattgaattattaaattgtttgctttgaattattgtattgcttgattgaattattttttgtcttttccatttttgaataatgatcatttttcgttatgaaaactattatatatcagttaaaataaatgtatatttggtgatttaataatctaaattatattttgcttattaaatttaatcgatgttaaattattttatagtttggtaattaaactactcatttaattggaggaatatt

SEQ ID NO: 4381 - DNA, 272 bp, Methanobrevibacter ruminantium
tttttgtctttttttactaattattctttttttatcattttttttatcgagtactcattttttatcacttttatctagttattcttttttcatcactttttatccagttattcttttttgctgctgtttttctctaatcattattatttttagtttattcttcttctaaaatttcttgtccttttatattattttttaaataaaaaaaaagaaaaaagaaaaaaatagaggaataataagttaaaatttgaataaaaaatttcaacgatttt

SEQ ID NO: 4382 - DNA, 161 bp, Methanobrevibacter ruminantium
atatttgctcccttttagaaattgtttcagttaatcattaagcaatttgcattggtgaaattactttatttgcttgtttagcttcttattaagcaatttgcattggtgaaattacttaaatcataactgattttaaggaaatatagattttatttaatcaa

SEQ ID NO: 4383 - DNA, 947 bp, Methanobrevibacter ruminantium
cttttcactccttgtttttttaactcaaatccattcaatagggtccttagaaaataatgctttgataggatttttttaatttaagtcttgatttaagcccctttagaattaaatcttttagtccaatcctttttcgtgattgttctttttaagaatcagattttttttattgatcctttcgtgaatttattctcttaaagaaccaaactcttaagatttaagtttcaaaaagaatttaaacttttaagaattaaatctattattttctaatgaataaaaattcttcaggtcaaatatgattattttatcaataatcaaatcttattttaggattttttcaaatcaatttttttttaagaaatttttcctttgaaatgaacccaagtcaatttttaattttttcattttcatatttaaatttaagcatttagaggctttattttaacaagtccatacaactttcacactttcgcacaattttacgagatgacatcaatttttacttcatttaagaattaataaatagtttaaatatgtaaattttggcctattttttagggtgatttttatgtatagtttattatacattaattgttcttattttataaaatggtttgtttgatttgaaactaaaatttttaatttttttaattcctgagtgaaaaatttgttcctataatttaaaactagtattcttaaggagttttgtttttcataattgtaaagatttcattatttttgccttgattttaagtcatatatttatactattattaacaaatttagatagtgatatttgaattgtgtaaaaatagataaatatttcctatcattgatttatgatatttttaaaacggttaatgaatcatactttaaatcgtttaattccaatttaaattattctaattaattaaaaacaatcaaaaaaattataattatgtgataaa

SEQ ID NO: 4384 - DNA, 223 bp, Methanobrevibacter ruminantium
aattttaagcattctatttattattattttattttttttattattcattatctttttttaagttttattttattatttatttttattatatagagttatatatgcttattttagcatattatctatatattgttcttttttttaatttaaattaattttctattttataagtcaaaattcattatatttctcattctcttgaattccaatgcttttaatttta

SEQ ID NO: 4385 - DNA, 258 bp, Methanobrevibacter ruminantium
tttattttcctattaattagtttcaatttaaaaaatagattttgcttattttattatttaatttaaatatttataaaatttactcaattagacttatttaataattttaattggcgaaataaaaattaaaatttttaaaattagtttttggaattttcagtaggttgtttttttttgtaaggtgtttttgtaaggtgttgattaactaaataatctttaaaaaaaagtaaaaaaaataaaaaagaggtgaaattaaga

SEQ ID NO: 4386 - DNA, 323 bp, Methanobrevibacter ruminantium
tttttctcaccttttaaattaaaccagattcttataaaagaatgtgatttctatttaatagtttgttttataaaatatttaaatatttttaaattttcttggtgtttattcagtatattttgtttttaaaggtttattatacttaaaatggttaaataatttatatttttgttcaaaatatttaaaaaaagataaaaaatatggcattaatttattaaaataatgttcagtgtttaatggatggtgatatctggtataatttatatggtttctaaatgctaatttggggttttatggtgtttgattataaaaaaagtaaaaaa

SEQ ID NO: 4387 - DNA, 56 bp, Methanobrevibacter ruminantium
ttttttgaattctataagttttttcttctttttgtgaattctttattttattcttc

SEQ ID NO: 4388 - DNA, 855 bp, Methanobrevibacter ruminantium
tattgttcatttttttattcttgcagcagttttatcattcttagttccaggattaggtcaagcatatgctggtgatattaagaaaggtataatatttttcatagtattcttagtaatcattggattatacgtgtacttcttgaataaatacttgcctttcaatattattgaattgattttcggtatttacgctgcttacgatggatatcaaatggcaaaagcttagaaatcttttttcgaatgcttttattattataaactaatttttattaatttctttttaatttatttttactatattttaatattttttttaaaggatattttcatttatttcttttagaagatttcattttttcttgaatcatttttttactattcttaattacttttttagtttaattaagttcattaaaccgaagttttacgaaacccatatgcagtgagcaagaatttaagagttctccgtgagcatgattaggcctacgtcataaatccaacttattccatgcctagactgataggctcagtgaaaagggtcggatatatgcttcagctattgtagaaaacaagagtttttcaacaaaacactgtttcttatggctatatgtagatttcatggttttactaggattttcaagtttttaaaaaaacataattttaaatattagttcgcatatattaaaattaacgattatattattttgacaattgcaaaaattttaaaatttttgttatgttgactcagaataagaataataataaaatatatccaaatatggattagatatatagaatatctaataaaatatttgaaagattctttttaatagttattattaggagggtaatagt

SEQ ID NO: 4389 - DNA, 485 bp, Methanobrevibacter ruminantium
ttttatttattcttcttttttattatatttttcttctttttttttaaataaataattattctttttttttaacgctttttagacttttttcgagattctttttgtgctgtttttaagatttggtgatagttttctttttaatgatggggctatgcttttctatagaccggtctttagatggtaatataaaaaaaataatatctgattatagtaagaaacttgtttaattgtattaaaagggtttcaaaataaaatatttgatgataaaaaaaaagggtttaatcattatgttaatttttataaaaaaagagatttaaaataattttaaaacttaaagtaaggattcaaaaagaactcttaactttaaattttccaacatcctaggagctaatgaaataactctaagtaatgttatatttttagactatataatattaactgatttaataaataatttttcatttatgaaaggggttcaaagatta

SEQ ID NO: 4390 - DNA, 913 bp, Methanobrevibacter ruminantium
attttctatcatcctaggagttaatgaaataactctatgtaatattatatgtttaaagtatataatattaactgttgaagaaaaaactaccctataaaaaatataaaaacaattattttttttagttcaacaactgaatacattttatttcattaataaaatgaagattttgaggatttctaaagagtattttagaatcttttcagagttgtctttcaagaattctaatgaatcttttagaagatcattgtttatatttttcatttttttcctccattttcggatgatagatatttttttgtagcaggaaaaaacttcaattaataatttatttttatcattaataaatataatggtttttttgagataaatattgatttaaaagtgttaaattgatttaataatgttaaattgatatcatttcgtaaaattgacttcatttggtaaattttacttgaaagtgtaaaattgatgtcatatcgtaaaattggtattaagatatgaaattgattttagggtgaaatctttaatgtccgttgaggaatcattaaaagaaatgtaaaatggggtttatttttatcctataaaaaagtggcaaatattctcacttttaaaaaaaatattactttatgttatggctaaatcgtatggtattgtaaaatgagggtcttgatttaaatgtgtgaaaaatctataagtttataaaatatcatgtacaaaatattagtaaaatcaaaatcaaaatcaaaaatcgaaagaatagaaaaattttttaaatccattatttttgttttaattaattaataaggtttatatttatgataacaattacagtaaaagaagaggaagtcttaaaatcaaaataaaacagcatggccaagagagaatagatgcctcagtcattaaggatgag

SEQ ID NO: 4391 - DNA, 111 bp, Methanobrevibacter ruminantium
tccaatatcttatttttttattttcttttattattttatttttctttatttttttataactaatttcttctatctatttatagatttattattttttttattcaaaactat

SEQ ID NO: 4392 - DNA, 295 bp, Methanobrevibacter ruminantium
aaaaatcatttatttttcttttttcaattaactttataatcttccttgtttttataattaattattttttcattgtccttatctctttttattataaaagcaattgaaaattaatgaaatattttatcatctaaatttttcaaaaaaatatcttattactcattcaatttaacttggaaatttagtaatatttatattgtataaagtaataatataaacataagaataataatttttatgtaacgattattaaaattttaaatattttgatttgtagttttaggtgtttattatg

SEQ ID NO: 4393 - DNA, 180 bp, Methanobrevibacter ruminantium
attaaattttatttagctttaaaatttaatttaaattctttttttattattttattatattattatttttattagttctgtatagttagttattttttctaagattgatagattgattgtttttttttaatttggaatttatttttggatttttaggttttttaatatgaaatttaatgg

SEQ ID NO: 4394 - DNA, 59 bp, Methanobrevibacter ruminantium
tttaaagttaggataaaaagatcgttgttaatggattctaaattattttatgtgatatt

SEQ ID NO: 4395 - DNA, 252 bp, Methanobrevibacter ruminantium
tataaatttttatctatttttataattagtttcttaaaaggattatttaaattacttttttttaaggatgaaaactatattccatgtgatgatttataactaatcattgatagtgactttaagaaaaatgatgaagttgaaattatagattaaaaaaagtttaaatcatagattaaaaatatattaaattgtaaatattatttaatcaatgaattgctttttaaaaaattaatttataaatggtcgtatttt

SEQ ID NO: 4396 - DNA, 27 bp, Methanobrevibacter ruminantium
ttcttttatattttttaatcttttcat

SEQ ID NO: 4397 - DNA, 231 bp, Methanobrevibacter ruminantium
tgtcaaattataaataatataaaagttatatcttataataatataagaatatataatcgatatttaataattaattattcttatgaaaagtccttaaaaaacaattaaaggatgaattatttgatttttttaaaataatctttttaaaattacttaattttgttgtcgatttattgaagtggattattcatttaaatggattatttgctcattactctaaagtgtgataaa

SEQ ID NO: 4398 - DNA, 11 bp, Methanobrevibacter ruminantium
ccgtgattaat

SEQ ID NO: 4399 - DNA, 121 bp, Methanobrevibacter ruminantium
ttggagcacagggaatggaccctgcagaagatgtattaaaggatattttaggttattaaaaagtattatagagtttaaagttaaattttaatcttctttcatttaaaaaagagttgattct

SEQ ID NO: 4400 - DNA, 73 bp, Methanobrevibacter ruminantium
tttttaactttattataaatatctaaaaatattcaaaaaattaatacttttttaaactgcagtgattgaaatg

SEQ ID NO: 4401 - DNA, 59 bp, Methanobrevibacter ruminantium
atttaatttgaaaaaaagaacaatattaactttatcttaaattttaaaaaaagaataaa

SEQ ID NO: 4402 - DNA, 84 bp, Methanobrevibacter ruminantium
ttattttaatttatttattttaatttatttattttaatttatttattttaatttatttattttaatttaattttttgtttttat

SEQ ID NO: 4403 - DNA, 115 bp, Methanobrevibacter ruminantium
tttaacatctcctttatatatttatttttaccatcataaatctatttttcctttttcatatcaattttgatttgatttagttaaaaaatattgcctttttccaaatttcttttta

SEQ ID NO: 4404 - DNA, 182 bp, Methanobrevibacter ruminantium
tgatgtgaaagtgtgaaattgatttcatatggtgaaattgttttcattttaataaattgatttcacctaataaaagttgtatgagattgttaaattgatttgagagtgtaaaagttgtataaagtaatataaaaagatttaaatatgttaaagtcaaaaataaaatcactccactaaaaaag

SEQ ID NO: 4405 - DNA, 106 bp, Methanobrevibacter ruminantium
gattatattatttaaaatttttttcttcgcttatggatattgttttgaattatttagaataatatttatctattaaaattcataaatatacatacaacgaatattt

SEQ ID NO: 4406 - DNA, 131 bp, Methanobrevibacter ruminantium
actaatatttaattttaatatttttttaatttttaattttaattattaatttttcaatcttttaatttttttaatttttaattatctttgatttttatatttttattttaatttttattcgatgtgatatg

SEQ ID NO: 4407 - DNA, 80 bp, Methanobrevibacter ruminantium
ttatttaaaaaatcattataaagttttttcaagaaattttcattattctaaaagaaactgccctattgggaggatttatc

SEQ ID NO: 4408 - DNA, 75 bp, Methanobrevibacter ruminantium
atatatttattgatgtatgaattatatgaataattatatgaagtaattataaaaattataaattaaggtgtatat

SEQ ID NO: 4409 - DNA, 199 bp, Methanobrevibacter ruminantium
ataactaatgagtgatattgcttatttttaattttaaatgattaatataagaaataaagagttaatggatatttgattccatttttaatttttaacaattaatacatgaaataaatagttaatggatatttgattccatttttaatttttaacaattaatataagaaataaagaattacaatacaggagatattcatat

SEQ ID NO: 4410 - DNA, 375 bp, Methanobrevibacter ruminantium
ttaagaattaataggggatttaatcatttaaattccttaatattatttttttaactatattttcaaattatccctattttcatttctttttttttaaatttcatttttgactcaccacaccaaaaaccacaatctccagaatcaaaacaatatctttttatataataattgatataataattataaatagttataaattaatgataaatcattataaattatttaaatttatcatttaaaattttaattaatcattataatttattaaaaatttaaaaaaaattattaaatgcatttaataactgttccaatggatttaagttgttattaactgagtaaattaatgctataagctatttgttttttggtgtctat

SEQ ID NO: 4411 - DNA, 260 bp, Methanobrevibacter ruminantium
ttttctttaaagtttgaatttaattaaaaaattaattttgttcctattttttaatttttttatagtattttttaaagatttttctttttttttactttatttttattcgttttcagtgattttatataatttgagttatatttgttaaattagctatttaaatttcttatattgttaaaaaagtgtttgttagaaaaggtttaaattttatattgttaaaaagtgtttgttaaataaattgttgtaattttggggattaa

SEQ ID NO: 4412 - DNA, 36 bp, Methanobrevibacter ruminantium
tttttttaaattttgatattatatttattttatttt

SEQ ID NO: 4413 - DNA, 80 bp, Methanobrevibacter ruminantium
ttttttttcaataattttagttattaatgtctgttatattgtaaatcttgtttttatcttattcttatcttattttttaa

SEQ ID NO: 4414 - DNA, 180 bp, Methanobrevibacter ruminantium
attatatctccttttatttttagtttttgtttaattaaattatgggtttatctcataactatcattaattttaatggatattttaattaaattatattaaaattatttcttataaatttcaatagattgtgtatttgaatcaatgctatttttttatattttaaaatttttttagtacac

SEQ ID NO: 4415 - DNA, 342 bp, Methanobrevibacter ruminantium
tatatcacaggtctgattttgtttttcatatattgttttgtttttagttttattttaagttttttaaaaaaagatttatcttgtaaatttttcgtattaaaaattgtttttatcttcaaatttttctattaagaaaatttttatcttgtaaattttttactcttttttaaaatactcttttttaccccttatataaactatacttagttaatctaataggtatctatttataagattataaaaatatataatagtgtattttaaaaaaagttaaatcgcttaaggtaattaagacttatttaggtaaataaaaccaatttttaataataaaggagaataaag

SEQ ID NO: 4416 - DNA, 132 bp, Methanobrevibacter ruminantium
tttgaattgttttgctaattaaattatcgagattatttatttgaatagatttttttttatttatttgtatagaagagtttaaatttgttatttattcttatatgattattaaatgcatttcggggtgaatat

SEQ ID NO: 4417 - DNA, 227 bp, Methanobrevibacter ruminantium
tctttcattctcttttaattaactatttagaatattttttctttttaggagtgttttttgctttttttctgctttttttgtcactcttgcattttaactgatttttgtttttttttatttatttatagtaaacttaataaattttaaaagactatttttaattaatagaaaaaattattttactgaattttttttaaataactttttaaacctgttaagtgattaaa

SEQ ID NO: 4418 - DNA, 613 bp, Methanobrevibacter ruminantium
tttttcttaaaattttaaataacttgttaaatttattatttttgtttatttaatatatcgcaggtattgtctgtacttccattgtctagtaaaatcatttcatcatcaacatttaaattgtatctacgaaggattctatgatgttggattcatttttcactagactaatggacactattttcattaagtttctccttttttatggtttgcttttttttgaaaaatcgtttaaaagttatttataaaagatataattttaaaatctattataatttatatttccatttgactgcatggaattaataatctctttagaattattaataaagtagtcactcttattataagatacattacttgcgctaatgtaataattcttatgatttttcataaagttaatatctgcactatatgattcaggagtttctttatataagaagtatgcagtaattccattttgactaatggtttgattagaagtgatatttttatcagtttccagtaaatcttttactttattttttaaatttctagaatcaggaagttcacaaactttaatggatatttgatttttgctatccactaatcttacttctttttcgttaattcctat

SEQ ID NO: 4419 - DNA, 106 bp, Methanobrevibacter ruminantium
ttaattcacctaatcattttttcaattctgaaattaattttgttttttattactttttaatatatgcttttaaatatatattgttatgtttattggtttgaaagaa

SEQ ID NO: 4420 - DNA, 25 bp, Methanobrevibacter ruminantium
aaaaacaccttaaataaaattaaat

SEQ ID NO: 4421 - DNA, 146 bp, Methanobrevibacter ruminantium
tttaacaccttaatctattctaatattgcatgatatttatgaattagttatttgaaatttctatgataattatgatttttgtacaatatgatttttgtacaattatgtttttttataattatgattttgtgacatttatgaattag

SEQ ID NO: 4422 - DNA, 19 bp, Methanobrevibacter ruminantium
aaaatctaatccttaaaaa

SEQ ID NO: 4423 - DNA, 135 bp, Methanobrevibacter ruminantium
gataacacctgatatttatataataagtaaatatatttattataatatatatacataatatgtaatcataagcattttgtataaatttttaatttttattatttttattatttttatttcagattcggtggttta

SEQ ID NO: 4424 - DNA, 175 bp, Methanobrevibacter ruminantium
aaaagtaaagggctttcagatgccaatttaatagaaaatgactaaaatttaaaaaagaaggtaatggatggtgattaattaaaaggaatttctaaattaactaatctaaataaataaaataattaaaataatcaagataattaaaaaagaaaagttattctagaagtttatttaa

SEQ ID NO: 4425 - DNA, 308 bp, Methanobrevibacter ruminantium
atttttactcctaaacaaatcataaaacattatatattatgtatattaaatatatatataacttatgtataattttaaaaaatagcataaaatattatgtgatgtgaataaacaataatatacatttaaatgtacattatataatattagattcgtattatgattaaaattattatattagattatattttacattgataattcttaattttacatttgattaatcttaattttacatttattaatatttaattaaagtattttattaacatttaatttattatataaatttagccatgggtgtagta

SEQ ID NO: 4426 - DNA, 332 bp, Methanobrevibacter ruminantium
tatttctttttcattttttaatgtttgatttgtttttgaaatttatttttttttcttcttttctttttcattttttaatgtttgatttgtttttgtaatttatttattttttttcttcttttctttttcattttttaatgtttgatttgtttttgtaatttatttattttttttcttcttttctttttcattttttaatgtttgatttgtttttgtaatttatttattttttttcttcttttctttttcattttttaatgtttgatttgtttttgtaatttatttattttttttcttcttttctttttaatgtatggagcaataataaagat

SEQ ID NO: 4427 - DNA, 227 bp, Methanobrevibacter ruminantium
tagtttattcggttattcgtttttaggccttttttggaatagattttaattttctcttttaaaggaggtcctggattttttggctttttcaatattttttgaaaaattaaatggttccttttttctttcttttttgaaacgtattattgatggaatatccttttccagaatatagttaaaaagtatggtattatgttgataaacatgaggttttaaacctaatgctg

SEQ ID NO: 4428 - DNA, 471 bp, Methanobrevibacter ruminantium
ttaatccccgtatttagataaaaattatagaaactttatataaaaacaaataaatatattatatattattgaattaaatatataaaatatgtggaatatatatgtaatgaaaagaatattagaaataaaaggatatatgtattaattttttatttatatctcattcgtggattaaaaactgaaaaaataatatttttattgttagtttgcttaaaatattattaaaaatgaatactattgattaatttttgcttaaaatattattaaaaatgaatacttttgataattcttgcttaaaatattattaaaaaaatattttgattaatatttatgatcaatattctgattaggtttaattaagaaaataattgattaaattctagaaaacttctaaaaaaataatatatatgattaaaaatataatataattaatttaaaaatttaaatcttataaaaaatagatgggataat

SEQ ID NO: 4429 - DNA, 14 bp, Methanobrevibacter ruminantium
ttagaggggatagg

SEQ ID NO: 4430 - DNA, 725 bp, Methanobrevibacter ruminantium
aatttatttatttatttatttatataatttagttatattataaaatgaaatcgttttaatatatggttaataattgatttgaattatagaatcttcttgaccatatttatatattaaaatgggatttgatagataatttggcctttattaaattttaacaatctttattttttcttttttcttttattacacttgcaaaataatttttttctaaaagaaacgtttttttttatagtttaaacagtgttgccaaaaaaatttttttacttaataatttttaatatttttttagagggtctgagaaagattatctatcaaatatgatttatatttaatatttttatggtttgataggtatttttcttttcctttataataatacttatatttttattttatttaaacaaatgaggtcatcttcattgttaaatttattaataagctttacatatatattatgtgattaaatgatactcaagcctagatacaataaagaagaccttaattatcttttgttagatgaaatatttaaaattctttgttcaagagattctaaaaaaataatcgctaaaatcatgcactaaacatatagttttgcttcaaccaaaaatatatattgaatgtaattcataatttatcacattaacataagagctatttctaaattctattaaattgatagaaaagcatcatattaattttattaatgtataaagttgattgaa

SEQ ID NO: 4431 - DNA, 341 bp, Methanobrevibacter ruminantium
gcatatttaattataaaatttaaagattaattataaaatttagccttgtagaaaccctttctaaaagaattgcatatgtctggaaatgttataagatacatcttttaaaaataataaaattaatgcaaaattttttaaaaatatttaatttggagtccctttcaaaaagagaaataaggagtgcttaattgagttgattaaatactcaatctcttgcgaagatatcttttgtatataccttatctgcaatgggtttccttatttcaaaatgttgatagatgttcctgaaatttagaacgtaatcgagtttaatagcttaggggattgataatactctctat

SEQ ID NO: 4432 - DNA, 944 bp, Methanobrevibacter ruminantium
tgtttcaccaaatgtttattaaatatgcaaatacaatattaagaaaaattcctatgatattattataaaaatggtaattaataaagtttctctttatgttcctgtcaatatggagaagggcttcatttcttcgtttagaagatagatttcatgctctagtattagagagatattttattaattagagagttgaaggaattgggggggttatgtgttatttaatcttgataataagagtgaaaagaatgatgtgcaggcatcatacattttattaaatcaaatcatacaaatgaaattaaattaataagagtgtattcaactagataactcttctagaaagataatgtattgggaaaagaaatcaagaaatgatatgacagctcaaaataagttttgtaatgtttatatttgataaataacaaatattaatatgatattttatttaattgattattgaaattaatcgtcttaatttgtggttctagaacaataggtgcataattacaaaaacaatacaaaacagtccatttcatagataaaacaatgatttattatccatttggttaaatacttcgagatattaaagaattttcaatcaggtttcaagaatattatattttcaatcggtttaacctaatgcaaattatggcagatatcaataaaattagcagaggattaacatgaaaattatttccattaccatagtaaaaaatgaagcagatattatagaatcatttatccgttaccatttaaatatctttgatgaaatgttaattttggataatggtagtgcggatgaaactttattaataataaataatttaattcgggaaggattgtctgttaatttaatagaaagcagtgatgcatatcatgttcaagatataaaaatgaccaaattgcttcatcaagctgttaatgaacattcgggagatattgtttgt

SEQ ID NO: 4433 - DNA, 220 bp, Methanobrevibacter ruminantium
ttattttagtttataatgttaaatctgtttttattaatatggagtaaacgacattatcaagagctaaaaaatttaaaagacaattaaaaaaatttcttcaaagagaatcagtaaaatatcaatttaaactcaatgtaataatagtttagtacatatattggatagtatatggggtagtcaaaaattaaattttgagaacatcccatcaaaagaaaaataa

SEQ ID NO: 4434 - DNA, 809 bp, Methanobrevibacter ruminantium
caaattcatctcctattataaaatatttaggggtctgacaaagattatgtatcaaacatgagttatatttaatatttttatggtttgatggatatttttgcctttccctgtaataatacttatgatttttatttatttaaaaaaataaggtcatattcatcgttaaatttattaataagccagtacatatatattattgtgattaaaatgatgcacaagccacgatacgataaaaaagacttaattatattttgttagataaaatatttaaaattatttgttctagagattctaaaaaaaataatggctagaaatggttttaaaaatataaatgaactgctaatcattattaaaacaataatctttagcaatattttgaaatggacatttaaaaggctgttaaagctttagaatatgatatggggtttcaaaaaggattaaagatagatttatcttctaagttcagaaaaaaatttatagcagaatatccagattaggtttgttgctttggaaaatacagtaaatagtatcttaaatagtttattattcattattttatttgtatttttttaaaactttttgatggtggtggtgctgtttattgtgtaggcgattatggttctgtggttaattgtagttttttcaggttttttttatacttggctgatatatttaaaaaacatgtcctcataaataatttaatcttgttatttattaatataattatatattaacatagtaaagttcatatattttataaattatatattttatatattataaaaaaaatcttaataaaaggagatatt

SEQ ID NO: 4435 - DNA, 402 bp, Methanobrevibacter ruminantium
tttttttattatttttggatttcaattgttttttttttaattggtttattgatcaatattttttcaacataatttttttctatttttataatttaaccttattcttctatttttttaagttataaaatgtaagttaaaaacattttttttgaaaaatctttctttttttaaaaataagaattattagaactttttttaggtttttttttatacttggctgatataatctaagaaaaaacatatactcaataataatttaatcttgttattttattaatataattatatattaacatagtaaagttcatatattttataaattatatgtctttatatataataaaagaaaatcttaataaaagaaaatcttaataaaagaaaatcttaataaaaggagatatt

SEQ ID NO: 4436 - DNA, 359 bp, Methanobrevibacter ruminantium
attattcttctagatagacttttagtcaaaatctagattttttaattttttttttaaaattgattctttaaattaatctttattttttcatttcttttttatttcttttttatttcttttttatttcttttttattttcatattaattttcacttgtatggtttcttttcgtaattttaatattttcttctttttttaatatttctctccacaattaaaagttatctatttatactcttaaaaatagatattattattaatagacaagtttaatttttttataaattatttttaataattctaatttatctaatcaacttttaggggataataatttgggctttagattttcagttgta

SEQ ID NO: 4437 - DNA, 297 bp, Methanobrevibacter ruminantium
ttattttattcatgaaagaagttttatttaatttattattattttattaacttatttaatcagttttagttcattaataggttttagtttatttaatcagttttagttcattaatcggttttagtttatttaatcatttttaattcaatttaataagaataattagtatttggagttgttaaaatttatttcaagcatagagtatatggattcatatttaatctatttaggatttttccactaaaaaagaatagagtctcatttatcactaccaaaaacgcttcttttgagagcaac

SEQ ID NO: 4438 - DNA, 123 bp, Methanobrevibacter ruminantium
ttcgtttaaactggattaaaatggataaattaattttaatttttaattcagtagtcttaatgctctagactcttttaaacacaatttatactttttttaaggtttttaatcaccgctagtttt

SEQ ID NO: 4439 - DNA, 300 bp, Methanobrevibacter ruminantium
ttttatattttttcaaccttgaaagataaatatattaattattataataaatataaaattagagattatttttatagcttggattcgaatcataattttggattcggctattttttatttttataaaaattaatttaagaggtttaaaatatttttttaaatttttaattctagtggcttaagaggaattcttttgagtcattaagtcttaaattattgttataacttttttcacaaataagaaggttttatatggttagaaagaaagcaagacgtcgaaaacggcaagaggaagatcct

SEQ ID NO: 4440 - DNA, 58 bp, Methanobrevibacter ruminantium
actttttaaaaccatgtctttaaatattactttcaactttctaaattaatgtgataat

SEQ ID NO: 4441 - DNA, 132 bp, Methanobrevibacter ruminantium
tttttaagatttttaatatttcttaaatctgttattattcgttattattcgttattattcgttatattcgtttttattcatttattattcattatttatttatatattaatttataggtgattatattggca

SEQ ID NO: 4442 - DNA, 55 bp, Methanobrevibacter ruminantium
ttttttttattaattatttattttcaaatttttatttagagcataacttcttttt

SEQ ID NO: 4443 - DNA, 348 bp, Methanobrevibacter ruminantium
tatttctgctccagaacctttgaaataaaattacgatttcctttgaaatgcttttatttttattttttatttatattttttattttgtataagaaactaattaatcctttctaatttttatcattttttatcaatttgaaattggcatgatgtagaaaaaaatagctgattattttaccttctctccgccctttaaatttgaatattgtaaaaaaatatagaaaagtttaaatctataaaacaataattattattagttaaaaactattttataaaaaaatattatattttttaactgtttatttgttaaatttataaatttagataaataattgggggtatgaatgt

SEQ ID NO: 4444 - DNA, 25 bp, Methanobrevibacter ruminantium
ataacaatattttgctttagagaga

SEQ ID NO: 4445 - DNA, 19 bp, Methanobrevibacter ruminantium
ttaattttttggtgaaaaa

SEQ ID NO: 4446 - DNA, 15 bp, Methanobrevibacter ruminantium
ttaataggtgttctt

SEQ ID NO: 4447 - DNA, 161 bp, Methanobrevibacter ruminantium
gttctttctttctaaaataagtttatatttctaagtttagattattttttctaaaattagttaatattttttttatttagattaatttttctaaaattagttaatattttttttatttagattattttttctaaaattagttaatattttttttatttaga

SEQ ID NO: 4448 - DNA, 83 bp, Methanobrevibacter ruminantium
ttttttttatatttttctattttaaacatcttaaatctttttttatcaaaattcttgttttttacttttaagatttaagattt

SEQ ID NO: 4449 - DNA, 179 bp, Methanobrevibacter ruminantium
tttaacacctgctatttttttttttttattttaattgctcattttaattattttacttataatcttgatttaaaaatttattcttcctatgtagagatatgaatttataatttttttagttttataatttattctcctattaaaatttattctccaatataaattatccttttaaaatt

SEQ ID NO: 4450 - DNA, 187 bp, Methanobrevibacter ruminantium
tttaattattattttaaataacaaatgaattttaataataattttagagaattgatacatttaagataattgctagaaaaataaagagcattaatccttttatataattgctatatgcgattatgattttgttaaacaattatggtaaattttttaatttatattcttaaaggaggataatttattc

SEQ ID NO: 4451 - DNA, 8 bp, Methanobrevibacter ruminantium
ttttttaa

SEQ ID NO: 4452 - DNA, 46 bp, Methanobrevibacter ruminantium
tttttctttttttttattaaaatcaatttttgttcgtataattgct

SEQ ID NO: 4453 - DNA, 32 bp, Methanobrevibacter ruminantium
gtgattaaaagatttttattgttttttaaggc

SEQ ID NO: 4454 - DNA, 240 bp, Methanobrevibacter ruminantium
tttccttacctcaatcaacaataataaaatcttttataaaaagtctgtatttaaatatatgttcttaatggttaaatacttatagaataattggaataatttaggatacttttagaatagtaataggatatttgattttgaatagatatcctactttaattttaattattcgaatctaaattgaatgattaaatttaataaatttaataagctataaaaataaaaatataattgattatt

SEQ ID NO: 4455 - DNA, 560 bp, Methanobrevibacter ruminantium
gtgttaatttaattgattttagctacaatatttttcatagtttttacttttatttttattatttttagtctactttttatttatttttattaaatttctgtgcaatattttgtgttttttcacttttgtgcttttttgaatattcatttttgtgttttttcacttttgtgttttattgtaatgttttttctgtgtttatttgtttttgtgttttttcacttttgtgttttattgtaatgttttttctgtgtttatttgtttttgtgttttttcacttttgtgttttattgtaatgttttttctgtgtttatttgtttttgtgttttttcacttttgtgtttttatgaaattcatttttgtgttgttatgttttcacaactattaaattttagaaattgacttatgttttacaattttttttcaaaaataatgattaactatttaatatttaaaaactaaatatataattgattaataacttttaaaaatatcaatagttattttaattattaaatcaaaattatttaaaaaatacattttaaaacttgttagtgattcat

SEQ ID NO: 4456 - DNA, 123 bp, Methanobrevibacter ruminantium
tttacttttttttattaatttagtaatctgattaatcgattaatccttattgagtaaatttaatcttatttaaactataaaaatctgtttttatgcttatttatatcttttaagagtgatatt

SEQ ID NO: 4457 - DNA, 25 bp, Methanobrevibacter ruminantium
ttgtaaattattatatttgcttgaa

SEQ ID NO: 4458 - DNA, 100 bp, Methanobrevibacter ruminantium
tttttttatttttttattttttacctttaggcttttaggttttttttttaaaaacttattcaatcgtttaaatttattttgttctatattagttgatatt

SEQ ID NO: 4459 - DNA, 132 bp, Methanobrevibacter ruminantium
tagaaattaaacaattatcccttaattttccattctttttaaaaaacatatataattatttaaataataggaaaacatattaataattaacattaactatagttaaaaataactatggaaataggtgataca

SEQ ID NO: 4460 - DNA, 179 bp, Methanobrevibacter ruminantium
atttctcgatttaatttaaaagagcaatatatttgctctttattaacttttttttaaaaaaatcatttattttatttattttgaaataataattaatttttactgtttttagtgatattatggataatgagattaagttcaaggatgatgagatattgttccttcttggtgaaagcggc

SEQ ID NO: 4461 - DNA, 56 bp, Methanobrevibacter ruminantium
ttaaaatttaaataatttagcactatttatttttatgaatttagaagattgaaact

SEQ ID NO: 4462 - DNA, 378 bp, Methanobrevibacter ruminantium
ataggtctatttttattattttattattttattattttattattttttatttttttattttattattttattattttattattttattgttcttctatatttttctatttattttaactatttttctcttttctataaattctatttattttaactattttctataaattataactattctttttttctttcttacatcttcgaattttctaatcctttttttcttttttcaatcaatcatttgttcagtaaaatatgaatagttttatataatatgaatgattatatatttataagaaaaatataacaattgaaaagtttacttgattaattactaaatgatttatttaattcaattaaaccaatgaggtgaattat

SEQ ID NO: 4463 - DNA, 230 bp, Methanobrevibacter ruminantium
tccttcaatttataatctgaaccttaatattatctttttttatttttaacctttttatacttttttttaaactttttttcttttcttttattttaatttttaagcaaaaatatacattttttaatcttaaagaacattaccaaaatgattaataataatgagattaaaactatacttattaagttttaacttaaaaaatatatttttctaaaaatctatggaggaaaagc

SEQ ID NO: 4464 - DNA, 89 bp, Methanobrevibacter ruminantium
tattttttaattttttgattcttaaaaagagaattaatcattgatttttttaaaaagctaattttaatattgtattagatgttgatact

SEQ ID NO: 4465 - DNA, 249 bp, Methanobrevibacter ruminantium
ttatgaatcatatggaaatagctcattttaatccctttttcattaaaaagatttattatttcctctcttattctaattttagggtctaaaaaagccaacatttatatactattaaatttatatattttattaatagttatgataacattaaattgttttttcataatttattcttaagacttttattatcaattcttttgaatttttataaagtattttaaccaattattttatttaataaaattagcg

SEQ ID NO: 4466 - DNA, 13 bp, Methanobrevibacter ruminantium
atttattctatcc

SEQ ID NO: 4467 - DNA, 92 bp, Methanobrevibacter ruminantium
tttaaatactaataagaagaaaaatattaatatatataattaaattaagtatcaatttaattaattcctaataatttttttagtgtgatttt

SEQ ID NO: 4468 - DNA, 327 bp, Methanobrevibacter ruminantium
ttctgtttttattttatcctttaattttttcttttttttaacttttttttagtttatatatttaaactaatttttactcttctttttattctatttcttttattattgctctttttattctattccacttattataattcttttaagcattattttcttttccatccaataattttttattttaatattagttttcaaatgctctctttgactttataaatgagtaagtttaaatattatattaacttattaatagtaatttgaataaaaataattcatataaatcaattatctaaaacaatttataaatcaatttaaggttttatc

SEQ ID NO: 4469 - DNA, 93 bp, Methanobrevibacter ruminantium
atgttaaatttaagtttaaaacaattaaatgagttattttgttacttatcataattattataaattattaaaaattgagttagaggtttaaaa

SEQ ID NO: 4470 - DNA, 138 bp, Methanobrevibacter ruminantium
tgaaatctttgtaaaaaaactccttttataaagtttataacagttatacctatttagagatttttacaaagatttataaataagcaataattattattagtaaaaaatttttaaaaaaaaatattatgggggaattta

SEQ ID NO: 4471 - DNA, 12 bp, Methanobrevibacter ruminantium
agggggcataac

SEQ ID NO: 4472 - DNA, 82 bp, Methanobrevibacter ruminantium
agcagtaaataaaatagtaaaaaactgtgaaaatagttaaagcagcaaaaaaatagtaaaaatctgtgaatataaaaatagt

SEQ ID NO: 4473 - DNA, 90 bp, Methanobrevibacter ruminantium
ttattctttttttttttaattaattggtctattaattggttcattattatttttcttaaaaattagattccaataaaaaaataagattat

SEQ ID NO: 4474 - DNA, 124 bp, Methanobrevibacter ruminantium
ttctaaaaattgaaaaaaattaataaatgtttgaaaactggtaaaaattgtctcagaaataacatttcaaaaaaaaatttagtcgaaagtgtataaaaattaacatttcatataaaaattagtc

SEQ ID NO: 4475 - DNA, 220 bp, Methanobrevibacter ruminantium
tttattatataattcattatttataaatgtaatgctaaatacactaatatttttaattattttatcattttgataaataataattcttgatatatcgaataaagttactttaataatcttttttaatattgggtaaatttaatactatttattataatgttattactaaaatatatttaaaaaactataaattacattttatttgtcttaaatcacttaa

SEQ ID NO: 4476 - DNA, 47 bp, Methanobrevibacter ruminantium
tttatctagattcaatcaatatgatagtgttactgtaaaccataagt

SEQ ID NO: 4477 - DNA, 104 bp, Methanobrevibacter ruminantium
attatcacctatttttataatttagacttttttaataaaattataaatctttatttctataaattaacaatttgattatagtttaattatcatttaataatcat

SEQ ID NO: 4478 - DNA, 534 bp, Methanobrevibacter ruminantium
attatcagtttcttttaatttaatagataaattaaggatttttattattttgggccttttaagagctctattaaaaaaaatccacttctttttttaaaagttttatctttataatttctttaatttttatcctttttaaaaaattttataacaattatatatttgcttatttttcataataaaacttatcattaagttcatcatatttttcatcaaattgatttaatattgttattttagtaaaaatattagttttcacatgctcttatgtaatctttataaagtataaatactaaaagtaaatataagaattgaaacaaagttttaaggaatttttatagattttaagattgattgagtattcatatttttaatgctatatatcacacaatttattcaaattttattcaattaatcaatagttaatcagtagttaattatagaatctaattaattaaataagtttataaatcattattttaatattatattgactaaaaatatttaaaagaattatattattggggtgattat

SEQ ID NO: 4479 - DNA, 87 bp, Methanobrevibacter ruminantium
aaccaccttagaactccaattagagtattcaatccaaggggacaggatctgcaggatatcgaatctgttgcagtgttctgcgggttg

SEQ ID NO: 4480 - DNA, 349 bp, Methanobrevibacter ruminantium
ttagtcgttattttgatttaattatatgaaaaattgtattgtgttttattattaattagcatttttcagtttttcatagattagactaatcattattttgttatcattttggattattaaattggatatttcattataaaattcagaagtattaaatttatattaacttatatgttacttattaaaaattattaagtaaatatgaaagaataattaaatttatatattacttattaaaaattattaagtaaatatgaaaataataattaatatatataacttattaaaaatcattaagcaaatatgaaaaaatatggtcaattagcagtcattcaattaaggtgtaaag

SEQ ID NO: 4481 - DNA, 135 bp, Methanobrevibacter ruminantium
gacaaattaatagcttattttttttaaaaaaagaatttatgatttttaataaaaaaagagtgtattatatatttttattaaaaagagcgtttataaatttttattaaaaagaacttttatgaaaaaagaaaaaaa

SEQ ID NO: 4482 - DNA, 105 bp, Methanobrevibacter ruminantium
ctaatcaccataaactgaataattaatactatatttttttattatagtatattaaagttatgaattattattcatatctcttttttaaaatctaataattaattc

SEQ ID NO: 4483 - DNA, 89 bp, Methanobrevibacter ruminantium
tattaatagacctaatttattgagattatttaattaattttacaatattaatagacactattttaattgaaattataggaagaaaaata

SEQ ID NO: 4484 - DNA, 58 bp, Methanobrevibacter ruminantium
attaataatatatattacttgatgataatcaataagtaaattcaatattattataata

SEQ ID NO: 4485 - DNA, 84 bp, Methanobrevibacter ruminantium
aaaatttaaaataataattataaagaatctttttagtaaaaaatattataaaataagtaaataaatatccgatttataaaagca

SEQ ID NO: 4486 - DNA, 143 bp, Methanobrevibacter ruminantium
aatattacctaaaattaaatattaaatattaaggatgaatattcagtataattgtttttttttaatagattaaagtttttctactatttaaactaaaaattatattaaattaaatcaaagtatatttttaactagtttttttt

SEQ ID NO: 4487 - DNA, 265 bp, Methanobrevibacter ruminantium
gctatctttacactcccatatttttatttaaatcaatttatttgtgaatataatcatttatcatttccttttgtttttttatcaatttttaaagataaatatgaaatgtttatccattttgggatttttttatttaattttatcaattattttagataaatatgaaatgtttatccatttgggatttttatttaattttattagtttttatagaatgaatttataaatttattgttctaaataagaatagtaagagattatctcc

SEQ ID NO: 4488 - DNA, 356 bp, Methanobrevibacter ruminantium
tatctcacttatttttaagattttgctaaatcattcgttcgattaaatactaataatattaaattaatataaaaatgttttatattaatttatatttatgttaattattattaataaatttaacatttcgtaactagagaaactatttatagggtatagttttgaatgtgtttaattcgattatttaagaaaattttataaatcaaattatctatttttaggatattgtttattgtttaattcgattatttaagaaaattttataaatcaaattatctatttttaggatattgtttattgtttaattcgattatttaagaaaattttataaatcaatttaactaattatatattat

SEQ ID NO: 4489 - DNA, 52 bp, Methanobrevibacter ruminantium
cttttaagtatttttacagtattttaaatacttttataattttttaagtatt

SEQ ID NO: 4490 - DNA, 18 bp, Methanobrevibacter ruminantium
ttcttttttttatttttc

SEQ ID NO: 4491 - DNA, 20 bp, Methanobrevibacter ruminantium
tttttcctttttttattgat

SEQ ID NO: 4492 - DNA, 468 bp, Methanobrevibacter ruminantium
tatccattgttatatatatttatgtatctaaagttttcatatatataaatattcatttttcttaaaaatttctttaattatattaatttattttagttatcttaaacagattaatgttatttttttaatatttgttcaataaattaaatatgcttattgaaatttaataaggattgttaaaacttaaaataattaatgcaaaatttattattttttaattcaattttaaataagtatttaaataaatattagaataattttactattacaaacctttataaattacaaagactataaataatattgtatcaattattataatactatcgataggtatattaataaaaagaagtcctttcgaatagttattaaaaaaaattaaaagtatatcatcatgataattagttttattttctaaattaaagcaactaataattagatttattttctaaagcaaagggataaata

SEQ ID NO: 4493 - DNA, 1777 bp, Methanobrevibacter ruminantium
gtctgaggatattatgagacaaaaggaaagtgtttcaaaaagaaaggttgagcatgaaatcattgatgattctctagatgttattgttcctataagtgctgaaagaagagcagatgaatataataattattctgaagatgctaatgttattattccaattcaagatgaagaggaatttgaagaggaatattataataatgattctcaagttgattctgaagagggaattgatgaattggaagaattaatctctgaaaacattaattattcagatgatgatgctagagaagaattcttaacaaataaagagtctaatcaagaaagtgaagaagattcttactattacagcgcagtaggaattgaaaattcacttaaaaagaatgctgttcaatatccaaaatcaagcaataggaataaaaaaggcattgtaggtgctgtatctagcttaaaagatgaaatgctttatatcaatgcttcaattaaagaaatagaaaacccaactgaaagagaaaaaatctatgtgatagacccttcagaagaggaatactataatcagccagatgattctatttactataatgattcccttagtgaaaataaggaaagatatgctaaatcaaaacaatatgaagatgaagttgaagtcatttctccggtatcagattctgatgagggagaaacaggccatattcaatctgattatattgaaagaaaagctgaagacagttctaaatctagttctgaatccttatttagtcctaaaaaacatgaatatttggataaaattaaggaatatgctgctgaatctgaatatgaagaggcagctgaaaaccctacaataagtccagttcatactgaaattgaagaaagtgttgaatcttctgtaattagcccggttcatactgaatatgttgaaactgttgaatcttctgctatcagccctgtccaacaggaatatgacaaaacagaggaaccttcaaccataagtgctgaagatcaagaaacagagtttattgatgatattcttttagaagaagatgaattatcaaatattcaagatactgatgactctgctttagctgaagaagaaccggaatctatagaaatagatgatgatgaatttgaaagcattatcactgatgtggatcaagattatcaagaacttgaaaaagagagaataaaggaagctaatgtattaagtgcagtagataataccagattaactcctaccggcaaattagaagattatatcgtggcatataaggaaattgatgatgtcattatcaaaagtgccacagaaatatatgatgatgagaagaaagtggctactgcagttatggacattgtaagtgcagaaggccctattcatgtagatatggttatacgccggattagggaaagctgcaatctctctagagcaggcactaaatttaaggaagctatatttaaggcaattgaccgcaatgaatctcatatgaatcttataagagaagaggatttcttatttatagattatgaccaaattgcagttagaaaaagagataaacctaatatagaccttatttctgatttggaaatagaaaatgctatagatttggtattaagctttgaaaaatcattaaaggttaaggaattagctagaatcgtttctagaaccttaggttttaaatccacttctaagaaaacttcagctaagattttagaagtcattgatgttatgatcggcaaagagattttagtaaatgttaatgataaaatagaatttagataatttgca

SEQ ID NO: 4494 - DNA, 58 bp, Methanobrevibacter ruminantium
ttaattttaattagattattttggtttaatatagttatatatagtaaactcgatttta

SEQ ID NO: 4495 - DNA, 396 bp, Methanobrevibacter ruminantium
taattagcctattaatattattactttttttgttatttttattacatatgtattatttttttctttaaaagtattacttgaaaatatgtaaaagtattaaaaaattgataaaaagtaatacttattttttctaataagtaataaaaatttcataaaaattaatacttttttcattcaaaaagtattacaaaattgattaaaagtattatttaagtattaaaaatttaataaaaagtattacgaaaaagtaataaaaatctcttaaaaagtattatttttttagctaataaattttagatttatttgtcctgttaaataggaattttgataattttctatttttaaaaattttaatctggataatttttgatcttgtcctggagaaaatattttcga

SEQ ID NO: 4496 - DNA, 328 bp, Methanobrevibacter ruminantium
ataaaataatttcaatagaataaaacaatattttaatttcatcataataaaactttttcaatatatgcaaactaaatattgtttataatctttgaaacatttttcatacatacaaactaaaatagtttagaactatagaaacatttctataaagtataaactaaattattacttaataataaaaaaagtattataggtatatttcaagtgtaaaagaaaaaatttttcgaaaatttttaaaaattgcataaaatagtaaaaaaacattattacatatacatcaaacgattaatttttgctattttaaaacaataattatttagaaaaa

SEQ ID NO: 4497 - DNA, 188 bp, Methanobrevibacter ruminantium
aaatttcaaaaaattttcaaaaaagtcccctaaatcatatattttcaaaaattgtttgtcgattttttttcataaatttcgaattttgttttaatcttatgaaactatcaaaaaatagtttttataatatcaaacaaacagaattttgttttaagtatatgaaacttttgaaaatagtttatgttata

SEQ ID NO: 4498 - DNA, 14 bp, Methanobrevibacter ruminantium
aaaagagaataaat

SEQ ID NO: 4499 - DNA, 24 bp, Methanobrevibacter ruminantium
tttaaaacctaaatatgaagataa

SEQ ID NO: 4500 - DNA, 5 bp, Methanobrevibacter ruminantium
attat

SEQ ID NO: 4501 - DNA, 131 bp, Methanobrevibacter ruminantium
taaaatattaattggataaaatttaggaaatataattaattttactaaaaataagtaaaatatttgatttataaaaaaataaaaaaagagaattatcttaaaaaaataataagataatttttatttaaatt

SEQ ID NO: 4502 - DNA, 252 bp, Methanobrevibacter ruminantium
tttttcagagttgtctgaactgtctaaactaatagtatcactactatctgatatattttcataggttacaagattagtattttgtgagtcagtagatgaaattatatcagtttcatttatttctgtcgctgagactgcaccaacgctaattactaaaattagacataaaagtgcaataatcagagtaaaatctatctttatcgatatatttacacctccatatcgaaataaaatcttgtaattaaatttata

SEQ ID NO: 4503 - DNA, 110 bp, Methanobrevibacter ruminantium
acttttaattataattttaaaaaaaaaattaggcattatttaaaattgaaaaaaattattaaagtaattcttttaatcttataacttatgttaagtgtcatggtgttaaa

SEQ ID NO: 4504 - DNA, 343 bp, Methanobrevibacter ruminantium
taaattgaaaaaatagttagtataaaaagaaatagttttttagtaaaataaagtgaaaattgttatttttaattaaaaagttaaaaagaaatagtgttttttagttaaataaggtgaaaattgttatttttaattaaaaagttaaaaagaaatagtgttttttagttaaataaggtgaaaattgttatttttaattaaaaagttaaaaagaaatagtgttttttagttaaataaggtgaaaattgttatttttaattaaaaagttaaaaagaaatagtgttttttagttaaataaggtgaaaattgttatttttaattaaaaagttaaaaagaaaatagttag

SEQ ID NO: 4505 - DNA, 390 bp, Methanobrevibacter ruminantium
ttcaccctaataataagaaagtcatattttaatttattttatcgaataaaggataattataattttttatttatttataaatttattttatcgaataaaggataattatgattttaatttattatatcttatataaataagattagcaagagcgcttgcaaactaatatttatttaataaattaaaattgtttttatttatacaaacaatttaatattagttttaactattatataaaattaatgatttttaaaaatgatttgattaatgaatttaataaaaaaagaatttaataaattatttaaacaatttattgaataaaataatttattcgcttaaaaaatattatttggattggtttaataaaaaaataaaaaagaataagaagat

SEQ ID NO: 4506 - DNA, 57 bp, Methanobrevibacter ruminantium
attataactcctttttttattataaaattaagcaattctgatataaatatttattta

SEQ ID NO: 4507 - DNA, 83 bp, Methanobrevibacter ruminantium
taaatattcaattaaaactagaattaagtgaaaactgaataattcaattaaaactagaattaagtgaaaactgaataattcaa

SEQ ID NO: 4508 - DNA, 65 bp, Methanobrevibacter ruminantium
aattttaacctaaaatataaaacttaaacttaaaactaatatgaataactcatcaattggcttca

SEQ ID NO: 4509 - DNA, 27 bp, Methanobrevibacter ruminantium
aataatcacttaaattaaatttaatcc

SEQ ID NO: 4510 - DNA, 4 bp, Methanobrevibacter ruminantium
ctat

SEQ ID NO: 4511 - DNA, 8 bp, Methanobrevibacter ruminantium
ttaaaaaa

SEQ ID NO: 4512 - DNA, 313 bp, Methanobrevibacter ruminantium
ctttttcaccccctgtattaatttataaaaatacagagattgaatatattattcaacaatattattatgttattccctatttaaatattatggtttttgattgtccaatgttaaaatttgaataggattttagtaaaaatagttaaatgttattgtaatttagataaaataaataaaaaaataaagagttattgtgaaaaatgaattactcactaaaaaacactattgaagataaaaaaagagaaattaagagagatagattactaaaaaaacactttgaaagtaaagaaaagaaaaattaagagagatagaa

SEQ ID NO: 4513 - DNA, 56 bp, Methanobrevibacter ruminantium
aatcacccactctacatacagtttttttttaaattaaacctttgtgcccttaaaaa

SEQ ID NO: 4514 - DNA, 58 bp, Methanobrevibacter ruminantium
ttttttaacccttttaaaaatacatatgtatttaaaaattaaacatttacagtaaaaa

SEQ ID NO: 4515 - DNA, 222 bp, Methanobrevibacter ruminantium
taaaaattaaacctttacacttaaacaaattaaatttgtttaattttaataagttttaacttattgtgatttatttaataagtttttaaaccattattttaataagtttaaacctattaagagtcccttttttaaacttaaaaagttttataatttgtttcaatcgacttaattataagttatttcatttgctttaataagcttatttgaatttaacttata

SEQ ID NO: 4516 - DNA, 76 bp, Methanobrevibacter ruminantium
ctaaccacttagaattttttttagtgattttatgaattcaaataggaatggaacataatatgggctaagagttaaa

SEQ ID NO: 4517 - DNA, 25 bp, Methanobrevibacter ruminantium
ttaaactaactaataattttctgca

SEQ ID NO: 4518 - DNA, 21 bp, Methanobrevibacter ruminantium
tgatctcacttaactaattct

SEQ ID NO: 4519 - DNA, 40 bp, Methanobrevibacter ruminantium
ttacaaatagccatagtttacttatggctttattaagttt

SEQ ID NO: 4520 - DNA, 176 bp, Methanobrevibacter ruminantium
taaatttgtaataattctgaatgcattaattattagtgtccatttattatttgtattagcaaataattttaatatttaaatgccatatattaatataagaattaaatttagatgatttattttagatgaatatttagaatttattaatattaataaatagtttataaggcgatatt

SEQ ID NO: 4521 - DNA, 111 bp, Methanobrevibacter ruminantium
ttctcttttttacttttttagtttatttctccatagcaaattaactagttttgaaaatttttaactaactttttcttaagaatacttctttttttttaactatttctaatt

SEQ ID NO: 4522 - DNA, 98 bp, Methanobrevibacter ruminantium
tattaatccctttttcttatttttaaagtctttgtctatttatctaaaataattctttatatgtttaagtctaaatttttagttataatctttaatat

SEQ ID NO: 4523 - DNA, 263 bp, Methanobrevibacter ruminantium
aataaaaccccatggtagatatatattttatataaaggcattttgacaataattaaaaatttaaagtaatttgatgtattggttggtttattgcagtatgatacttgtttttaaacaatctaatatcacatcccctgtttgattattatatattatattaaaatcatatataaagttttctaaaattatttgagattaaataagttaaagttttatttaaaaatagacaggaaatagtcatttttacaaataaaaccatataa

SEQ ID NO: 4524 - DNA, 77 bp, Methanobrevibacter ruminantium
attttcccctttacattatattgattttttaaaccataaaacaaaaataaaagctttaaacattaaaataagaaaaa

SEQ ID NO: 4525 - DNA, 56 bp, Methanobrevibacter ruminantium
tataaaactcctattttcttaaattcctgttgatatattgaataaaatccttataa

SEQ ID NO: 4526 - DNA, 11 bp, Methanobrevibacter ruminantium
aatattcctcc

SEQ ID NO: 4527 - DNA, 102 bp, Methanobrevibacter ruminantium
aatatatccctctttatgtttacaattaatttagaataacttcatctaatttattagaattaatttagaataatataactaacattaactaatctcaaccgt

SEQ ID NO: 4528 - DNA, 285 bp, Methanobrevibacter ruminantium
aaaaattctccaataagtttttaaaaaacctttaaattaattattcttccatttaattaattttttatatctttttaaaaatccattaaataatttaaaagtttatactataatactatttattaatcaatattaatatacttttttagaattttttttatcaaaatcaatatttttagtgaaaattagaataaaagaacatcttcttagtgaagattagaataaaagaacttatttttagtgaagattagattaaaacaaacaataggaataattgatttgact

SEQ ID NO: 4529 - DNA, 394 bp, Methanobrevibacter ruminantium
aaattcaccaattatttattttatttttattattttgatttaattactaatttaatttattatcttttattaagttctattttaattacacctacttttaattaaaattatgataatttttgttcaataggaatcaatattaaagatttaatattgaaatttttatccctaatagatttcatttattatttttattttaattctttttataattaatcaatattcaaacttaattatcctatttttataaaaacattagttaaataccaccattttatcaaaaggtatataaataaagaggattaaatatttaggtatacataaatattttttaggtatacgaaaatatttctgtaatattaaaattatttttaaattttataggtgtacaaaa

SEQ ID NO: 4530 - DNA, 371 bp, Methanobrevibacter ruminantium
tttttattcttttttaagctatttttaaatactttttattatttttttaagttcttctagaatattttttatttttcttttttagctcttcttgaatatttttatcaaacaatcaagatttactttttattcaatcctcaaattatcatttattcttattttcaaaactatgctaatattatagcatcataattatgagtaatcttgaatcagttaagttattggattgattaaagtgtatgattaagtgaatttataagaattaataaaaaaataaagatggatgtataataaaaaataaaataaattaaaaaaataaagtcaaattaaaattgaatggttttaaaaaagaaagaaaggaaacagaataa

SEQ ID NO: 4531 - DNA, 114 bp, Methanobrevibacter ruminantium
atcatcaccttttacatagcataattattaaatgaaagttattttaaaaatttaagtgttttgttattttttctattgaatttctaaatattatttatttaaattattttttta

SEQ ID NO: 4532 - DNA, 78 bp, Methanobrevibacter ruminantium
tttaccaagttaaaaaatcttcaataaagaaaaaactgttttaaaagtcataatcctttacagaatcaatataaagct

SEQ ID NO: 4533 - DNA, 508 bp, Methanobrevibacter ruminantium
aaatatccactactaatattatattcttgattagatttatagcttattacaatctttaacttataaaattagcgattcaattactaatttcaacccccttaaaacattgtatacatatagtatttatattgttatatataaagtttttgtttttttaatgtccttaaacttttggacaattaaaaatttataaaaaattgcttatttttatagaatttttaaaaaaattcatatttatttaatgtgattaaagtttaagaacaagttaaaatagaatattgccaaatgttttttttatcatacaatgtttgattcaatagtctaatattataaaaaggatgattgattcaactgtcaaataattaagattattaatgcctaattcaattgtccaaataattatgattattaatcaaaaggaatataataatattagttatacaaaattaaataaaacattttagtataattaatttacaatgatataaaaatgattaggagatagaat

SEQ ID NO: 4534 - DNA, 187 bp, Methanobrevibacter ruminantium
atagttttaagactatttaagaactagtgatttttaaaaataaataatagaggataaaacctctttaaaaaataattttcttttttttatataaataatgactttaaaaagtaattttctttttttaattagaaaaataatgacttaaaaattagttttctcttttttataataatgataaagtcat

SEQ ID NO: 4535 - DNA, 75 bp, Methanobrevibacter ruminantium
tttatctcctgcaagtatgtttataaattaaaaaataattttaattttaagaattatttatctatattaatccat

SEQ ID NO: 4536 - DNA, 163 bp, Methanobrevibacter ruminantium
attttcccctttatataatttttaataatttttcaatataagattttttttctaattagttgttacttttttagttcttatatttatatttatattaaaaactaataaattttggtaattttaaaaaccaggttaagggttaaatatttattctattaatctt

SEQ ID NO: 4537 - DNA, 42 bp, Methanobrevibacter ruminantium
cttccaaactgtagaaatagatgttatcaaccccttttctaa

SEQ ID NO: 4538 - DNA, 78 bp, Methanobrevibacter ruminantium
ttcaagtcttcgactttgctttttgcaaaatgtccttttaaaaaattctttaatttatacataatattggcccaccta

SEQ ID NO: 4539 - DNA, 274 bp, Methanobrevibacter ruminantium
aattatcactccatatgaatgaactttaatcaaagattgcatttattattttatttcaaccctatataaatatctttgccttatttttaaaaataagaacaattcataggctgatttactatacaacatatatagtaaacttttttggttatatatggtaaactatacattaaaatcaagagattttttatacatagtaaaccatacataaaaaccaaaattttttacaccgatgaaaggtgaaaaaatccaatctgtgattaaaatttccaaa

SEQ ID NO: 4540 - DNA, 396 bp, Methanobrevibacter ruminantium
gttatcacctacttaaatgtcttgtttttctttatatttaagtttaatcttagtatgataagtaaaaattgatgtgagagtgtaaaattgcttttagagtaaaacaaaattgatttcatttcgtaaaattgatgtcatctcgtaaaatttacttcaaagtgtaaaattgatgtcaaagtgttaaattgatttcatttcgtaaaattgtcgtgaccgtggaatatctatggagagctgactagagcttaagatttaatctatggattgtttttattaaaaaatagttgatggttgtttatatatagtttttagttattattaaaattccttatattaaaaataaatttttagatgattaaaataagttaaaataactgaatttagattaaattaaga

SEQ ID NO: 4541 - DNA, 110 bp, Methanobrevibacter ruminantium
aatcaaacatttaattttcccatttgtattataaaaatattaaattttgattaatgtatggtagataatagaaaataaattatataaaatagatgaaaattgacatctat

SEQ ID NO: 4542 - DNA, 94 bp, Methanobrevibacter ruminantium
attatcactttttataaaattaaataatagttattctttaaatttaatcattgcatttaataattaaacatcccatttaaacttaaataattaa

SEQ ID NO: 4543 - DNA, 109 bp, Methanobrevibacter ruminantium
aataaatcgtttattttttatattaaaaataattttttattgtttaaataataaggcctattatgaataattatttattgttttaatgattaagctaaacaattttatg

SEQ ID NO: 4544 - DNA, 108 bp, Methanobrevibacter ruminantium
attttagccccattattctaattaaaaaatttaaactttcaatttaaaaataaataaattattattttttgacaatttgagtaaaattataattttcccttttgataa

SEQ ID NO: 4545 - DNA, 62 bp, Methanobrevibacter ruminantium
gtccaagttaacaaagttgaacattataaaaaaaaccactaatccaagtgttattgaagtaa

SEQ ID NO: 4546 - DNA, 2 bp, Methanobrevibacter ruminantium
ga

SEQ ID NO: 4547 - DNA, 13 bp, Methanobrevibacter ruminantium
aagtcagttaata

SEQ ID NO: 4548 - DNA, 62 bp, Methanobrevibacter ruminantium
aattaaatattttattatttcaaaaagaagcatagtaattaaaaagaggatggagaataaaa

SEQ ID NO: 4549 - DNA, 546 bp, Methanobrevibacter ruminantium
gaacttaatgatgtgacaaaaacagaatgtatttttttaagaaagaatgaacgggaaaaagcttatgaaatcttagaaaaattagtgaaaaacgatggagaattatttatttttgatccctattttttaaaacaaagcgaaggaaaagatgtgttaaaagatttgctgaatactattttaactcataatgatttagttaatattatcttttcaaaagatattggagaatcttttgagaactttaaaaatagtttaactgttgatgaaaaacttttttttaagaatataggagggtccgccaaaaagctatttttttaaaaaagtttaaaattttcaattttttaagttatttattttagttatttttttaaaattcgatgttttttctattgttttcttttaattttggtgcttgcaccttgaaaaaattttttacttgttaattattctttaaatatgaaataaagcaataatattatagtaaactttatatactactttaaacataaataatatcaacaaagggttaatattttggtgttattt

SEQ ID NO: 4550 - DNA, 267 bp, Methanobrevibacter ruminantium
ctggtgttgtcaaaattttattttggcggacacccataggtatagaaaaaattaaattcataaattcacaagaaaggttccatgatcgattcatattcctacaaaatcaagaaaaattaattggatatcagataggaacctcattaaattcatttggagaaaattattctaacttaataaaattaagtgaaaaatgttctaaagagatttttaatatcctgaaaaaggatttaatttccgaagaagtttataggatggattattaat

SEQ ID NO: 4551 - DNA, 346 bp, Methanobrevibacter ruminantium
aaataccttgttattttttagaaactatagaagaaaatgaagaaactttctttacaatatttgaatcgttagaaatttataatattaatgaattaaattcactagttaacccattgaaagaaattcatattaatcaggacagattatttcaacaaatgataacaaaattagaaaagttattaacagaagaaatcattactattgataattatgaatgggaacattttttaaatattattcctgaaaaatatgttctaatgataaatggtcttcttcgaaaaacaattggggatttaacttttatttcagaactcgatagagaaataagaagtaaaagatatttctc

SEQ ID NO: 4552 - DNA, 213 bp, Methanobrevibacter ruminantium
aatcataaaaaagcacaaacaagaaatccgagaaaaactttataaaaaatagcaaaaaagttttttctacaatcttttattaaataaaattaatctattgagtactttttctatcttctccaatcaataaatgaaaattagaatatttaagtatactaccattttttatagttttaaaataaatatataattgaataaaaaggggtttttcat

SEQ ID NO: 4553 - DNA, 53 bp, Methanobrevibacter ruminantium
gattagaatatttttatttcctaatccttttttctcattaattaataaaatta

SEQ ID NO: 4554 - DNA, 30 bp, Methanobrevibacter ruminantium
agaaaatcaccatcattttaatatattaat

SEQ ID NO: 4555 - DNA, 13 bp, Methanobrevibacter ruminantium
ataatcacatatc

SEQ ID NO: 4556 - DNA, 135 bp, Methanobrevibacter ruminantium
atgagtactcaaccgttttataaaatttcatataaaatttatttaattaaagatagctaaagaataatcaatgaaatttaataaaccattgaaattcttatagctaaaactaattaaaactatatccattttaac

SEQ ID NO: 4557 - DNA, 151 bp, Methanobrevibacter ruminantium
aaaaaccccttatcatatttttttattaaatatttcattatggtgtctaataataaatatattaacaaaagataatatattttttgaaaaatattaatattcaaaaaacaaaaaatattatataaaaatattatgccacaggattgatttc

SEQ ID NO: 4558 - DNA, 9 bp, Methanobrevibacter ruminantium
gtgctagat

SEQ ID NO: 4559 - DNA, 2560 bp, Methanobrevibacter ruminantium
aaggttccaatagcttgactttggccctattctttgaagatgacgagtcagagccaaggtcattttcaagcgaagggcatattgataccttaggattatgtctctttttggcatttgtaaaggaattcaataaatatgatttcatcattttagacgatatcatctctaccgttgacttggaacataaggaacaggtaattaaccttctgtttgaatactttggaaactataaattcattataaccacccataacaagctatggtttgagcaattggcaaggcttgccgattactatcaacaaggcagattccaatttgttgaaattactgactgggacagggaaataggaccgtcactgtcacgtaaaaaagatgaaaaagaaaggattgaacagtacataaatgacaatgacacctttgcagcaggcaatgcaatcagacgccagctggaatatgaattggataaaatctgcaaggtaaatgaaatacctctgcctcttaaaaagcattatactgtaggggactactacactccaacaaagaaatttgctaaggaaatgtttaaggacactgatgttgaagaatattacaaaaatgtattcaaagaactggatttgtctttatacaaagcaaatctcacatcccataacaatgaaatgaactatgacttgaacatcaatgaaattaaaaaattaagggatgccgtttatggtttggaaacagcattcaagtgcaagaatcattctggaaactatgtattgaagtttgatatggacaaatgtctaggactttgcagccataaacggtgcatagacttctttacatttaatagaatttgattgctttagatggtactggacatacaagtgactatgttgataaatatcgctcaaataagaaccaaaaagaaaaaggatacagtaaatcatattgctatcgatgtgtacaatgaatgatccttcattatggagtctctagatgtccaaaacatgattgcaatttgcttttgcagccgtaaggcaaatgaaaaaatataaaccgcattactatttatagtgcttatgactttgaagaactaaggaaacgcataaacaaaatagtttagctttagaccaaataccacttaaaacaagagcatggccattatcgttcgaacagtgcaacagtcttcagacctaaagtctatggcagaagaatgaatgtggaaagtgttattctgtagttaagagaaaattttctggtgtaaacttttcatgaagtgatcgattgcgtaatgaaaaaaccaagctaaaagatgtgttataaaatatttacagacacatacaaatcttttagaaagggtttctacaaaggctgaagaatcattgcaattttatttataagaaaactgaagggataaacatagcaatcattgttttgttagaataatcaatgcaataaaattaaacaaaggaaacagattccaaagaaggtgttgtaatccttattttagtagattagcttttgcaatttttttccaaatcttataagcaggaggccagaaagatcgcaacccttattttagtagattagcttttgcaatacatatagataaatccttatggatagagagggtaggtcgcaatccttattttagtagattagcttttgcaataaactactacacaggtgttaaaatcggagaaatttgtcgcaatccttgttttagtagattagcttttgcaatactataaagagttaaaggccaaagcctttaaagatgtcgcaatccttgttttagtagattagcttttgcaattcaataggaatgaaataacaaatgacgcgcagaaggtcgcaatccttgttttagtagattagcttttgcaatataagggtatgttaaaaaccctaaaaaactataaacgtcgcaatccttgttttagtagattagcttttgcaattatgaaatataaagagttctcagataaatgggagaagtcgcaatccttgttttagtagattagcttttgcaatagaacggaggaatttcttatgactaatgaaaaatctgtcgcaatccttgttttagtagattagcttttgcaatacattgctagacacataggaatggtggaatatgatgtcgcaatccttgttttagtagattagcttttgcaatcgactacgaagcaactattagcagaatgaccaaatgtcgcaatccttgttttagtagattagcttttgcaatagtccaaaaatttcctctaaacatatcaaaaacatatggatattgcttctttttatagggtttttgtgcaaatctaaaaacttaacccttatttatatatatttgcacaattaaaataaaaagttttctattaatattacctaatattaatcattgaataaattatattaatgtttaaaatcaaaatatcaaaaaaataaaggttaagatataattaattaaaaaaataaggaaaaaaagagaaataaaaaaatatggaaaaaatagtgaaaaaataaaaattcattaaaaattgataggtttgcacaaaatggctttctggattat

SEQ ID NO: 4560 - DNA, 143 bp, Methanobrevibacter ruminantium
tttaaaaactccttgataactattctttattaaagtcttaaactctttaattttcttattttcatttattattaaaattaaatgcccattttttctttttaaatctttaactctttaattatagtttttaagctaattaaaac

SEQ ID NO: 4561 - DNA, 35 bp, Methanobrevibacter ruminantium
accaccacatccaaataatgcacaaaatacattgg

SEQ ID NO: 4562 - DNA, 996 bp, Methanobrevibacter ruminantium
attttcctcccaataataaagaaaatttattaattttcatagaaaacagagctaaaatcaaacatgactgataattaaaaccattaaactataaaaagagtttccaaatattaatattcaatgatcaaataaaatagccaaaacagactagatatttttctaattggataattaatattttagaaaaatgctaaatctaccaatatttatttagtgttgtatgtgcatacaataaatgtagttggttaaatataaagttttacattattttttcaaaaatcaaatctttttaaattacaaattttggcttttatataatttaatcaccaatatttgatacttttttaatttatttaaaaaatcaattgtttttttaggagatgggaatgaaaaatcttgttttttttaaggaaatatggacatataatttttatcctattgtgcaatagtgaaaaacttccaggaattttttaatttcattaaattttataatttttttaaatggacatatggtttttatggatttattatttctatttcaagttgaattttatttaattgattaatttagtcttaaaattttaaatggatatttgttaatttttattttaaatcctcaggtttttatttaagttgtgcaaatattataaatgtgaatatatttcacatacttgcacataattcgcagatacaagtgtaatatttctcaatttttgcatattatatgtggattttaggggttatttcattgagttttccaataaaacaaggattgcgacactttgtccagttctgcaataaaagttttaagttcattgcattgagttttccaataaaacaaggactcatttaacctattttataatacatcagaacagtttgcattgaatattctaaaaacaaggatttaactattttccataataaaatatcaaaaatattcttttagaaaaatagttattgaaacaagctaaaaatataatctaaaaaaaagaa

SEQ ID NO: 4563 - DNA, 54 bp, Methanobrevibacter ruminantium
aaaaaaatagaataaaataaataaaaagctaaaaatatgatctaaaaaaaagaa

SEQ ID NO: 4564 - DNA, 35 bp, Methanobrevibacter ruminantium
aaaaaatagaataaattaaataaaaaaagtaaaaa

SEQ ID NO: 4565 - DNA, 34 bp, Methanobrevibacter ruminantium
ataataagtgggctaaactaaaaataggaatatg

SEQ ID NO: 4566 - DNA, 23 bp, Methanobrevibacter ruminantium
aaaatcacttaaaataaaaaaaa

SEQ ID NO: 4567 - DNA, 37 bp, Methanobrevibacter ruminantium
tcctaaaggttcaaagctatttttaaaataaaaaaaa

SEQ ID NO: 4568 - DNA, 90 bp, Methanobrevibacter ruminantium
tacttaaataaaaaattttaattataattacaaattatatttcaaataaaaatctaactataattcactttttaattttcatctacaaat

SEQ ID NO: 4569 - DNA, 13 bp, Methanobrevibacter ruminantium
aaaaaacatcccc

SEQ ID NO: 4570 - DNA, 4 bp, Methanobrevibacter ruminantium
cttt

SEQ ID NO: 4571 - DNA, 304 bp, Methanobrevibacter ruminantium
atttcccctcaaagaaaaagaataaaatcataaaaatcaaagttattttatatttatgtgcattttatataataaaatatatgcatttaatgtttagtaagtatgattttgatattattttaataagttggaacaaaagaaatttcgatttttctttttaagttaaaacaattattaaatgttcaaaatagccaataaacaaaaaacgaaaatcataatgatgtatgtggcaaatgagataaatatatgcttattcatttataaaactccttttatgatgataggtttaatgaaataaacctat

SEQ ID NO: 4572 - DNA, 3003 bp, Methanobrevibacter ruminantium
ggtatcttataatttaatctagttcaactgcgattatacaaaaaatagaattgaacaaaatatttaatgtatggtacaagtcttttgtgatgtatcttttggtgttcaattacatagtataagtttataataatatttaaaggtttggttttttgttgctatccttgttttaatagattactttttgcaatttgtataccatgacagtaaaattgtaacttttgcatcacaatccttgttttaaaagattactttttgctattcagtaacaatttttctcgaaaaacaagaaggcaatcacaatccttgttttagtagattactttttgcaataaaaagacacttaaaaattatggaacaaaaaaaggagtcacaatccttgttttaaaagattactttttgcaattctgattcccttaacaaactcacaataagggaaaaagtcacaatccttgttttagtagattactttttgcaatattaacaaggaaacagaaatggagattaagacactgtcacaatcattgttttagtagattactttttgcaatatttcatttttggactgatgttgttcttgaagaaagtcacaatccttgttttagtagattactttttgcaatgtaggtatatttcttatagaataaataaaatttatgtcacaatccttgttttagtagattactttttgcaatacaataacagagacaacagtactgaagaaacagtaagtcacaatccttgttttagtagattactttttgcaatatgaaatcattgaaacacttgttgaaattcatgcagtcacaatccttgttttagtagattactttttgcaattatggtagttgagaaagttacaaaagttagggctaagtcacaatccttgttttagtagattactttttgcaatccttattgaatgataccaaagacaaagtggacgaatgtcacaatccttgttttagtagattactttttgcaatagagttaaaagagagtttagctatagcaagagtttgtcacaatccttgttttagtagattactttttgcaataagagctaataaacaaactaaagaatatatgcttaagctgtcacaatccttgttttagtagattactttttgcaatataagattagttttgatattattagatttttttctgtcacaatccttgttttagtagattactttttgcaattcggttcttccgtctctcgtgtgtccgtcgcgggtgcgtcacaatccttgttttagtagattactttttgcaatcctaatacctattgtaaatcttttcaatttaaaagagtcacaatccttgttttagtagattactttttgcaatgacaaactttataccttaagaaaggttcaaggtgtgtcacaatccttgttttagtagattactttttgcaatcaatcattcagtatacgataaagagtgtaacgactgtcacaatccttgttttagtagattactttttgcaatagataatagataaattgaggtgttaaatatgttatgtcacaatccttgttttagtagattactttttgcaatatatcattatagacaaatatagacaaaaagaaattgtcacaatccttgttttagtagattactttttgcaatatatcattatagacaaatatgacaaaaagaaattgtcacaatccttgttttagtagattactttttgcaatggcaaaattgaacgatttaagccaatacgacacttgtcacaatccttgttttagtagattactttttgcaataattaatgaaaattatataggtgattatttatgtgtcacaatccttgttttagtagattactttttgcaatatgaatttgacttaagaagccaactcttaagaagagtcacaatccttgttttagtagattactttttgcaatatcaaaatgtaatgatgccataccattatcatttagtcacaatccttgttttagtagattactttttgcaatattattgtgacacaaaaaagaaatttccttgacaaagtcacaatccttgttttagtagattactttttgcaatcaaaaatacattttacaaagatatgcttaaagtcttgtcacaatccttgttttagtagattactttttgcaatcccatatggaagtcgcgagggaatcaaagaagaggtcacaatccttgttttagtagattactttttgcaataaagttcaaggggtaacaagacaagcatacttcggtcacaatccttgttttagtagattactttttgcaatatcaaaaaacttttatattttttattggtgataaaatgtcacaatccttgttttagtagattactttttgcaatatatacaagttataaaaacttgagagttataaaaagcgtcacaatccttgttttagtagattactttttgcaatagagtatggttgtcactttagggaggatttctaagtcacaatccttgttttagtagattactttttgcaataccttagaactcttaaaacaagtaaaacatcgagcgtcacaatccttgttttagtagattactttttgcaatgaaatacagattaagcaatcaggcatatagacaagtcacaatccttgttttagtagattactttttgcaataaagacactttagatgtaattgttcgctataatgaagtcacaatccttgttttagtagattactttttgcaatattatattaaaactcaaataactatagatagatttgtcacaatccttgttttagtagattactttttgcaatttaatggacttatagttagttatgacttaaaagcacgtcacaatccttgttttagtagattactttttgcaatatgacatgagttgtgatttaaacggcatcgtaagcgagtcacaatcttgttttagtagattactttttgcaatagtccaaaaattttctcaaaatgtatgaaaaaataatggaaattgcttctttttatagtgttt

SEQ ID NO: 4573 - DNA, 23 bp, Methanobrevibacter ruminantium
gtgaaaaaagatttctattttta

SEQ ID NO: 4574 - DNA, 33 bp, Methanobrevibacter ruminantium
caaagtaaaaatgcatcgcttaggaggtgaaac

SEQ ID NO: 4575 - DNA, 144 bp, Methanobrevibacter ruminantium
tttttttattttttttaaaattttaccctcctaaaacaaagaataagcttttaaaattaaataaatctaaaaaaaataaaaatagaaattaaaaaataaaaaataaaaatttgattaaaaaaaagaaaagaaaaatagtagaaa

SEQ ID NO: 4576 - DNA, 374 bp, Methanobrevibacter ruminantium
tttaatcactttaattttagaaaataattgttagttattcttttagggctaagcattaattatctaatcttgatctgtttaaattttaatgtctattttaatttataaatgctttaaataagtcattctcttcattaagactgattgtcagttaaatctctatcgaatccagatgaaatgctttttatgattaaccctttgcttatttatatatgcttatagtttgtattagaaaatatatataaatatctaaatgatgttgggtaatactgaatgttttttaaaaaaagtatctaaaacacattagtcaataaattaagttttagaaaatgatttaaaatataaaaacagaaattatactaaggaggtaagat

SEQ ID NO: 4577 - DNA, 76 bp, Methanobrevibacter ruminantium
tctcttcttaaaaaaaaaattttgtctaaaagtagacaatgaaaaattagtgttaaaaaagtatgaaaaaatagtt

SEQ ID NO: 4578 - DNA, 336 bp, Methanobrevibacter ruminantium
attatcaccgagtacacaatgtatagacacaatcatttataaacctttgttttttataaactatttctaataaatagtaaaccaagcttccacttaaaaaatttctaataaatagtaaaccaagcttccacttaaaaaatttctaataaatagtaaaccatgcttccacttaaaaaatttctaataaatagtaaaccaaattctactttataaagcattaataaatagtaaaatgattgtctaataaactttttctaatattgtatataggcaataattatttttcaaagaaatatttctaataatggtccttaaaattgattatttaacttatat

SEQ ID NO: 4579 - DNA, 39 bp, Methanobrevibacter ruminantium
tatttatctagaatcaaaataagttaaggtgattaattc

SEQ ID NO: 4580 - DNA, 86 bp, Methanobrevibacter ruminantium
aaaaacaaaaagaagggtggcaaaaaagatagggtaagatataattaaaataattgctaatttttagataatgttttgtgtaaaga

SEQ ID NO: 4581 - DNA, 101 bp, Methanobrevibacter ruminantium
actcagcatatgagaaaattggaatttgagattagtaaaaaaattattaattttcaacacaaatgacagtaatgtgggtcaagcatagccaaaataaaaaa

SEQ ID NO: 4582 - DNA, 135 bp, Methanobrevibacter ruminantium
tattttctccttgataattaaaagactggttaaagagagtttaattaatttaaacagttaaaatctgccttaaaaagacttaaataaatacgaattaaaccataaaatctgccttaaaaagtacaatttaaacag

SEQ ID NO: 4583 - DNA, 69 bp, Methanobrevibacter ruminantium
ttttcctctcctaaaaaaaataactatccaatgagtttaaagttattgaatagttttgattttttataa

SEQ ID NO: 4584 - DNA, 129 bp, Methanobrevibacter ruminantium
attatcacaacgtatttttttttatttataatccttaaatcctttaaaaataaattcaatatctaaaaatattattttttggacttaattactataatgctatatatgaattatctatatatttatttt

SEQ ID NO: 4585 - DNA, 208 bp, Methanobrevibacter ruminantium
ggtatggttaaaaaaaaagaataaatagttggataagaaccaaccgagataaaaataattgaatttgaaagaagaaaaaacagacggattagacccaaccgagataaaaataattgaatttgaaagaagaaaaaacaggaggattagaccaagtgagataaaaattttggtccagcttttgcggagcgaagggccggaaaaggtggag

SEQ ID NO: 4586 - DNA, 107 bp, Methanobrevibacter ruminantium
tttagttcacctgttccatagttatttgttaaaaagcaggattagaccaaacagagataaaaattttggtccagcttttgcggagcgaagggccggaaaaggtggag

SEQ ID NO: 4587 - DNA, 412 bp, Methanobrevibacter ruminantium
tttcttaacccctattaaatataaaattattataaaagattcaattatcttcttctaaaattagtataatcctatatttaatagtcatatatatttattctttatgatttaaatcgataagatgagttattttttaaaaaaagtaactataattaatttatattaaaaataaatatgcaaaatatttttatatattcatattattaactaggttaaaaatatgaaaaaaagaccaaaccttaagatttaatcatgaaataaaagatatatgagagaatattttaaaaaaatttaaattatatgaaaaataaactaaattttataggatttgttgaaaatacgtttaattaaatatttttttatttaatcatttcaacaagaccgaattcttaaattataaaggaggaaaaaa

SEQ ID NO: 4588 - DNA, 227 bp, Methanobrevibacter ruminantium
ctattgaatttttttaatttttaattttttttaactttttttcttttaaattatttttttttattttatttactttaagctctttttaaacaataaaccattattaatctctttttaatcaataaaacccttattaatttcattaaaactccttttaatcaataaactatgaattacattaactctttttaatcaatgaacatttaattcaagtattttaaaagctg

SEQ ID NO: 4589 - DNA, 8 bp, Methanobrevibacter ruminantium
tgttaaat

SEQ ID NO: 4590 - DNA, 224 bp, Methanobrevibacter ruminantium
tatttctctcctaaattaatcatcaaaaatatgatgttaataatatttattttcttatcaataattaaacgtttctattttattttagcaaagataaaaagaatatgcgaataattaaacgtttctattttattttagcaaagataaaaagaaagcattcatgtgaataattaaacgtttctattttattttagcaaaaaacaaaaggaaggtaattgttttat

SEQ ID NO: 4591 - DNA, 103 bp, Methanobrevibacter ruminantium
gaatatctcctcatataatcatcaaattgatttaaaaataataaaaaaagcaagaataaaataaaaaaagataaaaatgtaaaaagaaaataaactattcaaa

SEQ ID NO: 4592 - DNA, 246 bp, Methanobrevibacter ruminantium
ttttttcactccttaattaatcatttaaacaatgatttaataatatattggccttataaactattaaaactttctataattttcaattctttgatgaaatttggttatttcattcagttattttaaagatatatgtttaaatggtaggattaatctaaaaaaattatcattttgtatgattttaaaaaaatatttttcatatctttattcagataattaagcgcctaaatttagaaaataagcaga

SEQ ID NO: 4593 - DNA, 185 bp, Methanobrevibacter ruminantium
gcttgcacttctgatttatattttttatatacttataatttaaatttctataaatattaaattttctttttgttttaatgggaattttatttttaattgggcaaaaaactgcctttaatggattaaaagagtacataatagtatctaaaacacattagattttacaaaactaaaaaaataaaaaa

SEQ ID NO: 4594 - DNA, 238 bp, Methanobrevibacter ruminantium
attagattttacaaaactgaaaaaaataaaaaaagtatctaaaacacattagattttgaaaagtattaaaattcaatattatgtgaaaaatagaaaaattagaacgagtatttaaaattaaagaaaaataaagagttaaataaaaaaagaattagatttgaataaaaagaataaaaaatagaatgaatttaacccccataggagctaaaaacatattaaaatttaatttaataattaa

SEQ ID NO: 4595 - DNA, 336 bp, Methanobrevibacter ruminantium
attaacttatcctatttatattgcttatagttttattagataagatataaaaatttatcttaataattttaagtttcaagttaaattagggagaacttttaaatgggatagttttgcttttttaattaagttttcaaatgttctttttaataaaataagtttcaaatgcctgatttagcaaaattaagttttaaaacagtttcaaatgttcgaataagcaaaattaagttttaaatagtattaaatgttcgaataagcaaatttaagttttaaaacagtttcaaatgttggaataagcaaaattaaatcctatttacttcaaatgttcgttattaa

SEQ ID NO: 4596 - DNA, 11 bp, Methanobrevibacter ruminantium
aaaattcctcc

SEQ ID NO: 4597 - DNA, 43 bp, Methanobrevibacter ruminantium
tttctacctccaaatttatcaggaacttagacgatttaaaaaa

SEQ ID NO: 4598 - DNA, 440 bp, Methanobrevibacter ruminantium
gatagttaattgataacaaaattaaaataaaaaatcaatattaattttttaaatccaatctaaagtccatataattagtcatattttaaatgtagtatataaattagtaggttaatcctaaaaaaggtagtttaagccccatcaatattgtagcgaaattaaaacaatatttacttcatctcgtaaaattgatgtgaaagtgtgaaattgatttgaaaatgtaaaattgatatgaaaatgtaaaattgatgtgaaagtgtgaaattgatgtgaaagtaataaattgttacgaaatcaaaacaattttgacttgaaatcgaaaacatagcagaaccaatataataggaaaataataattaaaaagtaaaaatagaaattaaaaagtaaaaatgaagttaaaaaataaaaatagaagttataaataagtaaaaaattaaaaa

SEQ ID NO: 4599 - DNA, 339 bp, Methanobrevibacter ruminantium
ttaagtcccttttataagtttaagaatactaaattttataaaaaaaagaatttagtacactaaagttctcacagtgtcttttttatccaattaaatttttttttattgaattaaaattattatagttagcaaaattatcttaaaatctttatatataggcttacctaatacattaaaaaaaaaatatcattgtatttatatttatatatttaaatactatttatatttattcatatttatggaattatttcttatgtattgaaatggatttattcgactgaaataactgattttaaaagggtattttatagattatggatttattattgttttatttgc

SEQ ID NO: 4600 - DNA, 8 bp, Methanobrevibacter ruminantium
aataagaa

SEQ ID NO: 4601 - DNA, 64 bp, Methanobrevibacter ruminantium
ttttataatctccaagataaaaataatcgtcaatagaaataattattgttttaataattagata

SEQ ID NO: 4602 - DNA, 221 bp, Methanobrevibacter ruminantium
taattatccccaaaacattaagaacatttttaatatatattaaatttattctcatatataaaatgttcttttttgatttaagtaataatttgctaaaagcataccccaataaacagtttcatcctaaaaatttagtaaattgaatttaaaaaattaaaagtgaataataattaaaaaaagataaagaatagtttgtaattaaaataatagattgtaattaa

SEQ ID NO: 4603 - DNA, 98 bp, Methanobrevibacter ruminantium
tttggataatttaatgaatttattttttgaatagataaacacttgaataatataaagccattgaataatataaatgtatgtggctttttagtctatat

SEQ ID NO: 4604 - DNA, 10 bp, Methanobrevibacter ruminantium
atatattcct

SEQ ID NO: 4605 - DNA, 159 bp, Methanobrevibacter ruminantium
taaaaaggtttatattttttaagcttttttcattaaattttggaaaaaaataagtaaaaactattaaaaaaatagggaaaatttaagaaaaataagtaaaaatccatgctaaataaataaattttgaaaatatatttcaaatttgaaaaaaagaaaaaa

SEQ ID NO: 4606 - DNA, 3 bp, Methanobrevibacter ruminantium
tta

SEQ ID NO: 4607 - DNA, 892 bp, Methanobrevibacter ruminantium
tgattaacacctcacatactcgaaggaaaaatattattaaattgtttgaatcaaatgaatggaattttagaaatgattaaaatcattcaaatgaatcaaatgtcggatttaacaaataagaaatattttattaaatcttcgtggtctaatgaataaataaattatatttattaaaccaaaaaatccgattaaaatgagctatttttcaaatctgaaaagatcaagttaatctgaatcagatatttaataataatcaaaatttttttaatgaaaaagatgatttaaaaacattgtgttggaatctgattaaaccaaatctttcaaatccaaaattatgatttttatccccgaaaattatttttaaaaaataaaatccagttgaaaaaaccaccaaattttaaaaattaaaaatcactttcagggggtttttccttcaaatatatgttgtaagttctcctttatatactaaacggttttatatcgccttaaaattgattttaaaatgtaaaattgtttcgatttcgtaacaatttactattctcaagtcaatttcacattttcatatcaatttcacatcttcacatcaatttaacacttttaaatcaatttagcactttgacatcaatttcacattttcatatcaatttcacatcttcacatcaatttttacttaagtgtgaatggtgatttaaacttggacttcgagtgaaaaaaagtcttgagaatgttggaaaaattaaaaaattttgccttgaaaattggcaatttttggaaaaaatgagcaaaaaatttaggaaaaaatcagtgaaattttaaaaaaattagattaaaaaattgaaaaattaggaaaaaatgagcaaaaaatttaggaaaaattccgtgaaatttcgga

SEQ ID NO: 4608 - DNA, 74 bp, Methanobrevibacter ruminantium
attaagaattaaaaaaatgtataaaaagttgtgtaatttaaaataagaagtaaaaatttaatctaaaaggagga

SEQ ID NO: 4609 - DNA, 345 bp, Methanobrevibacter ruminantium
aatctaacctattaaataataattatataattcttttttagtttctatttaattaaacaaatagttaaaatgtcttttgcagttaaatgaataataaaatatctttattgttaaattaaagatatctttgtctatttaattaaataaatagttaaaatgtcttttgtagttaagtatttaatcttgttagaatttaaaaaatagtattttttagattcattatcgtttaacagcaatataaataattaaaaatcattaataattattttagttgaataaacaacaattaatctaaaaaatattacttatataaactccaataaaaagaaaaagtgatgatgaaga

SEQ ID NO: 4610 - DNA, 126 bp, Methanobrevibacter ruminantium
tacaatgattagtaaaatctgataaattctaaatggaccaataataataacactaccttaaatcgaatatctttttattaaataatttatttgattatgattaagtcaaaaaacctttagctatct

SEQ ID NO: 4611 - DNA, 104 bp, Methanobrevibacter ruminantium
ggtatcttaataatttataaattatttacattgtaaatctgatatttctatctgaaaatatgatgatttttgaaaaatccgctgacagttaataatatttaaag

SEQ ID NO: 4612 - DNA, 268 bp, Methanobrevibacter ruminantium
tcactcaccgttttaattgataaaaaaattttaattgtaattttaattaattataattttaataattcaaataataatttggtcttatatgttaatacataataaactatgtttttaataatatataaagtcaattaatttttataaacattcaatcttaaattgatataaatttttggcaaaaaataaaatctttaatgaaataagccatcataagaacataaatcacattttacaaataaaaataaaatttactaaaaaaagaggc

SEQ ID NO: 4613 - DNA, 246 bp, Methanobrevibacter ruminantium
ggtatcatcaaaataagttaaattaaataaataagaattctatttaaaatttaataatttatattatttaaattttaagagttgattaggactaataaaaaggaaaaataatttaaatggtatgaaaagctatagaaaaaattataaatataaaaaaaagtagtggagaataaataaaaaaaaataaaataaaaattgttggaaaataagtaataaaagattataagaggccattaaaataaacag

SEQ ID NO: 4614 - DNA, 276 bp, Methanobrevibacter ruminantium
cttgaaatttatattgtttagtgcaactgtaccgtctggatatgcataaacaatgtctcttgcctctaaaatagtataacctccaacaatactattatattattaaagatatataaaccttttaaaagtattaataaattggtttgtttagtttataaagtattacttaattgtaaaataattaataaaaaaatagggaaaagataatctttaataggaggataggataaagatggtttgaaattttatttataccaatattaatctagtaaagtt

SEQ ID NO: 4615 - DNA, 154 bp, Methanobrevibacter ruminantium
agaacacttcctttttaaaaaaagtcaataattattataattctctttaaatatagtttaaagtttaaaatatatataatttcattcttaatagaaaaaaagtctaaaaaaataaaagtcatataaagataataaaaaaataaaaaaagaaaaa

SEQ ID NO: 4616 - DNA, 203 bp, Methanobrevibacter ruminantium
taaaaacacctaaaaatataaaaaatcaataattatgaataaatttataaaatactaaaattttgaatttaatcaattaaatagacaagaataattttatttaatcagataaatataaattactatttgaatatttttctagatttacttatttaatcaataaataataatttaatcactttaaatctaaattaatgattaaa

SEQ ID NO: 4617 - DNA, 640 bp, Methanobrevibacter ruminantium
tataaaatagtaaagcaaatatacgcctggatgaatagctgtaagttccatgatagttctccattataatatattaatttatcaataagttacaattctatatttatttgcaagctatataaaactttctttaaaaagaataaaacctgattgataaaaataaaattaaatagattaaaaagagttatattgaaaaataagaataaattggttaaaaaaagagtaataagtaatttattggtttttaaagctttaaaaaaaagcatactttaggaaaatattaattcaatcattatctgacaatctagccaaccagataatgatacaaaaaaatattgggaaatcctaaagtataacttacaattatatttattaaataataaaatttgttttatagaaaataaattataattgatggtaatactttataaaaacatatttataaatattattatttttttacattattagaacaaaaataggccgattttaaaaacggaagtaataaaaaaattattataaattttaaaaaagtttaaaatagtgaaaaataactaaaaatcagtcttataaaaatagaaaaatatctaaaacctattatttacgaattaacaataataaaaaaaaaaatagtaaaaaa

SEQ ID NO: 4618 - DNA, 26 bp, Methanobrevibacter ruminantium
aaaaataaaaaaaagaattttaaaga

SEQ ID NO: 4619 - DNA, 54 bp, Methanobrevibacter ruminantium
aataaagaatttgaattattatttttcttataaaaacaatttcaaggtataaaa

SEQ ID NO: 4620 - DNA, 246 bp, Methanobrevibacter ruminantium
tgagaaataagttctatgagaataaaaaaataaaaaataagtcttatgataataaaaataaaaaaataagccctatgataataaaaataaaaaaaataagccctataagaataatataaaaaataactcctataaaagtaaaaataaaaaaataagcattatctaacaaatagctaaaaaaagaaaaaaatctgtttattcaaattataagaaaaaatttaaaaaaaaagttaaggaatgtttata

SEQ ID NO: 4621 - DNA, 192 bp, Methanobrevibacter ruminantium
taaaatcacgaactagtttataattttataatcgttagaaaaaatattcctattttcattaattattaaattttttaatcattggaaataatatttatatctttatttattattaaacttatcttattttttaaaaaatcacaaactgctaaaatcttgaatactatttttaaaattcaaatggataatgac

SEQ ID NO: 4622 - DNA, 26 bp, Methanobrevibacter ruminantium
aaaatagctttaagcattaaaaagac

SEQ ID NO: 4623 - DNA, 245 bp, Methanobrevibacter ruminantium
gataacattcccacaattggataaatcaattagactgtaaaaataattgttttttaaaaaagtctaaacttaattaactaatattatattggaactcttttataaatctttataaaataatctgtctttttatttcaaaaagcattctaaataactgaataagcttattaaacaggatggtaaaaaacaattatatctaataaaaatcatagtaaatattaagaataattaagaggagagcaaac

SEQ ID NO: 4624 - DNA, 159 bp, Methanobrevibacter ruminantium
aaagatttaaatgaattaaaaagagttaaaaggataattataattccaattgaaaaaaatagaattataaagtgtttaaaaaaatagaatcataaagtgtttagaagcttaaaaacaagagaagcatagttaaatttaaaaaaaagataaaaatgaaaa

SEQ ID NO: 4625 - DNA, 29 bp, Methanobrevibacter ruminantium
tttaaaaataaataaaaagattaattttt

SEQ ID NO: 4626 - DNA, 274 bp, Methanobrevibacter ruminantium
acttatcacctctttaatttctataatcttaattagtcaaactagtatataaatgtaatgtattttttacaaaataaaaagatttataaaggcactcttaaaattgttaaaaattatagttctaagattaggtaaaaaagctttaaaattactggaatcaactaaataaataaatactatttaaatcaaaaagatctatagcgaataaacttataatgattataaggattataacgaattaatcatttaatcaaaaacaagcatagtgaataaa

SEQ ID NO: 4627 - DNA, 102 bp, Methanobrevibacter ruminantium
aataaataactaaccgttttaaaaagaaaaaggatataaaagactacaaaatctagccaatgaaaaataataaaaataaaaattataatttattgaagatta

SEQ ID NO: 4628 - DNA, 144 bp, Methanobrevibacter ruminantium
tttaaccccctttaaaaataatttaaaccttaaataatttaaccttaaaaaaataatttaaaccttaaaaaaaataatagataatagaatttaagaaataccattattcattcaataagctattaaacccaataatttataaac

SEQ ID NO: 4629 - DNA, 194 bp, Methanobrevibacter ruminantium
atagctaaaataaataatctaaacaaaataaaccaataataattaaaaattaaataaataaataatttaaacaaaataaaacttaataaaaattaaaaattaaataaataaataatttaaacaaaataaaacttaataaaaattaaaaatttaagaaatgaataaatttaaataaaaaatagaaagaaacggga

SEQ ID NO: 4630 - DNA, 267 bp, Methanobrevibacter ruminantium
aaccagctctttcaattaataaatttataaaatatcgtttaacaaactaaatacaaaaaataattacctaaattaagtttaaaaatcgcaaaataaaacatatcgaatattagaaacgaatgatagattattttagatttcagtaagataaacttaaaaagataaatatttacaatttttaatctattattatatttaatacaaataattaataaaccttatgaaaatctattatttttataagattttgcattttaaaacgaaaat

SEQ ID NO: 4631 - DNA, 94 bp, Methanobrevibacter ruminantium
aattacctcagcacaattaagaaattagattatagttgaaattaatcattaatagaaattaattaaatcattataaaaattaattttataaaaa

SEQ ID NO: 4632 - DNA, 193 bp, Methanobrevibacter ruminantium
ggaatcaccatcgcatgattcaaatcttttagattcgaattctttaaaatttaaggagtttgtcttagaaagattaattaactaaattgtctttatttaatccaaataagacaataactattttatttcttcaaatatttaaatttaatgctttttttcaagtaaaaattgatttcatttcgtaaaattgatt

SEQ ID NO: 4633 - DNA, 63 bp, Methanobrevibacter ruminantium
atgaaagttgtatgaaaatgtgaaattgacctgaagctggaattttttgttagatgagagaca

SEQ ID NO: 4634 - DNA, 41 bp, Methanobrevibacter ruminantium
aaaaataagaaaaaataattaaaagagattctaaaaaagaa

SEQ ID NO: 4635 - DNA, 98 bp, Methanobrevibacter ruminantium
attacccctctaaataatttttaattaaatataattatagattgaacttaatatcatataaaacaattcctaatgcgaaaaaaagaaaaaaagaaaaa

SEQ ID NO: 4636 - DNA, 111 bp, Methanobrevibacter ruminantium
aaaagtgaaaaaacacaatatcacaaaagataaaaaatgaaaaaacacacttgcacaaaaacacaaaaacacacttgcacaaaaacacaaaaacacaaaaatgcaaaaatg

SEQ ID NO: 4637 - DNA, 18 bp, Methanobrevibacter ruminantium
attagcagctaataaaaa

SEQ ID NO: 4638 - DNA, 275 bp, Methanobrevibacter ruminantium
gtgaatttttataaaaatccaatagtaaatactcaataaaatattagtttaatttattatatataatttgcttatcgatttttaatatatggaaaattagtttttaaatagtggaatattcgtaaaaatcataataaaatttgaaaaaattagtatgaaattaaaaaaaagtaaattgaataaaaatagaaaaaatcagagttaaaaattaaaaaaaagaataaaatgatttaaataagaaaaaataaggtcaaaataaaagaattcaaataaaa

SEQ ID NO: 4639 - DNA, 184 bp, Methanobrevibacter ruminantium
aaaaacacctcatcaataataagtttttctaacttcattaaataaactttaaatatttaatataagtttatttttaatgatatataaaaatattcaatcaatcaaagattataaaacacataaaaatgctccaaacaatccaacattataaaagccattcactatcaaaaaacgcttcaaataa

SEQ ID NO: 4640 - DNA, 53 bp, Methanobrevibacter ruminantium
tccagaatagtccttctctaatgtagaattatccttagaatctgatagatcat

SEQ ID NO: 4641 - DNA, 104 bp, Methanobrevibacter ruminantium
atgaacaccccttgaaaagaaaaaagttaaaaaatatttaattgcttaaatttattattgaagaaattgctacgaaatttaactcatttaattatttaaagcaa

SEQ ID NO: 4642 - DNA, 369 bp, Methanobrevibacter ruminantium
tacatatgcaccccgttttaattataaataatatattaaaatcaagttttaatatatttttaaaaataatttttttaaattattttcaatatagtttatagacatggttttatttaaacttatttaaattaagatgttagttaaaaatagtaatatatggtaaacttgaatatgaatctatttagtgaatgatgaaatatagttttgagtctttaaaccattatttaagtttaaattacttaatgaatgaaaaaatatagttttgagtctttaaaccattatttaagtttaaattacttaattaatgaaaaaatatagttttgagtcttttaaaccattattaagtttagatttaggatattcataaat

SEQ ID NO: 4643 - DNA, 109 bp, Methanobrevibacter ruminantium
agtaaaccacctgaggaccaattaagtaagttctatctacaaataacaattaaaattgcattaaaagaataaagacattcaattaaaattgcattaaaagaataaatac

SEQ ID NO: 4644 - DNA, 123 bp, Methanobrevibacter ruminantium
aatatcacataaaaataaaacttaataaagattataaattaataaaattaataaaaattttaaactaataaactaataaaataaataaaaattaataaatagattaaatattaattcaatcac

SEQ ID NO: 4645 - DNA, 13 bp, Methanobrevibacter ruminantium
ataaacacttcct

SEQ ID NO: 4646 - DNA, 322 bp, Methanobrevibacter ruminantium
tgtccataatatcacaatacctaataaattaaactactaaaaattaactaaattagttagttaaattaactattaaattctaatttttcttatcatataatattataacttaataaatattaaatttaattatttttaacttaattatttttaatttaattattttataaaaccagaacaagcaatttgaaaaaatacttaaaatagcttttataaaaaaataagataaaaaaaagagttaaaaagaatcaaaagaattatctggattttagagaaaattaaaaataaaaaagaagattaaagggtttgaaaaccctaagaa

SEQ ID NO: 4647 - DNA, 14 bp, Methanobrevibacter ruminantium
ttaaaaagaaatta

SEQ ID NO: 4648 - DNA, 4 bp, Methanobrevibacter ruminantium
aata

SEQ ID NO: 4649 - DNA, 38 bp, Methanobrevibacter ruminantium
ttttaagaaatatttttttaattaataatagtttattc

SEQ ID NO: 4650 - DNA, 46 bp, Methanobrevibacter ruminantium
aacaaattaatctgattaaatcattaaaaatattggagagttcaaa

SEQ ID NO: 4651 - DNA, 100 bp, Methanobrevibacter ruminantium
attaagacattaaagataagttgcattagattaaggcaataaaaacaatttatattaaattaagacattaaagataagttttattagattaggtgaaaga

SEQ ID NO: 4652 - DNA, 143 bp, Methanobrevibacter ruminantium
atactcatttaaaacaaatatttctattaaattaatctagagatgtacggataattattcatttaaaactaatatttctaataataattattcataactctattaaaaattaaataataaaaacctcgaagggaggtgaaaga

SEQ ID NO: 4653 - DNA, 186 bp, Methanobrevibacter ruminantium
ttattaaagaataaaatttaaaataactaagaaaaaataagtaaaatttattatttgcttaaaatgagtaaaatttctccaataatcaaaaagagcaaaattcaacaaataattattaaaacaattaatttactgataaatcgcaaaaagagcaaaattcactaaaaacatcataagaggaaaaaa

SEQ ID NO: 4654 - DNA, 63 bp, Methanobrevibacter ruminantium
tataagaaaaaataaatctgggaatatttataattattaatttacttaaattgaggttaaaac

SEQ ID NO: 4655 - DNA, 19 bp, Methanobrevibacter ruminantium
aaaaagttttaggagtata

SEQ ID NO: 4656 - DNA, 44 bp, Methanobrevibacter ruminantium
acaattatcaaatttaaaaaaaaaacaaaaaaaaggttaagact

SEQ ID NO: 4657 - DNA, 106 bp, Methanobrevibacter ruminantium
acagattctattaaaaagaggcttattaaaaaacataacctacattataagcttattgacaaagtaattacactaatcaatataatttaatcaggaagttttaaaa

SEQ ID NO: 4658 - DNA, 79 bp, Methanobrevibacter ruminantium
attcttctttttttataaaaaatagattaaatctttttaaattaaaaaataattaaaaataattaaaatagttaaacca

SEQ ID NO: 4659 - DNA, 324 bp, Methanobrevibacter ruminantium
gcttagcctcctccttttctttttttaatagattaatatgattaaaaagtataataattataattttaatttgttttttataataaaaataaatttctaaattttgatttttaaattttaaatcaaattatgaaaacttgtaacaccactgccaaaaaaaacacaaaaacacaaaaaacttgtaacaccactgccaaaaaaaacacaaaaacacaaaaaacttgtaacaccactgccaaaaaaaacacaaaaacacaaaaaacttgtaacccactgccaaaaaaaacacaaactcaataataaattcaaaatagaagaaaataa

SEQ ID NO: 4660 - DNA, 97 bp, Methanobrevibacter ruminantium
gacaagaccttaaaatcaatatttggataaaataagataatttgaatgaatgtgagttataaaagtatttatagttagtattagaataattaaaaaa

SEQ ID NO: 4661 - DNA, 130 bp, Methanobrevibacter ruminantium
aaaaggaaagtggaacttcctttagaaaaaggaagtgtaaacttctcttttaaaaaaaaagatggtttaaaaaaccgaaataaaaattttggtccagcttttgcggcccgaagggtcggaaaaggtggaa

SEQ ID NO: 4662 - DNA, 67 bp, Methanobrevibacter ruminantium
tgtttcacctttaaattaaaaaataaattttagaattttcaaaaatttcatagactaataaattaga

SEQ ID NO: 4663 - DNA, 21 bp, Methanobrevibacter ruminantium
tttttcaccttctcatatgag

SEQ ID NO: 4664 - DNA, 113 bp, Methanobrevibacter ruminantium
ggcattacctccctaattatttataattatagtttgaatttaataatatataaaatgttttattaaataacaagaaaataaataaaaaaagtattaatggataatccagttaa

SEQ ID NO: 4665 - DNA, 17 bp, Methanobrevibacter ruminantium
cccataagagttaaata

SEQ ID NO: 4666 - DNA, 163 bp, Methanobrevibacter ruminantium
aatatcctctaaaaataagtatttagattaaaataattaatttccactaagactatttaaattaaaaaaataatttcctctaataactatttagattaataattaatttttgcttaaaaaaaagaaaaaatgttttgagattaagattctccaaaaaatcaat

SEQ ID NO: 4667 - DNA, 61 bp, Methanobrevibacter ruminantium
gcttatcacagtttatttttataaataaggtaaatattagtttagttttgtaaaatagatt

SEQ ID NO: 4668 - DNA, 67 bp, Methanobrevibacter ruminantium
aaaaaagattaaaacatggtatgaaaaatagaaattaagaaaaattaaaaaatataaatataaaggc

SEQ ID NO: 4669 - DNA, 133 bp, Methanobrevibacter ruminantium
aatttcaacctgtttttcctttaactctaaatacctaaaactccaaatattttcacaaaactaaaaatcatttctcaaaagactacagatagactcttattcgagaataatttaattaataattaatataatt

SEQ ID NO: 4670 - DNA, 155 bp, Methanobrevibacter ruminantium
agataaatgaaaagataagcaatggaaaattgtcaaatgaccaacaagtgaataaaatagagcaatggaaaattgtcaaatgaccaaaacaagtaaaataaaaaaatataatatttacataaaaaaatgaaataaagtcttaaaagaggtaaatc

SEQ ID NO: 4671 - DNA, 62 bp, Methanobrevibacter ruminantium
aataaaaataaatgagaatcaggttttaaacaaccagatcctaaaaaaatagtttaaagttt

SEQ ID NO: 4672 - DNA, 375 bp, Methanobrevibacter ruminantium
agtctttccacactggttgattaattaaaagcgttaaaaaaatatctaatttacaatcaattgattaaatatagtttttataattagactttgtaatttctaataaaaaatacttataggtttattttaatttttattgcttatttttattaaaaaaattataaggttttcttaaattttaaataaatattattgattaagtctatgtataaaagtatacatttaattaaatataattaaattagattaaattttaacaattattttaaaatatggattaaatgcaatggacaatggaacttattcaaaagagagaatctataagtttgcataaaaaataagcattaaataatataaattataaaactaaataca

SEQ ID NO: 4673 - DNA, 208 bp, Methanobrevibacter ruminantium
tttcttttcatgcttttttttattttttaaacgatttaagctaagcttaaaaaattttgaatttaaaaactatctgaatttaaaaactatttgaatttagaaatttataacaatagttatatttataagtgaaaagagtcaaaatataaataaattatattagtcaataaatacaaaattaattaagagaaaactataggttgataaa

SEQ ID NO: 4674 - DNA, 34 bp, Methanobrevibacter ruminantium
tcctgttattatctttttttaaataaataaataa

SEQ ID NO: 4675 - DNA, 40 bp, Methanobrevibacter ruminantium
gattaaaacttgataaaaagattatataataaatataaat

SEQ ID NO: 4676 - DNA, 90 bp, Methanobrevibacter ruminantium
tatgtgaataaatttattaaaattatttattagaataaatttattaaataatatattttgtaaaataaaataaataaagttttattaaat

SEQ ID NO: 4677 - DNA, 98 bp, Methanobrevibacter ruminantium
ataaatcaccttaaatttttttttaaaaaaaaataattacctaaataccttttaaataaattacctaactaaattgaattttcttcttaaattcacaa

SEQ ID NO: 4678 - DNA, 109 bp, Methanobrevibacter ruminantium
tcaaatcacctttaataaatattgttttttaaattccccaaattaaatttaatctggacaaagcatatatttgcttttaaaattcatcaatcgatttaattcaatctat

SEQ ID NO: 4679 - DNA, 61 bp, Methanobrevibacter ruminantium
tcaaatcaccttttaattgtatatttctttttttaaattgatatttcttcttcaatcacaa

SEQ ID NO: 4680 - DNA, 164 bp, Methanobrevibacter ruminantium
aatatcaccagtatattataatataatttttcaaatatatatttatttatagtcttatttaaattttgtatagtttttattgcttttattaaacaaatgaaaaattattataaaataaaattttcttaataaaaagcaaataaagaataaaaatcgttaaaaac

SEQ ID NO: 4681 - DNA, 198 bp, Methanobrevibacter ruminantium
aagcaaataattactagaatttagtaaactatattaaataagtcttttataaatattattaattctattaggcttaacatattatatatcataaaagaaatgaacaattcattcctatacaacttacagcaaaaaaaagaaatgaacaattcattattatagaaacaaccgccaaataaacctccactaggtgataat

SEQ ID NO: 4682 - DNA, 79 bp, Methanobrevibacter ruminantium
aaagaaaaaaccataaaagaattattaaatcaaactaaaaaaaaaagcataattttaaattataaattgagaggaaata

SEQ ID NO: 4683 - DNA, 101 bp, Methanobrevibacter ruminantium
gataaatccatatattaaataaaactaaatattatattttttaaaatacatttttatattaacttattttttaattatttattatattataatgtgataaa

SEQ ID NO: 4684 - DNA, 160 bp, Methanobrevibacter ruminantium
aaataatactgattaaaaaattagtaaaggcaataaaactagaaaaataagactgattaaaaaattagtaaaggcaataaaactagaaaaataagactgattaaaaaattagtaaaggcaataaaactagaaaaaaataagattaaaaataaagtaaaaa

SEQ ID NO: 4685 - DNA, 137 bp, Methanobrevibacter ruminantium
aatattattccctattgaaaagttctgttaataagcattaaaataatttgaaaagttcattataataagcctttaaaaaaaaaattgaaaagttccctttaaaaagcttaaaaaaagtctttaagaatttgaaagga

SEQ ID NO: 4686 - DNA, 796 bp, Methanobrevibacter ruminantium
ttatatcccttttaaactaattaattaatggtataaaaagagaaaatgactttaaatcggaatataataattgggtgatgatttattattaatatttcaaatttatatcaataataatttaatattagattattcgatagttttttaaaaaaaaccagattagagagtcgataataatttaatattaaattattactttaaataccattatcactgtaaacaatacatatataatattagtttattgcttatacttattaaatgtttataaaaggttatggtgattgttttcaaggccttaaaatatatgttttttagtttgaatattaggggattagttttcaaatgctctcggacaagtcatttatatatggtaagttaaactattaattgcatttcaaaataattgggcttagttttttttagattttggactgattgaaatcaaggactgaactttaattattaaaataaagacactccaacagattgaaatcaaaaggactgaactttaattaataaataaagacaatccaaccgattgaaatcaagaagatatcttttaagaattaaatctaatttttttgaacatatgttgaaaattagtgatttttaatcccttattagaggagtattgatttgatcttttttaaaaaatatcaaggatttgcattatatctcggattgcaaaaaaatcctatcagatgtttttttaatttcatattagtatattttaataaaattaaaataacattcaactaaaacacaagaaaaacaatgatttggagaaagaaat

SEQ ID NO: 4687 - DNA, 21 bp, Methanobrevibacter ruminantium
taataaattaaaaaaatataa

SEQ ID NO: 4688 - DNA, 122 bp, Methanobrevibacter ruminantium
aagattaattatataaatcttttcttttaaagatttagccttttttaaaagattaattatatagattttaccttttaaaagatttaaaagattaattatatagattttacctttttaaagat

SEQ ID NO: 4689 - DNA, 26 bp, Methanobrevibacter ruminantium
atgaaaactccatttaattgtttaga

SEQ ID NO: 4690 - DNA, 106 bp, Methanobrevibacter ruminantium
gaaaataaaaaatatataaaaatagtggtttattgagataattcgcttttattatctcaaaataattttaaatgcaaaacaatagttctgcaagcttataaaaaat

SEQ ID NO: 4691 - DNA, 229 bp, Methanobrevibacter ruminantium
ttctctctcctccttaaattaataataaaaattgtaagtataaaataagtctttttacataggataaactacatataaaaagaatctaaaaataatttaaaaaagatttaaaaatctaatttaatagcttaaaatagattaaagatctaatttaaattgaaatataaaattgaataatctttattgagagcaacaaagaaaattagaaaaataaaaattagaaaaagtt

SEQ ID NO: 4692 - DNA, 11 bp, Methanobrevibacter ruminantium
gattatcacct

SEQ ID NO: 4693 - DNA, 152 bp, Methanobrevibacter ruminantium
gtttgtacttaaaattttaaaataagtataatttaactatattttctattgaaaataattaaaagttattaatatagaaaaaagattatggaatttagaattaatagctaaattagaattcaagtgttttaataaaatcaaaaacaacagaa

SEQ ID NO: 4694 - DNA, 149 bp, Methanobrevibacter ruminantium
attatcacttaaaatataaaatattaaagaatttactcttaattcaaatataaaaataaaatatcaaaaaaataatgaaaattaacgattgaaactgaagattagacctcaagattccaaatggcatctccaaaaaataaaatctaaaa

SEQ ID NO: 4695 - DNA, 107 bp, Methanobrevibacter ruminantium
aagaaaacattcaaaattgataaaataaactcaatcaaacaaattgatttaagataaaagatgaatcaattgagataatgttttataaagattattagtgatttatt

SEQ ID NO: 4696 - DNA, 189 bp, Methanobrevibacter ruminantium
tttatttttcttttttatttgattaacccattattaaacaattattctattttttacttgattaacccattattaaacaattattctattttttacttgattaacccattattatacgtaattattcttttttacttgattcatccaataaataagttcttaaaatactataaaaaaagagagggaata

SEQ ID NO: 4697 - DNA, 157 bp, Methanobrevibacter ruminantium
attaatatctccgttttaaaaaaaatatgtataaaataaatctacaaaaaataatctaaaaataaaaatagtggaaaaaataaatccacaaaataataatctaaaaataaaaatagtggaaaaaataaatccacaaagtaataatcagatttaaaga

SEQ ID NO: 4698 - DNA, 317 bp, Methanobrevibacter ruminantium
tttatcaccaaataggaattgaatagattattgtgaaaattatttattttattaaaatgtttagttatataaacttcttttaataatcacttaaataattttatatcattatgaatactattttaattaataattgggtaaaaattatttttgtttaatgaaatgaaataggcaaatctaaagtgtcccaaattaattaaaattgagcaataaaaaaaagaattgagaaaaataagtaaataaataaaaaaaaggaaaaaaaagaattgcaaaaaataaaaaaataaataaataaaagaaaagaagaaagaatttaa

SEQ ID NO: 4699 - DNA, 223 bp, Methanobrevibacter ruminantium
tctatcacctcatttacttagataaaatttttagagattattgtcattatattaaaaaaaaaacatcacattactttcatttaaagatttatttattaagctatataaattgactaaagtcttcactttatttagattaaatagtcgttattagaaagaatatattaaaattatttttttaaaaacaaacaaaggaaaaggtgatatcttgagaaaccatagc

SEQ ID NO: 4700 - DNA, 429 bp, Methanobrevibacter ruminantium
aaaactttagaactaatagttttttatatttgaaaaaattaatctattttaaagctataaaaactatgatttttaaaataatgaaaaaattataggaatttttaaaaaacttgtaaaaaatataaaattattgaattttttaaaacattacacaaaaatatcaaaatgtgattgatttttggctataaaataattaaaagtttactatatgaaatgtatagtaaaccaaacaactagccatttaatgaagtcaatatttaatttaatcaaaagatatgaaaatattatatatttgttaattataaatgtagatatagcgatagaaatttattaattttgcatgatttttaaaaaaataaacaaattaaaacagaataaaaattaaaagaagaatatagaaatttcttaaaactaaaagggaggtaaaga

SEQ ID NO: 4701 - DNA, 46 bp, Methanobrevibacter ruminantium
ggacaatccaaacctaagggaatggattaaaagcccgattgtctat

SEQ ID NO: 4702 - DNA, 39 bp, Methanobrevibacter ruminantium
aaaaagattatttctaagtcttaataagtaaaaatctaa

SEQ ID NO: 4703 - DNA, 359 bp, Methanobrevibacter ruminantium
ttagattcctcctttcgatttttaaataaattatagttttctaattttaaatgcctagagattattgcttaaatatttcaaaatcgtaaacttttctctagacctattaaaaatttatttttatgcttatttaaattgaataaaggaagtgctttattcaagttataaattcacaaaactaatattataaataatattttgttttaaaaaatatataaattttaaaaaaggggctaaattaagaaaatatagtcaattttaaataatatgaataacttatagaataaaacaaaactaaaaaaagtctaattgagcaatagattagaaaaaagcttaatagtcccaaaggagatgataaa

SEQ ID NO: 4704 - DNA, 145 bp, Methanobrevibacter ruminantium
cccggataagcctgagaatttggcaaaagtaattactgtatagctaaaaatagtaactaattgttgtattagtctaaaagaaataaaaagtgtctaaacatcaaatagttaaaataaaacaagttaaaaaaataaattaaaaaaa

SEQ ID NO: 4705 - DNA, 100 bp, Methanobrevibacter ruminantium
tttttttctctttttttacaagaattaaaaatattcctagtgctaattttataaaatgactcatattactaattttataaataattcatattactaattt

SEQ ID NO: 4706 - DNA, 181 bp, Methanobrevibacter ruminantium
tttatcaaaatacttattataataatttatttcgaatttagaatacctgataatcttttttaaaaaatagttaataaaagagttttcctttaaaatttatttaaaagagtttaatacataattaaaatattaaaagttaattaaaagaattaaaagctaattaaaaaccatattagattat

SEQ ID NO: 4707 - DNA, 42 bp, Methanobrevibacter ruminantium
agtttcacttcatttaaaaatacattaactcttaaagatatt

SEQ ID NO: 4708 - DNA, 42 bp, Methanobrevibacter ruminantium
ctcaatgatttaaaaataaataatttttagattttatctaaa

SEQ ID NO: 4709 - DNA, 179 bp, Methanobrevibacter ruminantium
ctcctcgattgatttttctaaggataaataaaattaattgattaaaataattcgtataaacactagtcaaatgataaaataaaagagttaaaagagttattagatgattataaccaaaatagctaaaatcctatccaataacaaattaaacactctttcaataactaaaatgtcgctat

SEQ ID NO: 4710 - DNA, 673 bp, Methanobrevibacter ruminantium
atttttaaaattgatactttcacctccttttattatcaataaaaatatttaaaaattatttttctttgcaatttaataagcaatattaatggatattaacttagagacaaattttaatcttaaatagatccagattaattttaataatttaacttatcaactatgattaattttaaatcataattccaagtgaaattcgtcaaatagccaaatattcaattaataaaaccaatcaaataattttattaataatccaatcaaataaccaattaaaataactatttttttattttaactaaattagccaatcgaaatattaacaaatatacatatattttaaaacttatataaatcgaataaagcatttgctttggtcaatgattatttttagaaaaatagaatatcttaaatttaaaattaaaaaggaataaggcaaaaataagaaaaattagaataaaataagattatttggaaattatattgcaatgtgtttgaattaatttttatcatgagattagaatacataatgcaaagtgtgtttttcccattataataaaaaataccattacataatgcaaagtgtgtttttcccattataataaaaaatccattataatgcaaaatacattacatttaaataatatgtgttttaacatattaataaggtgaaatt

SEQ ID NO: 4711 - DNA, 212 bp, Methanobrevibacter ruminantium
tccataaattcatttcgacaatgttcagattgccccaaataaaaatagatcccacatattcacttgatacagcattttgagtgattaggaattagagagggttatgctgcctcctgcaataaaagaaataacactacttttcactaaataaaatttaaataaagaaatacagatacttataactaaataaaatttaaataaaagaaatgaca

SEQ ID NO: 4712 - DNA, 193 bp, Methanobrevibacter ruminantium
tttaacaccatagaattaaattatttttataattattaccaaatcattgcctaattaaaaataaaagacctaaaaaaagaaaaaaagttttttgaactaaataagaattataaaaataattttaaaagaagaattaagtaaaaatacttattcttcttaaaaactatttaatatgttttaaatttcctttaaa

SEQ ID NO: 4713 - DNA, 715 bp, Methanobrevibacter ruminantium
aaataacactcctttttgtttataagtgatttaaattaaattaaaataattcaaatgggttcttattaaaagataagaacaaagattatgaaagcccagtaattaaaaataagttaattaatttaaaataatgaaaaaaataaaatacgatttggtttttctaaaaaaagcagttttataattatttttatttaacaaattgattaaaatgttataaaagttgttttaagattatttgatcaaagaattatttaatgcccaggataattcaataaacctagcatcatcctttaaattgatttttttaaactagtagtttctttttttataataatcaaataaacacataaactttgcaatgttaatcatagaaccatttaatttagaatcagctttcataaaattaaaatctgtttctgagtcttcgagtcccatggctaacacccccaaataatctttaattttagtatatatttaataaatatataaaatttatgaaatttgtctaaaaacagaaagatttagacaaataactaattttattcattttaaacttctttaattatagttttgattagattgtatataaatagagtaaaggaattgctttatttaaacttgataaaaatcgaaggataatcaaggaattatttcaatcaacaataaatccgtgaacattttaaaagcaggaatcataatataggattccgatgca

SEQ ID NO: 4714 - DNA, 187 bp, Methanobrevibacter ruminantium
ttttttaacctttaaatttttatctcaagcttttttttctcccatcaaaggaatactaaaatattcaagaattagctctttttctccccatcaaaggaataaataattccacataaagaatcttaaattttttattattaataagtatattttaaaaagtatttaaattgtataaataaattcattt

SEQ ID NO: 4715 - DNA, 123 bp, Methanobrevibacter ruminantium
ataaataaagtaattaaaaataatagttgaataaataaagaaattaaaagcaatatttaaaaaaatgattagaataattttagaggccaaataaaagaaaatttataaaaaaggaggtaaaaa

SEQ ID NO: 4716 - DNA, 177 bp, Methanobrevibacter ruminantium
ctcttaaaataaagcaaaaatagacagaagatagatgctcttttaattagatagagcatatcttccaatacttttttttaattatttttttaaattagatttattaaaaataaatccatataagtcctttttttagaatttataaaatctatagaatttatagaatttttccaaaat

SEQ ID NO: 4717 - DNA, 290 bp, Methanobrevibacter ruminantium
ctaatttaaagaattttgtcaaataagttttataaagggttttaaagagattttaaaaaaactgtttgtttaaaataaacttaaaaaaactgtttgattaaattaaaaattgttaaaaatttttttatatgattaatattatgaaaagaattattattaaatgtttatataatctttcataataatagaaaataagtaaatttataaaaaagagaaaaaacaattttttctggtgaaaattaaaaagggttaaataaaagaaataagaaattaaatagaaaaataagaaa

SEQ ID NO: 4718 - DNA, 173 bp, Methanobrevibacter ruminantium
aaaaatcactcattaattacttaaacttgattcgactatttaaattgccctatgactatttaaattgccctatgactatttaaattgccctatgactatttaaattgctctataaaataatagatataaatctttttaattaaatggatatctacaaccatattagttaataa

SEQ ID NO: 4719 - DNA, 561 bp, Methanobrevibacter ruminantium
cgattaaatataaaatagctttaaataaaaatttattaaagatggtttattaagtttactaatattgtaaaatttatttattatcgtgaaattttaaaaaataataagtctgttaaaatagtaaaaattatgatttttgtgagattttaaaaataaataagtttgctaaaattgtaaaaaaagggtttgaatttaaaaaagatcattaagttgagtaaatttttaaaaaaaataggtgttaaatataaaaaaattaattaatcaaacccattaactaaagaatctaagcaaagaaaatcaaatttaaagcttggaaattcgatattccagagtcacatcaatttcacacgatgacatcaattttacattgtcacaacaattttacgaaatgacatcaattttacgaagtcaaatcaatctttatttcattaaagcaaattgatatgaaagtattaaattgatttgagagtgttaaatcatcaaaataagaaaataaccaacaaatttaaatattaaatgaaataaactaatattacaaagatttttcggaggtgaaaaaat

SEQ ID NO: 4720 - DNA, 4 bp, Methanobrevibacter ruminantium
tttt

SEQ ID NO: 4721 - DNA, 220 bp, Methanobrevibacter ruminantium
gataattgctcctttaaatggtctttttgattaattttgaattagattaaatataataattttttgattaatttattatgattaacattttgtaattatttatttaaaatattttgtataattcactatgtttcatcaagaaaaaatatacaattaaaagaaaaaaaaccttctaaaatatcttcataaataatctccatctagaattgtccttttaaaa

SEQ ID NO: 4722 - DNA, 36 bp, Methanobrevibacter ruminantium
attatcaccttctaaaacttaaaataattctgtttt

SEQ ID NO: 4723 - DNA, 51 bp, Methanobrevibacter ruminantium
aggcctattaaattatttcattgactgtttaagtctattaaattaaatttt

SEQ ID NO: 4724 - DNA, 80 bp, Methanobrevibacter ruminantium
tttaccccctcaaaattatgcctaaaatattaatcttaaaattgaaaattaagacttaaaatatttattaagattaaaaa

SEQ ID NO: 4725 - DNA, 202 bp, Methanobrevibacter ruminantium
atttttcacctcacatagctttatttaataatctgattcattctttatataaatagtataaaggaattgctttattgaagaaattagattttcctaattgatcaactcacaaatgaggaaaataaataataattctagattataaacccacaaaaagcaaaatcaataattatcattatttattaacccacaaaaagcaaaa

SEQ ID NO: 4726 - DNA, 26 bp, Methanobrevibacter ruminantium
tatttgatttttataatatttgcaat

SEQ ID NO: 4727 - DNA, 23 bp, Methanobrevibacter ruminantium
atcaacacaacttaatcttaatt

SEQ ID NO: 4728 - DNA, 200 bp, Methanobrevibacter ruminantium
tttatcctccccataaggtaaaatccattatttcataatttaaccactaaaagaatccattagttattatagccaaaaatccattatttcataatttaaccactaaaagaatccattagttcttattaagccaaaaatccattatttcataatttaaccactaaaagaatccattattttgtcattattagccatagaag

SEQ ID NO: 4729 - DNA, 1648 bp, Methanobrevibacter ruminantium
tggatttaattagagcaaatttttataatttgattattctgctattgattttatttatatttatactagtatataatcttaaaatttattaaaatagccattatagtcttatatacattcattaataattcttatggattcatacacattattctcttaaatagaatatataaatccaataaagggttttatttactcttgataaaaaaagaattagagattttattaaaataattaaaaatagcagttaagaatgaactggaaatctaatccatttaaaaagattagattcctgatcactctcccaatacctatattgcaagataaaatcttacaacacttccgattagatattgaaaatctgaattatacaataagttggaattaaaaaaattcaaaaaatgaatttttaaaactctgttaaaatatatgaaaaaactaatatataaagttttttaatcaattgataggtttataagtcctaaaaataaaaaataaataatatgagatttttaataatgaaaacaagtccaaaaagtataaataataattataaatagttacataagtaaaccaaagaaaaagtttgaagatacaataataatgtaaaaaatattaaaaatagcaaaaaatgatataggaatctaatctatcaaaaaaaacagattagattctaaatcattcctcaatacctatattgcaagataaaatcctacaaaacccagattagatattgaaaaattgaataaaacaataagttggaattaaaaaaattcaaaaaatgaatttttaaaactcaataatgaatatgaattaaatagtatataaatttttttaattggtttataaattgcaggaataaccattacaagccaaatgaaaccaacaatcctgggagattgtgtaaaaaacaaaacaagcaatgattatttattcctacaatttaaaggagggaaattatgtcatcataacagtttaactaaaaccattatgacgataaggttcatacacatcaaataaatgacatataagaccagcaccatccagatcttagatcggatagtcataatgcccctcccttattgttttattcaattgcctagcagaatcttcatcaaatatgactatttgaatcggtttcatgggacaaatgcttttaaacattgtatcacctccaggacttgaggtttacattagatataaaaatatgtaattcttaatatataaactttatttctaatttaaagactatataagtgttattttaaatcaaaattggcttgaagtagttaaattgacttcatctcataaaattgatgtgaaaatgtaaaattgacctcatctcgtaaaattgatatgaagatgtgaaattgacttgaaagtgtaaaattgacttcatctcgtaaaattgatatgaagatgtgaaattgacttgaaagtgaaataagaatgcataattccctaattcttctaaaaagccataattaacccttaaagaatgccctaatttaatgaacaaaactttttttttaatgaaaaatacctgtcatttctgccacatcccataaagttttttctttattccattaatattatataaaccataaatgaaagattggatttataaaatttaaaggatgtgattgga

SEQ ID NO: 4730 - DNA, 203 bp, Methanobrevibacter ruminantium
ttttgattgattaaaaaaagaaaatattgattgattaaaaaattttaaaaaaagaaaatattgattaggcccattaagagacctaaaataagaaattagactattagacccttttataaactaaaataagactattttttaaactagaataagactatctaataaactagaagactattttttaaacaaaaaataacaataag

SEQ ID NO: 4731 - DNA, 256 bp, Methanobrevibacter ruminantium
gctatcagtttaaaaaattctataaatcgctttaaaatttgaataattcaattaaaattaaaaatatttaaatattagaaaatatcttatataaattatttatacaaatatatgtttgaaacatataatattatttttgattaatctcattaaataaactttagattaacaaaatattaaatcttaaaaatgattaattttttaatttgaaaacttaaaattactattttgataataaaaccaatggggtgaaatc

SEQ ID NO: 4732 - DNA, 126 bp, Methanobrevibacter ruminantium
ctattgctattttttaaatttatatttaaatagaaataaattaaatattgaatcaatttatttctaaaaactcttttttcttattttaaatatttaaagaattattttagaatttaaaactttttt

SEQ ID NO: 4733 - DNA, 2749 bp, Methanobrevibacter ruminantium
ttagatttattcttattttcagatttatcttttttagatttattagatttattagatttattcttattctcagatttatcttttttagatttattagatttattagatttattcttattctcagatttatcttttttagatttattagaattatttttatttttcttatctttcttagaatcctcagatttcttggacttcttagaattatctttacctttatccttcttagaatccttagacttcttagatttattctttttagacttcttattcttcttatcagtcttatcttccttatccttatcctctttcttttgagattcgttcttctttaactgatccaacttatgttgtatcttcctatttctattaagaatctcctcattctcctcatcaatcctatcggacaaccttctaagctccctaagattggtcttaaagaatggcttgctgtaatactggcttaaataattcttatcattaatggaatccttaatgattaccccatcatcaattgacaagaatgacatagccaccgcttttccaaaccgagttacatcaatagtatcatctgcatgtatctctatcgcttttttatcccttaattcttcaagggcagtatttatatcaattggaactggaatatccttatagaaattgattacatccctcactttagttaaagaccttgatgagatgtctgcaagtatctgctcaagtgatccgtcttctgtataatcaacaatgatattctccacatcactttctaaaagatctagggctacggactcctcactttcaccgtcgaattcacttccaatctctggaacaagatatatgattcccctgtcatgatagctaggccttcctgctcttcctaacatctgtgaaaactcatttggagaaatccatttgtttcccattaaaagggactcaaatattacttgggatgccgggaaatccactcctgcagctagagctgcagtggtgaccaccgctgcaatctttccctttgaaaagtccttttctatcttttcctttttaaagtaggatagtccggcatgataagcggaggcgtttattcccttaccagataggaaattagctatcttatgggtttttcttcttgaattggtaaatatcaatgtctgtccgctgaatccctttgaggatgttgagtaaaactccctttgaactaattttctcattaacagtcttctttgaacatctccattaacaaaaacgatatgtctctctaaaggaactgggcgctccttatactggaccagtttcatgttaaagtcctgtgccaaagtctttggattttttatagttgcagagaggccaatcacttgggtgtttggaaagagatgctcgattctttttataagtccgttgagtctgagacctctctcctcatcggagattgtatgaatctcgtctattaaaacaaggcctaaatcattcaagaggtctgatttgcctgatctaagtagaaaatcaataccctcatatgttccaaccacaatgtccgcatcggcaatatttgaatctggaagcttaagctctccctttgctttgattctgttcatccccactttgattgcaaccttaaggccaagtggctcatatctcttcttgaagtctctgtacttttgatttgcaagtgcaacaagaggggtcagaaagaggaatttcttaccattcaatgcctttggaacccctgcaagctctccaaccaatgtctttccgcttccggtagctgaaacaaccaagagattctcatccttaaggaggccttccctaattgcaaggtattgaaccggcaggagatattggttatccttgaggagaacatccctaaattcctttggaaccttaagacgcttcattgcgattttaggtatcttatcctcatgaacctttatggtgtcaaataaagtcaagtctgtatgggcgagagggtcaaatcttggtgaaagcatctctaaaacatcatccaagctgccagtcttttcaaggaccttcttgaagtttctaaataccttcttgtcatatcccctaagctgaagctctctcttgattgtctcttcggcacaggatttgcagatgagctgatcatgatagttatatgaaaaatctgagtttataatggtcacatatccttcataactacaatgctgacagatgtttgtaaatctgaccttgacattgttcttttcaaggaatgcctccatttcatcatctttttgtgccaagaaaacagcttgagatcttaataaattgatcgccttagaaggagcaagaggcttttcttccttatcgcttttaattagaaaacgcttgattgataatccgtcctccccttccataaagcggagaatgcctacaaactcagcctgcctttttgtattaagagctcctttaggacttccaataggatatatttcccaagatttctttcttttgtttaaaactatcattagtttataattatatttttaatagtttaaaaagattaagattaaaattgttttaatcctcgaaataaaaatttttagagatttttatatataattcaagtaatttttaaattagaagaaaaaaaagaaaaaatacatttaattatttataataaaatcgatataacaaataatgtattaaaaaaaataacaaaaagaacttaatttcaagaaaaaactaacttaatttcaagaaaaaactaacttaattcaagaggaataaa

SEQ ID NO: 4734 - DNA, 145 bp, Methanobrevibacter ruminantium
tttaatttgagtttaaattaaatcagctctttttttctttttttaagcttaaatagcaatccattaaataaaactccacatcacttatttcactattttaatgattataatagaaaatgctaattgaaaagcttaaattcccaca

SEQ ID NO: 4735 - DNA, 567 bp, Methanobrevibacter ruminantium
tagagaactagatccattggatttggatttttctttgcttttagaggtttttgaactagaattattagaattaaaactagaactagaattagaatggggattattgctttgagaatcatgataattagaattcgcattgttttgaaaatctgtcctaatataatttggatcaggctctatcgcccttagtccacatttaggacagaacttttcactatacctttatctcatttccgcaattatgacagtattttaccataaaaaccccttacatatttaataaattaaatactatttaaagatttgccacttggatttaatatatttatttatttgatttttataaaaccattagtgaaagaatgattagtgatgaaaagaatgaaaatagcttttgtaactagattagaaaaatagataaaataataattgttaaacaacaagataaaggatctaaaaataagaaaaatagataaaataataagtgttaaaaacaagaaaagctataaaaaataagaaaaatagatttaaagaaaaaattatgaatgatttaaaaaaagtaaaaaa

SEQ ID NO: 4736 - DNA, 400 bp, Methanobrevibacter ruminantium
aaaatatctcctaataatttttaaaaaaaataactaaaaattagtttttaactacaatataacccaaatttcaaatttctaaaatgtttatagtcaaatataaatattactaattattagttatttataattttgtaattcattatatataaagatattagtaaaataaactttaataaattctataaaataacttttattaaatattttcaaatttaataatgaaataatgaaaaatagataaaatataagaaaatcaactaataatatagaataaaaatcaaaggataaaataataatttcaataaaaaaaatttaaaaaaaaagtattactcatccatgatttgaaaagagaattaaaaaaataaaaattacctattaacttagaataataaaagca

SEQ ID NO: 4737 - DNA, 163 bp, Methanobrevibacter ruminantium
tctatcatcccaagaacttagtttctaattagagatatggtttcaagacataaatttatatcgattagatgaaaaatccaaaaaagttatgaaatgaattaagaaattatatcaaaaaagaataaaataagcaaataaagtaaaaaaaaaagaaaaaaaagaa

SEQ ID NO: 4738 - DNA, 124 bp, Methanobrevibacter ruminantium
cgtttatatgtttaaaaagtttgaaatatacaagttctagaaacattttgatcaaactttttctaaaagtttgaataaaattttggtcaaggttttgcgggccgaaggcccggaaaagcttgag

SEQ ID NO: 4739 - DNA, 79 bp, Methanobrevibacter ruminantium
tctatcactcccataatttttatctaattaaaattatttttccttaagctatttataatttatagccaaatccattaaa

SEQ ID NO: 4740 - DNA, 587 bp, Methanobrevibacter ruminantium
attatcattttctcatataatcaattaaaaaactataaatttaaattttaatatttttctcataaatcaataaaaacttagaaatttaaattttaaactttgttttaagtaaataaatattttttataatttgttcattttttctaaatttcaataatctagaatatacattttcaatttcaatctaaaagatcatgaaaagcaactatttttcagttttattgagattaaatatttgtgatttataagttaaattttaaggattaatttattttcaatagctgcctttcatgaggattagattttaaaatctaatttctataggcattttcatatttttaattttattcaaaaatttattttatttcaataaataatcaaaaattttatttatttcaataaatgaactaatgaaaagtttgttaaaaaacacctaaatttttttattaatatctttaattttagacattcttttaaaaagacaagccttaaataaagagattgatttttaaaagaactttaattttacctgatattaagtatttgtcttatgtcggaaaacggcttccgacttccgacatatagta

SEQ ID NO: 4741 - DNA, 112 bp, Methanobrevibacter ruminantium
ttgattattgatatgaacaatttaaaaataatcaaataactaatcaaatatcgatatacaacaaatattaactagagtatttttaaataaattaaaatttataggtggaaac

SEQ ID NO: 4742 - DNA, 293 bp, Methanobrevibacter ruminantium
ctatcaaaaaccatttaattaaagaaataattttaattaagaaatacttcttttaatatttccttttttatatttataaacttttcaaacacccattactttttttataatttttaaatcaaaaaagagtaaaaagagtatggaaaatttaatcattttaataataacgaataaattaattcagttaattagaatatggcatgaataatcacttatcaaaccatattcgtttaactaaataactatgatataaatcataataatacttaaaaactttgtataaaggtgaaaca

SEQ ID NO: 4743 - DNA, 46 bp, Methanobrevibacter ruminantium
aagaaatgtttaaaatcattaaatcaatactcatggcggtgaaaat

SEQ ID NO: 4744 - DNA, 133 bp, Methanobrevibacter ruminantium
ttcttctcaatttacttttttttaaattaaaggtgccaaaaacacccaaaatattaaatacaccaaaacaccttaaatatcaaaatcgtaaaaaaatagccaaaaataaaaaaaaaagaaataagacagaaaa

SEQ ID NO: 4745 - DNA, 223 bp, Methanobrevibacter ruminantium
atcaatcaatcccaatcatcttaaatatctaaatcagttaaaataagtttctttttaaaaatatataaacttagtgaaacatagattatattattcaaaagccaatcatttataataaaaatgattaagaactaaagaaatctaaatctaaaaaaagataaggaaataacatagatataaactaaagaaatcctaaatgtaaaaaaaatataaggaaatagac

SEQ ID NO: 4746 - DNA, 390 bp, Methanobrevibacter ruminantium
aagagagcaatatatattctcaacccaataattaaaagagagcaatatatattctcaacccaataattaaaagagggcaaatagattctcagcccaataattaaaagagggcaaatagattctcagcccaataattaaaagagggcaaatagattctcagcccaataattaagatttaaaaaaatagaaatacctttgagattcaaaaatccaaaggctaaagaatctaaaatcccaataattaaaaaactatttaagcaattaaaaaaagaatatttttataacttaattaattatttaatctaaactaaaattaagaatatctttcaattgaaatgaaataaagataataactaaaataaattaatataaaacttgtgcgtgatctta

SEQ ID NO: 4747 - DNA, 151 bp, Methanobrevibacter ruminantium
ttcatttctttttaaaagtcttcatcaattcctttttttaaatttttatcttactcctttttatcatttagatataaaaaattactcttttttatctttgaaatattaaaatatactttttttcttttatttaattaaaatataaatcaac

SEQ ID NO: 4748 - DNA, 126 bp, Methanobrevibacter ruminantium
aatatttattctctttaattatattcatcgtctttttacttaaattgtatgaataatccaagccataaatatgataaaatagcatataatataagacattataaaagttaatgataattagttgat

SEQ ID NO: 4749 - DNA, 10 bp, Methanobrevibacter ruminantium
aaatattcac

SEQ ID NO: 4750 - DNA, 125 bp, Methanobrevibacter ruminantium
atttacacctttttttaaataattttaataaaagaaaactcattaatcatacaaattatagaaaagttattactcgatttttaaaaaaaaatatattctctaatttaaaagcaatgctcacttaa

SEQ ID NO: 4751 - DNA, 801 bp, Methanobrevibacter ruminantium
gattacacctttatgaaattaaaagaataattttcttatataatgatattatgatatgtttacatatttaaatgttttcatatcatgatgttatgatatgttgtttaaatgggttaagatatgaaaagtcatattttggaagaatttaaaaagaagttttaattaatattaaaggactaaattgagtttaaagaataaaaaaagcatttgaagaaaagaagaacccacagccacctaattgaccatatactatggaaagtcgcccctcatcaagacaaggacgtgcaggtttaacttccaaaaaagcttttaccttcccatcttacaattttttatttaactttgtttatatttaaatatttcgattaaaactgtcttattttgcttaattttaaataaaaagacttattggtttactatttattataaatagtttactttactcttttttattttaattttctactgctatttttaagaattttttttaattttttccagatttttgcagtttttggcacattatttccttatcatctagagatatttctgtgcttttttctacaatatattagatataatggctttgttcagtttcacatcaatttttactttagaatgtaaaattgatatgaacgtgtgaaattgacttaaacttgtaaaatttactatatattataaatagtaaacctaatattacccatattaaattttaaggatatataaatcttattatttagaaaaaacttatatacttctttttactaatttaattttgtacaatattttagattcaaataa

SEQ ID NO: 4752 - DNA, 816 bp, Methanobrevibacter ruminantium
ttacctaattgaccataaatcattatggaaagtcgcccctcgtcgagacaagaacatataggctaaacttccaaaaaagcttttaccttctaaatcttacaataattactttgattttgtttatatttaaatctttcgattaaaaatgtcttattttgcttaattttaaataaaaagacttattggtttactatttattataaatagtttactttgcccttctttattttcattttctactgccatttttaagaatttttttatattattaggagtttttgcatttttaggcagttttattgtgttaatttgagctaaaattttaataattatcatattgcaataaaacatgctgattctaagaagattaaaggaatccaaatagtagacctaaatcttgatctgcatttcaatatattgaaaaaaaatgatggatttagaaaaaataatgcattaaaaaaagttttaaaaagattagagaactcctatgccactgcttacgcccctcatcaggacgaggacataggagatgataatttttacctcctaaatctacaataatagtttattttgtttatatttaaatctttcgattaaaactgccttattttacttaattttaaataaaaaagatttttagtttactatttgttataaatagtaaaccgaattattatttagtcaatcaaactaaaataagaaagttttataacaatatctataaattatccaaaagccatgaaaaagagttttattgagaataaggtgactttattaggaagatgacaactataaaaagaaaaagcaatataaaaa

SEQ ID NO: 4753 - DNA, 34 bp, Methanobrevibacter ruminantium
tttaaattaaaaataaataaaaaaagaggagcaa

SEQ ID NO: 4754 - DNA, 233 bp, Methanobrevibacter ruminantium
tttatcacattaaaaaattaaataattaatttactatttacaattaaatttgaaaactttatacactaataataatttattttactttatatttaaatttaacacaaaatcggattaattcaatcatattcaagaataaataaaaatgattgaatgatataaatttaagaaaaaatcaatttaccaatctgattctagaataaataaaaatgattttttagaccaaataagga

SEQ ID NO: 4755 - DNA, 125 bp, Methanobrevibacter ruminantium
ttaatcacctaataaaaagaaattgtaagtaaaataacattgactagtttaataaaaaaaaataaataaataaataaaatactgatatttttcattatttaaagcaaacttaatttaattatagg

SEQ ID NO: 4756 - DNA, 141 bp, Methanobrevibacter ruminantium
tttaacactccgctccttaaaataataatgaataataaattaaattaaattaaatttattaaatatgttaattaagataaatttattaaattaagtaaaattaaattaaatttataaatttgttaaattaagttagattta

SEQ ID NO: 4757 - DNA, 69 bp, Methanobrevibacter ruminantium
aaaaacacccaattaaatcctacaaaactccaaataattaataaacttctttctttaaatttataataa

SEQ ID NO: 4758 - DNA, 493 bp, Methanobrevibacter ruminantium
tatatcttctcaaaaattgaataaaaatcagtaatacaaatttatttttttataatacttattaatcttaacccatttgttttttacctacatataaatacatatctataaaaaataagatattatagtagttatttttacaattaggtatgcctaaattattattgttttatgaattatataaatatttccattaatggattttataaaaaagcaattgtaattgaatgtgaaaatattatgaaaaaatcagcaaaaattaaaaagaccaggcaatgagattaaaaaaaaaaataagcaatgaaattataaaaaaatcgatcttttaaatcaaaataaaaattttaaaaataagccaaaaatggataaaaatctttataaaacagaataaaaaaaatgagtttaaaatacttaaaaataggattgaatagtaaataatagaaaaaatagtataaaaagagtacaaaataattaaaacaaataatggagaaaa

SEQ ID NO: 4759 - DNA, 455 bp, Methanobrevibacter ruminantium
ttttcttactctattgtgtttaattatactagctaagattaaaagtttcaagaattgaacccttactactattttatcactcatagtatataaagtttgcttgaaaaattataaaatttagttgatagcaatattttgcaaagagatagccataaatgggaatatattttttataaaaagatttgaaaatcatcaaatagggaatgaagaattaaaaaatttatcaaatgaataaattaagaaataaagaaatattaaattagccaaaagaggaatgaaaatgatgtaaaagaaaaagcataataaaaggagatgaatgaaaaaattagataaaagaagataaaaagtgttagaaggaataagagaaaaatttaaagaaaaagaaaattaaaacaataaacaattctttacacaaatcacaatttaaacgtgtctgaagcctaaaatagataaaa

SEQ ID NO: 4760 - DNA, 23 bp, Methanobrevibacter ruminantium
ggctcaaaaaaagcttgcttgga

SEQ ID NO: 4761 - DNA, 84 bp, Methanobrevibacter ruminantium
taaataaataattaaaaaaaaatagaataaaaatataataaaaaagaaaaataagaaaaataagaaaaaataaagcagaattaa

SEQ ID NO: 4762 - DNA, 23 bp, Methanobrevibacter ruminantium
ttgaatcctcctaaaaaatataa

SEQ ID NO: 4763 - DNA, 292 bp, Methanobrevibacter ruminantium
attaacaccatatctgttaaaataatatttttatcataatttatttcaaatttttctaaacaatgtttaaaaaaactagaataaatgataattaattaaaattctttaaatattaatttatataagtttctatgtaatttttttaaactgtaaaatcattaagaaaaaagagaggatactagaaaagttgaaataactaaaaaaataaagtttatgatttaaaaggaaagaataaaaaaagaaaaatagcttaaatgaaaaaattctaatcaaactcttttaaaaagtctga

SEQ ID NO: 4764 - DNA, 151 bp, Methanobrevibacter ruminantium
ccaatcacctaattaatcaatgccaagaagaataaaattgaatataaaataaaaataaaatttctttttagaaataaaactgaataaaaaattaaagtaaaatttccatttagaaataaaactgaataaaaaattaaagtaaaatttccat

SEQ ID NO: 4765 - DNA, 57 bp, Methanobrevibacter ruminantium
atgatcacctgaaatcatttgttttagtaaaataatattctaaacagaatatgctat

SEQ ID NO: 4766 - DNA, 146 bp, Methanobrevibacter ruminantium
aataacaccaaaataaatatgatttaattaaattaaaaataattaatatttcaattttaatttaagacagtttaataaaaattaaatttagattatttgaaagattatttcatagtatacgaatgaaaaaattagagataaaaaaa

SEQ ID NO: 4767 - DNA, 77 bp, Methanobrevibacter ruminantium
ggttgaataaattagataatttattcgtttgaacgtcaaaatattcgtttcaactttaaaataaatattaaggctat

SEQ ID NO: 4768 - DNA, 224 bp, Methanobrevibacter ruminantium
attttcaccttatctttttttaaataaatttttaattagttgataaatctgataatgaattgattaattgatttaatattcaaaattatcatattcatgctaataaaacattatactataatatattgattaatttgtatttaaaactattgatttatagaaattgctttgattattgaaattaaaactattgatttatagaaattgctttgattatttgtttc

SEQ ID NO: 4769 - DNA, 206 bp, Methanobrevibacter ruminantium
tgaagagcgatagtctggagctgtttcaaattcaaggagaattgagtcatagactattttagcctgcttttcatccttgaaatcaacttggatgtcactattgatagattctaatattttttcgctaatatttattccccacagatttttattttaatttaactttgaaaaaaagagaatgaatgttatgaatcacttgtaatcag

SEQ ID NO: 4770 - DNA, 36 bp, Methanobrevibacter ruminantium
taaatataaaaaaagcaaattaaaattaatcaataa

SEQ ID NO: 4771 - DNA, 536 bp, Methanobrevibacter ruminantium
ttataatatctccagtaaaattgaattgataaaaacttattaggctttttaactaatctatttaattaattataatccttccagcctaataaaaatattatttaaccgttttaattgataaacaataaatatgaatttgataagttaataagacatacgattgtcttaattcataagattaaataaaaaattgctttaacacacaaggtgtattaagataaaaaattgttaattaaacatagaaaaattcagtataaaattaactaataatattatattagtaaattgaaaagtatataaaagtttaattgggtattttttcaaatatttttcattatgaaaaaaagctgtttaagataatggattttaaaaaatctttgattttttattttagatatgaaaaatatccattttttacaataagtttatatattaataaaatttcttgaattagaaatattaggattttaatttgtaaaaaataaaagaaatttagataaatgaatatctaaatttaatttttaaacggtttattt

SEQ ID NO: 4772 - DNA, 11 bp, Methanobrevibacter ruminantium
attttcacaac

SEQ ID NO: 4773 - DNA, 183 bp, Methanobrevibacter ruminantium
ctcttcaaatcacattataatcattaaatacgaaataataatgaataaaagattaaatccttaaataagaatcaatttaatcattaaatacgaaataataatgaataaaagattaaatccttaaataagaatcaatttaatcattaaatacgaaataataatgaatagttaaaattcaactgc

SEQ ID NO: 4774 - DNA, 201 bp, Methanobrevibacter ruminantium
ataagtatataaaaatattcaactacataaaaaagcaattaataataaattaagctttaaatcaaaattaaagtattcatacaaatataaacttaaaatcaaaattaaagtatttttattgattataataatttacacctatatttaaaatttatacaaatatacactaaaacatctacaatcatttgataaaagcttaaa

SEQ ID NO: 4775 - DNA, 71 bp, Methanobrevibacter ruminantium
gactattcaccaatccaatataatttgatactcttttatacatccatatagttaaaaactaaataaatgct

SEQ ID NO: 4776 - DNA, 76 bp, Methanobrevibacter ruminantium
agataaatgagttctaaaaataaaataaagaacccacaatcaaaaaaataaaatttaaaagaatttaagaaaaatc

SEQ ID NO: 4777 - DNA, 76 bp, Methanobrevibacter ruminantium
ttttatcaattaatatttttgaactgggaaaatgaattttcccattcaattgacaatcgaatgaatcgtcttgcct

SEQ ID NO: 4778 - DNA, 30 bp, Methanobrevibacter ruminantium
ctaatatcacctatctttttaaaataattt

SEQ ID NO: 4779 - DNA, 104 bp, Methanobrevibacter ruminantium
ccaaacattctgttatttggcaaatatgttgtattgatatttctgttcaataatatattattataaagttatttataaagttagtgtttttattctataatgtt

SEQ ID NO: 4780 - DNA, 125 bp, Methanobrevibacter ruminantium
tacttatataaaaaataattgttttgaatgtgtgaaacaaataattaataaataaataataagtaaacaatttaattaaacaaataaaagataattaaaagcatatttatcatctgaggcataat

SEQ ID NO: 4781 - DNA, 53 bp, Methanobrevibacter ruminantium
taaaagcatttaaattagttaaaaaaaagcaaaataagtaaaaattagtttaa

SEQ ID NO: 4782 - DNA, 16 bp, Methanobrevibacter ruminantium
tttttttctttttttt

SEQ ID NO: 4783 - DNA, 17 bp, Methanobrevibacter ruminantium
ttcttcttttttaaaga

SEQ ID NO: 4784 - DNA, 217 bp, Methanobrevibacter ruminantium
aatgattacctttaattagttttaaaaatagaaaaaaaatcagttaataatttttaaaaaatcaaatttgttcatataaatatttattaaaagtattttaaatagtttaaagtttgaaagcatttaaaaatgaaaatgattaaaaagttttcgatgtctaaaatattaattaagaatttataataccatctggaaagacctctttaatctttcttaa

SEQ ID NO: 4785 - DNA, 132 bp, Methanobrevibacter ruminantium
aactaacaatcctaattgaaaattaaaaagaataaaatttgaatataaaaatcataaaataagcattaaaattaattaaaagtagaaaaaatagttgttaaaaaaaataaaaaaataaaaagaaaagaaaaa

SEQ ID NO: 4786 - DNA, 37 bp, Methanobrevibacter ruminantium
ttatataacctcttgttcagcttttcgccacatccaa

SEQ ID NO: 4787 - DNA, 126 bp, Methanobrevibacter ruminantium
gagtttcctaaaataaaataaggatttttatagaatttattaattttatgaaaaaaagtcttgagtacagaaaattttttaaataattttaaaatatacgaacaaatatattttccataaaaaaaa

SEQ ID NO: 4788 - DNA, 7 bp, Methanobrevibacter ruminantium
tagcagg

SEQ ID NO: 4789 - DNA, 276 bp, Methanobrevibacter ruminantium
tttataaaactaacgatttagacatgtagttttaacaaaatcaaatcaatttagccttttgaaatcaattttacgaaatgacatcaatttaacaagttcaaatcaatattgacatgaactaaaatttgtaaaataatgatttaataaatcaaaaaaattagaaaaaataattaaaaaaaatttgcttaaaattaaaaaagaaattaatagaaaaataaaaaaagaactaaaaaaaatttataaaaataattaagatttttattgctaaaataaaaa

SEQ ID NO: 4790 - DNA, 87 bp, Methanobrevibacter ruminantium
aataaaccccaaaaataaaagaaaaataaaaaagaaataaatttatctagataaacatataattaatcaaaacatccatatatgaaa

SEQ ID NO: 4791 - DNA, 50 bp, Methanobrevibacter ruminantium
tttatcaccccttttaagacgatattaaaaaaccctttcatttgttatta

SEQ ID NO: 4792 - DNA, 279 bp, Methanobrevibacter ruminantium
tttttcaccatttttaaattttaaaaattatactaaacggagttaaaaaccccctaaactaggtaaaagaagttaaaaaccccctaaacaatatctaaaagaagttaaaaactattttactcttcgatttaaattgtcctagaaataaaaaatttcatttcttagttctatttaataataaattgatgaagataatatataaatattgctaatatcatgctaatagtgtgcacatagtatgaacatagtaataaatatgctaaaactatactttaaatt

SEQ ID NO: 4793 - DNA, 204 bp, Methanobrevibacter ruminantium
attaaacaatagcctataaaaaatataaataattttatttatttatcaaaagcaaaaagatattttaaaaactataagaattaaaataagagataaaaatatttaaataaaaatagaattataaaataatagttaaattaaaaaaataaaaaaaaataaaagtttatattgatttataaaaaatcaatagtttaactttaaaat

SEQ ID NO: 4794 - DNA, 153 bp, Methanobrevibacter ruminantium
aaataagcctcctaagataaattaagttaattaagttctaaaatttaaaaactttccccagcatagttttaaaagtaaaaaaaatagtccgtctttcaaaaaataaataaaaattttggtcaaggtttttcacccgaaggccaaaaaagcttg

SEQ ID NO: 4795 - DNA, 22 bp, Methanobrevibacter ruminantium
gaaaaacacctatatttatgtt

SEQ ID NO: 4796 - DNA, 4 bp, Methanobrevibacter ruminantium
ttgt

SEQ ID NO: 4797 - DNA, 15 bp, Methanobrevibacter ruminantium
attttccctccataa

SEQ ID NO: 4798 - DNA, 40 bp, Methanobrevibacter ruminantium
taattaatttaattttaaattgattctaaatcaattaaat

SEQ ID NO: 4799 - DNA, 617 bp, Methanobrevibacter ruminantium
atttacaccacattatataaaaaattcgacaaccaaagtttattttatttaaaaggttaaattaaattagcttattttaaaaggttaaataaattagtttattttaagaaataaattaaattaataaagatcaagctcaaataagccaattaaattaatttacttaagaggttaaattaaagtaatttattcaaaaggttaaattaaaataaacaatccaagattaagattatattaaaaaaagattaagaatatttaatacttaataaagataataattcatctttatttttttaaaatattgaataaaaatctgaataatataatcttctcttatataataattattttagatgatatataaatttattgaaatgattctcaattgtatttgaaaagataattttgaaaagatataaaaagaatagggagagtttaaaattaaaataaaagtaataaaagaaggaaattagaataaaaattgataaatgaagattaaactaaaaagaagaattaaatagtacattagataataaataaaagaagagattaaacaaaaaaagaaataaaaattttggtcaaggttttttggccgtaggccaaaaaagcttgcttga

SEQ ID NO: 4800 - DNA, 588 bp, Methanobrevibacter ruminantium
attatatctccatatttaagttgaaactttattgattatatttatgtattaaataagttaaataacttattattttaatctgcaatattagaaatcaatgattgaatgaactgtatattaagaaattcataaacaaaatatctaagaaagtaaaatgaaattagaataaaaagtaggaaaaagaatcagaaaaagaatacctaaaagaattaaaactctaaaaaaaagaatcagaaaaaagaaaaagaatacctaaaagaattaaaactctaaaaaaaaagaatcagaaaaaagaaaaaaatacctaaaagaattaaaactctaaaaaaaagaatcagaaaaaaaagaaaaaaatacctaaaagaattaaaactctaaaaaaaaagaatcagaaaaaaaagaaaaaaatacctaaaagaattaaaactctaaaaaaaaaagaatcagaaaaaaaagaaaaaaatacctaaaagaattaaaactctaaaaaaaaagaatcagaaaaaaaagaaaaaaatacctaaaagaattaaaactagaaaaaaagaaaaaaaggattaaaaattaataaaaagaaaagaataagaa

SEQ ID NO: 4801 - DNA, 114 bp, Methanobrevibacter ruminantium
tacaatcggtactaaaattgttgcaccgaaaatagcgcataaaacgttgaagagataatagaatccactctacaagaggtggcttatcccataaatcataaatcatatcgcttt

SEQ ID NO: 4802 - DNA, 132 bp, Methanobrevibacter ruminantium
attgaaaaaaatgaataaatattcaaatgcataatgaaaaaaatgaaataatgaaaaaaagaacctaatgattaaaacaaaaacaatgaaaaaaattgaagaaatgaaaaaaataataggtgaaaaataaat

SEQ ID NO: 4803 - DNA, 240 bp, Methanobrevibacter ruminantium
tgttaatctccaattataagaataatgattattataatatattttattttaaaaaatatttaaacattatttaagaaataactcaacctaaattaaaagaataactaaaccttaataaaaaaaaaagccttacaatgattgacttaaaaatagaatttctatctattcaaaagcaataaaataaatcaaacttaacccataatagttacttttatattaaataaataaaatagtaatatt

SEQ ID NO: 4804 - DNA, 296 bp, Methanobrevibacter ruminantium
gagaattgaataaaaagggttgaaattataaaaaaagaatcaaaatctcaagattatgaaaaaataaatcataaaacaagataaaaacaataaagaattgagatattgaaaatataaaaaaagaaattaaaaaccataaaaagaattggatattgaaattataaaaaaaagaaataaaaaaccataaaaagaattggatattaaaattataaaaaaaagaaattaaaaacataaaaagaattgaaatcttaagattataaaaaaaaagaaatatctaatcttaagattttaaaaaa

SEQ ID NO: 4805 - DNA, 159 bp, Methanobrevibacter ruminantium
taaacttattctaaactaaacaaagcacgatttaaagatttttatgaaaatcatacaatttaacttataatatttcaaattaaaaattatgaaaatcatagaatatatcgaatttgaatttatgaaattaaaccttaaaatcaaatataaaaattattc

SEQ ID NO: 4806 - DNA, 100 bp, Methanobrevibacter ruminantium
aatattcctcttaactatttttatttataaactcttattagcaattggtttgattaaataagtatgaatttaaattattctgaataaaaagagaataaat

SEQ ID NO: 4807 - DNA, 149 bp, Methanobrevibacter ruminantium
aaattcacctgttattccaattattaaattaatatttgttagtttttatttaaatatataaagaatttagggtgtgaaaaaggtaataaaactatttataataaaagatataaaataagtttttaggagaataataaaggagcaatatt

SEQ ID NO: 4808 - DNA, 227 bp, Methanobrevibacter ruminantium
attatcacctttttgattataaaataactttaaactttaaaaaagcctttatcattcaaatcataccaaccataccaaccatacaaatcaataaagacttaaaacattaatagtaatacttaagttattttagttattactatattaatcttaattaatataaataatttaagattaaaaaaataatgaaaattaaaataaataatttttcttctaaatattaatga

SEQ ID NO: 4809 - DNA, 86 bp, Methanobrevibacter ruminantium
agtcttacatccattaaaagataaaaaaaataatagtaaataaaattaataaataaaaaattaatacaaactaaggaacgccccaa

SEQ ID NO: 4810 - DNA, 252 bp, Methanobrevibacter ruminantium
taaatggataagcttaatcttgcttagaatcctttaagtatatctttaaataagatattatttaataattttgctagttaaaatgtaaaaattaagactgaggataattcaaaaatccatagaaaaataagttaaaaaaaatgagcaaataagtgaaaaataagttaaaaactaaaaaaagtaaatgaataaaaaatgagttaaaaactaaaaaaaatagtaaaataagttaaaaagaatgtatatagctaa

SEQ ID NO: 4811 - DNA, 227 bp, Methanobrevibacter ruminantium
aattttccccctttaaatattgtctaatattattttaaaattagtcatattaaaaggttttttaatttttaataaaatggaattttaaaataaagggatgctttttaaaaaacaattcataatgatattgaagagaatctaaaaaaatagcatttcaagaaaagattcaatcaacaattttataaaaattaaaagacataaataatatttgaaatggagattcgatt

SEQ ID NO: 4812 - DNA, 201 bp, Methanobrevibacter ruminantium
tattgctttaaaaaataggtccgaacaatttactatataaaaccatattaaaattataaaaatttataaaaaactttaaatcatataaaaattaaattaataacgtaactaaatatttgaaagtattacaacaaataagtcaaaaaaatatatctaaaaaaattgtaaaaacaaaataatattaagcaagtagtgataaag

SEQ ID NO: 4813 - DNA, 70 bp, Methanobrevibacter ruminantium
atcatttaactctttttctatttttatttttattaaataattaataatcttactctttttccattcttat

SEQ ID NO: 4814 - DNA, 220 bp, Methanobrevibacter ruminantium
caaatccagtgaaataaaaagaataaaataaatctaactaaaagcagataatacaaataatttaaaaaagaaccctaataagtttaaaaaccttataaagaattaaaaaaagataaaaacagtgattaaaaaaattaaatattgtctttttaaaaaagccataataattgaattttaataaaaatggaatttaaaaagacaattaaaaatcttcaaatat

SEQ ID NO: 4815 - DNA, 115 bp, Methanobrevibacter ruminantium
aaataaaaataaagacacatatgaaaaaatagaatcttaaaacaaaaaaagaaaaaataagtattttcaaaaagaaaggaaaaataaatttaaaataaaaaataaaagagactac

SEQ ID NO: 4816 - DNA, 251 bp, Methanobrevibacter ruminantium
aaaaatcacttaaaattccagttaattgataaataattataatagtttatatgttattaaatatgtttttatgattaataaaagtatttaaaaaccattgaaaaaaaaatttaaaaaatcaacaccgcaaaataataaaacaaatcataaaacaaatcataaaacaaatcataaaacaaatcataaacatcatattaaaaaattatataacaatgcaaataaatattataatataattaaagtataattaa

SEQ ID NO: 4817 - DNA, 19 bp, Methanobrevibacter ruminantium
cttggcaaatggtgttata

SEQ ID NO: 4818 - DNA, 111 bp, Methanobrevibacter ruminantium
cttttctaaactggttaaaaaaaatataataaacactttataaaaataggcatcttcttctttttataaaaaaaattgaaaataaaaaaaagtatctaaaacacagtgcat

SEQ ID NO: 4819 - DNA, 45 bp, Methanobrevibacter ruminantium
aagaaaaaataaggagaaattaaaagatctaaagagattttaaat

SEQ ID NO: 4820 - DNA, 211 bp, Methanobrevibacter ruminantium
ttaaaacacttctccattataagatttaaaaatctgtaaatattatttttttaaaaatctgtaaatattatttttttaaaaatctgtaaatattatttttttaaaaatctgtaaatattatttttttaaatataaggttttagactttagtaaatttacaaattgaataaattacaattgaataaaatcaataattaaacaaattacaagc

SEQ ID NO: 4821 - DNA, 306 bp, Methanobrevibacter ruminantium
tttaattccccattatagagtaaattttaatctaataatcacggtcaaataaatcttattaatacttcattaattagatttaaactatcaaaattttaataacttttaatctagcataaaaacattataattatatatttttataaattaatttaaataatttattataatttttctctattatacaatcagtcaattattttataaactattgtacaaaaacttaaatttcatatagaaaacattataaatttttactattttttcacaaaagaattattttcacaaaagaattaatctcactaa

SEQ ID NO: 4822 - DNA, 92 bp, Methanobrevibacter ruminantium
ttaagtcacttcttaacttgttttcgaagataattaatttttattcattctgagaaagtttaatccattttaagggaaatacataacccaat

SEQ ID NO: 4823 - DNA, 64 bp, Methanobrevibacter ruminantium
aaaattcatctctttttgtctttatcacaaatgtcttaccgcgaatataatttttcatctttat

SEQ ID NO: 4824 - DNA, 3 bp, Methanobrevibacter ruminantium
aat

SEQ ID NO: 4825 - DNA, 140 bp, Methanobrevibacter ruminantium
ttttgaataataattttttaagaataattaataagccatcataggtttattaagctgttaaactaataaaatctttttaataaatcaaataagaataataaataataaataaataaaaataaataaaaaataagttaaat

SEQ ID NO: 4826 - DNA, 69 bp, Methanobrevibacter ruminantium
ctatttcacctcctcaagaggcaaattgaaataaaaagaataatgattttctaaaaaagacttatccat

SEQ ID NO: 4827 - DNA, 132 bp, Methanobrevibacter ruminantium
aatatctgactccttatttacttatctaatactttttcaacagctttgttaaacaattattaaaatgactttatctgatctttcaacaacttcttttagtaacaataaatatgattaattaaaatgctttat

SEQ ID NO: 4828 - DNA, 136 bp, Methanobrevibacter ruminantium
tttaattaccttaattctgttcttttaataatgatttagtaaatataattacttaaataatgattaaaactttatttaagtttttaataatgattttaataaatataaattttctttatttatcctatgaactatt

SEQ ID NO: 4829 - DNA, 89 bp, Methanobrevibacter ruminantium
ttaaatcacttgagcaatttagttagataaacaataaatataaattagatttaaatatttaaagttaaatcttttaatttaaaaacttt

SEQ ID NO: 4830 - DNA, 181 bp, Methanobrevibacter ruminantium
gatttcaccttgattttaattttcttgagttttcttaaattggatagtaattctaataattataaatgtttattttagttaaaatggtttgtataaacaaacaaaagctatgcaaataattataaatgttacaaagaaagctattttttctagattttcagctaaatgggctgatttttcg

SEQ ID NO: 4831 - DNA, 68 bp, Methanobrevibacter ruminantium
tttaaagccttcttttttgagtttttttaaataaataaatattataataattcttttaaaattttaag

SEQ ID NO: 4832 - DNA, 39 bp, Methanobrevibacter ruminantium
aatatctgcaaagagacatatttaaccatttaaatcaaa

SEQ ID NO: 4833 - DNA, 141 bp, Methanobrevibacter ruminantium
tttatcgaccttctattttaataataaattaataaacatgattttatttgaattaaactaataatccgattctatttgaattaaattaataaatatgaactaaatttttaatataaaacttttaaagcatttaatagataa

SEQ ID NO: 4834 - DNA, 101 bp, Methanobrevibacter ruminantium
tatttatctccaataattattttcttccatattctctcataagagacaatattatattctcccataagagactattattatttctctcccataagagacca

SEQ ID NO: 4835 - DNA, 46 bp, Methanobrevibacter ruminantium
ttaaatcctcccttaaaaagtgatttaattcttaaaatcatttaaa

SEQ ID NO: 4836 - DNA, 56 bp, Methanobrevibacter ruminantium
ttagattcctccagtttctttagggctcaaaacaagagccaataatttaatgaaca

SEQ ID NO: 4837 - DNA, 52 bp, Methanobrevibacter ruminantium
tcaaatcacattcttgctttttacttctttaactatgaactgataaatataa

SEQ ID NO: 4838 - DNA, 75 bp, Methanobrevibacter ruminantium
attttaaccttgtattaactttttatataacttttaaactgatttaaactactttaattttatttatttaattat

SEQ ID NO: 4839 - DNA, 61 bp, Methanobrevibacter ruminantium
aataataaatatgttatattatagttataaatgttattacttattgacaagccgaaaatct

SEQ ID NO: 4840 - DNA, 196 bp, Methanobrevibacter ruminantium
gttcataattatttttaagacgattcaaattaatttataattatgttttaaaaatggtttaaattaatttataattatgttttaaagatggtttaaattaatttataattttttataaaatttcataattatcttaagatttagaagaaatcaaaacaactctttatattcaattaactaaaaaaggaccgatata

SEQ ID NO: 4841 - DNA, 102 bp, Methanobrevibacter ruminantium
ataaaagctaaaaatacctacaaaaagaatagaatggaatactaaatgaataatactttttaaaaaaaattttgctattttcaagcaaatcatggtggaata

SEQ ID NO: 4842 - DNA, 107 bp, Methanobrevibacter ruminantium
ttaaataaccccaatagcttaaaaacatgattaaataaaaaaaagccgcagaaataattattatcatactctatttttataattttcaaacatttaagagagattct

SEQ ID NO: 4843 - DNA, 58 bp, Methanobrevibacter ruminantium
aagaaccatcacactgatttacaccattattaatagtaatttgcaccacagatagtca

SEQ ID NO: 4844 - DNA, 141 bp, Methanobrevibacter ruminantium
aaatattaataataaaattgaatattttttccttaaaatattaaaacctccaaaatattgaatattttgaatagaacgatatccttaagaataatttttaaaaaagctaaacaaaataatatattattctaattttcctat

SEQ ID NO: 4845 - DNA, 191 bp, Methanobrevibacter ruminantium
tatgaaaaaaaacttttttaaaattatttaaataataatccaattaaaacaatttagaaaaataattaatcaaatctaattacctccttctagcaagataaaaatagattctgaattattaccccttctagcaagataaaaatagattctgaattattaccccttctagcaagataaaaatagattttgaa

SEQ ID NO: 4846 - DNA, 22 bp, Methanobrevibacter ruminantium
attgatagaactatcatttaac

SEQ ID NO: 4847 - DNA, 206 bp, Methanobrevibacter ruminantium
aatacttttcatatcattcttgtaaaaataagtttaaaataaaaaataatgaaaaaataagaaatttaaataaataaaaagaaaaaataaaaatctaaattaaataaaaactaaaataacacaagtaaatcaaataaaatataaaataaaagaagaataatgaaaataaaattaatctgaataaaaaattgaaccctaagaaaaaa

SEQ ID NO: 4848 - DNA, 129 bp, Methanobrevibacter ruminantium
gttctaacccattataaaatatctttattttcattaggatggtaattaattaaataaaataaaataaaactaaataaaataaaattaaataaaataaaattaaataaaataaaattaaataaaaattaa

SEQ ID NO: 4849 - DNA, 152 bp, Methanobrevibacter ruminantium
aataaaacctgatgtttattgattaaaaaaaggacaataattgttatggtgaattaattgaagtttgattaagttcaaataagttttttaaagaaaaaaatatttgatttatggttatgtataaaaaaataataataaatataaaaaaaaaa

SEQ ID NO: 4850 - DNA, 62 bp, Methanobrevibacter ruminantium
ttattaggataaataaataaagaaaattatttattaaaatcaataagcaaaattaacttaaa

SEQ ID NO: 4851 - DNA, 142 bp, Methanobrevibacter ruminantium
atgaatacctttaatatgaataaattcgctataaactattaaatagttaaataattcgccaatattgccaaatagtaaaataactaactataaactataaaatagtcaaataacaatatttaactaccaaatagccaaatat

SEQ ID NO: 4852 - DNA, 131 bp, Methanobrevibacter ruminantium
aatatcaacccaaaatatttactaaataataaaacataaatttatcagtttaaattttaaaaaacctgctaaaaaaaaaatcatttgaaaaaaataaggcaggattttaaaaaactcttaaaacaataaat

SEQ ID NO: 4853 - DNA, 10 bp, Methanobrevibacter ruminantium
ataatcgctc

SEQ ID NO: 4854 - DNA, 82 bp, Methanobrevibacter ruminantium
aaagataaaataatgagcaaattttaaaatccgaagaagataacaaaaaaattatatatatgaatcatagaaaaataaatgc

SEQ ID NO: 4855 - DNA, 168 bp, Methanobrevibacter ruminantium
tgagataaataaggaaataaaataaataaataaataaattaaatagttaaataaatagataaataaaatatataaataaaaaccaataaagaaaagtctttgactaggtttttatattattttatttaataatatcgactaactaaaataaatttagggctgtttctt

SEQ ID NO: 4856 - DNA, 99 bp, Methanobrevibacter ruminantium
aaattagttgattagtctgtatttttcttaaaaaaagtaaattagtcaaattggctaaaactaatcagatgtcaatttaaaaaaatagtaaaaattaat

SEQ ID NO: 4857 - DNA, 52 bp, Methanobrevibacter ruminantium
ttctttttttcttttaaaaaaaatattatttaagtgtttattttttcttatt

SEQ ID NO: 4858 - DNA, 150 bp, Methanobrevibacter ruminantium
tccaaaacggttgaaatactttacaatagttaaaaatacataatataatagtaaaaatacctaataatagtaaaaatacctaataatagtaaaaatacctaataatagtaaaatagttaaaaagagttattatatataataactattctt

SEQ ID NO: 4859 - DNA, 120 bp, Methanobrevibacter ruminantium
aagtccaagctcttcccaatttctttctattttaggagctttagattttttagatgacttattatctcctttacttttatttcctttttttagatttatttttagccatacttattcccc

SEQ ID NO: 4860 - DNA, 479 bp, Methanobrevibacter ruminantium
ttaattcctcatctttttgttttataagtttattaaaattataattcttattcgttgattgtaaaaatcaatatgaattgttataataaaaatagatttgtaatcatttaaaaatccatattatatttaattatattgattaaagtatataatagttagtttgaaaaaacgaattaaaaataaaattactaaaaataattaattcaaaaaaagattcaaaaaagaattaaagaaatagcaataaaaaaaaaaaaattcctaaaaataattaattcaaaaaaagattcaaaaaagaattaaagaaatagcaataaaaaaaaaaaaaaaaaaattacacgaaaaagactaaaaaagtaaaaaattcacaaaaaatctagttaaataaaaattcataaaaaaaagtctaataaaaaaagaatggcataattgagcaattatgtgaattaatcacaaaattgcttttatttaaattttttaag

SEQ ID NO: 4861 - DNA, 201 bp, Methanobrevibacter ruminantium
aaaaaatttaaatcaacatatataatatttaactttatactataaaactatttgctttctaaaaattatgatttaatacttatagataaaaactatttaaatatcactaatgaagactttgaatcttaagtgacttaagaaaatatataaaaagttacaaataacatatctattaataataagccaatattaagtgaaacc

SEQ ID NO: 4862 - DNA, 89 bp, Methanobrevibacter ruminantium
aaacaagtccgaaaaagcgaagttaaaataaaatctttaaaaatagttaaaataataaaaaaagcaaaattacaaaaagaattaaagaa

SEQ ID NO: 4863 - DNA, 573 bp, Methanobrevibacter ruminantium
ttaaaaaaacaaattaaaacaacagttacatctattgtctaatgaaaatgtacaattgtacatgaaagtatcattatatatagcttatatataatcgaggattatgtctccctcgtttaggacaattaacattcctaaaaatactaaaaaactaaaaaatacagtcataaacatttagcgactccatttttaaagttctataatatgatagaaccaattattaacatgactttttttataaaaaaatcatatcttatctaatattataaatgaactagtatataaatacatactatttaaatcccctaatcgttcgtattttctcgattaaactacgaacaatcttttatttttataaaaaaatcatgacaaatcattataaacaattataaattattacaaatcattatgaatcattacaaatagttataaatcattataaattattacaaactagggcaaattagacaaatagtaatatccatagtcctccaagaaaaataaaaagaaaaattaataaaaataataataaaaataaaaaataaaaataaaaaaagtacttaaataaatgga

SEQ ID NO: 4864 - DNA, 68 bp, Methanobrevibacter ruminantium
aaaaatcactttaatgggaatacataatgacttattttcaattaatcaaaaacagtttttatcttgaa

SEQ ID NO: 4865 - DNA, 436 bp, Methanobrevibacter ruminantium
tgcactgtcctttcctccggatattcctataattgcattgcagcccttgccgttttcttcaaaaaaagcttgaatccatttaatgcattggtttttagcatcctctgcatcaaaattgttattttcagtgatattatctcctcttatacattattaaaatgtgaattttgattaatgcctctagataatattttcaattttttatataataaaggtttttaaaaaatatccgttaaaaaaaagtggttaaaaaaagtggttaaaaaaagtggttaaaaaaagtggttaaaaaaagtggttaaaaaaagtggttaaaaaaagtggttaaaaaaataaaaaaaataaaattataaaaagagaataaagaattctttaaaattaaaataataaaaagaaaattgaataaatctttaaaaatagtgaaaagtgagagaaa

SEQ ID NO: 4866 - DNA, 12 bp, Methanobrevibacter ruminantium
cttaaagcctcc

SEQ ID NO: 4867 - DNA, 130 bp, Methanobrevibacter ruminantium
ttacacactatccataaaattgatttccttatttttataattcatttaaggttttaatgattaattagccttaataaaattgatttcctaatttttataattcatttaaggttttaatgattaattagcc

SEQ ID NO: 4868 - DNA, 146 bp, Methanobrevibacter ruminantium
tttatcactcttttaaaaattaaacgccatactccccttgagcatagcttaaaacaattcataatctattaaaataaatttgagtttattaatctttttaattataactaaaatttgcatcaatatccgattaataaataaaccaa

SEQ ID NO: 4869 - DNA, 162 bp, Methanobrevibacter ruminantium
attttgatatattttaattattttcgtttttcaaatttttttattttttcaaaccgttatatattaggaatattaagaatattaaaaaaaaaattaaaaatattaagaaatattgatattttattaatattaaatattgtaatactataacattaattaaat

SEQ ID NO: 4870 - DNA, 29 bp, Methanobrevibacter ruminantium
actagaaaaaaccatttggagggaaatag

SEQ ID NO: 4871 - DNA, 16 bp, Methanobrevibacter ruminantium
ttcaagctttttgaga

SEQ ID NO: 4872 - DNA, 394 bp, Methanobrevibacter ruminantium
aattttatttttttttaatgttttaactccctaataaaatcttattttgctcaataatttatgaaaactattcttaaattatttaaatcttttttttaaatgtttttatgaaaaactaattttttgactctctttcttaaaatccaactgatatccactttttaaacttatttttctcaaaatccaacagatgaaaacaaatacttttttaatttatttttcttaaagatcccttaattttatccaagtttttaaagagatgcaaaatcaaataaaaaattattattatactaaagtcaaatatttatataactttattaacttaatcaattaacaagtttatataaataattattgattaaactattgattaaactattttttaagggataac

SEQ ID NO: 4873 - DNA, 45 bp, Methanobrevibacter ruminantium
attgcctcctacagaggctttaaggtatgaatagggggaattgat

SEQ ID NO: 4874 - DNA, 37 bp, Methanobrevibacter ruminantium
aaaataagttcaaataaattaaataattaatataaat

SEQ ID NO: 4875 - DNA, 138 bp, Methanobrevibacter ruminantium
ttactctttttttaataaataaaaaaatatcaaggaaatagttcatctactcttttttttaataaataaaaaaatatcaaggaaatagttcatctactcttttttttaataaataaaaaagtaaaaacaagttataaa

SEQ ID NO: 4876 - DNA, 291 bp, Methanobrevibacter ruminantium
aaaaatcagtgcttaaaaaataagtaaaaagaaattaacagagtcaaaaaaataattttaaaaaagcaataattttaaagaaaatttactaataaaaattagcaaactccctttaatagcattaatcatttattctgaaaattttagatttttgtttactatatattatagttctttgtttactatatatttcaaatagtttagttttttgtttactatatattacaaataatttaattttttgtttactattaattataaatagtaaacccaactaaaattcaatataat

SEQ ID NO: 4877 - DNA, 124 bp, Methanobrevibacter ruminantium
tttttaaacctcaaaagtatttttaagtcaattcaaatcttttaatttaaataagaataatttacattttattatttattagtcattcatcatttttttataaatatagcaaaagccaaaactc

SEQ ID NO: 4878 - DNA, 199 bp, Methanobrevibacter ruminantium
gctttaccttcatataaaaattaaataaaaaaattgcttttaaactaaaaaattgtttataagactaaagaataattgccttaaaaactaaataaaaaattgtttttaagattaaataaaaaattgccttaaaaactaaataaaaaaattataggactaaatagaaaatttaaaagaaattgaataaaaattaataaaa

SEQ ID NO: 4879 - DNA, 282 bp, Methanobrevibacter ruminantium
tagtttatatttatattttttatttataatatagtttatgcagatatgttcgcaatatattaaataagtttaattaagagtctatttaattcaaaaaatagcacattaattcataaatagcagatttattcagaaaaatagcacattaattcaaaaaatgcacataattcataaaatgcagatttattcagaaaaatagcagatttattcaaaaaagagacaggataattaaaaatagaataaaaaataaaaaaagaaaaataaattaaaaaaaagtttagc

SEQ ID NO: 4880 - DNA, 296 bp, Methanobrevibacter ruminantium
aaaatcaccgcttaatttagttaagagactatccgtagcattggataaatagatatttatttttttatagataaataaatatcggaataaaggagaaaataaaagaggatatactagagaatatcctatttaagttaaatattagaaaattataaataagaggtgaaaataattttctaaatatttaacttaggtcgagaacaaaatatctaatctttaaaaaatctcattaaattttaaaagaaaaaatatctaatctttcaaaaaactttagatgaacagacagcaaatactgt

SEQ ID NO: 4881 - DNA, 131 bp, Methanobrevibacter ruminantium
ttttttccacctgaaaatttaatttcatttttataaacacatatgcaaaaactttgctaaattacaaacatgctaaaaatctaaaacttagcaattaatattataaacatctgaaaagttttaaaaaaaaa

SEQ ID NO: 4882 - DNA, 30 bp, Methanobrevibacter ruminantium
tttaattaaagttcaacttaatcaacagac

SEQ ID NO: 4883 - DNA, 72 bp, Methanobrevibacter ruminantium
tttatttgtagattaaattcaaattaatgctaaaatagtgacttattaagaaaaataagagtttatgataat

SEQ ID NO: 4884 - DNA, 222 bp, Methanobrevibacter ruminantium
ataaagaactaaatgataaaaatgagaaaaaataagatagtaaactaaaaaacaaaaagttcgaaaataaaaaaaagaaaaaataactgagaaataaaaaatttagataaatagataaaaaaataaaaaagtgaatgaaataaaaaaaaattaagataaaaaaatagctaaaaaaaagtgaatgaaataaaaaaattaagataaaaaagtgaatgaaaaaaa

SEQ ID NO: 4885 - DNA, 4 bp, Methanobrevibacter ruminantium
aaat

SEQ ID NO: 4886 - DNA, 34 bp, Methanobrevibacter ruminantium
taaagaaaatgaaattttagagcaagttggagaa

SEQ ID NO: 4887 - DNA, 13 bp, Methanobrevibacter ruminantium
ataactcctcctt

SEQ ID NO: 4888 - DNA, 258 bp, Methanobrevibacter ruminantium
tttattttgcaactttaaaaagaaataagctattaaaaactaatatttctttattttacatattttagaaaaaattctataaatacatactacaatttaattaaactttgtcttttaaatagtttactaaattttagtccaaaattaaaatttaaattagacaatttattaaataacacagttaattaaaaatttataaaatttttaaaataaattcgtagacaatagaataatttatcaattgttatatatataatt

SEQ ID NO: 4889 - DNA, 25 bp, Methanobrevibacter ruminantium
taaaaaataagaataataaaaggat

SEQ ID NO: 4890 - DNA, 47 bp, Methanobrevibacter ruminantium
agtatcacgtgtgtttgtgtttaaaaatagaatactataatttaata

SEQ ID NO: 4891 - DNA, 5 bp, Methanobrevibacter ruminantium
aaaaa

SEQ ID NO: 4892 - DNA, 60 bp, Methanobrevibacter ruminantium
taaaaccaaaaatattaaaccaattatcttattaaatttaatcttcaaaattctaacctc

SEQ ID NO: 4893 - DNA, 8 bp, Methanobrevibacter ruminantium
aacattcc

SEQ ID NO: 4894 - DNA, 237 bp, Methanobrevibacter ruminantium
aaataaaaattagttaaaaaataaaaaaaaataacttaaataactcaataaataaaaataaataaaaattagttaaaaaataaaaaaaaaataacttaaataactcaataaataaaaataaataaaaattagttaaaaaataaaaaaaaaataacttaaataactcaataaataaaaataaataaaaattagtttataaaaataaaataaagaataaagtcttttaaatgaatccaa

SEQ ID NO: 4895 - DNA, 8 bp, Methanobrevibacter ruminantium
tacatgaa

SEQ ID NO: 4896 - DNA, 194 bp, Methanobrevibacter ruminantium
tgtgtcacctattaaaaatttttgaaaaatttttgaatcaattattatttataataatattgtttgttattattaatataatttgattttttagatgaaaattgatattaaaattatttctataaacatgagaaaaattaaaaaaaagataagaaaaagataagaaaaagataataaaaagatttagaggaaaa

SEQ ID NO: 4897 - DNA, 339 bp, Methanobrevibacter ruminantium
tttttctttatttatactcaattaaaaacccccaaatagtaaatatttaagtaaaattgttcaatagtttaatttaattaatttaaagaaatttaaagaaattaaaatcaaactaatatttttaataaacttactacaataagcacttcgtcatatataaaacttatcaaaatatttatcaatttaaaacaagataaattaagatttaaaaaaacttatcaaaattgttgtcaatcatgataacaatttatatataattatcaacttaatatagtatattatatctacaaattagtttattttacttaaattttataatactttttattaggtaagaac

SEQ ID NO: 4898 - DNA, 181 bp, Methanobrevibacter ruminantium
attaaaaataaagaatttttaatatttagttaaagaaaagaatcataattacttaattagaagaaaaataattattaatacttgattaaaaaaaatcataattacttaattagaagaaaaataattatcattaaaccaaaaaagaaataaaatttatcaataataaaaaaggagggataat

SEQ ID NO: 4899 - DNA, 38 bp, Methanobrevibacter ruminantium
actattttttaaaataagaaattaaggaagaataaaaa

SEQ ID NO: 4900 - DNA, 5 bp, Methanobrevibacter ruminantium
aataa

SEQ ID NO: 4901 - DNA, 60 bp, Methanobrevibacter ruminantium
tttatcacttaaaaatagttaaaatacaataattgaaataatcttaaaaaaaaagaaaaa

SEQ ID NO: 4902 - DNA, 126 bp, Methanobrevibacter ruminantium
aattaatctccatagttaaattcagttaaatataagtctgatttttaaaaataaattattataatgaattaaataataaattaaaaaacattttaaattttattcattgaaagttatttaaaatta

SEQ ID NO: 4903 - DNA, 116 bp, Methanobrevibacter ruminantium
aatcacacgacaaacaacttataaatcaaatgaatgaattaattgattaaataaagcaaaataaaaataattttaaataatcaaataaaataaatgaatgaatgaattaaaattga

SEQ ID NO: 4904 - DNA, 30 bp, Methanobrevibacter ruminantium
ttatacacctcaatagacttaaattgaatt

SEQ ID NO: 4905 - DNA, 94 bp, Methanobrevibacter ruminantium
ataagataaaaatagatggtctaaataatacagtaatacataatatgtttattatcttatttaaactttactaaaaacaaaaaaataaaaaata

SEQ ID NO: 4906 - DNA, 203 bp, Methanobrevibacter ruminantium
aattaagagtatagaaattattttataaaaagatttttaaaaatatatctgaatattgaaataaaataaatagattaaaaagagaatatctgctctaaatcttaaaaagaatagtaaaaagagaattctactctaaatcctaaaaagaatactaaaaggagaattctgccataaatcttaaaaaaatagttaaaagtgacaat

SEQ ID NO: 4907 - DNA, 54 bp, Methanobrevibacter ruminantium
aataaacgtttaaatcaaatcattttagaaaaaacgccatagaagttgttaaat

SEQ ID NO: 4908 - DNA, 139 bp, Methanobrevibacter ruminantium
aaaaataaacttctcaaaaaaatcaaaaagaagaaaaaataaaatttaaatttgaaaatgaaaataaaaaaagtttattataaaaaaataaaatataataaaagagtttataaagtttaattaagaattagaacctatc

SEQ ID NO: 4909 - DNA, 373 bp, Methanobrevibacter ruminantium
aaagtaataccttccataaatattcttaagtattaaataatttatttttcacgatatataaaattattttatcgaacgatatagaaaaagaaacaatgaaattatctaaaagagaaaaaattgttaaaatgaatcaaagttaataaaaaagaataaaaaagaacaaaaatgagtaaaaaaagataaaaggaataaaaataattaaaagaaagataaaaagaattaaaataattaaaagaaagataaaaagaattaaaataattaaaagaaagataaaaagaattaaaataattaaaagaaagataaaaagaattaaaataattaaaagaaagataaaaggaatataaataattaaaaaaccttagagagaaag

SEQ ID NO: 4910 - DNA, 161 bp, Methanobrevibacter ruminantium
tattacaccaaaatgattaattaaaataatagtttttagttaaacttatataattatgagtcgtatttttaatttaaataaagaaaatttcattgctgaatttaccatattaaactatatataaaatgtccaaatatatgaaacaaaattataaaaatatt

SEQ ID NO: 4911 - DNA, 245 bp, Methanobrevibacter ruminantium
aagaacatctcgaaaattactaaaaatattaaaaaacttaaaaatgacttaaatactaaaatactaaaaaacttaaaaatgacttaaatactaaaatactaaaaaactttaaaatgatttaaacaatgaaatactaaaaaaacttaaaaatgatttaaaaaaactaaaaaaaaactaataaaactaaaaaaataaaaaaagtggaagaaatctcatcttccttaaaaattacatatgaagatgaa

SEQ ID NO: 4912 - DNA, 28 bp, Methanobrevibacter ruminantium
tatataatctccattaccctattaagac

SEQ ID NO: 4913 - DNA, 105 bp, Methanobrevibacter ruminantium
ttaaacactctccaaagcaataataagatatagaaattaagtagcaaagtacttaataaaaattaaaaaattagagaaaaataatttaataaaaaaggaatttaa

SEQ ID NO: 4914 - DNA, 491 bp, Methanobrevibacter ruminantium
aataccactaagttagttgattgataaaatattatttttactatatctttatttataaataactatatttaatcttttagattaaaaatggataaattttatatttttatagaatgaatgattgttttatataaaaattaattaaaaatcaattaaaaagcagttaagaaaaagaaaattatcaaatataaaaaatatataaagataaattaaaatacaaaaaacacaacaaaaaaaagaatataaacaaaaaatacaaaaaaacagcacaaaaagaatataaacaaaaaatacaaaaaaacagcaaaaaaagaatataaacaaaaaatacaaaaaaacagtaaaaaacacaacaaaaaaagaatataaacaaaaaatcaaaaaaaagattaaaattaaaaaaaattaattaaaagagtcgggaatagacccaactgagataaaaattttggtcaagcttttgcttacccgaaggccagtaaaaggttgaa

SEQ ID NO: 4915 - DNA, 20 bp, Methanobrevibacter ruminantium
aataatacatcccctattat

SEQ ID NO: 4916 - DNA, 28 bp, Methanobrevibacter ruminantium
tcgaataactccatgtttttaagaaata

SEQ ID NO: 4917 - DNA, 77 bp, Methanobrevibacter ruminantium
aaaaaagtaatagaaatgataaaaagttaaaaagaatgaataaaaaaagatcatcacaagcaaagccgtgaaaaaaa

SEQ ID NO: 4918 - DNA, 214 bp, Methanobrevibacter ruminantium
aatttcacctcttttttgagtattatataatttctataatcttgataaattgtattaatagtaattatatatcacaaagtatataaaaattatctataaatagttcgtttatagtaaaacatgagggaaatctaaaaagactttaactcgtaatccaatcaaattcttttaagacaatatttggaatattcaaaaaagaatattctctttaaaa

SEQ ID NO: 4919 - DNA, 71 bp, Methanobrevibacter ruminantium
attatcaccaaattttattttaaattttcaataataattattctaacttttataaaagttctaaattaatc

SEQ ID NO: 4920 - DNA, 153 bp, Methanobrevibacter ruminantium
cttttcaccgaaaatttaagcttagaaaataatgaacttgaatagtttactttccaataaataaatgccttgatttttaaataaatgtcaaaaaatcattatctaaccagataccttgatttttaaattaaatgtctaaaaatcattatctaa

SEQ ID NO: 4921 - DNA, 106 bp, Methanobrevibacter ruminantium
aatatcaactctaaatgcatattttaattaataaatctaaatttaaaattttttcaaaaattgaagttttatatacgttttaaattaaataagtcttaagaacttt

SEQ ID NO: 4922 - DNA, 139 bp, Methanobrevibacter ruminantium
aagagtaaaaaaagtaaaaatctaaagaaataagtaaaaaatgttaataaaagagtaaaaaaagtaaaaatctaaagaaataagtaaaaaatgttaataaaagagtaaaaaaagtaaaaatctaaagaaaagaataaat

SEQ ID NO: 4923 - DNA, 23 bp, Methanobrevibacter ruminantium
attaatatcctcctaaaaatcat

SEQ ID NO: 4924 - DNA, 144 bp, Methanobrevibacter ruminantium
tataaaacctctttttggttttggtaaatttatatattcataattgtgaacttaaaaagctttaaaaattcatactaataaaatttgagctttaaaagttctaagacaaaagcttaactctcggattgacaaaaagtttttaaa

SEQ ID NO: 4925 - DNA, 446 bp, Methanobrevibacter ruminantium
gttctaacctcaatcaataaatcaaaataataatattttttattagtcttaataaaacaaaataagagattttaataatcttaatggtttattaagtaaaattattattatactttaatatatatttattttaaaatatataaagtttaggattaaggcagttttaaaaagagaataaaataagcaatgtgggaaaatgaatttttcaaataaatgcaaattatccaaaagcaaatgaaaaaataggctaaaaaaaatagaaaaaataaagaaaaaataggactaaaaaaataaaaaaaataaagaaaaaataggactaaaaaaataaaaaaaataaaagaaaaaataggctaaaaaaataaaaaaaataaagaaaaaataggctaaaaaaataaaaaaaataaagaaaaaataggctataaaaaataaagaaaaaaataaaaaaa

SEQ ID NO: 4926 - DNA, 13 bp, Methanobrevibacter ruminantium
tttaaaaatagat

SEQ ID NO: 4927 - DNA, 422 bp, Methanobrevibacter ruminantium
ttttataatcctcctatatttttataaaaatatcttttaaagaatcagttaaataaattttttcattattaaaaacctaaaaattatcctaacttaataataaatagattttttcattattaaaaacctaataattaatctcaataaaaaagatacctaaatataattttatatcttttatagatataaattttatgtttaaattattaaataagataaaatagtatattttataaaaaagaattgaatccaacaaattaaagataatgaaaaatagataaaaatagataaaaaattaaaagaagttaataaatcaaaaaaaaataattaaaatagttaaaaattaaaaaaagaaaaaaagatagttaaaatagttaaaaacgaataaactaagtaaaaagtaaaaaaagcaagaaaaacaa

SEQ ID NO: 4928 - DNA, 269 bp, Methanobrevibacter ruminantium
gtaatacaaaataatccctcatatatcgatatttttaaattgaataaatataattaagtttttgaatgttttaattgaataaataaatataaatctttgaatgtttttattgaataaataaatattaaattttggatatttaattaaagtaataattaattaaattataatgatactattatttaaagttaatgaaaaacttaaaatttttaatgtaaaacttaaataaatgaactcgaataaattaaatccaaataatttaagcaaat

SEQ ID NO: 4929 - DNA, 88 bp, Methanobrevibacter ruminantium
aataacatcctgcttatagatatctaatgaattgaacgattgtctgatttcaatagcattaatactgttaatttagcatatagaaaat

SEQ ID NO: 4930 - DNA, 230 bp, Methanobrevibacter ruminantium
agattacacctttatcttttttaaacgaataaaataataatgaataatattgaattataaatctataaaacgatttttaatattttaacttataattccatgataatttctaatatatattaattgtaattccaatggatttttacaattttaatttcatataaatacatgtttctcataattctaaatgattatgcttacttttgactaaaaagatatttttagttgtt

SEQ ID NO: 4931 - DNA, 190 bp, Methanobrevibacter ruminantium
ttaagtaaatcaatcaaaatattgattttaaataaataattttagctaattagtttaaagaacaaataactaatcgaatcaataaataattttaaataaaatttaaaaaaatgaaaaataataaagaatgaaaaataataatgaaaattaatttcattaattagtatttttcatattcaaagctacctga

SEQ ID NO: 4932 - DNA, 188 bp, Methanobrevibacter ruminantium
taaaattcctcctttcaatttttaggaatttaatcttccataaatctctagatttattctattaaatatgataaattcttgaataaataattattaactattactacagtcttaagaaccataactcatctaaagaaccataactcgtcttaaggaccataactatcgatttaaggtccgatttcgat

SEQ ID NO: 4933 - DNA, 186 bp, Methanobrevibacter ruminantium
gtttactccttactaaaattgatttaaaaacaataatttaaatttgaatgaatttgaatgtctctcaagacagtcattatagtataattaatttattcataaatccaagcccaaaagacatgaaatgaatataatttatttattcataaatccaagcccaaaagacatgaaatgaatataatttat

SEQ ID NO: 4934 - DNA, 40 bp, Methanobrevibacter ruminantium
gttaaaacaccttcttaataagcattaataacttacgtta

SEQ ID NO: 4935 - DNA, 38 bp, Methanobrevibacter ruminantium
attatcacctattagttaaagataataaatcgaaggac

SEQ ID NO: 4936 - DNA, 18 bp, Methanobrevibacter ruminantium
cggcaaatattataactg

SEQ ID NO: 4937 - DNA, 187 bp, Methanobrevibacter ruminantium
acttatttaagatattggatttttaaaaaattataagaaattaattataatcatttaaatcaaataaataagaatctcataaaaaattgcaataaaatattcaattataatcacagatttaaagttttaatctataactctaaatattatatccatatcactaaataataaagcctaaagcaaattt

SEQ ID NO: 4938 - DNA, 108 bp, Methanobrevibacter ruminantium
aaagtattgctctaaagagcaatgttttattctctatattccgaataagataagataaaagtaaaaacttaaatcagatctttacaaaaaaaaacttaagtagaaaat

SEQ ID NO: 4939 - DNA, 102 bp, Methanobrevibacter ruminantium
atttaacacctcaaatttttataataataattgtatattttttaatatataaatatatcggttaaaatgcttaaaatttgatattatatacactatacttat

SEQ ID NO: 4940 - DNA, 40 bp, Methanobrevibacter ruminantium
aacagagctttagaacccatagaaaagagtttaacgaata

SEQ ID NO: 4941 - DNA, 51 bp, Methanobrevibacter ruminantium
atataaaaaaatgtaaaaaaagaataaaatttaacagataaagaaaaaaaa

SEQ ID NO: 4942 - DNA, 55 bp, Methanobrevibacter ruminantium
tagagataaaaattttggtccagcttttgcgacccgaagggtcggaaaaggtggg

SEQ ID NO: 4943 - DNA, 304 bp, Methanobrevibacter ruminantium
gttatcacataaattaattctttaatctaatcttttaaattaatataaaattatagtaagttgaaattataatattaatatacattatatagatatatttattatagtataaaaacttatattaaatttttacaaaatttcccacatttgtaaatttaattgaaaaaaatatattaaatttttacaaaatttcccacatttgtaaatttaattgaaaaaaatatattaaatttttacaaaatttcccacatttgtaaatttaattgaaaaaaaaagtagaaaaggataaaattataaaagaata

SEQ ID NO: 4944 - DNA, 136 bp, Methanobrevibacter ruminantium
ctaatccaacccatataactaaaatatcaatattaaaaatatcttaaattaaaaaaaaatcaacaaatgttctaaattcgaaataagaattaggattgataaaaatcaatccaataaaattccattaattaagcca

SEQ ID NO: 4945 - DNA, 236 bp, Methanobrevibacter ruminantium
aaaatcaccttaaaatatatccttttctttaaattaaataattgataaatattattatatgtttattgtgttatgtgttaaattatttgttgtgtatttaattaaattcatatgaaattaattactattttttactgcattagagtttatgctcttaaaaatatataactttatattaaaaaaacattgcctttagaatttttcattatttgcatcttctaaagaatgaaagttat

SEQ ID NO: 4946 - DNA, 90 bp, Methanobrevibacter ruminantium
ttaaacacctaataaaatctataataataaaagtttaatttgataaataatttaaaaataattattttagtttaatttgaaaatgagtta

SEQ ID NO: 4947 - DNA, 8 bp, Methanobrevibacter ruminantium
cagtggaa

SEQ ID NO: 4948 - DNA, 246 bp, Methanobrevibacter ruminantium
gaagacacctattaaaactataaaattaaacaaaatatgttttttataatccaaattaaaccaatgaatcttacaaatttaatataaaaaatatatttgcaatgtttaaagtatatcttatattatatttaattaagtaactatataaagttttggatagcctaaacttttaaaggataaataaaatcttaaattggattaaattcgataaaaaaagataaagaccccaatttaaattaaaaaaca

SEQ ID NO: 4949 - DNA, 11 bp, Methanobrevibacter ruminantium
attatttgagc

SEQ ID NO: 4950 - DNA, 351 bp, Methanobrevibacter ruminantium
taaataaaatttaaaattttaactaaatcattgttattaataaaatatttaataattaatactataaaaaattatccaaatagagaaaacaatattataaattaaaaaaaaataataaaatctaaaatcaaacaataaaagattcaaaaactgaataaaaataaaacctaaaatagaacaaaaaaaagattcaaaaactgaataaaaataaaacctaaaatagaacaaaaaaaaagattcaaaaactgaataaaaataaagcctaaaatagaacaaaaaaaaagattcaaaaactgaataaaaataaagcctaaaaatcgaataataaaagatttaaaaaaataaaaaaaa

SEQ ID NO: 4951 - DNA, 12 bp, Methanobrevibacter ruminantium
taattttaagca

SEQ ID NO: 4952 - DNA, 69 bp, Methanobrevibacter ruminantium
tgtaagattcttaattgaaattttttcacctcactttttttcaaaataattgaaaaaattaaagaaaat

SEQ ID NO: 4953 - DNA, 386 bp, Methanobrevibacter ruminantium
attttcaagttatataaatattactgtaaaaaattatttcaaataaggccaatccatactctaaaaattaatttactcaatctaaatagttaatttaagataaaaaaaataaaaattaattacttactgtaaaaagataaaaatatttagaaaaaagaagaactaagacattataattgtaaaaatataaaaagggctttgaatcctttaattaaagaataaatacttataattacttattttaatgaaatttaagaaaatattactttgataaatagaaaataaaataattatcattatttaagttaaaaaagaataactaactattattgatatttgatattaaagtgaaatcaattactatttttagaatacatatattaaat

SEQ ID NO: 4954 - DNA, 155 bp, Methanobrevibacter ruminantium
taaaaaaataaaaaatagttaataatttaaatttttaccaacccaaaaaaaacactattttttaaagtttgaaaaaatagataaaaaaaaataagaagaattagataaaaataaaaaaaaatagctaaaaaaaagaatactaaaaaaaataaaaa

SEQ ID NO: 4955 - DNA, 343 bp, Methanobrevibacter ruminantium
taaaaatatttaataaaattttcatcaccattttgtcaaaggaaacatcattattccttttaaaaaaatgaatctttttcaatttatccattaaatccctaattgaataaaattgtttcaatggataaaaatagtcaaatctattagaatttgtccttcaaatgaacaaatttatttctaaagatatatctatatagcagattataaaaaggttttgaaaaaattaaataaaatttgtttaattttatatacatctttctataaaacattgatttaaatgaaaattcttaaaaaaagtaaaacttctaaaaaaaaaataaattgttaaaaaaagtaaaaaaaa

SEQ ID NO: 4956 - DNA, 48 bp, Methanobrevibacter ruminantium
ttataaacttaaaaaaagacccagattaaagcatagccaaaataaaaa

SEQ ID NO: 4957 - DNA, 19 bp, Methanobrevibacter ruminantium
attatctcctaaacacttt

SEQ ID NO: 4958 - DNA, 194 bp, Methanobrevibacter ruminantium
aaagcaataggaaaaaaaacaaaagcataaaaaaacattaaaaaaaaaagttttaaaaaaagcattgcaataaacattaaaaaaagtattaaaaagttttaaatatcaaagctaaataaaaaattcaaaaagagccatttaaacaaaaataaaaacctgaaatcagattaaagaatagattaaagcgttttaga

SEQ ID NO: 4959 - DNA, 241 bp, Methanobrevibacter ruminantium
tttttcacctcgaatagttttatgtatttaattatgtttttgtagtataaatagtttagttatacctaaatattaatgtattaataaaaaataaaaggtgaaataacaatgaaaaaaagttaaaaccataaaaaaataattaaaattaaaatcgttgaaagagtaaaaccataaaaaaataataaaaattaaaaaaataagtaaaaaagcttaaaaaaagaaaaaaagaatatagaacaat

SEQ ID NO: 4960 - DNA, 209 bp, Methanobrevibacter ruminantium
tttaccacctaaaatctattatcaaataatatttttattttaatgatttatattatttttccaagagatagggttttatttgaataatgaaaaaaataatgaaattttaaaaaataagccgaataaagaatttgaaaagaaaaataaattaaaaaaataaatagaaaaagaacaattattatctcgttaatctcaactgaaaataatag

SEQ ID NO: 4961 - DNA, 300 bp, Methanobrevibacter ruminantium
atcaccaaaactgtaaaataattgattgtattttcgattttaagataatcatcaaaacttaaaaaaaattgatacttatatttagttttaaaataaggattataaatagttatataaaaatttttaaaaaatattaatgaaaatttaaaaaaaaacaaaaaaatgataaaaaaagcaaataacagataaaaaaaaagcaaaaaatggataaaaaaagcaaataacagataaaaaaagaaataacgaataaaaaaagaaataacgaataaaaaaaacaattaaggactaaaagcaaaacaa

SEQ ID NO: 4962 - DNA, 129 bp, Methanobrevibacter ruminantium
tcttaaatcttcttcttcactaataaaaatcacctaaattaaataaaataagtttaaataaaccataaaaaaaagaaatatagaaaataaatatagaaaactaaaaaatagttttaaaaaataaataaa

SEQ ID NO: 4963 - DNA, 173 bp, Methanobrevibacter ruminantium
aatcaaacccctaaataaaaataaaaaagctcaaaattttaaaattaaaattatggttttataaaaaaattctcaaaattttaaattaaaatttggttttataaaaaaataaaaaaatgctcaaaatttttaaattaaaattatggttttataaaaaaaataaaaaagaaaaa

SEQ ID NO: 4964 - DNA, 66 bp, Methanobrevibacter ruminantium
taataaagattttttagccaaacccagtagaaaaagaaatttggccaaggttttttaatcttaaga

SEQ ID NO: 4965 - DNA, 246 bp, Methanobrevibacter ruminantium
attatcacaattcatttattcattagtataacaaatattaaattaatcagaagcatattattaaataagataagttaatttaataggttatttaatataatatatgttttctcattagatatataatttttgttctattgtattaaaacaatatttggaaacaatgcattattagataataaatttttcctatggacaaaacaatatttttgaaaactagaaaaaaataagaaaaaatgtgataga

SEQ ID NO: 4966 - DNA, 428 bp, Methanobrevibacter ruminantium
aatcaaattgataaaattttcaaatccgtttaagacaaatataaaaatgcagcaatcatctgaatagaaggttaagaccagtaagaagcaaagattctttaaaagatagttaaaacccataataaacccatattcttaaaaaacacattaaaatagaaataagagacaacaccatacctattaaaaatccatagaagagtgcaaacataataatcttcagacttaactataataagattttattagattattcaaaaaaccactaaattttattttaataaatataaaatagagttgaattaagcagtatttggcaaaataaaaactataaagtttattaatcattaaatacataaaatttaattagttatagataatttaatttataactaatagttttttaaataattttaataaaaagggaaaaa

SEQ ID NO: 4967 - DNA, 98 bp, Methanobrevibacter ruminantium
acttctctgactttcaattattattctttttagatggatcaaataatccattataactctttttttaactgaataacttatttaaaactagttaaact

SEQ ID NO: 4968 - DNA, 32 bp, Methanobrevibacter ruminantium
tttaaaacttcttttttgagaatgaaaaagat

SEQ ID NO: 4969 - DNA, 446 bp, Methanobrevibacter ruminantium
tcttaacctcacaaatttgtataaaaactataaatccataagaatatatgtattttttaattaaggacagatttaaagttaaatttctaaaacttgaaatcccctttaaaaaaagaattcttaatggacttattttaatatcaaataaatcttaaataatctttacaaataaagaacaaatagaagcatcatatttttaatacttgtctattttaagttctattatctaaatagtatttatgagcatataaaatttactattgtattattatattgattaagaaatagatcagatagggttgaatttagaaaaaaagagttaaaatagttaaattagataaagagattttataatattaaaaaaaagattgatttaaaaaactagtaaaaagagtatttaattgtaaaaaaaaagtaaaaaataattaaaagtcaaaaaagactat

SEQ ID NO: 4970 - DNA, 207 bp, Methanobrevibacter ruminantium
accaggtatcatattatttcctcattgtttatttaatagttaaatcagtttaattcattttttatgttttactaatccactaatttaatctgaatcatatttaattctatttattaaaatatataataatttttattttttgaaattttcttattaaaggattgaaaaataaaattggtttaagtgaaaagaaaaaataagaactaa

SEQ ID NO: 4971 - DNA, 27 bp, Methanobrevibacter ruminantium
gattttaattcctataaaatattagat

SEQ ID NO: 4972 - DNA, 26 bp, Methanobrevibacter ruminantium
tcaatagcagacaaaaaactataaaa

SEQ ID NO: 4973 - DNA, 150 bp, Methanobrevibacter ruminantium
aattacacaacccccatttttttataaaaaaaataataaaactctaaaagaattaatttttaatttcacaccaaacctatatcttttaatcaagccaactttaagcaccataactttaaaaacctaaaatccaagaaaattaaagaagaa

SEQ ID NO: 4974 - DNA, 86 bp, Methanobrevibacter ruminantium
ttaatcacttgatataaataattttttaattaatcatatcaatattagtttaactagatatttaattttaatctatattgagaaat

SEQ ID NO: 4975 - DNA, 82 bp, Methanobrevibacter ruminantium
tattttcaactcttttaatataattttaaaacattcttctgttaaatcccgggaataaattattttattggttaaacctact

SEQ ID NO: 4976 - DNA, 15 bp, Methanobrevibacter ruminantium
tatatacctcccata

SEQ ID NO: 4977 - DNA, 533 bp, Methanobrevibacter ruminantium
tttatcaccctctttaacataaaaaattcacccataattttttttagtttctaataatccaataattcttgtcctaaaaagaattatctgaaattcaccatctcgtttttgcaaataaatatttgtcttaaaaataaataaagctatttgaaatgcgataaaatgattttgtgcaaaaatgcaaaggtgaatttatgaaaaaaatgattttatgaaaaaatgaaactgtgaaaaaatgattctgtgacattgtgattttgtgattttgtgattttgtgattttgtgcaaaaatgcaaaaatgcaaaagggcgttggaaaaaaagaggtgcttattttaaaaccgagatctattggcaagctttttttgccttcggcgaaaaaaccttgaccaaaatttttttaaatgcttgtgagaactaggaattaaaaaaaaaacaagtgaacaatggaaaataagtaaaaaaagtaaaataaaaattagtagatgagtgaaattaaaaaaagtgtgaaggaaataagggaatagccgatg

SEQ ID NO: 4978 - DNA, 551 bp, Methanobrevibacter ruminantium
agttagcctccaattgtaaaataagtttttagattaattaataaattaattatttataacttatcttaatttttttaactaattaaaattgaattgtcttttaatttaattttagtatatttattaattagtgattcatttttaatatattttaagatttatggggcttatgatgagaatattttaagaatggggtgaaaaatcctaagataaaaagtctttctataatcttcttcaacagcaaataaaccttttaaaaaatcagacaggtttatcttttttgaatattcctttccaaatctacttttatggttttcatagtatcttaaaatcctttttgtaaaattagatttacctttagagcatataaagattcttgcatcctatattgtgcaaaaatgattttgtgaaattgtgcaaaaatgcaagtgtgaaaaagtgaaaaagtgaaaaaaaagttggaattaaaattaaaaaaataattattgattaaattattattttattcttcaccaatacaatcaaataaattttcaacaaaggtcaaaaaa

SEQ ID NO: 4979 - DNA, 214 bp, Methanobrevibacter ruminantium
aattttctttaatgataaatttatcagtttcatcgattatttttaagttcaataaaataatgtaaattaagcccaaatgggatagctaaccataaagagagattaaaaatataaaatactattgctaaaataatcccacaaataattaattttattaaactctttaataaaccccaaccaagtttgtaatcagttttgaatatatgttggagtg

SEQ ID NO: 4980 - DNA, 612 bp, Methanobrevibacter ruminantium
taaaatatatttggctgatatttcatagtttattttgataagttcacgtgaattcgaattaatcaattttaattatattaaattataatagttttttaaattactttttatatttattaaattagtaattcatttttaatatattttaagatttagggagcttatggtggtgaatattttaagaattgggtgaaaaatccttaagataaaaaagtctttctatatccctcttctacaatttcaaataaaccttttataaaatcaaacttgtttatttcaacaatttccactttagaatgatatttctgacatacatactcttgacaaaagatctgcttgtaaactcaagattcttaaaatccaatattaccttatcataggatttcatgctattaaataatgaattgcagttgaatccataactatcttatttgaatattcctttcaacatctacttttatggttttcatagtatcttaaaatcctttttgtaaaattaaatttgcttttggagcatataaagattcttgcattctgtaattgtgcaaaaacacaagtgtgcaaaaatgtaaaagtgaaaagagttaaatttgaaaatcgaaaaaaataaaa

SEQ ID NO: 4981 - DNA, 37 bp, Methanobrevibacter ruminantium
gttatcagtgaaatttcttaaaaaattgtctgttgat

SEQ ID NO: 4982 - DNA, 503 bp, Methanobrevibacter ruminantium
tcttaaaaccccatctctttataaacacagattataaacctttgaattcttaaaccctattattaataaaaaaacaaatctttaaataaatatcttttctttccaattccttacaatgattttaaaaataattaatttgtctaaaattatccttgattttccccatttatgtttaaaatatcatcaattatctcttagactaaatgctcttttatggaatacataattttacatcttaaaatggctcataagggtattctgcatgttctgattctaatagagttcatcaaaacaatcatcccttacaaaaaatgcatttgctccattaataatcacagccaaaaagagcatacatttaggattttcataccaatattcatttaaataaaccagccatgtttgttagttttattcaacaaaaatttgattaattcttttattctcctcttttcaccattgtatgctcttcaaaatatttattgttcaaatacattattcgatga

SEQ ID NO: 4983 - DNA, 64 bp, Methanobrevibacter ruminantium
atcttttcccctctaaaattatttattttaatttaatgtacagtattttctataaattagttat

SEQ ID NO: 4984 - DNA, 33 bp, Methanobrevibacter ruminantium
aatttcacagcacaaataaaataaaaataattc

SEQ ID NO: 4985 - DNA, 24 bp, Methanobrevibacter ruminantium
ttgcaattttttattaagtattat

SEQ ID NO: 4986 - DNA, 189 bp, Methanobrevibacter ruminantium
cctttcacagttttttaaaacaaaacaaaaatagttatcatcaaaatgtaaatttaaattagaaacatatacaaaattattaaaaaaagttaaataactacttaaatggaaaaagattaaataaatcctaagaaataaaagaggttaaaataagtatttaaaaagaaagttaaataaacccttaaaaga

SEQ ID NO: 4987 - DNA, 651 bp, Methanobrevibacter ruminantium
gacctcaccaaattgtttaaaattgtttaattgattaattgactaattaaattaatatttatttttaagatatttaaataaatctatggttttgattctgaatggcggattttgaattggaaaatgagacttgaatttgaaaatggaaattatgatttaaaaaaggaaattttaaattgaaaaatgaattctggttttgaacaagaattaaagcaaaaaatttttcactaaaattgcattcaaaaattagtttattttatagtatacgaactttttatatatagtaaactatacataaaacaaaaccgatttttaaggcctaaatttactatttataataaatagtaaaccaatattaaaaaataaaatcaaatgtttgtctaaatattaaataaaagacataaaaaaggttaaatttaaatataatgagattaagagataatagcacacacatcaaacgaatcacaaaaacgaatatttgaaatttagaagaactgataatccacgaatacatcagaccacaataagattgatttagaaactaaaaacataatttctaaagagagaatagctgaaatcaaagaaagtgccgaatcgattggagaatatctcaaagaggaacatatctttccaaaagaatattacgacttt

SEQ ID NO: 4988 - DNA, 75 bp, Methanobrevibacter ruminantium
taataaactttcactatgaaatcaaatcaaaaaaaggacatttgaataaatttattaaaaataaggagactaaat

SEQ ID NO: 4989 - DNA, 10 bp, Methanobrevibacter ruminantium
aggggatgaa

SEQ ID NO: 4990 - DNA, 105 bp, Methanobrevibacter ruminantium
tttaaactgtataaaacaagccaaatgctccattaagaaatataaaattattaacaattaagtatctttataaatacgaacaaatataatattaaatgtgataag

SEQ ID NO: 4991 - DNA, 173 bp, Methanobrevibacter ruminantium
tcaaaaaccaatatcaccatatttgatgaaaaaatagatggtttaaagagttaaaactagtaaaaatcagttaaagaaaatgctctgcgagttaagaaaaaaagaaaaagaaaagcctaaaccctaaattataaatctaaggaaatagactaattattttaaattaaattaat

SEQ ID NO: 4992 - DNA, 541 bp, Methanobrevibacter ruminantium
attatccaccacagttattacattttaattagtataatactattagtttttaaaaattgattaaaataattaaaaattaccaatttcattttaaaattttttaaatttataaacagtatttataaattgtttatagttaatattatttatatttttataagaaatagcttataaaatattctattttttaagattgattggtggaaaataagttaaaataataataaacaatagaattaagataaaaaaatgagtaaaaatagatgaaaaataaataaaaataagacaagaaaaactaaaataagataaaactaagtcaagagatgaaaaataaatgaaaataagacaagaaaaactaaaataagataaaactaagtcaagagatgaaaaataaataaaaatagaattaagataaaaaaaataagtaaaaataagggaataatgaaaataagacaaaagatagactaagattataaaaaagaactataataaatctctagaaatagaacgaactaagattagaaaaatagccaaacatgat

SEQ ID NO: 4993 - DNA, 44 bp, Methanobrevibacter ruminantium
aaaacacaaccccaaaattttcttatccaatgcaattattataa

SEQ ID NO: 4994 - DNA, 255 bp, Methanobrevibacter ruminantium
ctaaaagatcctctaaaagaaaagaattaaaactaaaaattcatctaaaaaaacattaaaataaaaagattctctaaacgaaaagaattaaaactaaaaaatccatcttaaaaaagacaagagtgaaattaaaaaagtcaaaattaaattagatttattaatgattaaaaataaagaattaatcattataactattaactaatattaataataaaaaacatatcttaaacaaagataaaaaaaatcaatatttag

SEQ ID NO: 4995 - DNA, 159 bp, Methanobrevibacter ruminantium
gaacaatactttaaaaaaacaaagaaataattattcaattatatatccaattaaaaaaaaaaaaaaaaaaaaaaaaatcatccaattaaatattcaattaaatatagaaaataaaaataactattatcaaataataaattcaaatttaaggtgtttaaa

SEQ ID NO: 4996 - DNA, 40 bp, Methanobrevibacter ruminantium
atacagactgataaaatattacaattattaaagtgataaa

SEQ ID NO: 4997 - DNA, 152 bp, Methanobrevibacter ruminantium
gctatctaaaaccttaattatttattcagttaatataaaatatttaagctatctaaaaccttaatattttattcaagcttaattaaaatataaaccctttttttaaaaaccaactcaaattatttaaaaaactatcaagcaaggaagataac

SEQ ID NO: 4998 - DNA, 503 bp, Methanobrevibacter ruminantium
taataaataaaataaactatttaaatgaggattgaataaaatcaatcccttttaactatttttaaaaaaaaaaacaccaccactaccagaaggaataaataaaataaataaataaaagagccatagccacatcccactcgatttcaattatcattaatttttaattaaaaccactccataagttatttgacagttaagttaatactttttcatcacatcccacaaaaaaatattactcataatcaagataagtattattaaaaaaaggacctattataactgtaagagtaaaaaaaattaaaaaataattataaaatatatcaaaattagataataatgaaatatataaaaaatagattaaaaaaatattttaaatgctaaaataaagaacaaataagcaaaaaaatacattaagtttaaatagtattaaaaatataactaattattactcaaatatactttatgagttatgagtgaataaaaaaaaataaagcggagtaatt

SEQ ID NO: 4999 - DNA, 39 bp, Methanobrevibacter ruminantium
gcaagcttttttggactgcggccaaaaaaccttgaccaa

SEQ ID NO: 5000 - DNA, 153 bp, Methanobrevibacter ruminantium
tatcttttctttttttactttttcttttttttataaatactattaaatttacttttttttaaaatatttatccaaataactaattttctaaaataaactcttaaaaccctttttttaaaaaataaactaccaaaaatatttccttttacaaaa

SEQ ID NO: 5001 - DNA, 125 bp, Methanobrevibacter ruminantium
attaatcttaaaatagaaaccatagaaacaaataatcaaaacaaaataagtcaaaataataaaaaagaaagaataaaaaaagaataaaagagtataaaaataaaaaataagagtataaataaagc

SEQ ID NO: 5002 - DNA, 582 bp, Methanobrevibacter ruminantium
cttatcacattaaaaattaaatatttgatatccttttaaattaattgaaaaagtcaatattaaaaatccatattagatatcattttaatcaattgaaaaataaatattaaaaatcctgattaaataaattctaacaaccagttaaaaaatttaatatatttataatattttcatacatatataattttagaactagtattatataaatttaaataagtattatgctaatttttcatgaattttataaataattatataatttcacttacaaaaataataacaaaaataataacaaaaataaaatacaaaagaaattttttatcaaaagaaatgaaaattaggcaatcagataaacaaatgaaaaaaaaatactgtttgaaaaatcattcgatgtaattcaaacaaagcaatgaaaaaaaatagcaaaactgaacatcaaatcaaacaaaataagaaaattttaaacaacaaaaggaaataaaaaactaaaataaaaattattcaattattagttttcaaatgctctcatagaaactatttaaataataaaagtcaatttaaaactacatcagatgtgtaaac

SEQ ID NO: 5003 - DNA, 402 bp, Methanobrevibacter ruminantium
tattgaaaattgaaaaaacaaacgatgctattaaaaaaaaaataatttttagacaattaaaaaaaaaaagattttagaaatattagaaccaattacgaatttaagtaatcaatcagaggaggaatttctatcaatcaatttaaaataagcataatcatacctgtttacaatggagagaaatatcttccactaactttagattcagtaatcaatcagacaattggaattgaaaatctggaaatcattatagcggatgactgttcaacagacaacactgctaaaatcattcaagaatataaggaaaggataaattcggatactggaaaggaaactataaaatccatatctcttgaagaaaacaaaggaggagcattcggtccccgcaatcttgcattgaattat

SEQ ID NO: 5004 - DNA, 182 bp, Methanobrevibacter ruminantium
aaaagaaagctttataaaaagcaaaataaataaaactagaagagattattatccaatccatactgaaattcacataaagcaaagaattaatttttaactttactaaataattaaatattatactaatctaatattaaatagtaagtatactgatttaagaatgaaaaaccaaaggtgaaaca

SEQ ID NO: 5005 - DNA, 81 bp, Methanobrevibacter ruminantium
attaaaattaaatttaaacaattaaataatttttaagatttttaattatagaaaacaactattttaaccaaagggattaaa

SEQ ID NO: 5006 - DNA, 189 bp, Methanobrevibacter ruminantium
ttttcttaaattttttaaatctttctaagtaaaattaaatagaagttctaagaaaattaaaaagaatttctaggtaaattaaattgaattcctatgtaaattaaatagaagttctatgcaaattaaagagaaaaataacttatcaccacaccattaaaattaaatctcaaaaaattagttatattgatt

SEQ ID NO: 5007 - DNA, 48 bp, Methanobrevibacter ruminantium
aagacataatttgttcgtaaattatttaaaaaaatatggggaataatt

SEQ ID NO: 5008 - DNA, 18 bp, Methanobrevibacter ruminantium
atttaaaaatagatttaa

SEQ ID NO: 5009 - DNA, 139 bp, Methanobrevibacter ruminantium
ttttttactctttttatttataaaaataagcattaatcttctaaataaagatttaatgaaaaaataagattttactttttttaaaatgaataatcagactaatttttgattaaaataattaatcagactaatttttaaa

SEQ ID NO: 5010 - DNA, 230 bp, Methanobrevibacter ruminantium
aaaatcccctctaaaagtagaatgataaaaatgattaaaaaatagatgaaagtcttaaaaaaatgaaattaattaagacttatgaaataaactaaatttaaaaaataaactaaatttaaaaaaattaagaaatgaaaaaacaataataagttatataactgtttaatgaagaataaataagaaaaaaactgctaaataaataattcataaaactaaatattatcataaat

SEQ ID NO: 5011 - DNA, 9 bp, Methanobrevibacter ruminantium
tctagcaat

SEQ ID NO: 5012 - DNA, 106 bp, Methanobrevibacter ruminantium
ataatccctcaaactccatttcaatacataattgcttaaacttaaattaatgatataaaaatcttaatttaaattaaagctaataataaaattatcataaactatt

SEQ ID NO: 5013 - DNA, 473 bp, Methanobrevibacter ruminantium
tatatcgccttaattataaaaaattaaataaatttaaataataaatggaattattaatttcccatagttgccaaaataataatttttgtaaaaatatattatttagcataataactaacaataatattttagtatttactattaaataagtatttgccataattctattttaagtaatatttattttttgaaaatgattattgatggtgcagttatgataattttaaaatgagtaattatagcgttctattgatatctatgattattttaaaatgggtaaaaataagtataaataagtcaataaaagtaaaaatagtccaaataaataaaaacaagaataaaacaagcaataaaagtaaaaatagtccaaataaataaaaacaagaataaaacaagcaataaaagtaaaaatagttcaaaagaagtaaaaaaagtaaataaaaaaaagtaataagaaaaaagaattaacgaaa

SEQ ID NO: 5014 - DNA, 646 bp, Methanobrevibacter ruminantium
aactacatctcctcaaattttttaatccgttatttagtaatattaataaataaattaattaagatcaatcttaatattggttttctatttagatattaaattaagattatctcttaataatgctttttaactaaaatttccatagaattgtctagggaatattagttttataaaaattaaaactcaaaaaacaagctgtccgctttgcttgataaagagaaaaacttaatagcacttgtatttaccattaaatttatttttatatttattttttaaaataaaacgagaataaattctcaaataagcaagttaattaatgactcttacggcaagaataagtaagaatgtatatatttatattcaaaacaatatataaacctaactatttttagacttaaaaattggggatttttcaaaagacatcggatttagaatgaaaaaaattcacagaaaagggatttaaagaaaaagggcataaaaaaaatcaaaacttgattttaatagagaatagttagatagaaaaataaaattaaataattaaagtttaaaattagaaatcaaacttaaaaataaacataaattatttaaaaagtaaaatctatacatattaatagtataaaaaaatcttttaagaaaaggtgttaaa

SEQ ID NO: 5015 - DNA, 144 bp, Methanobrevibacter ruminantium
aaaataatgttaaaatacattcttttagagacaaaaaaattcagatagattcttttagaaaaaaacttaataatccgatttataaaaataaaaaaataaatctataaattaaaattacaataaataataaaaccaggtgtaata

SEQ ID NO: 5016 - DNA, 77 bp, Methanobrevibacter ruminantium
gtttatttgaaaataaacgatgaatataaatttattaatttattttaaattattttaaaaacattgcgggtgataaa

SEQ ID NO: 5017 - DNA, 393 bp, Methanobrevibacter ruminantium
atactcttttttaatttaaatactttttttcaatctttatcctataaatcatcactatttttttatttttcgataataaacttttttgaatgctttcactccttttaaaattataaattcattaattttatattatttaatcttttaattatatgaaaattatatgaaccataagttaaatattacttaaaaaaaaaattaattttttaaaagtgaactataatgaaaatcccttaatcgagttaagtcaatgttaaacaatgaataaattaaattccttactttataaagccattattaaaaaataaggtaaaattagttaataatagataaaaaatagataaatataaataagaagatatgtaaagtatagtaaataataggtaaaacagt

SEQ ID NO: 5018 - DNA, 33 bp, Methanobrevibacter ruminantium
ttttatttaaagattataataagaggtgataat

SEQ ID NO: 5019 - DNA, 54 bp, Methanobrevibacter ruminantium
aaactgtgaaaaaatactgtaaagttgaacttaaaaaaaataagtaaaaaaaaa

SEQ ID NO: 5020 - DNA, 25 bp, Methanobrevibacter ruminantium
cttaaaaaaataaaaaaataaaaaa

SEQ ID NO: 5021 - DNA, 16 bp, Methanobrevibacter ruminantium
ttataataaaaaaaaa

SEQ ID NO: 5022 - DNA, 64 bp, Methanobrevibacter ruminantium
aaaaatcacatctaactaaaagcataaaatcaaaaaatagataaaaaataaaaatctaaaaaaa

SEQ ID NO: 5023 - DNA, 93 bp, Methanobrevibacter ruminantium
caaaagataaaaattacattttaattaattagttaaaaaaaatattcctaaagaaacttattcaaagttaatgccttcttctaaggaagaaac

SEQ ID NO: 5024 - DNA, 321 bp, Methanobrevibacter ruminantium
ctaaacaccagatgtgatttttatatttttattaaataagcattattttataatattataatatatctttaatctaattaataaagatttatgaaaaatagctctaataaaaaaaactatcatttatgaaaaggagtttttaattaaggaaattcttaataaaaaaagttttttaagaaagagaataaatgataaaaaaaatagaaataaaaaatagaaatgaaaaatagaaatgaaaaatagaaatgaaaaatagaaatggcaaataaaaatggaaaataaaaaaataataaaaaacgaagcttgaataaagaaaaaaaa

SEQ ID NO: 5025 - DNA, 67 bp, Methanobrevibacter ruminantium
aagaatacctcaaaattaataaaattgaatacctcaaataagaatgcctcaaatattggaaaaaata

SEQ ID NO: 5026 - DNA, 78 bp, Methanobrevibacter ruminantium
attattcactcacaaaactttaataattaaaataataattttaattgactgtttaaggaaataatgattttaatagat

SEQ ID NO: 5027 - DNA, 172 bp, Methanobrevibacter ruminantium
gttaaaattagattaaaaataaaaaagataattgaaataaaaaaaactaaaacctaaaaataataaaaaaagtttaaataaaaaaaataataagaaaaacagaaaaaaacctaaaaataataaaaaaagtttaaataaaaattaattaaaaattaaaaaaataagaaaaata

SEQ ID NO: 5028 - DNA, 50 bp, Methanobrevibacter ruminantium
attaagcaccttaaataaggaattttaatacatctcttaatttaaaaaac

SEQ ID NO: 5029 - DNA, 250 bp, Methanobrevibacter ruminantium
actctcacatcgcttaatttagacactttatctaatgtgccttttttttaatttatttaattggtttttattatctaaatttcaaaaagcaattatttaatattaaaaatggatgaatcgattcttttattttattaacgaatgaaaagtaatcccttaatcaggaatagaatcaaatccctaaccttaacgattaaaataaatatcatcaacactatcttcactcaaatcatcatcagacaaatcagaa

SEQ ID NO: 5030 - DNA, 120 bp, Methanobrevibacter ruminantium
aaaaaacacaagtgaaaaaataccaaagatatatttttcattattactgttcggcaaatataaaattatatatattgaaaaatacataataaatatagtaatgttttggaggcattaaaa

SEQ ID NO: 5031 - DNA, 62 bp, Methanobrevibacter ruminantium
gctatttaataaaatttaaaatttatatttctattttttttttagaaatctctacaataaaa

SEQ ID NO: 5032 - DNA, 338 bp, Methanobrevibacter ruminantium
tttccccaaactcatacatacaccaatatttcttaaataaattaaccaaaacctatttttaattttctaatgaaatttgatttctcgcaatttttcatttttacttattatccctagcaaaaatttgaaattttgctaaattttattatatatgaaaatcatattattaatattatagaatataatcaataaattcattcataaaaaattttagataagtgatgaaaaagattgattaaacatcttaaaaagcaaaaaatagatagaaatctttaaaataaaataaataaagataaaaatctttaaaatgagaaaataaaagatgaacaaaagataac

SEQ ID NO: 5033 - DNA, 135 bp, Methanobrevibacter ruminantium
tatttaaaaaaaaagaaacaatctgatttattaagcactgaagaacataaacttagaaaaatcaatacaaactattaaatattaaatataacttagacttacaaaaataataaaaatatatggagaggggaaaat

SEQ ID NO: 5034 - DNA, 280 bp, Methanobrevibacter ruminantium
ttagaactttttatcaattctttttctttaattatttttttaatttaaaaatggaacttttagttcctaacttttttctattttttatcaaagcccacactcttattttgattttttaaaattaatttttatattatttttactaaaacttttccattacttcaaattattttaaagattaattgttttataataaagaaacaatttatgattataagaactatttttgcataaaaatgaaaaagcaaattatcacaaaaacacaaaaacacaaaaatga

SEQ ID NO: 5035 - DNA, 44 bp, Methanobrevibacter ruminantium
aaaaataaaagagcgataataataaaaaaatatcaagatataag

SEQ ID NO: 5036 - DNA, 67 bp, Methanobrevibacter ruminantium
tctatcacctaaccttttaaatagtttattttattattttcataaataattattaatatttttagaa

SEQ ID NO: 5037 - DNA, 32 bp, Methanobrevibacter ruminantium
tttaaacactcctaatcataataaatactttt

SEQ ID NO: 5038 - DNA, 136 bp, Methanobrevibacter ruminantium
aaaataaaataaaaaaggttaaaaaaaaaattggacagtataatgataataaataatttatattcaagttaagttaaattaaaatgaaatattaaaaaataaaaaaaaggagattaaaaaatgaaagaaatatttt

SEQ ID NO: 5039 - DNA, 605 bp, Methanobrevibacter ruminantium
aatatcacctgtaattaattagtagtaagaatgaatatttataacaattgttataattttttaataaaaaaattattatgatatgcaaattatgtatggcatgaaaaataataaaagaattattaaaaaatataacaattaaaaacaacaacaatatttaagaaaatattcattatataacaattgttatacataatatataaatattttggtagttttaatataatgaaattaaaaatcataaaagatatggaaaatctgatttaacaatctttggtacattaataaaaatgtggaaaagaaaaaataaaaaaagaataaagatccctatgttagtaaagataaagctaaatattctgattaaaaaaaagcataatgaattaaatgttcgtaaagtataaaactaaaaaattcttgataaaaaaaaggctggcagctaaatgaaattctcatagaccgaaacccatagtacacaaacaaaacgcgaaaagacttaacttctgggatcggaacgagaccaggtgtaaccccatcgctatgaccgccaaacctaattatgagtatgattaaatttgaaaaatatgaataaataatgaataataaaa

SEQ ID NO: 5040 - DNA, 8 bp, Methanobrevibacter ruminantium
accgccaa

SEQ ID NO: 5041 - DNA, 42 bp, Methanobrevibacter ruminantium
attcgaataagaataattattttcgtaaataagaaaataaag

SEQ ID NO: 5042 - DNA, 309 bp, Methanobrevibacter ruminantium
atattttccataaaaatataatactcaaactaatcaatctagttaaataatagtaaacactacaaagaaaattccagtgtcaaacataaaatgtctgagaaaaaatataaacatacacttaaaagcgcaatatacttttccaacaaaatacataacaaacaactaaaattcggtttgttagtgccagtagggttactaatgcacagataatcaaaaaaagatcatcccttcacacacaattccaccacagaaaaggtgctgcacaaaaaaatgaaaaatatcaattctaagatatcaaataagatataa

SEQ ID NO: 5043 - DNA, 211 bp, Methanobrevibacter ruminantium
agatcttaaaagaacaatccattatattgctttagtaaaatagatgatttagtgtttgattgctatataagcaacataaatttgtataattcacttctaattacacacaaaaaaaatgataatcacataaaaaaatacataataaaatccagtaataaataccaaaaatatattaaaagtataaggaggtgatccagccgcaggttcccct

SEQ ID NO: 5044 - DNA, 277 bp, Methanobrevibacter ruminantium
ccaggatcaaacagatttgacagaatacaaaaataagttcaataagacttagaagtacgctaaaaaaatatagacgagatattacacaaatatttattattacatcacagacataacaatcaaatatcaccacatctactttaccaacatcaaacactaagttaaacttaggttctcacgaatatcttataatgaataaatgaattgatatcatataaacattaagtgttgctaccaatcgtagcacaactattaggcaacgttacaacacttacaa

SEQ ID NO: 5045 - DNA, 133 bp, Methanobrevibacter ruminantium
ttaaaatattgtttcaatataataaaacaaaccaataaatcttaaacttacccattttcagataaaagcaaaacgaagcaagaaataggataaaaaatgagaaaaacgaaacatttatatatgagaagtattt

SEQ ID NO: 5046 - DNA, 155 bp, Methanobrevibacter ruminantium
attagcaactgcaaataactacataataaaatagttattattataatatattatattctataaaaaaaactaaaacagaaaaaaacaaacattatattctataaaaaaactaaaatagaaaaaatacagaacaattaattaaaaaaaagaaaaaa

SEQ ID NO: 5047 - DNA, 58 bp, Methanobrevibacter ruminantium
ttagataaaaatttttggccaaggttttgcgggccgaaggcctggaaaagcttgaagg

SEQ ID NO: 5048 - DNA, 28 bp, Methanobrevibacter ruminantium
aattaattatgggtcaaaaataaacaaa

SEQ ID NO: 5049 - DNA, 31 bp, Methanobrevibacter ruminantium
ccattaaaaaaaaaaaaaaagtagattaaaa

SEQ ID NO: 5050 - DNA, 343 bp, Methanobrevibacter ruminantium
tgtactataaatttccattatatctccttaaaactaattttaataaaaataggataaaaataactatttaaacataatctaactaaatcaacgaaaataattatctaaacataatctaactaaatcaatgaaaataactatgtaaacataatctaactaaatcaatgaaaataactatgtaaacataatctaactaaatcaatgaaaataactatttaaacatgatttgaaataattaaataaaattttaaaaaataccttattaaatataaaaatatggctgaaattagttaaaataaagtcaaatcaactaatattccagcaatagataaaaaaaataata

SEQ ID NO: 5051 - DNA, 77 bp, Methanobrevibacter ruminantium
aaaatacctcctaatcgcttaatattttttatatcattaatatacatttaacgtataaaacaaataatgaagaccaa

SEQ ID NO: 5052 - DNA, 444 bp, Methanobrevibacter ruminantium
aatttcaccatctttttaaagaatcttatctaaaataaaactttattgaattttaatttaaaatacatttttattttaaataattcactattgttattagaatattcatatatttataactaatttaatataaacttaacacaagttatataataacaaagttatattttatcgctcttaatatataaactattttaaaaataattatttaaggagatataaattataaaaatagttttaaaaatgattttaaaaaataaaatatactattgtttcaataagaaaaaaataataagatattcctatttcaataagaaaaaataataatatgctcctatttcaataagaaaaaaaataaataaaagtttattttttaaaataaaactcttaaaaatgatttaaacaaataaaccaatatttaagagttatttataaataaaaaaa

SEQ ID NO: 5053 - DNA, 82 bp, Methanobrevibacter ruminantium
aataatcacaccataataattttataataaaaataatcatttgacttagaaatagataattatatacattttcaatactaaa

SEQ ID NO: 5054 - DNA, 221 bp, Methanobrevibacter ruminantium
caaacttttactgatataaaaaaataacaattgttatattttaacgattgttatattatagttgattatgatagtatataaatatttctatgaaaacagagatttttaataagataaattgaaaatatatctttaaatggggataaatgcaccctctaaaaatatttaatcttaaaaaaaaggattaatttccatttaaaaatcttaaaaaagatgataaa

SEQ ID NO: 5055 - DNA, 146 bp, Methanobrevibacter ruminantium
aaacaataagtaaagtagatacgactatcaaacaaaactggtttaaaaacaataagtaaagtagatacgactatcaaacaaaactggtttaaaaacaataagtaaagtaaatacgatttctcaaaaaaaagtttaatggcttgata

SEQ ID NO: 5056 - DNA, 3 bp, Methanobrevibacter ruminantium
tat

SEQ ID NO: 5057 - DNA, 256 bp, Methanobrevibacter ruminantium
ttattacaatcctttgattaatttcctattataattaatccttttttaaattaaatatttcttattaatatttatgattaatattataattaaatctttatcaaaaatttaaaaaaactagaaaataataaaagcaaaaaaataagaaaaaataggtaaaataaaaagcttaaaaaagtaaaaagagcctatctcaagcaaaatgagataaaaattttggtcaaggttatttggccgaaggccaaaaaagcttgag

SEQ ID NO: 5058 - DNA, 17 bp, Methanobrevibacter ruminantium
gataagcaccttattga

SEQ ID NO: 5059 - DNA, 56 bp, Methanobrevibacter ruminantium
aatataaataaatgaccatttaaaggcaaaaatataattttatgtcagaacttagt

SEQ ID NO: 5060 - DNA, 127 bp, Methanobrevibacter ruminantium
aattctcccccaatgattttagtagaatttactagattctacaagattttaatagattttaatagatttcagtagattttaagataaataattataaaaacttatatcttaaaatccttctaaaagt

SEQ ID NO: 5061 - DNA, 160 bp, Methanobrevibacter ruminantium
attaaaccccctaaatttaatatttattttaattgtgattaattcattaatttatcactattaatattatgtgcatcggaatatataaaatcatcttttttgattgttggggagcccttaaaacagataatcccttgaaaataaggttaaacaaatcttt

SEQ ID NO: 5062 - DNA, 252 bp, Methanobrevibacter ruminantium
ttctctaccccaatacaattataaatatttctttatttgtaaatgaggggtataaataattttttaaaaaattcttcaaagatgaaaaatcctttaattatcttaataagatggatataaattgatgaaaaaaattcttgaattgccttaagaaagataaaaattgatgaaaaaaaattcttgaattgccttaagaaagataaaaattgatgaaaattattgatattaaataaaaaaaaagaattaaaagaa

SEQ ID NO: 5063 - DNA, 395 bp, Methanobrevibacter ruminantium
aatatcacttaaacatatcttttaaaatacttatttttaaagattttgtcactaaaatagggtaaaaagtaaaattgggatagctagataaaaatagaaaataagaataaaaaaaagaaaataagaataaaaaatgattccaataaatgattagagaaaacatctgaaatgattaaaaatataatggaaaatgaaaaagagtttaaattatatttaggggcctgaatttttttatgtatgaaatcgttcagattttctatatttttattcattaccctataaaaatgtatttatttctaaaaatacaattgtattattagttatataaaaaaataggtctttaatatcgttaaatttaaataatatgctttacaaatatattattggcgataata

SEQ ID NO: 5064 - DNA, 148 bp, Methanobrevibacter ruminantium
aatcgtcaggcccctaaataattatataagaataaataaaaaaaccgataaaaatagataaaaaagaataattatataagaataaataaaaaaaccgataaaaatagataaaaaagaatgaaaagtaaaaaaaaacaagtttttttac

SEQ ID NO: 5065 - DNA, 409 bp, Methanobrevibacter ruminantium
tgaaaattaatagttaaataaataatttaaaattctaaaaagaactattttctaaatttaaaaaacaaacacaataatctatttaaaattctaaaaagaactattttctaatattataaaatcaatttcaataaataaaacattctatgttaatatttattaaaagtatttattaaagattttgtaattttagatttaagtatgtaattttagatttaagttagggaattaaaaaaataatcatcataaattatttaaaacttcaaaaaacaatagttttataataaataatgtacataaagaaacatagtataatatataaaagaacatattgatgtcttgttgaaatgcaggaaaaaataaatctaatgttcaaaattattaaaaaacaaattaacgaggtgaaaaa

SEQ ID NO: 5066 - DNA, 185 bp, Methanobrevibacter ruminantium
cattttttctatttttatagagatatcttaaaaatagattatttaaggctcatattccaatatgtcaaaaaaaaattatatttaacaaatgaaatacgcttagaaaaatcatttttctaaaataaaatattttttgaaaaattataattactaaaataaattattaactgattataggagataaa

SEQ ID NO: 5067 - DNA, 209 bp, Methanobrevibacter ruminantium
aaactttctttttttaaacttaaactttaaattaaataaatctttaaacttattttctctttttttaactagaataaaagttttatctttcatttaaattattataaatttcttttttcattagaattatttttaacttcttttctttcatttaaattatataactccttttttcatttaaattattaaaacttgttttctttattatt

SEQ ID NO: 5068 - DNA, 194 bp, Methanobrevibacter ruminantium
aatatctccttaataaactaaataaaattaagtaaatgaataaactaaataaaattaagtaaatgaataaactaaataaataaagtaaataaataaagtaaataaataaactaattaaataaagtaaataaataaagtaaaaagataaattaagtgatttaaaaataaaaagaatgattaaaaaaccttaaaac

SEQ ID NO: 5069 - DNA, 94 bp, Methanobrevibacter ruminantium
tttaacacctatattaactttatttaaattgccttataaatatttttgatatttcttaaaacgcacaagttttgaggtgataaaaaaacaattt

SEQ ID NO: 5070 - DNA, 185 bp, Methanobrevibacter ruminantium
cttaagcacctgtttttaatttatgatttgtcttaaagattaataatttttattatctagaaacaaaaagcaaaacaataatttttcaaggaataaaaaacaatagcatgaaaaaggaaaaaataacaaaagcttttatataagcaatcaaatatattaattaaataaaactaaagggtgaaaaa

SEQ ID NO: 5071 - DNA, 6 bp, Methanobrevibacter ruminantium
aaaaaa

SEQ ID NO: 5072 - DNA, 9 bp, Methanobrevibacter ruminantium
aatccaaat

SEQ ID NO: 5073 - DNA, 273 bp, Methanobrevibacter ruminantium
tttatcaccctaagtaaataatatatagcttaacaaaattttagattaaataaaaaaaatatctaaaaactaaaaaaatttaaacgaatgtaatacaaaaattacttttgtatactattaaattgtcatacaaaatatataaatgtattcatttttagtgacaaaaagaaaaaacttaaacccaaatccttagaaaaagaactagactaggctgtaaaaatgagaaaatatttaaaaatagtaaaaataataaaaaatagtaaaaattaagca

SEQ ID NO: 5074 - DNA, 204 bp, Methanobrevibacter ruminantium
aaaagacaaaatcttaactctttcatgctgtatagtgcgtaatgattgtttttctaaccattccttataatcgcttggaaacatcaatgccataaaatcaccccaaaaattaataaaattcattttaagttaaaaattcaaattccaatttgtattttaaaaaagagattaaaaattaatctaatcccaataaagttaaaaaaa

SEQ ID NO: 5075 - DNA, 98 bp, Methanobrevibacter ruminantium
caataaagttaaaaaagagattaaaaattaatctaatctccaataaagttaaaaaaagagattaaaaattaatctaatcccaataaagttaaaaaaaa

SEQ ID NO: 5076 - DNA, 28 bp, Methanobrevibacter ruminantium
atcctcatttatcaagaatagactaatt

SEQ ID NO: 5077 - DNA, 402 bp, Methanobrevibacter ruminantium
ttgtcttttcttctaaaccgttaaaagattctaaattagttacattcttttccatttcaaacatagccattttttagtctccttaaattcatttattcgtataaagtctgtattgggaattaatttaattatttgtcttattcgaaaagacaattctaattaattctttttagagaattcgttttatttctcttaaaacaagtatgttttggagcatatataaattgaataaaggaaaatatttatagaaaaatgagatagtagaataatttaaaaaaaaaccagatgagaaaaaataatcataaacaaaagaaaaaaaaccataaagaaataacttataaaagtaaatgagaaaaaataagttaaaaagaagaaagagtcataaaaaataagtttaaaaac

SEQ ID NO: 5078 - DNA, 35 bp, Methanobrevibacter ruminantium
tgctaagaaataaattgaaagcctaattagtaaaa

SEQ ID NO: 5079 - DNA, 169 bp, Methanobrevibacter ruminantium
tttatcactcccattttaaaaaaaatgtaataaaaataattttttcttaaattaacttatataagttttagtatataaattgtataaagcaaatcattgatttaataaaattaaaaataggttatattaaatataacttatattacaaatagcctatctaattatcttt

SEQ ID NO: 5080 - DNA, 266 bp, Methanobrevibacter ruminantium
aaatcatcatcaaatttaattagagattcataatttataaagatttttaaaaattttttctcaaaaatcaaataaaagagtttttactttaagaaataaagaataaaaattaataaaataaaaatcataaataaaaagagctaataaaaagaactaataaaaagagctaacaaaaaaacaagataaaaagaactaacaaaaagaactaataaaaagagctaataaaaagacaggacaagaagaactaataagaattaagtgaaaaa

SEQ ID NO: 5081 - DNA, 48 bp, Methanobrevibacter ruminantium
gaattaaaagataaataattaataatttgaaccattttggaggttttt

SEQ ID NO: 5082 - DNA, 173 bp, Methanobrevibacter ruminantium
tctaacatttcccatatatccttatttttcgtgtttgtgtttaaaaagtccctattaaaatagctacaaactattttttaaaatacagatgatgtgagttggcatatggaattaaattctaaaaatattaaaagtcaggtcatttaaaaatttaataaaatttaaaaactctt

SEQ ID NO: 5083 - DNA, 101 bp, Methanobrevibacter ruminantium
aatttacatttatacctctttttattcgcctttctacaaaatcaccaaaatacaatcttatctcattttaatcaattttataaaagataatggggaaataa

SEQ ID NO: 5084 - DNA, 11 bp, Methanobrevibacter ruminantium
tatatctactc

SEQ ID NO: 5085 - DNA, 662 bp, Methanobrevibacter ruminantium
aattaaccttaaaatacatataattcagattactacttcattatcaaacgtttgaataaatagggaatatatggttttatgcaatagtggtttgatggaagttgacaataaatagtaattaaagtatactatttttaattaaatccagtttattgtctaaactcgaattaaacaaacaacaatgggtggattcaaaattagagagagaataggctttaaattaaaaatatcagaaattaagcgatggaatggtcttaaaagtgttatttttaacttcttaaagctcaagtctcattagaactaaagtcaagatcattatctgccggttaactcagataatccaagactaaattccaagagcaatctctaagaattaaccccctttattgctatatataattcaaattatagaatcatctaaactccaatttaatttttttaattaaatctagaaccaaaaaaagaaacgttctatagcaaataaaaattttaaatattattatagatgccgctgtccttcagcagtataaatcaaactctcgtgattctgtatgtgtaatggcaaattgtcccaaaatatggtgttcttaaggcgactttaccctaagatataggcgttcttatgacaaccttgcctcaactaataggcatcgttactacaa

SEQ ID NO: 5086 - DNA, 14 bp, Methanobrevibacter ruminantium
catagaaaattaat

SEQ ID NO: 5087 - DNA, 29 bp, Methanobrevibacter ruminantium
attttcacctcttaactttaagacataca

SEQ ID NO: 5088 - DNA, 226 bp, Methanobrevibacter ruminantium
gagttttttatgaaaaaagtttaataaaatttaaaaaaatacaataaaacttataaaaaatagataaaaaactagataaaattaaaaaagagataataaagctctcttaaaaaaacgataaaaagttaataaaattaaaaaagaactaaaaagccctcttaaaaaaaatgataaaaagttaataaaattaaaaaagagttagtctaaaaactcttcttgaatctta

SEQ ID NO: 5089 - DNA, 523 bp, Methanobrevibacter ruminantium
ccaattcctcgcataatcttttaaaactttaaatcaatatgatctctttaaatcctaaattgatatatttaaagcaatttaatcatatatgagataaatttaaaatatcttttattatcatttaaagatgtttataaatttcttaacagtttaatatttactgattttgatatttaaatctattttttaactgttgaaatagggataaaaataagatgaaactggagcaaaaataagtttctactaaagaagatgtatatgttaaccaacaatatttatatgaaagaataataaacttatttaaaatgatttattgtttaattaaaaacaatgaacattaatcaaatagcacttttgtgatagctaaaattaaaataaattaagaaaaatttcttctaaaaattgaatggcaaaaatatcatttttgaatgaatgaaaaattaatcaggattgaaagaataaaattataaaaaaagaaaaatagttgaagttaaaaaagttataaaaattaaaaataaaaaaa

SEQ ID NO: 5090 - DNA, 142 bp, Methanobrevibacter ruminantium
tgatttgtttttaattgaaattgtttcacctcattatacaaaaagacatttaatgatttgttaaaattgaattaagaattaaataagaatctgattcaatgaaaatcattagcatattaatttataaaaaaacttttacgat

SEQ ID NO: 5091 - DNA, 623 bp, Methanobrevibacter ruminantium
gtttataataactattttaataaaatataactaaattaaaattatttaaatgaaatattaataatataaaacgaattaaataaaaataactcttattagactttattaaattgaaattgaaaaaaggtaacttaaatatatttatttataaaaagacttataagaatgtttttattttaaagaacagaataagccccaataataaaaaataattaaaaatcaagagatttagccccaaatatccattcttataagaaatagaaaaaaagatagaaaatgcttaaatttggcctttaaaaattgtgaaaaaatgaagatgaataagaaaaaacaggactaaaaaactgaaaaaaaatgaaaaatataaagaaaaaaaatgactaaaagaaatgaataataacttgatttagttaatattcaaataaaaaaatcacaaagaattaataataataaataaataaaaattaccaaatataatataaaataatagctataaaaataaaaattccaaattttgatagcaataaatataaaataataattataaaaccataatctctcattatgggcagggattaaaaaaatgacaaaagccatttaaaacaagttataagggtaataaa

SEQ ID NO: 5092 - DNA, 212 bp, Methanobrevibacter ruminantium
taaattaatagaatagtgaaataattgaaaaataattaaaataagtaaattaatgataataaatgaccagattaaattactaaaaaagtgaaaataattagaaaaatggattaaaataagtaaatttgtgaaaataagaataaaaagttaaaaaaagtaaaaaatattggttaataaaagattaaaaaaataaaagattagcgataagtcga

SEQ ID NO: 5093 - DNA, 60 bp, Methanobrevibacter ruminantium
gagaaatcctccttaaaatttaagataaatgttattttctatataatatctgctttggat

SEQ ID NO: 5094 - DNA, 288 bp, Methanobrevibacter ruminantium
atataattatctcctaaaagattaaattcaaaaatataagccaaattcaatccaaatgattatgaaaatccgattgaaattagttaatatttttttcttgtaaaaatttataattatattttatttataattatctattaatatataatttaattttttaataatataaatatttttataaaaaatcccagaaaatggttaaaattagggtaaaaataaaaaacttagaataaaaaattaagaaaaaagtttagggtgtccgccaaaataaaattttgacaacaccag

SEQ ID NO: 5095 - DNA, 346 bp, Methanobrevibacter ruminantium
aaataacaccaaaatattaaccctttgttgatattatttatgtttaaagtagtatataaagtttactataatattattgctttatttcatatttaaagaataattaacaagtaaaaaattttttcaaggtgcaagcaccaaaattaaaagaaaacaatagaaaaaacatcgaattttaaaaaaataactaaaataaataacttaaaaaattgaaaattttaaacttttttaaaaaaatagctttttggcggaccctctttaagaaaaaaaagtttaaaaaaaagaattttataaaaaaataatgattttagaaagaccagaaaattagaatctgaataaaatcaaa

SEQ ID NO: 5096 - DNA, 82 bp, Methanobrevibacter ruminantium
tttatctctccaaagcttaatagattaatgattaattaaattaataatcaaataatttattttaattagtattatttaataa

SEQ ID NO: 5097 - DNA, 21 bp, Methanobrevibacter ruminantium
tattattttattggtgctcta

SEQ ID NO: 5098 - DNA, 10 bp, Methanobrevibacter ruminantium
aaaaataaca

SEQ ID NO: 5099 - DNA, 114 bp, Methanobrevibacter ruminantium
aaggaaaaagtaaaaaaaggaagaaagtaaaaaaaggaaaaagaagtaaaaatttaaactaaaaaaattaaagctcaaaaactcgaaatctaactttttctaaaagtttgaggg

SEQ ID NO: 5100 - DNA, 244 bp, Methanobrevibacter ruminantium
atatactcagtattactttttgaaaaaattgataaaaagaagatagcaagaggtataaaaataataaaaaggaattataaagataaaaaaaataataaaagaagtataaagataaaagaaataataaaaaaagaattataaagataaaaaaaataataaaagaagtataaagataaaagaaataataaaaaaagaattataaagataaaaaaattataaaaaaagatttatttaaaccatcata

SEQ ID NO: 5101 - DNA, 69 bp, Methanobrevibacter ruminantium
attaatcacaacataaatcaattatttaattatctgacagtctaattatctattatccaattatccaat

SEQ ID NO: 5102 - DNA, 106 bp, Methanobrevibacter ruminantium
aatcatattaataaaatctcttctaaaaaaaataaaaatagatattaaaagtgaataatattctaaagaaaaacataagaaatgttaatccttagaataaagacaa

SEQ ID NO: 5103 - DNA, 46 bp, Methanobrevibacter ruminantium
agaactacctcgcatatcttaaataaataaaattcatccatcaaat

SEQ ID NO: 5104 - DNA, 8 bp, Methanobrevibacter ruminantium
aatatcac

SEQ ID NO: 5105 - DNA, 231 bp, Methanobrevibacter ruminantium
aaaataacctcctatatctaaatttttgtataataattataaataactcaaaaacttattatataatgccaatccccaacttaagaatacttatacagacaatctccaacttaaagggggcatataataatttaagagaataatgaaaaaatttaggtaaaactaaattatgaaatcttaaaacacattataataactaaatacacataatgaaaaatcatgcccttaaaa

SEQ ID NO: 5106 - DNA, 248 bp, Methanobrevibacter ruminantium
tttaaaatgataaaactgattcttttataaaaaaaatcatatgattaatattttaatgaaaataataatttcttaaaactaaaaatattctttataataattaaaaaaatgcaattttaattaataaaaaaagtagaaaaggtttttaaacttttagagtttttaaaactttctaaagtgtttaaaactttttaaactgtttaaaactttctaaagtgtttaaaacttttctacttaattgatattaa

SEQ ID NO: 5107 - DNA, 110 bp, Methanobrevibacter ruminantium
aattaaactccttaaagttacaaaaataataaaatatcaaacaaacaattttaattggaaagttttagaatactttccaagattaagaagtaatactaattttaaaattg

SEQ ID NO: 5108 - DNA, 433 bp, Methanobrevibacter ruminantium
aaaacaagcaaaaataggcaaaataataatacttttaaaatgcaaaaacatatattcaaaaatatgaagatttaaatcaaaaaagtaaaaaatcaattatcagaaccatgataaaattaaggattataaaagaatatattataaaaaaaataattataaaaaaaatatcctaaaaaagaaatattataaaaaaaatatcctaaaaaagaaactattataaaaaaaaatatcctaaaaaagaaactattataaaaaaaaaatatcctaaaaaagaaactattataaaaaaaaataatctaaaaaaaatatcctaaaaaagaaactattataaaaaaaataatctaaaaaaaatagcccataaaagtagattaaaaaaaaaaaattaaaaaagaaaaaggaaataatagctaaaaatagctactatttattaaat

SEQ ID NO: 5109 - DNA, 312 bp, Methanobrevibacter ruminantium
attttaacctcaattaaaatatttttaatatttaatatctaattctattaaatagttttataatctttattcaaataaaatgaatgaattttatttaaaaatgaataaaatattataattataattttgcttattaaactatttaaaattttataaatcatgtttcatttaaattagaaaaataaataaaaatagttcttaaaaaaatacgattaattaaaaaacgacataaaaaagaatatagaatataaataaaaataaaaatagatgaataaaaaaagaatatggaaaaaaatagttaaaaaaataact

SEQ ID NO: 5110 - DNA, 86 bp, Methanobrevibacter ruminantium
ataatcaccagaaaataaaaatatatccaaatataaaaattaaaagtttatttacaaattaagacataattaagaatagaccttaa

SEQ ID NO: 5111 - DNA, 73 bp, Methanobrevibacter ruminantium
ataatcaccatcattttcttctaaatatcaactgtaaaaattaaaatatttttaattgtaaatataaaattta

SEQ ID NO: 5112 - DNA, 173 bp, Methanobrevibacter ruminantium
tttatcactttaataatttttttaaatagattttataataatcaatcacttaatatttatgttaaatcttatacatataattaatctaaattaacttaaataaaataatttatcataagacaaatacaaaaataatattataaaaaatcatatcttaaggcaaaatcatgaaa

SEQ ID NO: 5113 - DNA, 85 bp, Methanobrevibacter ruminantium
aaatgaagattaaagataataaaagataataataagaataaaaaagaataaaaaattttgatcaaactttttctaaaagtttgag

SEQ ID NO: 5114 - DNA, 23 bp, Methanobrevibacter ruminantium
aaaattccccctaaattaaaata

SEQ ID NO: 5115 - DNA, 221 bp, Methanobrevibacter ruminantium
aaactcaccccataattaatataattatttaagtggatttacaatccaatcaaatatttatttaatatttataatgaaaatgattacatttaaagttttctatttaattataagattttaattttgattattaaactaaaagtcaaaaaatcagcaataaaagcaaatcttaagcaaataaattcagaaataataatcaatcttaagcaaataaagcaaaa

SEQ ID NO: 5116 - DNA, 531 bp, Methanobrevibacter ruminantium
tttaaaaaccgattcaattactcaaacccataatcaattatgaacatgattcaatttaaaggaaatgggagagcgattgaaaactaatatttcaaagattaactagagtgacacactaaagactttatattttaaagatcaactaatgataactaaaacttatattttaaagatcaactaatgataactaaaacttatatttcaaagacctcaagcttggaaaactaagaaaaactttatatactaaaaaactaaaggtacctgtagaaaaaatctaagggtacctgcaggaaataataaaaaagatttgaacaaataatctaaaggtacctttaataaatatgaatgagaaaaataattaatgaaaaaataagctaaaaaactttaaaataaaaattaacttaagaaagtttaaaaaaagaaattaaaagaattaaacttaagtttgaaaccacaataaagcagatatattaatcaaaatcaagattaaagtaaaaatttagcttaaataaaactaaaaagagcaaaatt

SEQ ID NO: 5117 - DNA, 44 bp, Methanobrevibacter ruminantium
tatgaaaaaaataacacctcctaaaagagaaggaggcaaataag

SEQ ID NO: 5118 - DNA, 96 bp, Methanobrevibacter ruminantium
gataaattaattttttttatttttcaaatgagtaataaatagaaaagtttaaaaaaagatagattttggaaaaataaataaaataatataaaaaaa

SEQ ID NO: 5119 - DNA, 16 bp, Methanobrevibacter ruminantium
caactagagaaaaaaa

SEQ ID NO: 5120 - DNA, 6 bp, Methanobrevibacter ruminantium
gtttga

SEQ ID NO: 5121 - DNA, 444 bp, Methanobrevibacter ruminantium
ttttattcacctttatttatttaatgaaaagtaaaattctaaaataattttacaattaataatctgtatcataaaagtattaaatcttactatttaaattaaaaataattcattaaaatggaaaaataagtgaaaattattcgataattatcaaataaataatttagttattcataataaataaaataaaaataaacattgttcatttaagtttataaagccattaaaattagaataaaatttattgagaaattgcttggaaacttataaaaaaatatgaaaaaattactcaaacaaataaaggcagatggaaaaaaaacagagatatgaaaaaataaaaaaaatgaaaataaaaagagaaaaaaaactaaacaataaaaagagaaaaaaagaaaaaacaatgaaaaatataaaagtaaaaagaaaaaccattaaaaataaaac

SEQ ID NO: 5122 - DNA, 209 bp, Methanobrevibacter ruminantium
gaaatcaccttataaaatattattttagtaatacttaatatattttagcaaaaatccaaataaaaaaacagaaaaaaacaaaatcgaaataaaataaattaaaaaaaaagttaattgccagcaacaatagataagaataagctaattgcaagaggcaatagataaaaattttggtcaaggcttttagccgaaggctaaaaaagcttgag

SEQ ID NO: 5123 - DNA, 207 bp, Methanobrevibacter ruminantium
ataatacaccttccaaatatataattattaaatcaatgtgaattttttataaatacgattaatattttttaatagtttttctataagtgttaaaataattaattgtgaaatcaattatattaatgagaattagtgaccatattttgaataatatttaaacagaataattgatttttataatgattaaaaaactgagtctaataatga

SEQ ID NO: 5124 - DNA, 163 bp, Methanobrevibacter ruminantium
tctaaatctccaattaaaaaaaatctatttaaaaatataatcaaaattaatattaatatattattcattaatataatataaaactattgataaaatatcaaacagtttaagagtaataaaactaaacaaagattgtaatacctaatctgataataaaaagaaa

SEQ ID NO: 5125 - DNA, 109 bp, Methanobrevibacter ruminantium
caaaaatgaacagtacggataaaactatctttaaaaaaatgattagttgtttaatgtttatcctaaaaaaaggataaaaacagtttaaattaataactgcaaagtaaag

SEQ ID NO: 5126 - DNA, 488 bp, Methanobrevibacter ruminantium
ttaatcaccaaaaatatattaaactagaaaaattaaccgtatcttcttaaaatagaaccttttacaaatcttttaaattaaatgagtgatttaattaagtttaaattaaagtattaattaaaatattgagaaaatttaaaagatattcatgttttatttatattgatgtttataattaaatattactattttaatatttatgaaaaaataagtgataattttggaacaaagcagtaggtttaatattggaatggaaagaagatagaataagttaaactagtaatatgaatcaaaagatagaaaaataattaccaatagaataaattaaaactagaaaaaataatctaaactaaatagaataagttaaaactagaaaaaatagttaaaaatagaaaaaataatctaaactaaatagaataagttaaaactagaaaaaataagttaaaaatagataaaaagtaaaaataattaaaaaaataaaaaataag

SEQ ID NO: 5127 - DNA, 169 bp, Methanobrevibacter ruminantium
aatatggatttggaataaaataagggtaaaaagacttagtaatagttaaaataagaaaataaatgaaaaaaagataaaagataaaaagggaaaataaatgaaaaaaagataaaagataaaaagggaaaataaatgaaaaaaagataaaagataaaaagggaaataataa

SEQ ID NO: 5128 - DNA, 436 bp, Methanobrevibacter ruminantium
attatcaccttccacttaattaaatcaataaaaatggattttgattaactaatttttttaatctaaattattatagttagatttaagtatataaactttttgcatatttgttgatgggagaatcaaaggggtttagaatagttataaattgattataagatttgaaatagaaaaataaggaattacaatatagataaaaataagatataataagaattgataaaaatagttaaaattaataaaaatagttaaaattaataaaaatagttaaaatggataaaaaaataaataaaagtggttaaaagaataaaaaaataaaaaaagaaggtttgagaaaaaataattaattagagtttcccaaactagaaaacattttgatcaaactttttctaaaagtttgagctaattatgagcaggcttagacaagctaacccct

SEQ ID NO: 5129 - DNA, 147 bp, Methanobrevibacter ruminantium
ttaaaacctccttaaagtttttaaattcatacttattaatttttttatcagtttcatttcagattgaagtttttaataatcatttatcattatataatataatcttggtttattatattaatatatattaaactacattcttaataa

SEQ ID NO: 5130 - DNA, 22 bp, Methanobrevibacter ruminantium
atattaattttaaggtaaaacc

SEQ ID NO: 5131 - DNA, 153 bp, Methanobrevibacter ruminantium
aataagtgaaaataattggataataataaaataagaaaaataaattgtaaaaaaaagaacaaaaaagtatataaaataaataataaaaaagaataatttaaaaaaataaaaaagaaaagagcaaatctcaaaaaaaaacagagataaaacttt

SEQ ID NO: 5132 - DNA, 150 bp, Methanobrevibacter ruminantium
tttttcacctttttaataaatatcattaattaattagtcccaagtttatcctcttaataattgattaattagaattattattctcattcaaaattgataattagaattattctcatttaaaattgatttatttaaatttcatctccacat

SEQ ID NO: 5133 - DNA, 36 bp, Methanobrevibacter ruminantium
taaatcacgaccatatttttagttcataattgaata

SEQ ID NO: 5134 - DNA, 27 bp, Methanobrevibacter ruminantium
aaaatagagttaaaaatagtaaaatca

SEQ ID NO: 5135 - DNA, 13 bp, Methanobrevibacter ruminantium
attaaaaaaaaag

SEQ ID NO: 5136 - DNA, 307 bp, Methanobrevibacter ruminantium
ataataacaacatataaatgttggtcaacataatatttaaatctttctattgttttgttaagagaaaatagaaaatattataatattgaaaaactcgatattttttacaaaaaatacaagcaaattataaatactattaaataaaaataaaaattgtttatggtaaaattatattttttattaactattatttgtaattatgaaatatttctaaaaaaattattcttaaaaaaaattccaagatttaaaataatcataaataatagctaatacaaagtatattgattagatgaagaggaatgattag

SEQ ID NO: 5137 - DNA, 8 bp, Methanobrevibacter ruminantium
gtgaaaat

SEQ ID NO: 5138 - DNA, 132 bp, Methanobrevibacter ruminantium
aaggaaaaattaaaaaaccactacctccatactatactcattacttattttaaatctatttttaataaagagattaactattaaaccgccaaaaaggggactattttttataaaaagagtgcaaaagcaaaa

SEQ ID NO: 5139 - DNA, 84 bp, Methanobrevibacter ruminantium
cttataccctccatataaaaattaatacaatgaataaatttaaaaaactaaataatagcccataagattaaaaaagcaaaaaaa

SEQ ID NO: 5140 - DNA, 36 bp, Methanobrevibacter ruminantium
tttgtttttgcatagcttacaaagggccattaaaaa

SEQ ID NO: 5141 - DNA, 121 bp, Methanobrevibacter ruminantium
aatcttatcaattataatatagatagcataattaataaattttagtataaaattcattaaactaattctatggaggtctttatgaaaatgattattcaatgagccctaaatctaaaataag

SEQ ID NO: 5142 - DNA, 471 bp, Methanobrevibacter ruminantium
tttttttaccaacctttacattttttatgaaaaaacttcatatataaaaattgtttttaaactatataaacttaaacagagagcatttgaaaactaatatttgattttggtaaactatacattataaatagtaaatcggatggaaaatcgttctttatatccaaaattaaggctaatttttataaatagttatatatagtaaaccgaaccaaaaaattgtaaaatttagaaaaaatgttaatgatacttaaaaaagctaaaaaagtgcatagaaattaataatggcattcagaaaataataaaaaaataagtgaaaagctaactataatgaaaaaaagcaatccaatacatgaaaattaaaaataagatacaaataggtacaataacaatagtaaaagagataaaataagttaaaaacaaaaatcgataaaaaaagagcaaaataaataaaaaaaaaaataaaaagtaaaa

SEQ ID NO: 5143 - DNA, 58 bp, Methanobrevibacter ruminantium
taaaacttttggtcaaggttttacgattttggcttcgccaaaatcgtcaaaagcttgc

SEQ ID NO: 5144 - DNA, 113 bp, Methanobrevibacter ruminantium
attttacacctcaatttttttaaataattagtttttttaaatagataataaatataattcaaatcatatctttaaagggatatgaccggttaaatccaattaatagaacaatg

SEQ ID NO: 5145 - DNA, 404 bp, Methanobrevibacter ruminantium
tttactaccctccttttaagttttaatacaaaattgttttttaaaaaaccctcattgataatggttttttaaattcagcaccataattaacttaaaaagttttcattttcttacaagcaaagatatatttattttcaaacttaataaaggttttttaaatgcgaaaaagtgattttgtgaaattgtgattctgtgcaaaaatgcaaaaacacaaatgtgattttgtgcaaaaatgctaaaattgctcatagttttaagagataaacttttaaatttagtttgctaaaatgtggctagtgaaagaaaaacagtttatttctttaactttattccacattatctgtgaataaatttatctttttaggttatctttattttaatgaatttttttatgccacttccat

SEQ ID NO: 5146 - DNA, 34 bp, Methanobrevibacter ruminantium
caaatcaaatgtcaggcttgttctcttttgcctg

SEQ ID NO: 5147 - DNA, 12 bp, Methanobrevibacter ruminantium
tctatggctcct

SEQ ID NO: 5148 - DNA, 30 bp, Methanobrevibacter ruminantium
attaccacaggataatatattttaagaagc

SEQ ID NO: 5149 - DNA, 92 bp, Methanobrevibacter ruminantium
gttttgtattaatagtttaatcttttaaatcgtttttaaaattagttttagttaaaataatcaattataattcttttttaaaaaaaataaaa

SEQ ID NO: 5150 - DNA, 26 bp, Methanobrevibacter ruminantium
taaaaattcaattttataaccaagct

SEQ ID NO: 5151 - DNA, 1213 bp, Methanobrevibacter ruminantium
ttgttacctctaaaaaaattttatatatttttaaaaagttttaaacttatagaaaagttttaaactcataagaaagttttaaacttatagaaaagttttaaactcataagaaagttttaaactcataagaaagttttaaactcataagaaagttttaaactcataagaaagttttaaacttatagaaaagttttaaacctttaggaaagttttaaactcataaaaatagttctatacttagcaaacaagcaaaaaatagtttatttcagctataaagaataagtatatagtttaaggtctatcgcaggatatatatatatatatagcgattgttttatattgtgcatgcgccgtttattttaaaaagcgcaaattggcctttgtcggttttaagccataatgcttggaaatcttttttgttttatttcttatattgtggaggcgatgtttgcattttgggccttgctcttttaaaatttgcaaatctttaatttgtttactttgtttagtttttgattgaaatttttgtttcttcggacctttttttcgcatgatttttcttggattgtttaacattgttaaggtttaatctaattttgttaattctgggcaagtggtattaatttgctttttatattgattcagaaataaaaagcagaaagagtattgggtgaatcaaagggttcttgtgttttttggtggcaaaaattttaataaaaataagaatttaagggtttttatcttctttcattggtggaaattttaaaaagcgatatgtggggttttattggtttcaattcttttattggtggaaattttaaaaagcgatatgtggggtttttattggtttcaattcttttattggtggaaattttaaaaagcgatatgtggggtttttattggtttcaattcttttattggtggaaattttaaaaaaagtgatatgtggggtttttattggtttcaattcttttattggtggaaattttaaaaaaagtgatatgtggggtttttattggtttcaattcttttattggtggaaattttaaaaaaagtgatatgtggggtttttattggtttcaatttttttaatggtggaatttttaaaaaaataagagaaggggattgaacccctaaaaatagtttattttgttttattttataggatttgattcctattttttatttgattttatttcgtttataggatttc

SEQ ID NO: 5152 - DNA, 351 bp, Methanobrevibacter ruminantium
gttactgaagttgaatcttgtattgatcctgtttattatgacatctgcgcttgaagtggatcctgtgtagttttcattgccgtcgtagctgattgttacagtgtagtttcctgctgtcaggtcctttgtaggaaccttgatttggccatttgagtcggtaatgaatgtcttcttgccgtccaggtcaattgatagctctgcaccgattataggatttccttggccatcggttaatgttgctacaagatacttttcttccttgcagcttgcattgacatcatctgtcttgattgagctgtttaatttagtacgttatactgcggtttaacgaaaccctataagattctacct

SEQ ID NO: 5153 - DNA, 523 bp, Methanobrevibacter ruminantium
acaaaccccaatgtatacttaactaatcagaataatgaaacattcaagtttaatttagtacattatactgcagtttaacgaaaacatatataattttttaattgtttttaatagtataaattagtttattatgatatcttgagttttagagtatatccttccacttttcccataatcattttcaaaagaaatttttactaactgatctggattattgggagtgatttctaatgtggcattatctttaataaatatatatttatcttcagtgaaagatgtgaaatcaggttctttaaatgatggtggaactctacaaatatcatataaataatctggaagttcaatttttaaattaaaaaaacataatagttctgaaagtttaatatccctatttcatcattttaatgtttaatttagttcgttatacgatggtttaatgaaacaaaaggagaagataaaaaacaataatttttttttaataatgtaatcagataaattatattatcaaagaataataggggat

SEQ ID NO: 5154 - DNA, 384 bp, Methanobrevibacter ruminantium
aatatatattttcagattccgaaaagtctcaaacaggaacgctcgcatccattcaaaccaatgaattctataatatgagttatattcaattgtagattttagatcctaacggcacccttgttttcaatgagagcgtcaagtttgatatgggcaagatggatttaagtgggcttaatgaaaaatgaatgttttctatttcttagatttctaaacccattatttttaacttaaatttaagtaaataaagagtttactagaatgaactcaaattaaacagaaaaaagagttaactaaactgtagtttgaaaaaagttcaaaaacaaaatacttaaatatactaaacgatataatataattatcaatttttattacaatttttcaacg

SEQ ID NO: 5155 - DNA, 412 bp, Methanobrevibacter ruminantium
tttcttatttttttaaaactttttcttttaaatgctaaattataactgtttttattcatctatttcttattttagtttcttaaaccctagtttagaacataaatcaacattttttttaaagaaattctagataaaatcgatctgataaaatttttttaaaaaatctctaagttttcttttgagtaaattatagccataaatcacttagaaaaaattaaaataataaaaaatacataaaattaattagattaattaaattaatagaataattaatttaatagaattattagtagataaattagattaatcagatatcaattatcatattttatgaaagggtgattttattaaagacaaaagcaaatcctcaaagattgatggggatgaagatttaattgaaagatatgaaaag

SEQ ID NO: 5156 - DNA, 43 bp, Methanobrevibacter ruminantium
attgttttttgacaaattaaaacacctgccatacctgccacta

SEQ ID NO: 5157 - DNA, 92 bp, Methanobrevibacter ruminantium
aaattaaaaaaataagaaaaataagaaacaatattccttaaataaaaaaataaagataaaatagataaaaaaaataaaaaaataaaaattaa

SEQ ID NO: 5158 - DNA, 254 bp, Methanobrevibacter ruminantium
tttatcacttaaatataacttaatttaaagctaatctacagattcctaaaaaatatttctttagattgacctatattttttatagaaatcaattgagattaatcgttaattaaaactatcaattaaaaatatgtataaactcttatttaaactatttgataaaaattgttgttttaattaaaatattgctatatttggattaattatattgaaaaaaagataaaaaaataaagtggcattggataatggaaagt

SEQ ID NO: 5159 - DNA, 283 bp, Methanobrevibacter ruminantium
ccacaagttcacaaaagcaaaactaactgacaaaagcttttccaattatgctcagcataagaataatttttattattttaaaaaacactcccattcaccttttttaatcatttaaagatgcaaataagcacttgcattcgaaaaactatttatatactcttgaataaagtaaatactgtgtctgatgtgtttaacttaatcaaaagttaaaaacatcagtcacatatccaaaatatatttttattaaaaaaccaaatgaaaaaaaaaataaaaaggtgaaaat

SEQ ID NO: 5160 - DNA, 243 bp, Methanobrevibacter ruminantium
tttttctttattttcttgttttattaaatttattttacttataatcttatattatttcttttttttatttactaattttatatacttattttatttaaaaattatttaattctttttcaagattttactaattttgcttaatttaaaccagagttttacataataagacattgaccaaagttttcttcattaggagtggtctcttttctttttttcttcatttctctttattttatgttctat

SEQ ID NO: 5161 - DNA, 184 bp, Methanobrevibacter ruminantium
attatctatttatatttaaagtacttataaatctatttattcgcctttaattaacttaattaaggctatttatgcttactatgggtattactcttctttgagaggtttttgtagaaattttaaaataaatatctgataaataaaattattattatcaattttaaggggataatcatcatttaca

SEQ ID NO: 5162 - DNA, 142 bp, Methanobrevibacter ruminantium
atccaaacaccataccttatttattatctatcattttatgaaaaactcaaactatccttgcccaattaagatgaattagttaaaataatttggcttcacattggccaatgtgctcaactagaattaaatggtaattcaggtt

SEQ ID NO: 5163 - DNA, 370 bp, Methanobrevibacter ruminantium
ttcatcacctataataatttacatcttcaatattaatatctattctttaatctaattaaaaattattataaaaatttaggtataattgaagtttatttagttcattaaaccatagttttacgaaacgtaccccccaaaaaagaataaaaaaacctaaaaaaataacttaaaaaaaaacagacaaaaaacactcccctaaagaataaaaaaacttaaaaaaagaaaaagaataaaaaacttaaaaaaaaacagacaaaaaacactccccccaagaataaaaaacttaaaaaaagaaagaaaataaaaaacttaaaaaaaacttaaaaaaccaaataacccatctaaaaaagcacaaataaacaaattcaaa

SEQ ID NO: 5164 - DNA, 376 bp, Methanobrevibacter ruminantium
aactagccccccgattcatataaagaaatctgttaaataatcaagcattcaaattattaattaaaataattcacccattaaactccaaatacaaaaacaaaaaaactcacccattatattccaaattcaaaattaattaaagtttcgtaaaacttgggtttaatgaactaaattaaactcaagtgtaaaaaatatttaggggcctgaattttttgatgtgaaaattccctcgaattttccttattttaattcattctcctaaaaaataagtttaatttctaaaaatacaaatattatttagttatataaaaaaataggtctttaatatcgttaaatttaaataatatgctttacaaatatattattggcgataata

SEQ ID NO: 5165 - DNA, 194 bp, Methanobrevibacter ruminantium
aaaaacagtttatttgaatgtatttttaggagcgctgatagtatctcaaggattttactcaaaaacggccattcaaaagttatctgaaaactgaaatcgtcaggcccctaaaaatattaaaagaattttagaattcatgttaaaaattcaaataaatatataaaatacaataacaaaattttaattaggatact

SEQ ID NO: 5166 - DNA, 10 bp, Methanobrevibacter ruminantium
gagttaaaat

SEQ ID NO: 5167 - DNA, 35 bp, Methanobrevibacter ruminantium
ttcatctttttaatcaatattaaaaaaaaaagttt

SEQ ID NO: 5168 - DNA, 128 bp, Methanobrevibacter ruminantium
tttagttcattaaaccatagttttacgaaacagaataatatccaattctgtatcttccatcctattttaccctttttttgtttaaatttaatccctgcagcctcgcacaatgctgttagtttgacatc

SEQ ID NO: 5169 - DNA, 74 bp, Methanobrevibacter ruminantium
gcgaaatttttcaaataaataatcttcacttaattcttccaacttatcccccccaaactttaaaatttctgaaa

SEQ ID NO: 5170 - DNA, 19 bp, Methanobrevibacter ruminantium
tttatccctttttataaaa

SEQ ID NO: 5171 - DNA, 134 bp, Methanobrevibacter ruminantium
aaataatcatataaacataacaatatttaaatttttatttgaaaaatcttaaaaaaagtaaaaaaaatgcaaatataaaaaataataaaaaaaagacttaagaataaaaataaaaaaagaattaataaaaaata

SEQ ID NO: 5172 - DNA, 53 bp, Methanobrevibacter ruminantium
ttaaatcatctcaataattataaatattctttttaattaaaaggaataaaaaa

SEQ ID NO: 5173 - DNA, 193 bp, Methanobrevibacter ruminantium
aatatcatctaagtaaatagttaaataaaaattaggtaaaataaaatcctaaataaatttaaaataaaaaaattaggtaaaataaaatcctaaataaatttaaaataaaaaaattgggaaaataaaatcctaaataaatttaaaataaaaaaattgggaaaataaaatcctaaataaatttaaaataaaaaaa

SEQ ID NO: 5174 - DNA, 11 bp, Methanobrevibacter ruminantium
gaatagctatc

SEQ ID NO: 5175 - DNA, 35 bp, Methanobrevibacter ruminantium
aataacaccctaaattattaaaattattattttac

SEQ ID NO: 5176 - DNA, 148 bp, Methanobrevibacter ruminantium
agttcgtaattattaaaaccaattgaaattacaaactttggcaaaaccaattgcaaaacatcaaaaatcgaaaatgagaataatcccttaatatgaaaaaaagattaaggtcaaattccctataagttagaataaataaaagcggaag

SEQ ID NO: 5177 - DNA, 94 bp, Methanobrevibacter ruminantium
ttgtttacacacctttttgataaataaaaaaaaaataattatgattttaataaattaagataaaagttttttaaaaacaaaatatcttattaat

SEQ ID NO: 5178 - DNA, 37 bp, Methanobrevibacter ruminantium
aaaagttaataaaaaagaaaagtaaagcaaaaagcaa

SEQ ID NO: 5179 - DNA, 2 bp, Methanobrevibacter ruminantium
aa

SEQ ID NO: 5180 - DNA, 16 bp, Methanobrevibacter ruminantium
aaaaataactccatag

SEQ ID NO: 5181 - DNA, 92 bp, Methanobrevibacter ruminantium
aaaaagggataagacacaaaagaaattgtgaaaatcaagaaaaaaaaataataaagattaataaaaagagataaaggattaaaagtgaaacc

SEQ ID NO: 5182 - DNA, 146 bp, Methanobrevibacter ruminantium
aaaaagtattagaaaaataagaataatataaaaaatgaaaataagataaaaaataagaataaagaaaaaagaatgaaaataagaattaagaaaaaagaatgaaaataagaattaagaaaaaataatgactaataaaaggaaggaaa

SEQ ID NO: 5183 - DNA, 278 bp, Methanobrevibacter ruminantium
ctaatcaaattaacatcatacaataaaaataaaattctttttgattttttcaataaaaaattatacttaagattatctttgattttttcaataaaactatacttcaatataagcaacaaaatatataaaattatatattaatttaaacaaatataaattattataaaataaagtaaaatttcaaaatatttgattataattttatatcaattatgaaaataaactgcaaactactgttagattactgttaaattgacttaaaccaaaaggagaataaa

SEQ ID NO: 5184 - DNA, 210 bp, Methanobrevibacter ruminantium
attaaaagtaaataatagatacaagaactgataaaatctaaattaaaatctatttttttctcaaaagtgccaattaaaaattcatacttaataataggaacatttatatattaacgaacgaaaatatataatcaaattggcataagtttatcaattgttatacttataaacaaaaaccaaaataataaaaaataaatttaaggtgataaa

SEQ ID NO: 5185 - DNA, 145 bp, Methanobrevibacter ruminantium
atagattttttctatttatcttttcattttttttatttctaattttaaactactaattttaactatttttttataaaaactctaaataataatttaaactattttttaaaaaacaccaaatactaattttgactttttaacaagt

SEQ ID NO: 5186 - DNA, 53 bp, Methanobrevibacter ruminantium
attttaaaattaatgattaaaaaccaattaaaacttattttggagattaaaaa

SEQ ID NO: 5187 - DNA, 432 bp, Methanobrevibacter ruminantium
ttatatcttaaataaaaacccttgaaataatcaaaactcttggagttttctaagattatactaaaaaaataataaaaattcaagagctttttaagatcgagacttaatgaattaataaaaaattccaattgtctaatcttattttttaatttaaacagtttttagaacttattcttaagtcacatcaaaattgatgtcaaagtgtgaaattgatttaatttcgtaaaattgatttcaacttgttaaattgatgtcatcttattaaattgatttaatttcgttaaataagaactttaaatcaatataaaaataaaaaaatgctaaacatttattaataatgaaaataaagataaatgtaataagtaaaattaaataaaatgtaaataatttttatctaaaatattttaaaaaaggaagtaaaaggttgattat

SEQ ID NO: 5188 - DNA, 246 bp, Methanobrevibacter ruminantium
aaaataagcactttaactagattctaataatttaaataaataataaagtcgtttaaaaaagaatataagactataaaaaaataatacttttcacatgctctatctcaaattaaattaaatataaacaataaaaataattataaaatttaattttagaaaagggtaaaaacttaatagatcgctgctttttaaaaaaaaaaaagaaaactacgaacatttctcaacaaaaacaaagaactgattact

SEQ ID NO: 5189 - DNA, 216 bp, Methanobrevibacter ruminantium
ttccattctttaatcaaaagctaaaaaaagttgattattaaagaaagaaagacaaataagtttataaagagaataaggaaaaatctggataaaaaaagattaaataaaaaagaaaacaagtataaagtaaaaaaaaaagcttaaacaaaaaaaagaacaaaaatcagataaaaaaggccaaacaaaaagaaaaaaagaacttagaaggttaaagga

SEQ ID NO: 5190 - DNA, 87 bp, Methanobrevibacter ruminantium
agcatcacctaaagataaaaaaatagtaaaaaataaattattaataatttatcaaataactatttgccaaatttaagaaaaagaatt

SEQ ID NO: 5191 - DNA, 460 bp, Methanobrevibacter ruminantium
gatttcacctagaagaaataaaataattttaaactattaaaaatagttcatatacagtttaatatattattaataaaaaacaaataataaaatgttttaaattaataaatcagtttacatttttcaagaataaacttgatttcaagattaaacttgatttaattaaaaatatggattgataatatataaacttatctaaataatattataaaactaaaataaatcatttaattgaagaattttaaaagaaattaatggaaaaagtaataaaattctaataaaataactataaaagtaataaaagtctaataaaaaagatagaaaaaattataaaccaaaaagagaataaacaaaataactattaaaacaaaaagagaataagctaaagaactcttaaaaccattaaaacataaattttatcagttaatttatggcataataaaaaagaaggaggtaaaaa

SEQ ID NO: 5192 - DNA, 34 bp, Methanobrevibacter ruminantium
tataactaaataaaatataataaatgaaaatcaa

SEQ ID NO: 5193 - DNA, 23 bp, Methanobrevibacter ruminantium
tttttaaattggaggatgattaa

SEQ ID NO: 5194 - DNA, 37 bp, Methanobrevibacter ruminantium
ttaattaaactgtcattgattaattaaaaacaaattg

SEQ ID NO: 5195 - DNA, 5 bp, Methanobrevibacter ruminantium
ttatt

SEQ ID NO: 5196 - DNA, 5 bp, Methanobrevibacter ruminantium
ataaa

SEQ ID NO: 5197 - DNA, 459 bp, Methanobrevibacter ruminantium
tttctacttactaaaatatgtaaatgattatatataaatctttctaaaatctgagaaattcatatataaatagaaatatttttaaaaaaaatagacatttttttatccaaatatcttaaaaccgatgcctagaaataaaaattccaatttattaacattcttattctgtaattaattatttatatattttgtggaaaaggaaacctttggaaagtaaaatcttctagaaaactaaaaccacgatgaaaatattagatagatctgaaaaataagataaataaagaccatgaatgcaaatataattaaaaatagagaattatataatgactcgaaaaaaaatagactagataaaataggattgataaaaataaaaaagaaaaagtttaatttgaactaatttttaaaaaatgtttttaatgaaatctgaaaaatagattcttttcattaaaaaaaaataaa

SEQ ID NO: 5198 - DNA, 31 bp, Methanobrevibacter ruminantium
tagttaacagttaaaaacttagataacaaac

SEQ ID NO: 5199 - DNA, 146 bp, Methanobrevibacter ruminantium
attttcacctccaattaaatgttgtactccatattatataaaggttttgatttttaatagtataaaatcacttataatccaatatatagtaatagaaatataggaattcaaataataggaaatattaaaaagtattaaaaaaatat

SEQ ID NO: 5200 - DNA, 251 bp, Methanobrevibacter ruminantium
aatatttaaatcattgtttaatccaattttttaaaagaattttcaaatgaaagaataaagaactttaagaaaaatagatatctaaaaaataataaaaaaatagaaaatttttaaaataagtaatacttttttaaaatatggatttgactgataataatcaaataatcaatcggtcctatggacaatgccccatataataaccaagtaatcaatcggtcctatggacaataatctgtataataatctaataa

SEQ ID NO: 5201 - DNA, 152 bp, Methanobrevibacter ruminantium
attaattcttagttttctattatttatgttcttattcggccattttattatggccttattaaaccgtactacttattcagcagcttaaaagaaactcatttaaaccacaactacttattcaacggcttaaaagaaactcatttaaaccataa

SEQ ID NO: 5202 - DNA, 210 bp, Methanobrevibacter ruminantium
cttgaaaaatcaaatttctaaatttaagataaggaaatttcaaattttaaaaatttaaaaaattgaataaaaaaattaaaaataattgaaaaatgataagaaaaaaataaaatcaaaatgacgtgcctaaaattaaacatatcttaatgtaaactaaagaagaaaatcaacaaattaatttaattaatcgaagaattaatttaaacaaac

SEQ ID NO: 5203 - DNA, 39 bp, Methanobrevibacter ruminantium
agtattcactacaattataaaatattaaaaaaataaaaa

SEQ ID NO: 5204 - DNA, 72 bp, Methanobrevibacter ruminantium
agaaattaaataaacaaataaattaataaattaataaatcaaagagatcacatcaattaattaattatttaa

SEQ ID NO: 5205 - DNA, 197 bp, Methanobrevibacter ruminantium
tataaatatgaatatttttttaaattcattagcactatattaaacaaatgtctaatgatagtcaacatatttaaatgtccatatataatttattaaaataagtatttatatttattgtaaaaattgctattgaaaaaagagttaaaggaatttgtgataatatattaaagaaaaatgttaaaattaagtaaaaaaaa

SEQ ID NO: 5206 - DNA, 30 bp, Methanobrevibacter ruminantium
aaaaaatagttaaaaattaagtaaaaaaaa

SEQ ID NO: 5207 - DNA, 90 bp, Methanobrevibacter ruminantium
aaaaaatagttaaaaaaattactaaaaaaaattaaaaagaagaatggatagaaataaaaattttaatcaaactttttctaaaagtttgaa

SEQ ID NO: 5208 - DNA, 24 bp, Methanobrevibacter ruminantium
tttaccaccgataaatcatagaaa

SEQ ID NO: 5209 - DNA, 8 bp, Methanobrevibacter ruminantium
attaattt

SEQ ID NO: 5210 - DNA, 52 bp, Methanobrevibacter ruminantium
tgctatttaactttgagcaatataaaaataaataatcttaaattgggataat

SEQ ID NO: 5211 - DNA, 200 bp, Methanobrevibacter ruminantium
ataatagacctaatttaagattatttgagtattggaataaaaacaaaacatgaattttaaaaaatactgctaaagcattaaatcaaaaaagagcaaagaacactaattttaaaaagagcagattaaagcattaaatcaaaaaaagagtataaaacactaattttaaaaagagcagattaaagcatagccaaaaataaaaa

SEQ ID NO: 5212 - DNA, 5 bp, Methanobrevibacter ruminantium
ttgaa

SEQ ID NO: 5213 - DNA, 431 bp, Methanobrevibacter ruminantium
tatttgcctcgataaataaatttagtttttttttaatattattttaaaaaatctatttgaaaaaaactgttatactaataaaatttttaacacataataatttataactaattataaataaatttagtgtttttttaaattattttaaaaagaaattggaataatagaaaaaatagaaatataggcatgaagagaaaaaaaggcttatagaaaaattgaataaatgaataaaataaattaaaatgaaaaaaaggcttatagaaaaattgaataaaatgaataaaataaattaaaatgaaaaaaaggcttatagaaaaattgaataaatgaataaaataaattaaaatgaaaaaaaggcttatagaaaaattgaataaaatgaataaaataaattaaaatgaaaaaaaagaaaaatgattaaataagcctaa

SEQ ID NO: 5214 - DNA, 119 bp, Methanobrevibacter ruminantium
aatatcaacatttatatatatgtattattatctaatatactttttcaaaaatagggcaattatctaatttttcaaaaagaacctcatttaaagagagattggaaaaaacaaaataagaa

SEQ ID NO: 5215 - DNA, 31 bp, Methanobrevibacter ruminantium
tctatcaccaaaaattaaaagaaataatatt

SEQ ID NO: 5216 - DNA, 97 bp, Methanobrevibacter ruminantium
actgattaaattcttgaataattatttaaacttttaaaactgattaaattcttgaataattatttaaacttttaaaactgattaaattcttgaataa

SEQ ID NO: 5217 - DNA, 68 bp, Methanobrevibacter ruminantium
tttttagtaaatttttaaagaatgtctaatgaaaaaagttttatattgataaataaatatttaatatt

SEQ ID NO: 5218 - DNA, 19 bp, Methanobrevibacter ruminantium
tggctaaattgaggataag

SEQ ID NO: 5219 - DNA, 124 bp, Methanobrevibacter ruminantium
tgatctaataataagaagaataagataaaatagaaaaatataaattaaaaaaatagagaaaataaaaaaataatgatttaaaaatataagaaaaaatttaaaaagaatagaataataatttaaa

SEQ ID NO: 5220 - DNA, 87 bp, Methanobrevibacter ruminantium
ttaatcacgtcctaatcattgtttaaaaaaataaagaataataaattgctttaaataattaattcattttacttatcttaaaaagaa

SEQ ID NO: 5221 - DNA, 8 bp, Methanobrevibacter ruminantium
aatatcac

SEQ ID NO: 5222 - DNA, 147 bp, Methanobrevibacter ruminantium
agttcacctatttttataaatacccttaaatattaccttaaataattaaaataaatgattataaattaaatttaatcgtttagcaactcaaaatcattacaaattagatcaaatcgtctaagcaattcaaaatcattacaaattaaa

SEQ ID NO: 5223 - DNA, 167 bp, Methanobrevibacter ruminantium
aataatcacaaaaaatatatctaaatataattttatctttataaatttaaatatttagctataaacttctattctataaaaatttgaattgttaaatcgttcaagtattaagcaattcattgaaaattatataagatttatttataatgatatcaaaataattaact

SEQ ID NO: 5224 - DNA, 65 bp, Methanobrevibacter ruminantium
ttataacagctataaaaaataagaaatttaactatttttaatgataaaaagaaaaactaaaaaaa

SEQ ID NO: 5225 - DNA, 115 bp, Methanobrevibacter ruminantium
caaaccacctaatcatttttaaatgaaaggctccattcattataaaactaaaataaactaaaccaagcctaattctgtatgaattatgcagagattggtttaattcattataaaa

SEQ ID NO: 5226 - DNA, 166 bp, Methanobrevibacter ruminantium
acaatctccaaaacttaagaattattgtaattattatctaaacttgtaaaatttattaattttctaaaacttaaatagatttatttatcctctaaaaagacatttatctttttaaaagaaattaacccctaaaaaagtttgataagagaaattataaaaatttctc

SEQ ID NO: 5227 - DNA, 38 bp, Methanobrevibacter ruminantium
tatattaatcctttaaattaaagtgtaagaaatactta

SEQ ID NO: 5228 - DNA, 100 bp, Methanobrevibacter ruminantium
aaaaagaaagaacttctttaattattcaaattattcttaaaaaaaaactaaaaaaagaataaaactaaattaaaaaaaataaaaaaaggaaatgaaagaa

SEQ ID NO: 5229 - DNA, 337 bp, Methanobrevibacter ruminantium
aatttttcaccgtataaaattatactattaaaataaaaagtattactttttagggagtaaacgataaattagtaatacttatttctattattttaatactatacataattaagtaaataagtatataaaaatatatttattactcttcaaataaacttgatttttacaatattgtacaaaataatcccaattaaatttacaaagttaatatttgatataattaagttaataatttattcaaataattaaaaaaataatttacagactaacaattatactttttatcaaaagtaatacaagtataaatataaatattattaaatccaaatattcgacc

SEQ ID NO: 5230 - DNA, 227 bp, Methanobrevibacter ruminantium
ttttaagaaaatagttatttttttatctatttaaaaaattattattattttatctaattttaaaaaaaaatagttattacgcactagtcttaaaaatagaatctaaattagtgctttttgaaattaaaaattaaattaaacttgttttaaaaatagcgtttaaagtgttatttttgaatgttaatatttaaatgaaattaagttgttagaaaaaccctatttttatt

SEQ ID NO: 5231 - DNA, 510 bp, Methanobrevibacter ruminantium
attaacacttcaaggaagttattattttttctaagaaaaaaacatatttagtaatacttttatgcaatttttgattactaataatattgaagtttaaaattatatttaaaacttattatttaatcctaggagaaaggcccaatttaaaatttggctttaaaagtaatactaaatggctaaaaaagaccataaaagtaataaaaaattaaataaagaagagaaaagtattacaaaataaagtaaaatgataaaaaaagtaatacaaaatatgattagataaaataaaaaattggtaaaatagaattaaaaaaataagaataataagagaatagaaaacagataaaaaaaatactaaaaaagatgttagtgtgagataataaaagaggttgaaatgagttaatgagaaacatcttttttagaataaaaatgaattaaatcattcaaataaatagataaatgaataaataaaatttaataaaaggattgttaaatccttttttgatagaatat

SEQ ID NO: 5232 - DNA, 103 bp, Methanobrevibacter ruminantium
taataatcacctaaaaaacattaaaaaattttttaaacatttaaattaactaaaaacattaatgatattttaaatctttaaatcacctataaaacaccttttt

SEQ ID NO: 5233 - DNA, 104 bp, Methanobrevibacter ruminantium
taagcaaataatagttaattgttaaaatcacctagtcaagaaatgactaatatctttaaatcacttattagtcaaaagaatgattaataagttccttttaacaa

SEQ ID NO: 5234 - DNA, 39 bp, Methanobrevibacter ruminantium
caatattaatataggcttaaaacaaaaagggattaaaat

SEQ ID NO: 5235 - DNA, 9 bp, Methanobrevibacter ruminantium
ggcaaatgt

SEQ ID NO: 5236 - DNA, 116 bp, Methanobrevibacter ruminantium
ataaataaaataaagatagaattaaagaattagtcgactataaaaattaaataaataaaattaagacagaattaaagaattagtcgactatagaaattaaaataaagagtaagata

SEQ ID NO: 5237 - DNA, 28 bp, Methanobrevibacter ruminantium
caagatttgaaatgagaaaataaaaaat

SEQ ID NO: 5238 - DNA, 48 bp, Methanobrevibacter ruminantium
taaaaaaattctaatttaacaatttaaaagacttaaaaaggaatcaaa

SEQ ID NO: 5239 - DNA, 152 bp, Methanobrevibacter ruminantium
aagcaatgaaaaatagaataattagaataataactagaatttagattattaatattattaaaattaaaatatttgcttttaaacttattaaaattattatttattaaaattaattattaaatttatatttattattttatggagaaaagaat

SEQ ID NO: 5240 - DNA, 61 bp, Methanobrevibacter ruminantium
aagaataataaactagaattataatcatattttgtaacaagaaaaaaattaaggtgtaaac

SEQ ID NO: 5241 - DNA, 180 bp, Methanobrevibacter ruminantium
tcaagcccaaagaagattgacctagacttctttggaatgcacccataatcaagcccaaaacatatccataaaaatctttttatagaatagcaatcataataataaataattaaagggtaatttatcaattcagcaataaataaaaaagtttttttaaacagaactctaaggagtatttaa

SEQ ID NO: 5242 - DNA, 375 bp, Methanobrevibacter ruminantium
ttcttttttcttttttttaaaacaccaaacatagcctattttagcataaaaactttttactttttttaaattactattatctgcttttaattataggatttccacttaaaaaaataataaaactaaccaataatttaataataataagaaatataattaatatcgtataaatttaaatcaatcttttgattactcatttttatatgcataatcaaacctttgattaattattttttatgcataaaaatgaaactcatttttataaattatacaaaaataaaagaatgctcgtttttattaaaaagaatagaattgagctaaaattttattatcattaaaatagaaactagaatttttaataggtgtaatagagac

SEQ ID NO: 5243 - DNA, 2 bp, Methanobrevibacter ruminantium
ac

SEQ ID NO: 5244 - DNA, 46 bp, Methanobrevibacter ruminantium
attagctaaaacaaaataaataattctaaaacaaaatttaaacttc

SEQ ID NO: 5245 - DNA, 223 bp, Methanobrevibacter ruminantium
ttttctatttttattttaatttttcacactcaacaatattcttataaattaaaatataacaattgttaaactttttatattaaaaaaattaatataaacatataaagaaaataaataatgattaagacttaaataattagtactttaaatgattaaaatttaagcaattaatatttaaatcattttataaaattattttctaaaaaagaattggagattaaaa

SEQ ID NO: 5246 - DNA, 167 bp, Methanobrevibacter ruminantium
attgtttttttaaaaaaaaagactgattaagaagaaataaattctaattaaaaaaagatctaaaagaagaaaaaattctaattaaaaaaaaggcctataagaagaaaataattctaatttaaaaaagacctaaaagaagaaataaattctaaaaaaagattgattaa

SEQ ID NO: 5247 - DNA, 16 bp, Methanobrevibacter ruminantium
ttttatttttttttat

SEQ ID NO: 5248 - DNA, 87 bp, Methanobrevibacter ruminantium
aaataaacaccttataaaaatattataaataaaaaaagagttattttaagtttttaaatttaaattagaatgttaaaaaccttaaaa

SEQ ID NO: 5249 - DNA, 349 bp, Methanobrevibacter ruminantium
aaataattatttctttaaaattttatttataattttttattggcctgatgaaattaaaagaagaaaaaaacttcaaaaatcatttatgaattgaaaaattatatttgaacaattttcagtaaatagatacaatatctgaatgaatcatatcaaagaaattattatatatattatttcgatataaatattattaaccttaaaatagctaaagggaaaaatgaagtaaaacatttcaatcccaaaaataataaaaagggaaaaaaatgaagataaataagaaaagtgataccctatcttatttattctaaacattaataaaatctaaaaaaagcaaatttcaggtgaatat

SEQ ID NO: 5250 - DNA, 474 bp, Methanobrevibacter ruminantium
atttttagggggtttaattcccccatattaactatttttaataaatttggactttattgctccaatattaactatttttgataaatctttttttaaaatttaattattctcataaatggcttttgtttataaaaataaaagccaaaactttttttaactctatttaactcttttttttaactttcttaacaaacctataataaataaaatatctacatgctataatacaaaaaatatcaaatttaaaaaactaaaatcacaaacctttaactcaattaataaatagttatatctattaaaaacaataaaacaataaatgaataaactttataaaaactatatttataaagccatagataaaaaaaaactttataaaaaatatattttttaaagacatagatgaataaaatttataaaaacattatttacaaaacccataaaaattaaaaaactaaagaaataaggagtcttaaa

SEQ ID NO: 5251 - DNA, 80 bp, Methanobrevibacter ruminantium
ctttcacaaaaataactttttatatttaaaaagcaaaactctataaaaaatatcttattattttcaataggaattaatga

SEQ ID NO: 5252 - DNA, 116 bp, Methanobrevibacter ruminantium
ttatatttataaaattaataacttagtagaaaaaaccatagaaaaattaattacttaatctatttacccagcagaatagatttgatttataaaaaaacaattaaaacgtgattatt

SEQ ID NO: 5253 - DNA, 101 bp, Methanobrevibacter ruminantium
aactaaaatcaagaatgaaacttgataaaactattctgatttgacttaagtcgaatcaaaactttttatttttttacacctaaacacaccaagctactttc

SEQ ID NO: 5254 - DNA, 34 bp, Methanobrevibacter ruminantium
ttttttttaaaatctctttattgattatccctac

SEQ ID NO: 5255 - DNA, 384 bp, Methanobrevibacter ruminantium
tttttttcttttttaaaactctccaaaattcattcttaattcatttaaaaaaggacaaaaaatataacttcctatttagataaattgattttaaaaaaactatatcacaactccctaatttaattatttaaaatgataaaatatatctcaaaactctcttaatttacttaatttttagaaaggataaactatatttcaaaactctcttattttaattatccttttttattttttttaattttcttattttaattgtttttattctaatatacttattttactttctattagagttatccatattttgatttaaattgttttaattgatttaaattgattacatttaattattctaagtttactcattctatttttatttcaaag

SEQ ID NO: 5256 - DNA, 69 bp, Methanobrevibacter ruminantium
gaaaaaagggaaatatttaatactaagttcgaatataatattacttaactataaaacggaggtgaaaat

SEQ ID NO: 5257 - DNA, 298 bp, Methanobrevibacter ruminantium
gataattaatttatcttattttcaaattttttaaatttttaatttttttgtattactttttttaaaactgatttttatttattatcttgacttattttgaagttataactgctataaactgatttattccttattttaacttattttgaatttataactgcttttaaagtgttatttcttaaaaaaaagaatttaagataattatctgccaatttaaaaattatgttaaaataaaaaaaagagtttcaagacaattattcagcgaatgaaaaactatcttgacttatttaaaaaaaaa

SEQ ID NO: 5258 - DNA, 185 bp, Methanobrevibacter ruminantium
cttaaaatctccattataataaaaatatacttgaaattgtctaaaataataaaataaaaatcataattaaattgcataaaataataaaataaaaataatctacctttaataaaataaaataaagaaaaaaagaaatctaaaataaaaataaacattaattaactaaataagtccaataaaaaaaa

SEQ ID NO: 5259 - DNA, 55 bp, Methanobrevibacter ruminantium
aaaaaccctctttttattttttataaaaaaatcaatatgataaatttagtcaagc

SEQ ID NO: 5260 - DNA, 101 bp, Methanobrevibacter ruminantium
aatatttattaaattcaaaattgaaaaaaacagaaatttaaattaaaaaagtaaaattaaataatcaaaaataatttagatggaaataaacggggctaaac

SEQ ID NO: 5261 - DNA, 127 bp, Methanobrevibacter ruminantium
ggaatctgaaaggatagttaaaaaagtagctggaaaagaagagaaagaggctatgaatattttaaaagagaatttgaaagagcagggctttgacgtttaaaataaactaaaaaaaagagttaaaaga

SEQ ID NO: 5262 - DNA, 250 bp, Methanobrevibacter ruminantium
ataatcacctgtaataatactgaatactctaaaaaagttttaagatagtttaaaacactgaaaacttatttaaaacataaagtagttttaaaatacttacaatctttgtaggttaattgctaaaaatgtaatttgaaacaattaaaattatgaaaataattaaaataataattaaaaatagaatagaggagtttaaaacccctttcaatgaaataaaattaaatattattgacttaaatagtgaattgac

SEQ ID NO: 5263 - DNA, 169 bp, Methanobrevibacter ruminantium
attgaaaactcccaatatctaattttttaaaaaaaaatatgatttaacttaattaaaaaatatgatttaacttaattaaaaaataatgatttaacttaattaaaaaataatgatttaacttacaatgctaaaaatataattaaatcggatttataaaaaaataaaaaat

SEQ ID NO: 5264 - DNA, 352 bp, Methanobrevibacter ruminantium
tgaaaatctccttatttttaatacaaaaattaaattgcttaaataattgataaatactaaaattaatttatattcaattagaaataagcccaataaaaagaattgagttctatatttaagcaattttttaatatattcttttattcactataatatattataatataactattagttaaagtgatatttatagtatttgaaaattttactagattaattataaaaaagaagaaaaaaataaaaataattaaaaaattctataaaaataaactaaaaaaaagaagaataaaataaaaatattaaaaaattctataaaaaataaaaaaagaagaaaaataaagggtttatctga

SEQ ID NO: 5265 - DNA, 116 bp, Methanobrevibacter ruminantium
gagtaatggactgatgctttctggtaaaaatattgccggaatccagaatatccaggtaaaaacataggccagagcaaaaaagagaaccggtttataatggtatttttcagtgctgt

SEQ ID NO: 5266 - DNA, 43 bp, Methanobrevibacter ruminantium
agttgcctccaaaaaaggccatcaatcggtttttatattatga

SEQ ID NO: 5267 - DNA, 142 bp, Methanobrevibacter ruminantium
tttatgggcaattataaataaataataaaagtagttttagaataaaaataaaattacaaaaataaaaaaaataaaagcagtagaataaaaatgaaattatataaataaaaaaagtagttttagaataaaaaaagaatttgac

SEQ ID NO: 5268 - DNA, 50 bp, Methanobrevibacter ruminantium
ataaatcactaattttaattttaaatgaataactaataacgaataataac

SEQ ID NO: 5269 - DNA, 194 bp, Methanobrevibacter ruminantium
attacgaataaataaaaatatttaataaattaatatattaaaaaaaataaataataaattaatataacttataaattaaaaactaataaataagaaataaattccattagtagaataaaagaaataataaatttaaacatttaaaaagaactaatgagaattaataaaaagttaaaaaataaaaatgtggtaaa

SEQ ID NO: 5270 - DNA, 280 bp, Methanobrevibacter ruminantium
aagttcaaaaaagagaagaaaataatttttattataaaaaatataaaaaatttcaataacaaactcaaaaaaccaatatttgagaataaactctaaaaaaacaaatatttaaaaaaaaactcaaaaaaccaatatttgagaataaactctaaaaaaacaaatatttaaaaaaaaaactcaaaaaaccaatatttgtgaataaactctaaaaaaacaaatatttaaaaaaaactataaaaaagtcccatttattaaactaacgaaaataaggaggtaaaag

SEQ ID NO: 5271 - DNA, 55 bp, Methanobrevibacter ruminantium
ttaacttttataaaaaataaaagttaataaaaactctgttttaaaaataaaattt

SEQ ID NO: 5272 - DNA, 157 bp, Methanobrevibacter ruminantium
ttaactttatttttttaaatttttaaaaaataataaaaacttaactttttttattaaagaaaattatccgatttaagtaaaaacaatcttttaaacaaaatcccgattaaaagaaaatatttttattaaaacgattattaagagcaagagtgaaaaa

SEQ ID NO: 5273 - DNA, 268 bp, Methanobrevibacter ruminantium
atgaataaataaatttctattctgcaagaaaaaactaaataaatattaatcaatcaaataattatattaagaataatttacaaaattattatgataaagatttgataaaaaataacttttattaattaaaatttagttaataattgaaaaaagaattattacacaaaattaagtttaaagccaaatcttaatgaaaaaacaattcttattcaaaattaagttcataaattcacaaatttttatataaaaagctaataggcctgattag

SEQ ID NO: 5274 - DNA, 131 bp, Methanobrevibacter ruminantium
aacttaatcactttttaattttaaataatgtatttgtttaaaatgtattactaaaatgataaaaagatgcaaaatgataatatcaaaataacaaataatgcataaataaaaaaattattctaattctgcag

SEQ ID NO: 5275 - DNA, 9 bp, Methanobrevibacter ruminantium
ggaatatct

SEQ ID NO: 5276 - DNA, 168 bp, Methanobrevibacter ruminantium
aacagcttaaaataaaaaaaataataaaataaagcaaaaaaacaatattatttaatttaaaactttacaacttactacactcaaaattcaactaaagataaaccttaaatttaaaaaagaaagataaatctaaattcaagataaattattcataagtgaggaataaaa

SEQ ID NO: 5277 - DNA, 197 bp, Methanobrevibacter ruminantium
tttcttttttttattaaaaactaatttagttttatactttacgaataaataatattttcctaaaaaactgattttcctaaaaagaaattttccctaaagctaatttttcctaaagctaatttttcctaaaaagctaattgaatttatatccaatgaaaacaaaccatctttttttaaaaaaaaaaaaataattaaac

SEQ ID NO: 5278 - DNA, 165 bp, Methanobrevibacter ruminantium
tttaaacaacccttaattttaaaatacccataaaaaacatgttaaaaatactttttataacaagcaatttttaaagctataatatacaatataaaagtagaaatataaagattttactaaaaaagaccgtttaattaaatgttaatctaattaagtactataatc

SEQ ID NO: 5279 - DNA, 73 bp, Methanobrevibacter ruminantium
agaaaaataaacaaaaaaatgaccaaaaaacttataaataaagaaaactaacatttataaaagggtgatatat

SEQ ID NO: 5280 - DNA, 37 bp, Methanobrevibacter ruminantium
atatcaatcttagaatctttaaaataaatttttaaaa

SEQ ID NO: 5281 - DNA, 142 bp, Methanobrevibacter ruminantium
actttttatatttttctatttttaaattcaacccattttattgaaattataattttttcataattataactattttttaagaaaaaataatatcataattactatttaaaaaaaaaaaataagtaaaattaaaaactatttt

SEQ ID NO: 5282 - DNA, 246 bp, Methanobrevibacter ruminantium
tataattccaccataaaaataagtttttcaaataaatcatttattttaaaatcgtttataatcttcttttcaaacaataaattactattaattaatcttatacttattttataattagataaatatatacattattgttaaaaaatatacatttgtttcaataatgcaaaacataaaacttaaaaagcaaaaagaaaagactattaaataagtttaaatagcaaataataagaaataagtgatagc

SEQ ID NO: 5283 - DNA, 584 bp, Methanobrevibacter ruminantium
aaaaattaaaaaaattgacttcacttaaacaaatttttttaaaaatcaaaatttaaaaaaaccaccaaataaccatacttaccaaacaaataataaatcaaatctctctataaaaaatacttattttaaactaatttaaacttttttaatcaactttaaaccatttttacaatttaactatttttccaccaaaaaaaccatttacagcatcaagtcaattttgacatgatccaaaagtaaaaaaatggcaaattttaacacattcaagtaaaaattgacctaaatctgtaaaattccattcaaaatccacatcactttttacactttcaagtcaaaattgatgtgaagctgttaaaaacacccccaaaattatcaaaaattttacaaggtcacatcaatattgttacaagaatagtaaattgttttgatatgaaaacaattttgatttaaatgcgtaaaattgttacaatatcgtaacaattttctaaaaagaatgtaaaattgatttaagagtgttaaattgatgtaaaacaaaaaagaaagatttataagtcattaaatcgaaaataaaacatggtgattcc

SEQ ID NO: 5284 - DNA, 202 bp, Methanobrevibacter ruminantium
aaaaagaaactgataaaagaatttttaaataaattgacaaaatcctaaagcaaaacaaaggattaaaatggaaaaataaatagcaaaatcctaaagcaacaaaagattaaaatggaaaattcaaagtataacgaacatttgaaaagcgctacaaagatttaaaaactgcaacgaacatttgaaaagccaaaaggagactaaa

SEQ ID NO: 5285 - DNA, 39 bp, Methanobrevibacter ruminantium
agtttaaataagctcaacattagaattttttagctttaa

SEQ ID NO: 5286 - DNA, 94 bp, Methanobrevibacter ruminantium
ttttacccccttaaaaataaaaatctataaaaattaaaaacaactatcaatcattaacataactaaaaataattttcaatcaattgatctaaaa

SEQ ID NO: 5287 - DNA, 91 bp, Methanobrevibacter ruminantium
atactcaccaaaaacaattaaaactattaaaaattaaaataaaatataaaagcatctaacttaaaaaattaaaatttttacaataaactat

SEQ ID NO: 5288 - DNA, 88 bp, Methanobrevibacter ruminantium
aaaaatccctttaaataaaatataagtatgactaattaaaatactaccataagcataattctttaataaaaccatcagtgaaaacaga

SEQ ID NO: 5289 - DNA, 238 bp, Methanobrevibacter ruminantium
aattataagttgactttaattagatataaaattttataaaaaattatcagatgattaaaaaaaaaatctaaaaaactaatcaataaaaatataattaaaaataagattaaaaaattatcaataaatttataaattattaaaaataagattaaaaaactaaacaaaaaaaaattaaaaaattaaaaaaaatcagaccactaaaaaatataagtaaaaactaaaagatcataaaagctaa

SEQ ID NO: 5290 - DNA, 735 bp, Methanobrevibacter ruminantium
tataccataatatcacatttaaaaagttttgttctctaataaatatctgtgttttaaaaagctttctcctataatagaatacctgtgcttaaaaaaagctttctcctataatagaatacctgtgcttaaaaaaagctttctcctataatagaatacctgtgcttaaaaaaagctttctcctataatagaatacctatgctttaaaaaagcgttcttctataataaaatatctatgtattaaaaaattatcttcaagtattatttttatagttataaacttaaatagattattatatggattcgatatttaatgctttatttttaaaaatagggcataatgcttaaatgaaacaataataaaaaaaaaagaataaattaaaaagaaaaaataagaaaaaagtaagaaatgaccttaaaaataaaaaaagtaattaatagcctaaaaaataaaaaaaagatgaaatactaattctatcaaattatttcaaatcgattaaatatcaatagttctaacgattccttgagcgttcactataccatactgccaaatttatatattaagaaatatctaataaaaacgcctttatcttatttatcttagttaaatttattatttttagaaaattaagtaatcttaacgctttaatacttaattgacttatctattaaagagaaaagttttagtaataattataatataataaaaattataccaatataaccgaggtgaaaaat

SEQ ID NO: 5291 - DNA, 407 bp, Methanobrevibacter ruminantium
ataaataaatgaagattaaactaagctaataaaaatttttattgatttgacttaaatcctatagtttttattatttgaaaattttattatttttttattaagataaattagttcttttttatcttaaattatttttttataactttttttcattttttaaaattcaaaaaaccgctatcttttaaaaattatttaattttttactattttttaaaacactaaaaaaatgctttgatagaaaagaagatgggccatgaaaacaatgcaaagaacttcttgttcttaactggaatttaatgatacagtaaccattagtttcttaaaaaaaatgtttttaaaaaaaataagcatttcaaaaaagtaagaagattataaataataagaaaaaaagtaaaaaaaagaaaaaa

SEQ ID NO: 5292 - DNA, 346 bp, Methanobrevibacter ruminantium
aatttattctccataagttataaaaaataaaaagaattgatcttttcaattaataaaactaataattaattaaaataataaaaataaccgttttataaaattcaactatatttcaactaactatacttaactacaaaagacattttaactattttttagctacttttactaaattaagtaaatattagtttatattaattagagatattaatcaaaattctcaaatggtctaaaaagcgcaaaaaattagtttaagcttaagatacaaagggaatttgaaaaattaatatcgagacattggataagatttcactaccataaatctaaattccaaaataaatttatt

SEQ ID NO: 5293 - DNA, 411 bp, Methanobrevibacter ruminantium
ataaaaaactataaaaaatcacaaaataacagcaaaaaattggacttttttaagaggatatggaaatctttttcaagccaaagagacttatgattttttattcattgtatataaaatattgaaataactaaacataatataattattttgtataaaaatagacaaagtagtatatttaaaatattttaaccaatattcattttcaaatccgaaaatctggatttcagtagggtaggaaaataaagtgccgaccaaaaatgaacaaaattatatagaattaataaaaattatggacaataatacaaacaaaacattaagattctgaacgctagaaaaattcaaattttttaaaaaatagtaaagttttgattaaagttttaaaaaaataactacttttcatcagtgataaaa

SEQ ID NO: 5294 - DNA, 89 bp, Methanobrevibacter ruminantium
acgaaaacattaattaatagataaaccataattttaattagaaataaattgaataaactatttaattaaaattcaaaaagggattgaaa

SEQ ID NO: 5295 - DNA, 354 bp, Methanobrevibacter ruminantium
cttattttttaaaaataatatgttttagccacttcatcctttaatcattttttgaattcattagcgaaaatatatttttttatattgaaaaaacttatttttttaatcaaaaaacgaaacatttatatgctttcataacataatataatacgatatgtatttaattgcatatcattaataaaaaattttataatctccaatacaaaatgatttattaatttatcaattttaatttaagaggatatttgttaattttctttaattttaaaagtcctatataaattaccttaaaacttgtttatttatacctcccgtataaatattcttattataaattacctaaatactataaat

SEQ ID NO: 5296 - DNA, 311 bp, Methanobrevibacter ruminantium
tgaaaaaaataaaaaatataactaggattatacatccattggataaagggaataatcaaatttatttgattaaattatcggaacatagttaacaaagaacctttataataatttataaagaagacggataaaatttatcaaataaaagtttagaaactaacacaagaacactatgttcccttttccaatctttttttgactttttttatcaatcttatctctctttaagaccatgccaacttttaaaaaagagatataaaactatttttttaaataagagataaaccttaaactatttttaaaaaacaagc

SEQ ID NO: 5297 - DNA, 140 bp, Methanobrevibacter ruminantium
taatgattaataattaatttaaaatattaaaatcatgaaaaaaagtaaaattaattaataaaaaaaaagggtgcttattaacacaggcccaccataaacctgctctagaacgttaaaaagcaaccctttttacaccatac

SEQ ID NO: 5298 - DNA, 178 bp, Methanobrevibacter ruminantium
ataatatcgaaaaaagagaaaaaattaaaaaatagaataaaatcaaaaccaaattttaaaaaaataagaaaaatcaaagaattacaataaatttaattcaataaaaataaaaacaaaaaaataagaaaattgtaaagaattgcaacaaattcaatttaaataataaataaattcttta

SEQ ID NO: 5299 - DNA, 455 bp, Methanobrevibacter ruminantium
aacaattcaattctcaattaaaatatcttaaaacttctaaaaacattcataacaattcaattctcaattaaaatatcttaaaacttctaaaaacattcataaaaatataacatacggcttataaattgaactatcaaattttagtaaatatattttttatttttccatttatttatttattcatttgactttaaagaactaaatcaaacttaaattagacattcctttagaaatccatttatattggtggggagaactataatttcactttaaataacatgattaagtatccaagcgaaattaaatagaaactcttatataagtattcatataatataaaaaatatatttataaaataatatatcataaataatatatcaaatttgggattggtatgagtgttggcagaaattattttttcttgaatatttttcatttttcctaaactatttttt

SEQ ID NO: 5300 - DNA, 49 bp, Methanobrevibacter ruminantium
atcaatcaaaaattcatataattatctgaatagttataaaattacttat

SEQ ID NO: 5301 - DNA, 452 bp, Methanobrevibacter ruminantium
atttgaaaaaaaaattaaaaaagtgtaaaaaaaatagaaattgttcaaatgttaataatttttgccaacactctttaatttgttacacgttctcttttttaatctctttttgtttattaaggaatttttaaatttctttcttttttatctttcataattatttcatttataatctctgatgattattgggatgatggttttaatagttttgaatggtaaggaggaattgagatgagatagtattaaaaagaataaaaattaaatatttattcaaaagagaaatgaaatgacaaaaacaattaagaatacttgccaaaaaaagaaaaataaaaaaatcaaaaaatgaaagaaaaaatctatccatttaaacaaaataatccctaattaaattaaacaaaccaacaacaaatataataataattaatcataaaatcaatttaatcaaagatacc

SEQ ID NO: 5302 - DNA, 174 bp, Methanobrevibacter ruminantium
cataaactctttgtaaaaaaagattaaaaaatagaatttgaatcaatagccgcaactattgactctaaacaataaaaaagcaatttaaaaaagcaattttactaaaacaattgtaaaaaaagaattaatttagaaaagcaattttaatagaaacaattgtgaaaaagaataaat

SEQ ID NO: 5303 - DNA, 1138 bp, Methanobrevibacter ruminantium
aatatcacaataatagtttaataaaagaaaatataattataaaataaatttttaagtttaatacaataagatattggtcttttttaaataaataacttattataaaaacaataagaagatgaatagaaatagataaatggaatttttaaatgataacattctccaattaattagattaaaaaaatagctaaaaatttaaaaaatgagctgtaatatgtggacaaattccccaatgaccacatactttccagcacttatataaacgatttttaaaaacttgttttgaactataaggtggccccttacaagtaaacttgtaatccatattatataaaaagcattatataaagattttggataaaagaatgaaaattaaactagaaaatgaaaaaataaggaaaattatgatgtatttttataaatagtaaactatacataaaaatggagaacatcctccaatcaattagattaagaaaaattaatgaagagcatactcaagagaactaataaaaacttcagctcatcacaataagattttttctaaatataaggttgtactaatgacccaataattataaagagaataccaataatgatataaatgactccttctattatcaaagtcatactaattacccctccattagaagaactttgaaatgaacaactggtcgtctaagtcaaaacaaaattcagctatataaaattcaactattatgcttctttagtattttttatatagataatgaggaatactatattctaattaaataaagaatattctcaattataatatgaataaaataagatatataaatagtcctaatgcgaaaaaacacaaaaatgaaaaaatgaaaaaaacaacagaacacaaaaatgaaaaaacacaaaaatgaaaaaatgaaaaaaacaacagaacacaaaaatgaaaaaacacaaaaatgaaaaaatgaaaaaaacaacagaacacaaaaatgaaaaaacacaaaaatgaaaaattagataagtatactctaaaaagaaatgataataattgaaaaagactagaaaagtaaaaaaagaaaattattaaaaaaagagctgttatatgtggtcacattcctctaatgaccacatattaatttcagcaatcaaatag

SEQ ID NO: 5304 - DNA, 30 bp, Methanobrevibacter ruminantium
acaaaactgtttttaaaaaataagtaaatc

SEQ ID NO: 5305 - DNA, 4 bp, Methanobrevibacter ruminantium
acta

SEQ ID NO: 5306 - DNA, 82 bp, Methanobrevibacter ruminantium
aaaaataaatgtaaaaaaactaaaaaataatagttaaattaaaattaagaagaaaagaatctttgaaattcaattcacacac

SEQ ID NO: 5307 - DNA, 106 bp, Methanobrevibacter ruminantium
tataatcactctaataaaaataataataaaaagaattagaaaaaaaaaaccaattcaataataaataaaaagaattagaaaaaaccaattcaataataaataaaaa

SEQ ID NO: 5308 - DNA, 46 bp, Methanobrevibacter ruminantium
aatgataaataagattaaattagaattttctaaatcgatgaattat

SEQ ID NO: 5309 - DNA, 122 bp, Methanobrevibacter ruminantium
aatatcatcctcataatcataatatagaaagtttttaatcgtttttaaatttaaaataataaagtgttttatcaaaatcaaactttaaataatttaaaaccattaataatcccataaacttc

SEQ ID NO: 5310 - DNA, 90 bp, Methanobrevibacter ruminantium
aaatctttcctcctaattctcaccataaataataaaggtttatttctaattaaaaccttaaattaagcattatctaaaccttaaataagg

SEQ ID NO: 5311 - DNA, 489 bp, Methanobrevibacter ruminantium
taataaaatttgtaataattattattcgattaatcagtagtttaaaaagatttaaaaattgcatttacagttttaaactactgaaatataaaaataagaataaatgacctttttaaaataaatctaaataaaataagttttattttaataggcgaaaaaatatccttatttatatatattaaatatatgtttatttctaattatataaaatagtttttaattgattttggataataataaataaattaaaagtatgatgccttaataggaatttctttaagacatcctcaagcttaaaaatagattaaaaataataatattaataagttttaaaaagagaaattataaaaataattgctaaattcacaaatataaaataagaattggaataagactaaaagcaattaaaaaaaaagcacaattaaaaaaataaattaataaataaaaaaaaggaataaaacaccaaataaagaaaaaaataaaaaaaaa

SEQ ID NO: 5312 - DNA, 36 bp, Methanobrevibacter ruminantium
taaaatcaactcttaataaaatatctgatatctccc

SEQ ID NO: 5313 - DNA, 239 bp, Methanobrevibacter ruminantium
ttaatttctccccaaaaaataaacataaaaacaataattgtttaataataagccatagggcaaataagagccattagttaaaaaaaacccaagatcattaaaaagaatgtaatggcttattaaataaacttaaataaatcatttaaatagttaaaataattcaaataatttatttaaacttatctaaaaatagaaaacaccttaaacaagttaaaaggctttataaaataaaaaaaaaa

SEQ ID NO: 5314 - DNA, 15 bp, Methanobrevibacter ruminantium
ttaaatactatttac

SEQ ID NO: 5315 - DNA, 193 bp, Methanobrevibacter ruminantium
aaagaactgtgaatcaaaataaaagaaaataaagaaaaaatagaggactttaataaaaataaagagttttaaactaattttttaaaaaaagtttaaaaacactaacaacatataggcataaaaacttatcttgaaaatgaacataacataaatgtttcaatcatgagaaagtgtgaaattgcccaaataaaaa

SEQ ID NO: 5316 - DNA, 10 bp, Methanobrevibacter ruminantium
tcttacacct

SEQ ID NO: 5317 - DNA, 315 bp, Methanobrevibacter ruminantium
taacttaaaaccgaataataaatttaaattaaataattgaaatctttaaattaatttaattattcagaatcatctgattcctcatcaggatctccaaattcttctttaatgtattctgcccatccatcagattcatctatttcctctgaatcttcagaatcattggaaacagattcttcaatatcttcagttaaaacttcatctgaagattcttcattaactataggccctgaatattcttcaatatactcctcttcaatataaacttcttcaataggggcatcttcataaatatcttctaaagaatcatcatgt

SEQ ID NO: 5318 - DNA, 257 bp, Methanobrevibacter ruminantium
attgcacaccaaatatagtttagtagttttttgaattgattaaatcgaaaattcagtcttttgaatgatttaatcaaatttttgtcttttatagtttctcaaaattgaataaaaattcgtattctatagttataaatgcttaaataagtataataaaaacacaatttttaaaatagcaattaatatgccattgttcttaaaaataaaaaattcaacccattgttcttaaaatataaaaagttcatcaattatttaaa

SEQ ID NO: 5319 - DNA, 212 bp, Methanobrevibacter ruminantium
aaatatattttagtaaaatgaattaataaatttaattatatttttctggccagtaataaaaattaaagtaaaactttgaataaataataattctaaaaaaaaatctcataaataaaaataacaaaaaactatttaaaatttaaatctcatatgattaatagtaattataaaaaaacaagttttaggtatttaaaaaatagcaggtgatttag

SEQ ID NO: 5320 - DNA, 36 bp, Methanobrevibacter ruminantium
aatttaaaaaaattaaaccttttctttagacaaaac

SEQ ID NO: 5321 - DNA, 79 bp, Methanobrevibacter ruminantium
gataagaaaaaaataaaacagttctttaaaaaagataagaaaaaataaaaaaaagaaaaaaacatttgatataaatcaa

SEQ ID NO: 5322 - DNA, 42 bp, Methanobrevibacter ruminantium
cactgaaattaaataaaacagttaagattcttattaaaccac

SEQ ID NO: 5323 - DNA, 515 bp, Methanobrevibacter ruminantium
aaaaagcctcctttatataaaataagttcaaataatcattaattgaaaaactttcttatggaaagttgtttaaaaacttattgattaatatatcttttattctaatcaattaataaatattttgttagaattaagttaaagaatgataaaaagaaaaaaagctttttgctagaattaacttaaagaatgataaaaagaaaaaagtcttttgttagaattaagttaaagaatgataaaaagaaaaaaagctttttgctagaattaacttaaagaatgataaaaagaaaaaagtcttttgttagaattaagttaaagaatgataaaaagaaaaaaaagttttttgttggaattccatctgaaattaaacatttggcaatagaacatttaatctcaaacagaaccccaacaattctaatatgaggtacgaataattaaataaaactaaaaaataaaaataggaataaataattaaaacatatattccaatcaataataaaaaagatataaggatttaa

SEQ ID NO: 5324 - DNA, 9 bp, Methanobrevibacter ruminantium
gatatcacc

SEQ ID NO: 5325 - DNA, 43 bp, Methanobrevibacter ruminantium
tcaatgacctctaaataaaaatttaaataaaaatatattgtga

SEQ ID NO: 5326 - DNA, 7 bp, Methanobrevibacter ruminantium
aaaaata

SEQ ID NO: 5327 - DNA, 39 bp, Methanobrevibacter ruminantium
aaattatacttataataagaaaaatcatggagaaattat

SEQ ID NO: 5328 - DNA, 78 bp, Methanobrevibacter ruminantium
actattaaattaatttgattaataattagaattttaataattgataaataaacaaatattagtatttaggatgatatt

SEQ ID NO: 5329 - DNA, 221 bp, Methanobrevibacter ruminantium
atcttcttacttttctttttttattttatttaacatttaaaacttttttaactatttttaaacttaataagaatttttaaacttatttaaccatttttacttagaaatttaagcagaaatatcctcccacatctatttttataaacgtaaccaaattaattaaaaaagattaaattactttactaacatacataatattaagaaacataacggagaataaa

SEQ ID NO: 5330 - DNA, 15 bp, Methanobrevibacter ruminantium
caaaaggaacttcct

SEQ ID NO: 5331 - DNA, 92 bp, Methanobrevibacter ruminantium
tattcttttttttaaaaatattagaaaaatagtttatatataatttccagcccaataagctggaatctattcttttttaagtatgtcatttt

SEQ ID NO: 5332 - DNA, 170 bp, Methanobrevibacter ruminantium
tttaacaccaaaccaaatttgtaaatttatcaagaaatgaaaataaataaaaatttaaaaattaatcaaataattaaattttataaaacaattaaaataattagaataattaaaaaactataaaaaattaaaaatgaatgattaaaaagttattaagagcaattagctag

SEQ ID NO: 5333 - DNA, 107 bp, Methanobrevibacter ruminantium
cttatcctctcttaaataatcttaattagtttaataatacaatgaatgtttatttagaatgattcaagttttttccctcaaaatgactcaatttgttttcccaatat

SEQ ID NO: 5334 - DNA, 107 bp, Methanobrevibacter ruminantium
ttaatcaccaaataattcattgtattttgttgaatttctatagttagttaaataataaaaataaaatttaaaattcctataaaaccataagaatcttcaataaaaac

SEQ ID NO: 5335 - DNA, 128 bp, Methanobrevibacter ruminantium
atttgaaatttgaaatattttaagttaactattaaaaaaagaatattttaaaaattgaattaatgctaaactattaaaagaaaaatggaaaaaaaaacaagtgaaatattatcaaaaaaaagaaaaga

SEQ ID NO: 5336 - DNA, 78 bp, Methanobrevibacter ruminantium
ttaaatcataaaaagaattttaaaatcaaacatataaattagttttagccgtttggcaaatattaattaaaacagata

SEQ ID NO: 5337 - DNA, 273 bp, Methanobrevibacter ruminantium
aagaacattcctttaattttttttatcatttttcaatttgcatatatactttatatttcatctataaaaaaattttagatagttgtaaaaatttaaaccaaaaaaagaaaaataaagggtagtgaaaaaaatcaaattaaataaccccaatggctaaaaattagatatctataaaaacaacaatttacaataaaataatatagacaattaattaaaattatctatcaaatttatcaatagattgcattattaaaaaagagagaaggtggaaaa

SEQ ID NO: 5338 - DNA, 94 bp, Methanobrevibacter ruminantium
tttacctctttttaaaaaaagagttaaattaacagatttattgaataaataatttttaataagaaatgactattaaatattttggagattaaac

SEQ ID NO: 5339 - DNA, 303 bp, Methanobrevibacter ruminantium
ttattccaacagaaactttttaaaacaatcccccaccatcaagaacatataaaaacacagcaccactttttaagtaatatttttttataaaaaattcctattttacaagcttattttttcaaattcgaaaattaaactaaaaagtttaaataataaaaagtttaataaaaagaatataaaatataattagtaactataaaacctatttaaaaaatttaaagggattgaaaaatacctattttaaaaaaacaattaaagggattgaaatgaaaaggattatttccatttattccattataagca

SEQ ID NO: 5340 - DNA, 64 bp, Methanobrevibacter ruminantium
atgattaatttaaaaaaattagatagctatattatttcaattaaaaacaagcaggaggaataag

SEQ ID NO: 5341 - DNA, 87 bp, Methanobrevibacter ruminantium
agtcaaagaaaaaaaattagttaaatcctttttttaaatttaaagaaatagcaaaattaattcaacagacagatgtcaaaggacaaa

SEQ ID NO: 5342 - DNA, 220 bp, Methanobrevibacter ruminantium
atgaataccctaaaaataaaatcaataaaacttttaaaacattttatatatagttttatatagtaaatattgattaatatattatataaacttaatttaaattttaatgccttatttttaaaataggacttaaatgaccaaattaatcaaatgaaaaaaaataaataaataaataaaagaataaattaatccaaaaaaacaaaatcaaggaaactataaa

SEQ ID NO: 5343 - DNA, 305 bp, Methanobrevibacter ruminantium
gcacaataaataagaaaaagaaagaataattcctaaaagaataaaaaccatatccaaaaaaattaataaaaaataccttaatatttattattaaataataattaaatatttatataatcaaatcaaacataataatactaaaatttatcaatacaaatataattaaatccttaaaataaagatttaagactatttttaactcaattagagactaaaaatagaaaaattcaagactatttttaactcaattagagactaaaaatagaaaaattcaagactgtttttaatcaatcaggagatataaa

SEQ ID NO: 5344 - DNA, 111 bp, Methanobrevibacter ruminantium
gaggaaaatattaaaataaaaaaacttgactaaacaacaaaaaacaaaatgagttaggaaaaaagattaaattttaaatactatattaaataaaactactattaagtaaaa

SEQ ID NO: 5345 - DNA, 436 bp, Methanobrevibacter ruminantium
atttaacttttaatattggttttttaatcaatattaattaaccaccatttattcttttttttaataaattttaattaattattctttaaaccctttttttaagtgcttatttttttataattattatttataccctttttaactgcttatttttttaaaatccttatttaaactcttttttaagtgattatttttttaaaactaattatttaaactatttagactcttttttctaaaatttcaatcgagtttctcttttttaaatagtttatctgtgaaaattcatttttgcacaaaaacacaaaaatgatctatcacaaaaacacaacaccacaaaaaataaaaatcatttttacaaaaatgcacaaaaacacaaaaataaaactgtgttatctacatactgtttaattaaaaaaataatcaaaatatatgaatc

SEQ ID NO: 5346 - DNA, 19 bp, Methanobrevibacter ruminantium
aaaaagaatttagaaaaaa

SEQ ID NO: 5347 - DNA, 130 bp, Methanobrevibacter ruminantium
atatgaaaataataaataatataatcttaaaataaaataaaatgaatttaatgaactgaaaataatatttcagatcaatttcataatatgcttaaataaaatattaagttaaaaaacaaaacttaattaa

SEQ ID NO: 5348 - DNA, 32 bp, Methanobrevibacter ruminantium
gttttaatcctccctatcctaggcaaaaataa

SEQ ID NO: 5349 - DNA, 182 bp, Methanobrevibacter ruminantium
aaattaattaacctaagaatagaaccatactaaagattaaaaacttataaaattatttaaaacctaacaataaatttttataagaaaaatttaaagtaaattaaatctttcaaaacaaaatacaaagttactatttaaaaatagcctaatgataatttttatataaaaaaattatgaaaaaa

SEQ ID NO: 5350 - DNA, 55 bp, Methanobrevibacter ruminantium
atggaaaaaaacccaataattaagttaatttataatttaagttaaatcactaaac

SEQ ID NO: 5351 - DNA, 399 bp, Methanobrevibacter ruminantium
tttaaaacctcatttataagtttattaataatttcataagttaagaataaataattacagtatataatattctgcaataattaagaattaaattctaaaaatattgaattcgtaattctatgaaatctttatgaattgataaaataaataataattatcattttcattacagtaatataatacagtaatatagaatactcaactatatgtatttaattatatatcttataatatataaactatatgttttttccaccgtatttttgaaaaaaattccaatatatgatagaaaaagatcatatgaaaaaaattgattataaaaaaatcataacatccaggtaaaataatattagaataatattaatttatataataggaagtcagtgaaaatataaaaaa

SEQ ID NO: 5352 - DNA, 11 bp, Methanobrevibacter ruminantium
taggataagaa

SEQ ID NO: 5353 - DNA, 14 bp, Methanobrevibacter ruminantium
aaatattacctcac

SEQ ID NO: 5354 - DNA, 269 bp, Methanobrevibacter ruminantium
atttattctcctttaaaatttatagggcaaagtcccattaaagttttttgaataaattataagattaaaataaatattctaagcaaatagaaatccaccgctgcgatttactattatacaatgaattaatttaactgaatattcttattatcgccactggctgattagaccagatttttaatattcttatcactgatactggctgatttaagccaatatccttaaaatacacaaataatgaaaattgtataatagcaatctaaacttct

SEQ ID NO: 5355 - DNA, 51 bp, Methanobrevibacter ruminantium
ctaaaaaagatataaaaatcttgtcttgatataatattacctattataaca

SEQ ID NO: 5356 - DNA, 33 bp, Methanobrevibacter ruminantium
atcatttgcattaaatttaatagacacaaaaat

SEQ ID NO: 5357 - DNA, 447 bp, Methanobrevibacter ruminantium
ctgcctcctaaattttgatttaaaaaattactttaaataggaatttaaaaacctaataagtaatggtatagattaatttaaagtgctattaattaaattaaataaaaaattaaataacaattaaaaattaaactaacattattaaatataacacttattatatataaatattcggactgtttcattataaattataaatttttaaaatattaaattttattaaggaaacatatgaaacacttataaaaatactactattgaatgaagaatctttttaaattcctataaaatagtagcatcttttcagtgaaatgattttagaaaaattaattatatcttaaaataaaaaaaatattttaaataataaaattaaatataataataaagctttaaattataaagaagtatacaatttaattttgaataaaacacagagggggataaata

SEQ ID NO: 5358 - DNA, 172 bp, Methanobrevibacter ruminantium
aaaatcatagcccataaaatcaatctaacttttttgcaatagaggaaaataatcattaaaaaaaaaactagacaagaaattagaaaactaatttaaaaaaaaatgtaaaaatttagttatataaaaaaataataaaataggactcaaacatcctatttttaatagaaattaa

SEQ ID NO: 5359 - DNA, 111 bp, Methanobrevibacter ruminantium
ttattatatgataataactattaatcattatctaatcttatttatggttagaattctttaattttgacaaatttccttacttttcgttgaaatatatcaaattctcctaaa

SEQ ID NO: 5360 - DNA, 34 bp, Methanobrevibacter ruminantium
aactacacctctcgacaaaaaactaaaaagaaaa

SEQ ID NO: 5361 - DNA, 469 bp, Methanobrevibacter ruminantium
taaattatgtttttcaacattatgtgacattttagccaataatttccttttcaataaaataactttttacaatttctatctttttgttagaaaaatcagtaataagaaaagcaatttaatttttgcattccttatgaactaattaattaattctgcggagtgaaatgtttttgaatattgttcagaaatgtcataaataaaagatttcaaaacattatctcttttaacttcagcaacaatacttccacatttatcaaaagaaagatttatatctctcctttataacaaaattattttattgttattgtcaccaatatgtaaattaataattatttatcaaaatcattaaaaattaaatagataataacaattatttttaatatttaacatcataataaataaataaataaataaggcaatatgataattaaaactaaattaaggattattgtaccatttattagtactt

SEQ ID NO: 5362 - DNA, 12 bp, Methanobrevibacter ruminantium
aaaattgcctcc

SEQ ID NO: 5363 - DNA, 107 bp, Methanobrevibacter ruminantium
taatccaaaattaatttgatcaatttttttaataattcctttcaaaatattgactcctaataaacattataagttaaaatctaatattcttagtttaacctcaattc

SEQ ID NO: 5364 - DNA, 12 bp, Methanobrevibacter ruminantium
acaatcacctgc

SEQ ID NO: 5365 - DNA, 123 bp, Methanobrevibacter ruminantium
ctaatttctccaaaataaatataatcttaattaaaataatttaaagtttatagtttaatagtttaataattaataatttaaaataactataatagtttaacaaatctcgctaatgacaataat

SEQ ID NO: 5366 - DNA, 232 bp, Methanobrevibacter ruminantium
aatattcctccagtaaataaattttaattcaatattaattttcaattgagttaaataaactaaaataataatatatttatttccataattttaaatttgcaaatttcattatttttaccacttttatcatcctaggaacttcataaaaccaatcattggggattaaagtgaattagaattcttacatagccctatctacaatcattaaaatctaaaaaaatagatagagttg

SEQ ID NO: 5367 - DNA, 14 bp, Methanobrevibacter ruminantium
taaaaaaatcagag

SEQ ID NO: 5368 - DNA, 52 bp, Methanobrevibacter ruminantium
tgattaaacaaatgaaaatttatatggctatcaacttaacataaaagttaag

SEQ ID NO: 5369 - DNA, 193 bp, Methanobrevibacter ruminantium
aaaacttatgagagtaaattatactcattaaaataatatgattattattatatataaatgtttgtattcttcgagactcttaagagaaaaaataaaaatattaaaaaaagatcttgataaaaatcagtccaatcttatttaaataaataatttttctcaaaaatcgaaaaataaagaatatataataataaaa

SEQ ID NO: 5370 - DNA, 12 bp, Methanobrevibacter ruminantium
atagatacaaag

SEQ ID NO: 5371 - DNA, 109 bp, Methanobrevibacter ruminantium
aatatactaatatattgtaaacaactagtatataaatgtttgcttactttagacttaaaataaaaatttctttaaaaatcacttattttaagttataatagaatataaa

SEQ ID NO: 5372 - DNA, 269 bp, Methanobrevibacter ruminantium
aaaataattataaaatgattatgaaattattaaaaaataattattaataatcataaaaattattctaaaaaagaatattaaactctcaaatattagcatctgcaaaaatattcaagaaaaatgttcaacaatattaatttattaaatactagcatataaagtttactataaaaataaattataatgaataatcatgacaaattaagaaaactatatatgcattgaaaagaaaaaataaaaagtgaaaaaatttttaaaaaaggtaaact

SEQ ID NO: 5373 - DNA, 5 bp, Methanobrevibacter ruminantium
ttaaa

SEQ ID NO: 5374 - DNA, 280 bp, Methanobrevibacter ruminantium
ttatttttttttattaaaaatttaattagttcggatagatagaaactttttttaatttaataattgtggcttaaaatatgaaaataataataaacatctattaaaagaataaataagcagtgattaaaaagttattaaataataagtaaaaattagataataaataactaagaaacaactagaaaataagtaaagaataagtaagtaataaataaaatattaataaataataagtaaaaaataagtaaaaactaattaaaaaaagaaaaaataagcagaa

SEQ ID NO: 5375 - DNA, 108 bp, Methanobrevibacter ruminantium
agtttcactctataataattttaacacaattaaatcattagcacttataatccgtgcaaaaaaattgttcaactttataatattttaagcataaaatagcgtaaaaac

SEQ ID NO: 5376 - DNA, 79 bp, Methanobrevibacter ruminantium
attgtctttaataatgtaaaaatagtaagaatagaaaattaataaaaaaatagcatttaaaggcttaaaaaaagaaaaa

SEQ ID NO: 5377 - DNA, 61 bp, Methanobrevibacter ruminantium
attatagaaatactgtctttaataaaaaaacatttaaaggcctaacttaccaatttaaaaa

SEQ ID NO: 5378 - DNA, 18 bp, Methanobrevibacter ruminantium
aaaataagataaaaatat

SEQ ID NO: 5379 - DNA, 8 bp, Methanobrevibacter ruminantium
tttaccac

SEQ ID NO: 5380 - DNA, 66 bp, Methanobrevibacter ruminantium
aaaatcaactctactaaatttaagaattaagataataaataaatcacttatctaaaatagaaaatc

SEQ ID NO: 5381 - DNA, 21 bp, Methanobrevibacter ruminantium
aataccttaaaacatatcagt

SEQ ID NO: 5382 - DNA, 77 bp, Methanobrevibacter ruminantium
taattaatagcctaagtcaagagaaaaaatagattaaaaataagaaaataaaatataaaaagattaaatgaacttaa

SEQ ID NO: 5383 - DNA, 19 bp, Methanobrevibacter ruminantium
aaaatacctcgaataaagt

SEQ ID NO: 5384 - DNA, 385 bp, Methanobrevibacter ruminantium
ataaaatcaccgaacaaataattttaatttattagtattatctaatttaaatttatttttatatttaataaatttaaagatttattcgaaaattaaaaaaatagatttaaagaattgttaaaattcaaattaagaagttgtttttgaaaaagagtaaaaatatagaaaagttttttaaataaaaaaagaaaaataaaatgttaaaaataaaaaaaaatgatttagaatggtaaaaattaaataagagcaataataaacaatcaaatttaaaaacaaactattaaatgaggataatataaacaccatcatatcaaagaataattaaacatcctcatataaaaggataattacacatcatcatataaaataggataattacatatcc

SEQ ID NO: 5385 - DNA, 241 bp, Methanobrevibacter ruminantium
atcaccaaaccctctgaaatgagataaaaacagtagaaaaaagggcaaaaacaaaatgtggaatagtaaaaaatagataaaataaaaaagagaataaagaaagatattttaaaaaataaagttaaatattggctaataagcaaatatcataaaataaagttaattaaacttaaaagttaaaaatttgctaaaataaagtgaaataattaaatagcaaatatactatttgaaaagaagaaga

SEQ ID NO: 5386 - DNA, 363 bp, Methanobrevibacter ruminantium
aatttgactccaatattactttaaacaaactcctttattaatttttctaaaaaactaatacaataatcttaatttaaatataagttacaatatgatattaatattaacatcaaatagtaaccataagcttatatccattttacgatcccatcaatttaattagcttaaatcaaaattgatttaagttcgtaacaatttagcattttaaaatcaaaattgacttgaacttaaaacaatttaccactttaaaatcaaaattgacctgagcgtgtaaaactttttaaattcataaaaaatcttaataaatttaatcaattatttaaaaaatagatataaaatttattacttaattatttatgtaat

SEQ ID NO: 5387 - DNA, 57 bp, Methanobrevibacter ruminantium
tgtaaggattttaataatttaaaatttaataggcaaattccttttagatgtgtttat

SEQ ID NO: 5388 - DNA, 129 bp, Methanobrevibacter ruminantium
atctaaaacttattttaaaacttaaattatactccttcttaaagaagcaataaaagcaccaccttttaaaaacatcaagcacctacaaaatccatcttttaaaaatattataaattaaacattcgccaa

SEQ ID NO: 5389 - DNA, 81 bp, Methanobrevibacter ruminantium
gtaaaagtcattgaaattataattaaattaatttttaatcaattaatgattttatacaatttcaaggcgctttttctaaaa

SEQ ID NO: 5390 - DNA, 193 bp, Methanobrevibacter ruminantium
ttcctttatttacaccactaccacctaattaaactattttttattaaaacaattctaaaataactatttttatcaaaataagctttcacaataaataaactaataaaataagaacacttattatcaataaactttacaacaattaaaataataaaaaaaacaatttttattctgtatttaaaaacaaaaagaa

SEQ ID NO: 5391 - DNA, 353 bp, Methanobrevibacter ruminantium
aaaaagaccccctaaaaaagtattatatattaatataaatcttgtaattattataattgttgaaaaataacaaaatttaacacactcaaatcaaaattgacctaaccctaataaaaatccctaaaaaaacaccaaagtttaacacaccaaaatcaaaattgtttcaatattaaagcaattttgatgtgagaaaagtgagaaaatcccccaatttacaaaagtatttaagaaagaaataattaagtattaacaaaaaagatttaaaaattttcacacccttgatttaattttaataaaatcattttaaatcttaaaaataaaaataagaaataaaatcaaaggaaagtaagtaa

SEQ ID NO: 5392 - DNA, 189 bp, Methanobrevibacter ruminantium
aatcaaatgattgatctaatcctaaaaagataatagaaaaaatcttaaaattagacgaaaatagaaggatttttcacaaaaaatagaaaaaactaaaaaaaagaaactgaaaaaatagaagaaatagttaaaaaagaaaaaactaaaaaaagaacaaaaaatattaaaaaataaaaaaaactaaaaaaa

SEQ ID NO: 5393 - DNA, 631 bp, Methanobrevibacter ruminantium
atattccattttccatcaaagattgctgcaactgaacatacaggattttcaaactcagcaaatgcaccttcatcaaagataaacttgcatgcatcatctggagtttcggcagaatatacaacatcttccggactgttcttttcataagtggaaatgaattgagcaccctcatcaatcttttcaaccaatatcttactgtcagttacaataccaatatatgcttcaaaatcatctccacctttaaccactgcagcaattctaggagtgttataatcgtccttttcataatccaaggtaatcaaggaatatgccattgcatcacgaatattcataccaatggatatcttatctgcaatcggattggtctgtgaaccatttgagataattgcaatatctcctacagtttttatacagtcataagcaatataagagtttttaaaaatgtccttttcaaagccttcctttggaatgatagccgcttcatcttcaagaacctttacctgtctgtttggaaaagatctgcttgaaactctataagctacaaaaggcttgccatcttctgttttacctgctgaaataattcttcctaaatacattttataaccccaaaactttaataaataagaaaaaa

SEQ ID NO: 5394 - DNA, 87 bp, Methanobrevibacter ruminantium
ttaaaaaaataaataaaactccaaagagcataaaaatgccctaagagttaaaaaaattaaaaaaataaaaaaaagaataaatttaaa

SEQ ID NO: 5395 - DNA, 47 bp, Methanobrevibacter ruminantium
ctaatcaccatcttttccgaataagccttttagaaactagaaatcgc

SEQ ID NO: 5396 - DNA, 8 bp, Methanobrevibacter ruminantium
agtatcct

SEQ ID NO: 5397 - DNA, 134 bp, Methanobrevibacter ruminantium
cttaaaaaaagagttaatctatttagaaaataactttttaacaattctaaaacatttaacaataaataaaataataaaatatttattattaattgtgattttatttattaattcaatgcaatagagagataaga

SEQ ID NO: 5398 - DNA, 139 bp, Methanobrevibacter ruminantium
aataaactaaagaaaagatactattaaaactaaaagaagatttttaaaataattctaaagaaaaaatactatttaaattaaaaaccattaaagatttaaacttattttcatacaaaataaaacaatgtgagtgcaaact

SEQ ID NO: 5399 - DNA, 289 bp, Methanobrevibacter ruminantium
aaaaataatgaaaacaaatgaatcttgcaaaagtggttttagaactttaaaaaaataatgaaaacaaatgaatcttgcaaaagtggttttagaactttagcttgaaacaagaccccaactgaaaaactcattttaaaatttaaagaaatgaacaaaagcaataaaataataaaaatcataaaaaaattattaataatcatacaaaaatcagaaattaaagggtaaaaattattaaagtataaatatgattttagttataactaaatatattactattaggtgaaaatat

SEQ ID NO: 5400 - DNA, 218 bp, Methanobrevibacter ruminantium
ataaacttattttcacttaatttaattttcttttttatttctaaatttttattttttaattttctattttctatttttattatttttatagctatttttaattaactaaatctaaaactctttagtatgaaaattatttaaataattaaaatcagaaagaaagatgttaaatttagcgaatctattaaggaagtgttaaaataaaagtacttgcgcca

SEQ ID NO: 5401 - DNA, 206 bp, Methanobrevibacter ruminantium
ctaatttttacctcatttaaaccaaacaaaaaaaataagattcgatttaaatcaaataaaaatctaactaatttttacctcatttaaaccatacaaaaaataaaaaaaagaaggaaaggacattaaaagtcctttataaagtttattcatcaaattcttcaaaggtgattacagctcttccttcgactcttccgtttctcaagtcg

SEQ ID NO: 5402 - DNA, 535 bp, Methanobrevibacter ruminantium
atttattcctcatttttatttttattcattaaatgataattcaatgaaactaataaaacaatttcttatcctaaaattcactaaagatatacaatgaactaataaataatcctaaaattcactaaagataatacaatgaaacaaataactaatattcaaataaagattattcaaataaatgattaaaagtattaatttcgtttaatgatgtctttaaacagttgaatattaattagaaaaattcgtatttatctaaacattttatttataaaaatctgattaatattttattaatccaattatataatttttttgaaatgtttttaaagttaagccttaactcgataaatttcttaaacttaacccttaaatcgatattttttaaagttagctattaattcgataatcccaacaagcaattagttaaaaagcattgaaccataagtttatgaaacttaaaatacaaatatcaaataaacatatccaaaaggaaaaataaaagaatatccttttaaaaaattattgaggcattaaa

SEQ ID NO: 5403 - DNA, 4 bp, Methanobrevibacter ruminantium
aatc

SEQ ID NO: 5404 - DNA, 65 bp, Methanobrevibacter ruminantium
tgattattttcatttaatatataaaaactttttaaggaactatttcaaagaaaaggagagaataa

SEQ ID NO: 5405 - DNA, 266 bp, Methanobrevibacter ruminantium
ataaaaaacttatcttaaaaaataaaacaaaagcaaaaagaaaaaaaataataaaaaacttattaaaaaataataaaaaagcaagcaaagataataaaaaaataaaaaaatatcaaaatttatattaataatatcgattataaataataaatatataatttaataataaaccatttgatataacattaaatcaaaaaatatttgataaaaaaattctatcaaataaaaaaaaattaataattacaactaattatcaaggcgggctt

SEQ ID NO: 5406 - DNA, 32 bp, Methanobrevibacter ruminantium
aatttttttcaatcgtttggaaaaacttgccc

SEQ ID NO: 5407 - DNA, 129 bp, Methanobrevibacter ruminantium
aatataaaaatataaaatttataatgttataatactataaaataaattaaattataatgctaatttgatttataaaaaaatataaaaaaataataattattttatcataagaataaatggagatataaa

SEQ ID NO: 5408 - DNA, 98 bp, Methanobrevibacter ruminantium
atgaattctatttgaattgttgaaacctaatcctaatcgaaaaactaaaagaaactaaattaatcgattgaataaaaaatagcatcaaaagtgataat

SEQ ID NO: 5409 - DNA, 128 bp, Methanobrevibacter ruminantium
tctaatcaaaaaagagtaacttttatttattcaaaatttaattaactaattcaaaacctaaagaataactctcataaatccctaaacgacttttatttaaaaaactattatataaaggagaatcaaaa

SEQ ID NO: 5410 - DNA, 195 bp, Methanobrevibacter ruminantium
cattaaaaattaacaccataaaataatcttgttaaagaataattgtcttaaattactctttttagaataaagatatcttaaattactctttttagaataatagatgtcttaaattactctttttaaaaatagttaaaaattaaagtaaaaattaaaattataaaaatagttaaaaattaaaattaggaatgtaaa

SEQ ID NO: 5411 - DNA, 227 bp, Methanobrevibacter ruminantium
ttatatcacattcctttattctcttttttcatataaagtcaaattacaattttaattggattaatttttatattaaattataaaatttaaaatcacataatcagattaataagtttattattaacattatttaaatattatcattacttgattaagcaacccatatcaaagtgataaactatcaaattgattaacactattaaatatatcattacttgattaagaaa

SEQ ID NO: 5412 - DNA, 216 bp, Methanobrevibacter ruminantium
aaaatcccttaaaaataattataaattctttaataaaaattgaataaaaattaagataaacaaataaattaaaaatgaaatgaaaaaactaaaaaattaaaaatattagaaaaaaagaagaagaaatagataaaattaattatccattcaaagattagaaaaattaattatctttcaattaaagattttcacagataaaattaattatctatccaa

SEQ ID NO: 5413 - DNA, 180 bp, Methanobrevibacter ruminantium
tttttaaacatccttaaaatattaagtttataaaaaattgtttatgccattaaaagtttataaaaaacttttaattatatgattaaagatttataattcaatctatatataatttgatattcaagttaagatatttaaaaaaaagattataaaattaaaagaaaaaattagattgaatga

SEQ ID NO: 5414 - DNA, 104 bp, Methanobrevibacter ruminantium
ctacaattatttattattaaaattcatcacaactataagctctacagaactactcctattataactgtctacagaactactcattaatataaccgtccaaagaa

SEQ ID NO: 5415 - DNA, 308 bp, Methanobrevibacter ruminantium
attaaaccccctaatatcgtttaatgtttaatagtagtatatatgttttgattaatataattttttaaaattcgcttatgaaaataaaatatttttaactgattaaattggaaagtccaggacataattccctataaattcaatggataaaaaataagtagaataaagagatatcactaaaaaaagaatgaagacatttcaacaaagaaaaaaaatcaaaaaatcaaaaacatttcaacaaagaaatgagctaaaaaaagaaaaaaagattctaaattaattcaaaaaggaatgaattaaaaaaaaaa

SEQ ID NO: 5416 - DNA, 120 bp, Methanobrevibacter ruminantium
attgtatcgaagatgacttttgcaggattgtcttcagagtttaaaatcactgtcaaagtcttcatcgtcagttgtaacagtcacaacaaaattgccatcgggaagataaccattatgtaa

SEQ ID NO: 5417 - DNA, 202 bp, Methanobrevibacter ruminantium
ataaaacctcctattttatatttaatattgaaatatatatatagattttgatttaattcggccaaataagttcttatatattaaaacaaataaaataagaaatgaaaaaataaacaaaatactttaaatcattagaattgaaaaaatctaatttttaaaactaaaaatccttaaagtcaccaataaagttctaatgtaaaag

SEQ ID NO: 5418 - DNA, 315 bp, Methanobrevibacter ruminantium
aatatcctctcaaaaaaagaatttgataaaaaaagcctataattttatttaaaattaaaaaataagagatttgtctatttacctaacaccccaatttattaaaaactaattattagtatatgacaaatattttataaaatttactaattgatttaaggatgtttaaaaatagcataatcagaaaagagagtaaaattcaacaaaagagaaaatagaaaaatagaaattaaaaaaagtaaaaaaagactaaaaaaaggataaaaaaaatttaaaaagtaaacgaaagaaaaaaaaaagatttaaaagatttaaaga

SEQ ID NO: 5419 - DNA, 203 bp, Methanobrevibacter ruminantium
ttttcaaactccttaaaatattgattatttgttaaaaattaaaaaatttttaaaactattcataaagaaagattcaaattaattttttaacaaaaagcattcgactacctaatacaattataaatacagatttttttatgcccatcacaaatagcaaatatatagatatacccctataggtataaaagtcattgaaaaaaata

SEQ ID NO: 5420 - DNA, 28 bp, Methanobrevibacter ruminantium
atatgataataataaaggcccatattaa

SEQ ID NO: 5421 - DNA, 518 bp, Methanobrevibacter ruminantium
acattctttcaatataacaccaccatataattttataccccaatgggtatgtctatatatgaatatatttttctagtatataaacgttttgaaaaattatcggaaaaatcaaatttttaaaacagttatataatgagacaataatggtaaaataattataggaaaataaaaaagagaaatagaagaataaaataagattacaattgcacaaaacatcatactaatatcaaatacttaaacaaagcttaaattactattttaagataaaacaattttaacagccttaatcaatattgttacgaaataaaagcaatattgttacgagataaaagcaattttctagcgatatcaaaacaatattgtagcgagattaaaacaagtttgttattaaattaaaacaattttatatctttaaatcaatttttacttatcatactaaggttaaatttaaatacaattaaaataaatcaaatattaggcaaataaagaaaaatacttaaaaaaatatgaggtgtaat

SEQ ID NO: 5422 - DNA, 150 bp, Methanobrevibacter ruminantium
aaattaaaatgaaaaagagtccgaaaaacggaaatatctaaaattgaaggataaactaaaaataagcataaaataaactaataaaagtaagaaaagtaaaaaaagtaaaaaaaactaaaaaaaagtaaaaagataaattattaaaaaaaa

SEQ ID NO: 5423 - DNA, 16 bp, Methanobrevibacter ruminantium
actttcccaaagataa

SEQ ID NO: 5424 - DNA, 5 bp, Methanobrevibacter ruminantium
ctaaa

SEQ ID NO: 5425 - DNA, 787 bp, Methanobrevibacter ruminantium
attaaacctcctttaatttagaacaaatttatcaatttttttctaaaatctatttttaaagaataaattttatcaatcatttactaaaatctatttttaattaaatataaagaataaattttatcaattttctacattaatattaaatctacatgattcaaacaccaatagctaaaatatttagcatgctatctagttgaatagtaacttaaaaaattcaatttaattaatttttttatgattaaaaaattaaacctagaataaattaaaattttctttatagcggtaatgtttgatcaaatttcattctaaataatttataatttcttaaaaattcatgaaaaaattaactaaaacatagtaaattcttcactacatatacatatgtacttgaaagtatataagagtttgcatatatttgaaattattatgcatacaatgttaagactatatagaaaaatcaaaggcaaagtctattaaattatagttaactattttttttaatataaaaattttgccttatccatatactcttgttaagatatagtaaacttttatataaaactaatccatatgaaatttaaacaatataatttgaataagaacaatctcaaatataaaaattaaaaaaaggataatgatttgaaaataataatattaaaaattggaaaaaaacaagaaaaatataaaaaaaataaagtaatgtagattatgaaaataattaattaaataaaaataattaattaaaagaagaataattaattaaattaaaaataaaagaaaagaa

SEQ ID NO: 5426 - DNA, 406 bp, Methanobrevibacter ruminantium
ctcatttatttttttaattaaaattttgattttttaaattaaatcttgaatatttaatttatttttaactaataataattatttattccattatttattaatctttatatctttataggtttatcccattatgatttcaatatttattacgctagaaactaaactatgagaacattaaaaatagtttatatatcatatataatttgaattgtccaagagcatatgaaaactaatggaggtagcatttcaagtgtaaatttaagaacaatgagaagagataagtaattaaattagataaaaaaagcaatgaaaataaaataatcttaattagataacaaaagcatgaaaaataaaataaacttaaagaataaaaaagtttaaaaagaaaataaataactaaaaaaag

SEQ ID NO: 5427 - DNA, 24 bp, Methanobrevibacter ruminantium
gaaaccacctgaaataaactataa

SEQ ID NO: 5428 - DNA, 181 bp, Methanobrevibacter ruminantium
aaaaacaccctaaatttagataaataaataactaataaaactaagaaaactaaattaataaataatttaattaagtaaataaataaaaaagagttcaaattataaaaaggttataaaagtaaataaagtaagtaaataattaaataaaataagaaaagaagttaaaaaagtagtgaaaaac

SEQ ID NO: 5429 - DNA, 128 bp, Methanobrevibacter ruminantium
agaagcgagaaagaagttgaggttactttgtttaattaatcatttatacaaaataataaattataaaatcagattaaaaaaatttaaaatatctaaaataaataaatattattagataaggtgtaaaa

SEQ ID NO: 5430 - DNA, 78 bp, Methanobrevibacter ruminantium
ttctccattttaaaaaagaatgaaaatccattaagatgcatattattcattctaaaaaacaaaaaaagataaaaattt

SEQ ID NO: 5431 - DNA, 67 bp, Methanobrevibacter ruminantium
ttattattttaccttaattctttttttaataattaatttactttaattcttttttttaaaaaaaaaa

SEQ ID NO: 5432 - DNA, 99 bp, Methanobrevibacter ruminantium
tcatttacttattttaaaaactagtttttaaaaggctttaattaacaaagcccccttaaacaaaactattttattctatttttataaacaagactaatc

SEQ ID NO: 5433 - DNA, 58 bp, Methanobrevibacter ruminantium
aatatcacataataattaagataaatataaaaaataccctttcaactcttttaaaaag

SEQ ID NO: 5434 - DNA, 193 bp, Methanobrevibacter ruminantium
aaaaaccacttaaaacgattttatttaaccataaaccacttaaaacgatttattttaaccataaatcactaaattaagaatttatttacctgctgtacctatgagcaatattacaggttccctctttgctgaccatacatgcaccaatcggatgcataggattacatgccctttctaaaacaagccttacaag

SEQ ID NO: 5435 - DNA, 158 bp, Methanobrevibacter ruminantium
aacaccattctttttttatttcacaaaacattatagaataattattaatttaaaaatcaaaagaatttttatcgaattatactatataaaattattcaatttaaaaaattaatcaactaattaattcattcgaagccattataaaaaactataatcag

SEQ ID NO: 5436 - DNA, 62 bp, Methanobrevibacter ruminantium
aaataataatctattaagtgcaaagtagaataatatccatcaagcctaagggagaaattaaa

SEQ ID NO: 5437 - DNA, 146 bp, Methanobrevibacter ruminantium
aactaaaacttttaaaaaattaattaaaaagtgatgtgcctttgaaatccgaataaaagaataaaattaataaaaaaaccatataagcattaaaattagaacaaaaaaacaaaattacatattatcaaagattaaaaggtgaaaaa

SEQ ID NO: 5438 - DNA, 117 bp, Methanobrevibacter ruminantium
taattgatttaaaaaaacctttagaataataattataaattttagaacaataatttatctaaaaaacttttagaaaatttatccaatgactaaacttttaatttaaggacctaaaac

SEQ ID NO: 5439 - DNA, 110 bp, Methanobrevibacter ruminantium
gaaatatgaattcaaaataaataaaaaaaataaaaaaaatcactatagtgaaatactataaaaaatcataattacagattaacaattatcaaaaaagacatgtggttgat

SEQ ID NO: 5440 - DNA, 128 bp, Methanobrevibacter ruminantium
accatcatagaattagaataacaactcatatttaaagaattagtaaaataagtgaatgaataaaaaaaattatataagaatagaaaaagcaaaagtataaaaaatcaaatatattcgcttaaaaagca

SEQ ID NO: 5441 - DNA, 165 bp, Methanobrevibacter ruminantium
ataaataagtcctttttatgcattaataatgttaaaaataattaaataaacttttctatgcatttaatatcttaaacacctttgaaatcatataattacaaaaaatagaaaagaaaaattgataataaaaatataaaaaaagtttaatttgaatagaacttcaaa

SEQ ID NO: 5442 - DNA, 276 bp, Methanobrevibacter ruminantium
gctattcccacttaaaaatctatgaaattttttaaaaaaatttaaaaaattgtctattaaatcaatactattataatataagtaagttattagatttaaaggttatggatttatttaatcaaaaaatcaatatttttttgataaaatattaaaattctaaaattatatgataaaaattattaaaaaatactgaaaattaaaacagtttaggaaaaatagaataaattaatatgaaaaaaaatgaaaaaatgaaaaaattataatctttaattaaaa

SEQ ID NO: 5443 - DNA, 173 bp, Methanobrevibacter ruminantium
aaattcaccgataaaattaaaataatgttaaataattaaaataatgttaaataattaaaataaagctaaaaaattaaaataaagctaaataattaaaataatgctaaatgaataaaaattattaaaataaactgataaaaacaatttaaagtttagtcagaacttttctaaat

SEQ ID NO: 5444 - DNA, 124 bp, Methanobrevibacter ruminantium
aatttaacctgtaaagagtaaaaataaaactataattctaaaactaaatgagtgaaaaaaactataattctaaaactaaatgagtgaagatgaataattaattatcaaactgccctatgaagaa

SEQ ID NO: 5445 - DNA, 272 bp, Methanobrevibacter ruminantium
ttaatcactcgtagtttatttgaatcataaaacactaataattgatttattttataaaatcactgatagttaatttgtttaatgtttattataataatactttgatatttaaattaattaaagatatctataaaaagaattaatattctccattagtcaaaatatttgaaaaacgaaaatcatgattgatttaataaaacaagatttaagcaatgtcatttaataaatcagcaaatttagatgccattttttccatggaatagtcatctata

SEQ ID NO: 5446 - DNA, 322 bp, Methanobrevibacter ruminantium
caaaccaccaaatatataaattaaaaaatacttaaaatttaatacctctttttaaaaaaatttatataaatcaaaatagaatataaatacaaacataacaatgattatatacttattaaaataaatatcaatacataaatgtataatatactatttgattatattctatttaatttttatttaaaaagtttcagaaaattccaagcatttgataaaaattaaatgaatatatttaattaaaaaaaaattaatacttaaaaaaatattttaataaattattaaaatcatattaatctattaattcaagaatactggtgaaact

SEQ ID NO: 5447 - DNA, 49 bp, Methanobrevibacter ruminantium
aatgattttaaagttaagctatttactttaaagttaaaaaaaattttta

SEQ ID NO: 5448 - DNA, 357 bp, Methanobrevibacter ruminantium
tcttaactttttatttttaataataccaccaaaaaaaccattttttaacagcatcaacactgaagatacaattttacatatctttaaatcaaatacaataatcctaatctcccagaaaaactcactcatttttaaccaatcactaaacctgattaggttctaaattaggcaaaataatagataagtattattaatagtttaaacataatatatttatataatgaaaaaatttttaatatattagttgttttataattatcgaacaaagataattgatatatttattcagttaacagataattgtaaaaaaaatatatttattcagttaatttaaaggaaggaaagtgaggtgtaaag

SEQ ID NO: 5449 - DNA, 12 bp, Methanobrevibacter ruminantium
gtctaattcttt

SEQ ID NO: 5450 - DNA, 150 bp, Methanobrevibacter ruminantium
agatttatttattcgatattatacgaattactctaagttaaaaaagaaaggtttcaaaaattaaaaaagagaatttaaagtaaaaaaagtattaaatcgactaaaaaagtaaaaaataaataaaaaaagtaaaaatattggtaagaataa

SEQ ID NO: 5451 - DNA, 223 bp, Methanobrevibacter ruminantium
ttttctcactacttgttaaaattaacataattttaaataaaaatttaaataaaaagctaaaaattatctgattttaatgaaaaattattctaaatgtttaataaattataacatttcagattatataaacttttccaatgatttttttttaacgataataattaatagggacaaatattattttttaaaataaattaacatcaaaaacacatttaaataagtt

SEQ ID NO: 5452 - DNA, 133 bp, Methanobrevibacter ruminantium
gataaaacatccattgataaaattaaatcagtattccagaattttcaattttttcttatacttatagatatataattacaattaaataatatttgttataaagatatacttataatcttaaagaggaattcaa

SEQ ID NO: 5453 - DNA, 86 bp, Methanobrevibacter ruminantium
ttgaaattataagatttattgtagtttaataattggcaaaaaagcctaaataaaaatcaaatttaaaaaaagcaaaagttgaaaca

SEQ ID NO: 5454 - DNA, 117 bp, Methanobrevibacter ruminantium
acaataattaaaattaattatcaatacatttcagcatcttgaataaataatgatttaagattaattaacttacaaaaataacttatacagagtagaaagattaagaaggacaaaaat

SEQ ID NO: 5455 - DNA, 68 bp, Methanobrevibacter ruminantium
acacccttctattgattttaataaaaaagaataaacaccatctattgattttaaaatagaaaattaaa

SEQ ID NO: 5456 - DNA, 62 bp, Methanobrevibacter ruminantium
tttttaattaaacaaccacacattagccacaaataagaaataaatcaccaaattcttaaaga

SEQ ID NO: 5457 - DNA, 162 bp, Methanobrevibacter ruminantium
ataatccccttagaattttgtaaaataaaacaagaaaaacaataattgtaattttcatataatattatttcagaactaatatataaaattaaaaagagcatttgaaaactaatattgcaaaaaataaatgataaaaaagaatttaaaaaaaaaaataattag

SEQ ID NO: 5458 - DNA, 492 bp, Methanobrevibacter ruminantium
ataattagatttttcttctaaattaataaaattttcttatattaattctaaatggaataagaacatctgattggaacaaatttcctcttgaaaaaaaacacaaaatcacaaaaatgaaaaaacactaaaaaataatttcataaaaacaactaatcacaaaaatgaaaataagaaaagtaacaaaagttaaaaattgaaaaatcacaaaagtgtaaaaccataaaatcacttaaacacaaaatcacaaaatcacagcaaaaattaactatcaaaatattaaaaatacgataaattaaattaaaagtaaaacttaatctataaaaataatttatcaaaaatctaattaaaataaaccatatagaaaaaaatataattttataaactgttatctacatcaagtgaaataaatatagaaaaataatgaaaaataataagaaataatgaaaaatagagagtatagattaaaaaaatagtaaaaataagagaatcgaa

SEQ ID NO: 5459 - DNA, 66 bp, Methanobrevibacter ruminantium
gatattaccttaaaaatgaaacgataagttaaaaattaaatcaaaaaattaattttaaaaaccaat

SEQ ID NO: 5460 - DNA, 5 bp, Methanobrevibacter ruminantium
ttaaa

SEQ ID NO: 5461 - DNA, 12 bp, Methanobrevibacter ruminantium
agtttttccctc

SEQ ID NO: 5462 - DNA, 147 bp, Methanobrevibacter ruminantium
taaaaaatattctctaaaaatgtttaaaactaaagaataaaaaatattctctaaaaatgtttaaaactaaagaataaaaaatattctttaaaaatgtttaaaactaaagaataaaaaatattctttaaaaatgtttaaaactaaaaa

SEQ ID NO: 5463 - DNA, 513 bp, Methanobrevibacter ruminantium
taaaagtcctccatataatcataatttgaatcgactgtgaataattaattccatataaatttttttatttcacagcaacccattttttcaactagctgaaatccatatcattttatttaacagcttatgttgaaataaataaacgttctatcagaacattgtaataaggctttaaagaatgatacccatattaagacaatataagctataattatattgcttattatcatgattaaagccatataaaaatgataatctaataaataattgttttttaaaatatttttaaaagcatattttaaatatttatataatttttttataattatttattattattttattaagttagatagaataacattatttatttttttaaacattaataaatgttatcattcttgggcaaaatttcatgaaaaaatatgatttttcatggaaaaattataaaatttcagtaaaaatcataagaaaatgacttgaaggaatacaaaagtaaattgaaaatataaa

SEQ ID NO: 5464 - DNA, 321 bp, Methanobrevibacter ruminantium
atttaagcaaaaaagaaaaaatctataaaactaagaccctaaactaaaataaaaaaagctaattttaaaaagatgtttaattgataataaaaatattcgtatggatacaaaataagataaatttaataataacttaaaagataaatatataatactataaaacttataaagtatatcctttatatccttttttaagtggaactttgcttaaatttaaagtaagagagttataagttttttttaaagaaataaaaacaaaaaacaagtttaatgaatataatattaatttattcgtaattaaaactaaattgaagtgttatt

SEQ ID NO: 5465 - DNA, 223 bp, Methanobrevibacter ruminantium
cttttattttttaataacactttaatttttaatttaaaactttttttaattatttttctaattttacttattttttattatatttttattatttaatctatttttactagttttaaactttttttacagtacttaataaaatagccatataattttataatataaaaagctattttaatcaaaaaaggcccttaatttatttaaaacaatggttaaaaaaaaa

SEQ ID NO: 5466 - DNA, 151 bp, Methanobrevibacter ruminantium
aatataaaataaaaatagtaatttaaattaaaaaagagaaaaaacctatttaaaaaaaagaaaaatcaatacaaaatatcaaaaaaaaagaaaataattacgattgaaaaaaaataaaaaaaaagaaaaggtaggggaataattaataaaa

SEQ ID NO: 5467 - DNA, 9 bp, Methanobrevibacter ruminantium
tagagaaga

SEQ ID NO: 5468 - DNA, 247 bp, Methanobrevibacter ruminantium
aatatataatatttttattaaaattaataaaattaattatttaaatctaaaaatttaacacgtttagaaacctaccaagtctagaaacttacaaagtctagaaacctaccaagtctagaaacttagcaagtctagaaacttacaaagtcttgaacttatctctttcaaaattcaaaaattaattttattaatccaatgcaaattaaatccactaaaactgacttcattcatgatttgaaagtttaaa

SEQ ID NO: 5469 - DNA, 36 bp, Methanobrevibacter ruminantium
tagtgaaaataaaaaattgttcttatctcgtaacaa

SEQ ID NO: 5470 - DNA, 237 bp, Methanobrevibacter ruminantium
aaaaacaccataaagtaaaataaattaaataaacagtttttaaagaaaaatcgttattaactcaatgaaaaatattgaaataattagtaaaaattttaaattttgcttctaattaaatatttttaattaatatataataaacctattttaaaatcacaagaatttaaaaaaaaatcagcgtaaaaaattagaaaattcataacaaataagaaaatacgataaaaaaaaagtaaaaaa

SEQ ID NO: 5471 - DNA, 41 bp, Methanobrevibacter ruminantium
atacctaaataatataggtttaattttgtattttgacgtac

SEQ ID NO: 5472 - DNA, 15 bp, Methanobrevibacter ruminantium
tttaacactccaaag

SEQ ID NO: 5473 - DNA, 16 bp, Methanobrevibacter ruminantium
agtaagttttaccata

SEQ ID NO: 5474 - DNA, 20 bp, Methanobrevibacter ruminantium
aaataatcctccagttaaat

SEQ ID NO: 5475 - DNA, 690 bp, Methanobrevibacter ruminantium
agagtttatcctcctctattttcaaatattgtttatagtccaaaaataaaattctaatttcattttagacttatctcattatttcaatcaatcaaaaatatcatcaaatcaatcaaactgatataattgatagtcaatatgattagtattggcttattgaaacaattcgatactcaacctaaatagtttgaactattagatcaatagtctcactatttttttaacctataaagatccaaatcaaaaatcccatagattaattcttgaattccaaatcaaaaaattcaagattccgtttgaactttaaaaatccaaatcaaaaatttctaaagctctagatttcaatctaatttcttttttaaaaaagtttttcaaatctataattaaagcattttgatggatgccttaatctcaaatcatcgtacgtcaatgagctagctcagcttaacattaatgtactaatatatattatattaagaattaaatataaagcttacttggaaagtaaatacacaaactttatatactataatacttttttttaaatgtgtattaactatataaaattaaaatatggatgataaataagcgatatgaaaaaataagcaaaattattaataagcagagaaaaaaaggaacttttttattatcacataaaaatcaagctcataaaaagagattaaattaagt

SEQ ID NO: 5476 - DNA, 335 bp, Methanobrevibacter ruminantium
ataaaaatctcctattaatatatattttagaggtaatatataaaattaatgtaaaatttaatttccctatcaaaaatgagatttaaatatttttccggaacctaaatagtgtgaaatcattcaaaatatatccccctagtgataggaaagcattattcaagaaaaaaaactattaaaattaataaaaaaactaaaaaaagcattataataaaataaataaaataataacagaaaaataagtgtaaaaaaagtaagcttaggagcatacaactcccaagtagagataaaaatttttggtcaaggtttttgaggccgaaggcctcaaaaagcttgga

SEQ ID NO: 5477 - DNA, 585 bp, Methanobrevibacter ruminantium
gctatcatatcctaatcattttcaaaattaacgaattacaaaatataaataaatttgacagtttattaatagtattttaagtcaatttcattgacatcattgaattaataaatcattaaattaattatataacattattatattagtcttttactataaaataattaactatttttttaatttaggtatgatgtgaaagtaaattaaaattataatcaatgataaaaatgactaaaatcaattgaagaataaaatcagaaataatatataataaataaaataatgatatgcaaagaaaaaatagactaaaatagagaaaacaagctataactaaataaaataaggataaacaaagaaaaaatagactaaaaaactaaaaataacttaactaagaaaaacaataacaaataaagaaaaatagactaaaaaaactaaaaataacttaactaagaaaaacaataacaaataaagaaaaaatagactaaaaaactgataaaaaaaattaaaaaaattaaatttactaaatacaatgcaaagaaaatagataaaataaaaaagtgaaaatatagttagaaaattattcag

SEQ ID NO: 5478 - DNA, 98 bp, Methanobrevibacter ruminantium
attttcaccaataaatcttaataattataatcgaagagattatgtttcttgagaatattttttattttttccatctgatttttcaaaccaagaaatca

SEQ ID NO: 5479 - DNA, 172 bp, Methanobrevibacter ruminantium
aaaaataatttaaagtttagaaaaaatggattttgaaacaaatttttccaaaaggataatgagaatataaaaaaataatgaatcttaaaaaaaaaatggatttggaaagcattaccaaataggataatggaggtataaaaaattttgaaagacctttggaaatgatgaaaga

SEQ ID NO: 5480 - DNA, 41 bp, Methanobrevibacter ruminantium
gcttagaatagtttaaaaagaaaaaataaaaaaggtactga

SEQ ID NO: 5481 - DNA, 17 bp, Methanobrevibacter ruminantium
ataaaaatccccataat

SEQ ID NO: 5482 - DNA, 15 bp, Methanobrevibacter ruminantium
tcggaccctttcaaa

SEQ ID NO: 5483 - DNA, 66 bp, Methanobrevibacter ruminantium
ttttactccagcaatatctacgacgagttgttctttatcaaatctaaacatttataatcctccaat

SEQ ID NO: 5484 - DNA, 11 bp, Methanobrevibacter ruminantium
ttataacacct

SEQ ID NO: 5485 - DNA, 15 bp, Methanobrevibacter ruminantium
ttataaaacctccag

SEQ ID NO: 5486 - DNA, 14 bp, Methanobrevibacter ruminantium
ctataacaacctcc

SEQ ID NO: 5487 - DNA, 12 bp, Methanobrevibacter ruminantium
aatgtaacctcc

SEQ ID NO: 5488 - DNA, 135 bp, Methanobrevibacter ruminantium
attttcttttcctccttaaattttattaaattttaattatttaataaataaataagtgattaaaatttccctttttttaatcacttttagacatattccaactcaaatataaaatacataaagacaactaaaaaa

SEQ ID NO: 5489 - DNA, 121 bp, Methanobrevibacter ruminantium
taattagaacatcctatagtaattttatactttatgattatacttcaaaacttaaacaagatttttaaatcaaataagccaaagtaaaccactcagcttttaatctagctagattaaatcc

SEQ ID NO: 5490 - DNA, 311 bp, Methanobrevibacter ruminantium
ataaaataatgtcgaatttgtaaataaattttttaataaaaaccatttcttaattaataaataaatgaatataaatataatatttttaaattaaaatgaaatttataagtttcaaaaatgtttgaaaaaaaatccattctaatttatacaaacaaatttttttattgaaaaaaataaataaggtaaaacggattatttcaatggaataaaccaatgaaaagattttatggaaaaacaattccaataaaatcaattcattatgaaacaatcagttaaaaaccttatttatataattcccgtttacaccaaac

SEQ ID NO: 5491 - DNA, 14 bp, Methanobrevibacter ruminantium
tttaataaacctcc

SEQ ID NO: 5492 - DNA, 2 bp, Methanobrevibacter ruminantium
aa

SEQ ID NO: 5493 - DNA, 31 bp, Methanobrevibacter ruminantium
attatctgacccttaatcaaactagatattt

SEQ ID NO: 5494 - DNA, 99 bp, Methanobrevibacter ruminantium
tatttaacctcaaatattcaaatcaaaatgattcaaataatttattattgtaattgtgaattttaattagattttaattaacaaaaattaattcgataa

SEQ ID NO: 5495 - DNA, 821 bp, Methanobrevibacter ruminantium
ttttttccctccttaataaatagagttaatatacctctcaaaaaaaactttatgttttaagtttttcatgagtaagccataaagcaagtttttgcaatagccagctatttggtatacaaatattattttattttaaatataatataaacattattctaagaatcaaatagcaaagtttataagcaataaacgattcaaaattttttattatatttgactcaaaaagtaatacttttcatttttaattataattcttgaattggaataaaataagtgattgattaatattttataaatttaaagtccataatttgatttctctaaattatatcccagcatattagtcaaataggaaaaatacccctaatttaaaaatgatgaaaaaaatcaaaagtattacttttaggttgatttaaactattttttaaggacattagaacagttatatataaaataaatataaattaaagtttttactcaaaaaataagcaaaatttagtcttaaacaaaaaatacaagatagtaccaccaggagaattaaaaaaataatactttctattaataaaagaattacaaaaaataatatttgagaataaattagtttgaatatggctaaattaataatttttatgtataaaaataatacaaaagagctaaaaaaaatttcataaaattttgggatttttgaaaaatttgaaaaaattgaaaaaattagaaaaaataatggttttcttaaaaaaatgctaaaaaaaataaagctaaaaatagttaaaaaatgttaaaaaaagttataaatagttaaaaattaaattttagacata

SEQ ID NO: 5496 - DNA, 78 bp, Methanobrevibacter ruminantium
aattcttccttctaaatgagatatgaaataaataaaaataatcaatatgatttattaaaaaataaatactataaatta

SEQ ID NO: 5497 - DNA, 32 bp, Methanobrevibacter ruminantium
agaaaaaatagaaaaaaataaaaaatatatga

SEQ ID NO: 5498 - DNA, 19 bp, Methanobrevibacter ruminantium
ttcatcaccttaaactaat

SEQ ID NO: 5499 - DNA, 77 bp, Methanobrevibacter ruminantium
gaattaattaactaattaaaaaactaacaaaaaaataaatatttacaattatatttatttagaatttttttaactaa

SEQ ID NO: 5500 - DNA, 211 bp, Methanobrevibacter ruminantium
attcatattttcctctttttcttataaaattccttatttttcttattttttattattttattattttattaatttattaatttatgattttattaattatttttatcaaaaatcgttgcatataactaattattattttaatcttattttagtattagaagatttaattaaaaaaagtgctaattttatatataacaattaagtgattttt

SEQ ID NO: 5501 - DNA, 128 bp, Methanobrevibacter ruminantium
atcccaatttgattttaaaccccaattttgatttataaatccatttttgtttataattattgatgacataaattaaaattttaaaaaaagaaacctacatcacaatttattttaattatagaccaaaa

SEQ ID NO: 5502 - DNA, 131 bp, Methanobrevibacter ruminantium
ttaatcactcaaaatgaatttaaaaataaaataattctttaatagaataaaaaatcaataaaaagaatttaaatataacagtcattttaaaataataaaaaaagataaaatatatttgatttgaaaaagaa

SEQ ID NO: 5503 - DNA, 96 bp, Methanobrevibacter ruminantium
gttttcaccttttaaacgtttaaaatgaataaattataactcaaaatatttgccaaaaagggcataaattactaaataataaattttttaatggac

SEQ ID NO: 5504 - DNA, 113 bp, Methanobrevibacter ruminantium
gatatcacattttttatttctataataatttcaatttaaaaacttttacttataatctgattaagatttccataatttattttaatttaaagattattaaaacttatctttac

SEQ ID NO: 5505 - DNA, 241 bp, Methanobrevibacter ruminantium
atttttcttttttaaaagagaatatcacttaattttaaaaaaaaaataaaattgaaaactatttttaaaagattataaatacttttttccgccatagattttgaatttcaccatatgaaatttaagaattagaaaattagcatgcttattttaaatataaaactaaagtttaaaattaaaaagtgattgtctagattaatatttaagacaatcccctatccaaattaatatttaagataaa

SEQ ID NO: 5506 - DNA, 144 bp, Methanobrevibacter ruminantium
tacaatcaacctcaataattaacaattgttatatttatattgaagattataatatttaaatatttagtcaaaaaatgaaaaataagaaaaaataatgaacaaattaataaaaaaaacttatgaaaactaatatttgaatgtaaa

SEQ ID NO: 5507 - DNA, 70 bp, Methanobrevibacter ruminantium
aaataattacctttaaataagcattaataagtaaaatagattaaattttagctttagacttgaattttaa

SEQ ID NO: 5508 - DNA, 142 bp, Methanobrevibacter ruminantium
cttaacacatccgattaatttaatatctaattttttataaatccttatggaaaatcattctttaaatcgctaaattaaaatttttataaatccttatggaaaatcattctttaaatcgctaaattaaaatttttataaatcc

SEQ ID NO: 5509 - DNA, 2 bp, Methanobrevibacter ruminantium
ga

SEQ ID NO: 5510 - DNA, 114 bp, Methanobrevibacter ruminantium
aattgcatcctcttaagtatttagtaatatgtactaaaatacatataaagatttctaataaaaatatgacaatattgaaatcggagtataaaattagattagaaaaataaaatt

SEQ ID NO: 5511 - DNA, 29 bp, Methanobrevibacter ruminantium
taaaataaagagtgctaaatccattagac

SEQ ID NO: 5512 - DNA, 398 bp, Methanobrevibacter ruminantium
aataaagcaataaaaacttaaataacttaagaatattattggtttttcattataactattcaaatgtttattttccataatttataaaagttttgcagaataatttttaaaaatcatttcataaacaaaatctctaaaatgattatattgaatttcaagaaaaaaagctttttttaagacttagagcattataaggagtttgaatttaaaatgaattttttaaaaaaaaaataaggctaaaagaatctctaaataaaaagtcaaaataaatatataataaaatatattatatacttaatactaaaatataaacaattgacattaatatttaatgtaaatgaggtgaaaaaatggaatcaaataagattttatccattataacaatattaattgggtta

SEQ ID NO: 5513 - DNA, 61 bp, Methanobrevibacter ruminantium
tttttacttttttttaaataaaaatagcttattttaattattaaaatataaatttaacttt

SEQ ID NO: 5514 - DNA, 261 bp, Methanobrevibacter ruminantium
tttttattctcctttcaattgataaatgattaatagtctgtaagtgtaaataagttttgatttaaattaattaagaccagcattaagcaaaagcccagaataatttacaggcaaaaataagctagtgcttagattgaaataacgcttaattaaatgaaacttatatattaaaaatttattataaattaatatattttttattatttaatatctttttgtttaaaatagaaattttaaatgaatatagggggatgtggttta

SEQ ID NO: 5515 - DNA, 203 bp, Methanobrevibacter ruminantium
aataattccttaaacaattatttctaaaaagataaataaagataattaaagataatcaaagacatcaaagacatcaaagataataaacattaataatgatttctttaaaatatatattaatattaatacaaaatgttaaatataaatttcgaaaactaagacaaaaaacatccaaagaaaaaatgcttgcagattaaaaataa

SEQ ID NO: 5516 - DNA, 7 bp, Methanobrevibacter ruminantium
ttttaaa

SEQ ID NO: 5517 - DNA, 79 bp, Methanobrevibacter ruminantium
ttgaccttaactttatatttggaattaagaaaatcttctgagaaaaattagccttaactttatatttggagatgaatct

SEQ ID NO: 5518 - DNA, 127 bp, Methanobrevibacter ruminantium
atttaaaaaattgccaaaactgtgctgatatttaaaaaaaaaacattaaatttattaacatatttgacaaatattaaataatatttataattacactttatttttataaaattttaaaaaggactta

SEQ ID NO: 5519 - DNA, 128 bp, Methanobrevibacter ruminantium
ttataaaaaaataggtcttgaaagaaaaagaatagtaaaaattataaaaaatagactttgaaagcaaggaaaattagttaaagcaattatatttactaaattaaacaataagataggagaaaaacccc

SEQ ID NO: 5520 - DNA, 64 bp, Methanobrevibacter ruminantium
ctaatattttctattaataaaatgaataaatgatattctatactattaaaagaaataaactaat

SEQ ID NO: 5521 - DNA, 173 bp, Methanobrevibacter ruminantium
ttttttcttttttttagcaaaataaaattagttcgttaatataagaataaaattaatattgtccaatatgagcaatttctaaaaaagataaataaaaagagataaattaaaaaaagtttaaaaataaataaaaaaataaaaaagataaaaaatatagcttatgaactaaacaa

SEQ ID NO: 5522 - DNA, 237 bp, Methanobrevibacter ruminantium
ttttatcacctattcctccaaaaattatttaatgatatttctatcttaaaggattattaaaattatctattttttttaattccctcaatacttaaaatataaaatatatattctaaaaaacccttcaaatataaaaccaaaaaagaatgtagatgaaaaaataatgtaggtaaaaaaatactaaatttaatatactatactaactaatagaataatataattaaaatactgatttat

SEQ ID NO: 5523 - DNA, 108 bp, Methanobrevibacter ruminantium
gggttaattgaaaaattataaaaaatagaaagaaaaaaggggaaattaaaagagaacacatatactgaaaaataattagtcttactcttttccctaatataaagcagt

SEQ ID NO: 5524 - DNA, 126 bp, Methanobrevibacter ruminantium
gatatcacttaaaaatttaaaaaaaatgggactttaaaaattattaaaaaagttttctattaacttttatatcatacaaagtataaaaactaaactatgataacagcagatttatgtattatacca

SEQ ID NO: 5525 - DNA, 642 bp, Methanobrevibacter ruminantium
aaaatgctttttttacatcaccataattgcattaaacattatttactcaacactttattaaaatcattcctttttagccaaatacctttttttaaaatcattcattctttacccacactttattaaaattatcattatacgaaaaaattatcattatttaaaactttcatcattataataaaatattatcattatattcaattttttctaattaaaataataatttactcaattaaaaagaaaattttatatttattgttcaatataacattccataacgaattattatatttttccacttcatctcattttgtggataatatcttaattcatgaggtgtttaatatgaaaaactaatttgacattaaggataaagtagcagtaattactggtggatcttctggattaggtttccaaatcggaaaagcatatgcagaccaaggcgctaaagtcgtacttcttgcaagaagagaagaaagattaaaagaaaacgttgaagaaatcaaagaaacctatggagtagaagcatcctacgaagtagttgacgtaaccgactatgcaaatgttgaagcagctgctaaaaacatcattgacaaatacggaagagttgacatcttagtaaactgtgcaggtagaggatac

SEQ ID NO: 5526 - DNA, 244 bp, Methanobrevibacter ruminantium
aacctcttttttaaaaaaaatagctaaataagattataaaaaaatactctttttaaaaaaaaaatagtttaaataaattataaaagaatactccttttaaaaaaatagcttaatatatattataaaaaactctctatttgataaaaaaatagtctaatgaataaaaaatactctttttgataaaaaacagataataaataaaataaaaaaaataagataaagaatatataatccataaaaagaa

SEQ ID NO: 5527 - DNA, 217 bp, Methanobrevibacter ruminantium
attttcacctaaagaacataaaacaaaataaaattatattaaataaaaattatagatataaaatgtaattaaatataattagttgattttctaaatatataatagttagtttttaaaatcttaataaatttagcttttttattcagttaaattttaaaatcttaattaaaaattcatagaattaagtaattaaaattccttatactaaaatattact

SEQ ID NO: 5528 - DNA, 264 bp, Methanobrevibacter ruminantium
ttttacacatccttaaaattggctgaagaagtggaaaataaataatttaatattaataaatcatttttcgaaaagaaaataagccaaaaatcaataaacacttatccgcaaaggaaacaattttagtcaattaataatgattagagaaaaattaatgaaaagtaaaaaaatacctaaaaagtaatatttaagtgaattaagtttaaataagatattttagaaataaatccattcagaacagccttagagaaaaaataagaataa

SEQ ID NO: 5529 - DNA, 53 bp, Methanobrevibacter ruminantium
gacaatatacatttcataatatactatacttaacaagattaaagagtgaaatt

SEQ ID NO: 5530 - DNA, 5 bp, Methanobrevibacter ruminantium
attga

SEQ ID NO: 5531 - DNA, 46 bp, Methanobrevibacter ruminantium
taaaacaatcaaatgtaataatcaaaactaaaactatataaaagat

SEQ ID NO: 5532 - DNA, 58 bp, Methanobrevibacter ruminantium
taaaaaaactaatttaattaattttttcttttaaacatgcaaatattgcttatttgct

SEQ ID NO: 5533 - DNA, 61 bp, Methanobrevibacter ruminantium
ctcaaataaacgggcattaaaaaataaaaaaaaagagaatttgaagattaaattaaaaaat

SEQ ID NO: 5534 - DNA, 139 bp, Methanobrevibacter ruminantium
tttccttaataaatctatacacttatattaatcaagataatataaatcttttttccaagaccatatgaaaagtatttttaaaaaatcctctcctaaaaattctatcctttcttgatagaatctataactaaaaataata

SEQ ID NO: 5535 - DNA, 21 bp, Methanobrevibacter ruminantium
aaatatgcctcaacactagaa

SEQ ID NO: 5536 - DNA, 107 bp, Methanobrevibacter ruminantium
tataaaaggtttttcaaaagttaatctatccccaaaatcttaaaacttaacttcactagcctaatttgaccaaaaaaaagtaatctttttcaaaatgctttgaataa

SEQ ID NO: 5537 - DNA, 64 bp, Methanobrevibacter ruminantium
cactttttctttagaaatcttaaaaatattttaattcataacaagtaattaaataaatagaaaa

SEQ ID NO: 5538 - DNA, 97 bp, Methanobrevibacter ruminantium
taagctaataaattaaaataaatagaaaaaaattactttaaataatttctaagctaataaattaaaataaatagaaaaaaattactttaaataattt

SEQ ID NO: 5539 - DNA, 31 bp, Methanobrevibacter ruminantium
aaaatcacaactatgtgataaacttttaaaa

SEQ ID NO: 5540 - DNA, 69 bp, Methanobrevibacter ruminantium
attatcaccttaatttctataaaattaaaaatcaaaatagtatttaaaaggtagagacgatagagcact

SEQ ID NO: 5541 - DNA, 15 bp, Methanobrevibacter ruminantium
aacgaagtgattttg

SEQ ID NO: 5542 - DNA, 530 bp, Methanobrevibacter ruminantium
ttgtaatttaatagggattattcatgaacaaatgtaatttaataaggattattcaaatggatagttcttatttttataattatccttctaaattcaagataaaaaaacacccgcccaccaataaactaatgaatagctaaaacacaccaccacagattaaaaacttgaataaaaaccaccacaagatttaaaacttaaccacattaaaaaatccctaaaagctaaaaaaaacctaaaaatctaaaaattgacaaaatcaaataaaaatatgattattttaaaaaatccactaaaaatttaaaaaaattaggcaaaaatatttaagaattgacaaaaaaccataactcttatataatatatattactatattttaaagtgtaatgacttaataatttaataacttaattatttaatgaattagcattttctaaaatctttttctatattgcattaattctttgaaatttaaatatccaaacattattaaatgcaaaatagaaaaaattaaatttttaaaagtcgtgattat

SEQ ID NO: 5543 - DNA, 114 bp, Methanobrevibacter ruminantium
gttggtttttaaaaaaaacttatataaaagttaattgaataaaaaaaaatcctaaaaagaattattttcaaaaaataaatgaaaataattctattattttttagaggatgtaaa

SEQ ID NO: 5544 - DNA, 347 bp, Methanobrevibacter ruminantium
aatgcttaaacaagcccaaaaacaattattaaaaaaagattaacaatctaaaaatattattaaaaaaaagattatacaagcaaaaagaataattgtttaaaaaaaattatttaaaaagagttaaacaattaaaagaaccctaaattaatcatatttatctttgataaacttgtaaaagagaaaattgaaaaaaatatcaatttatctttgataaactcttaaatcagtaaaaagatattttaaaaagactcttgaattgaaccctaattgaaaacgaaaactgttcaaaattatttaaaattgacctgatttattaaattagcattaaacaatggaggtataaaata

SEQ ID NO: 5545 - DNA, 7 bp, Methanobrevibacter ruminantium
gtttaag

SEQ ID NO: 5546 - DNA, 503 bp, Methanobrevibacter ruminantium
ctactttttttaaaaaatcttttaaactgaaataataattcaataaaaattaaaaaaatatactcttttaaattgaagcaaactattcaataagaattaaaaaaaaacttcaataaaacaatttattaactatttctaaaaataatattatagcgaatcatgattattctttaattgattggcttaaatcctagagagggattaaaatgactttagaagaaaagaaagaagaattatccgaaaaagtagaaaaaagaaaagaaactgacaaaatcaaagccgaagagtaaaagttaaaaattgaaaagaacaaagctaacgctagaatcagagctcaagagaaaaagaacgacatcaaaactacaatcaacgataagaaaatagcaaaacatcttgaaaaagctgataaaaaggttgataaggctttagatgatgcagacaatgagattttaaaattattagatgccattgacaaagagcttgacaaatacccagacaaacct

SEQ ID NO: 5547 - DNA, 373 bp, Methanobrevibacter ruminantium
gtcttctttaaacaaatttaagccaaaagatttgaataagtctttttaaacgaatttaattaaattcaatattgaagaaaattaatcattttcttcccttatttttttatactctttttaaacaccataaatttcaaataatgaaaaaacaatacccttcttcttaaaatagcaaatcaaaagctctccttttttaaaaaattagaaaataataattttagaatttactttgtaaaatatatatactatctaaattaaaaataactatataaattctataaattaataaatgattattaaaccttgtagaaatcataataaaaaaaactaatcaattaaaaaacaattaaaaaatgaatatataagtgatttt

SEQ ID NO: 5548 - DNA, 66 bp, Methanobrevibacter ruminantium
atatcttcctttgataattatcttaaaaaaaaactgatgaaaaaataaaataaaaactggtgtaaa

SEQ ID NO: 5549 - DNA, 174 bp, Methanobrevibacter ruminantium
aaaaaacctagaaaggccccaaagaaagagattgattctaaataattcatatatatatgaactagcttggctaaacaaccctcatttgattaaaaaagtcaaaataaataaaaatacatcaaaaaatgcattaaaaaagtcaaataaataaaaataaatcaaaaaaggcaaaga

SEQ ID NO: 5550 - DNA, 178 bp, Methanobrevibacter ruminantium
tttaaaaattacttaataaaatgacaaaaccacactaattgattaaaccatactgattgattgatgagaaacttactgattaattaaagcatattgattgattgaaaaggaacctactgattgattgaaaagctctaataaaccacaaaaatcataaacctaataatgcgccatatat

SEQ ID NO: 5551 - DNA, 99 bp, Methanobrevibacter ruminantium
acaatcaccaaaaatctaaaataaacttaaaatcaaaaagaaactattataaaattaagcaaattgctttcaatattaaatatatactgcctagttttt

SEQ ID NO: 5552 - DNA, 48 bp, Methanobrevibacter ruminantium
atacaaaataaaagtagttaggaaaaagtataattaaatcaaagctaa

SEQ ID NO: 5553 - DNA, 16 bp, Methanobrevibacter ruminantium
tacgaggtgtattaat

SEQ ID NO: 5554 - DNA, 134 bp, Methanobrevibacter ruminantium
acgtgagaattatttattttaaaaactttattttacaactaattttacatattacagtataaatagtatatgcaataattaagtaaacatcttttttatgacacaatagctgtttattaaagcatataagttaa

SEQ ID NO: 5555 - DNA, 526 bp, Methanobrevibacter ruminantium
tttattatactacttaattttatattcttaaaagtttaagacagttctataaacttttaactaaaattaaaacataattaaaaacttagaaaaacagttttttaacttaaattaaaaatatagccagtcctataaacttttaactgaaatataaatattaaaacagcttatttaaaaattaaccaaaatttacttaaccaatatttaatattgcatttaaactagaattaaacttttagagattggaataattcaaaaaggaattaaacccacaatttaaatcacaaaaaatcggaataattcaaaaaggaattaaatccacaatttaaatcacaaaaaaatcggaataattcaaaaaggaattaaatccacaatttaaatcacaaaaaaatcggaataattcaaaaaggaattaaatccacaatttaaaaattagattttcaaaaataattattttacaaagatattagaatattgacttattaccatatactaattttatacaactatttttcgaagtgattat

SEQ ID NO: 5556 - DNA, 343 bp, Methanobrevibacter ruminantium
acttatactaaaatttaataaaaaactattatcttataaaagctattaaacttttaaaagctattaaacttataaagctattaaacttttaaaagctattaaacttataaaaactattaattttataaaagctattaatcttaaaaaagctattagaaaaattaagaaataatagtatataataaataatagctttaacaaattatatattataacttattgaaaaaataagaaaattcatattaaataatttgaaatttgattcaaataaattaaaaaacattaggaaaatcttaaaaaagaattttcctaagtataaagaaattattaataaggtgttttt

SEQ ID NO: 5557 - DNA, 192 bp, Methanobrevibacter ruminantium
actttaaaagaataattaactttcaaagaaaactaaacctattaagtttaaagaataattaactttcaaagaaaactaaacctattaagtttaaagaataattaattttctaattattaaaaaagaaccaattaaaacttattaataattaaaacactaaaatttcagcattaaggaaataggagggaaaga

SEQ ID NO: 5558 - DNA, 176 bp, Methanobrevibacter ruminantium
tgaattagatattgatttagacagttatttaactgaataaatcattctttctttttctttcctatttttttaaatttactctttttagctcacagcatactattttttaaactgattttaaaccactatttttataatattttagatttaaaactactcttttttgaaatgctatt

SEQ ID NO: 5559 - DNA, 38 bp, Methanobrevibacter ruminantium
gaggcatctatcatttaataaaacaaaattgtgaaaaa

SEQ ID NO: 5560 - DNA, 136 bp, Methanobrevibacter ruminantium
taaaaacacaaaaacaagaaaacaaaaatgtgaaaaaattaaaatctgtaaaagtgaagaaatgaaaagtcacaaaaagaaatgaaataataaaaaagagaaaagaaataaaaaattgaaaaataaattaggataa

SEQ ID NO: 5561 - DNA, 64 bp, Methanobrevibacter ruminantium
attaacacctaaaataaaaataaaataataaaaatcattaatccggcttaaaaaaataaataaa

SEQ ID NO: 5562 - DNA, 100 bp, Methanobrevibacter ruminantium
aaacacacatcctttttattttaaatataacaatttttaaacattttaataaaatctaatagaattatctaaaataatactgatagtaaaagaccataaa

SEQ ID NO: 5563 - DNA, 122 bp, Methanobrevibacter ruminantium
cttatcaacctaagtaagtaaaataatattttataagttaaattaaccttttaagaatttaacaagttttaaataattttaaattttttcttcaatttccaaatccaaatcttttgaaaatt

SEQ ID NO: 5564 - DNA, 117 bp, Methanobrevibacter ruminantium
atagattacaggtcgaatggtaaaaaatgacaataccaataaaattattatgataaatatgtgtaatgcatacttattttttagtaaaatctatcatttcaatcactatctataaaa

SEQ ID NO: 5565 - DNA, 61 bp, Methanobrevibacter ruminantium
aaactcttaaacaaataaataataaagttataaaattttttctattaattatcaaatttat

SEQ ID NO: 5566 - DNA, 91 bp, Methanobrevibacter ruminantium
cttatcacctttagaaactaattatttatgagcataagccaccatatcttcgatagagctaaatccgctctcatctacaaattcttccaag

SEQ ID NO: 5567 - DNA, 269 bp, Methanobrevibacter ruminantium
tattaacctccaaattgtataataatttaattttaaactgaactttttaaaatctaagatttcgatttaattattaatttcccaaatattagatttgtgatagattttttattaatttcctaaatattttatatttagcataatagtatttttattaattatactattttaatttatgattaacatatgatatataatatttgattttttttaaatgaaattctaaaaattatgtaaaatatattaaaaacaaaatgcaaaataaaact

SEQ ID NO: 5568 - DNA, 134 bp, Methanobrevibacter ruminantium
ctttttttaaaaaaagtataatactactttaaaaaaagaagaatgaaaattattgattttataaaaaaagcttaaaacttattgaattatactaaaaactaaaaataaagaatttaaacaacagagtgagaata

SEQ ID NO: 5569 - DNA, 1026 bp, Methanobrevibacter ruminantium
aagataccaccatcatttttcaagaaaaaattttttaaaaaaccatacaaaatcatttttatttaagatagattattaaaagatatccaaataaaaaatcaatactattttttataagattttttataaaaagaatgaaagaaaaactaaaattaatatgaacaaatatttaaaaaatgataaaaaaaataattaaaaataaaggtttttagctctttttagccattttaaagcattataatataagtattacttttttatgaaaactcaaaaactaaaattatttttaccatattattttcataatctgattaggaaaatctatttaaaatctaaaataggcaattgataattaagtatgattgacttgagaaaataaattgaaaccatatataaaataactaataatttaatatttccatatcatacgaacaatatgaaaaaagtattacttatgaaagctttttatatgataaaataacaaatatataattgctaatgcaatgcaaaaaaagttcataaaaatatcctctaagtttattcactcataatattactccataattacaaaacttagaggattgaacttttaaagccaaataactatttttaaactctttttctataaaatttttaaaaaaatactaaaatttttccctatttttaaaaataagtaaaaacaactattttcttaaaaaaagtaatacttttttgataaatttcttaaaataaaaagcactttaaaactagttttaaaattcaatatatttttattattatattcaaaaaataaggaatttaaatagaaaaattgtaaaaagctaaaaaattactttgaaaaaataagaattaaaataggaaataaaaaaatcacattgaaaaaaaatagaattcgaataggaaataaaaaaaaatgactttgaaaaaataagaattaaaataggaaataaaaaaatagaaattagcaccatcatctaaagattagaaaagcaccaattataaaaaaagattaaaagcaagaaatag

SEQ ID NO: 5570 - DNA, 122 bp, Methanobrevibacter ruminantium
ataatcacttcaaaataaaaacaaaattaaaaaattaacttaaaagaaaagaaaaaaattttaatgcaaatagaaaaaacaattaaattattaaattaatgcaaatagaaaaaatcaaaaaa

SEQ ID NO: 5571 - DNA, 179 bp, Methanobrevibacter ruminantium
aatttatctccaatggaaaataaatacttaaataactaataaatttaataatcgcttaatataagcattttaaaacaaataaataaaaatccattccaataaacgccaaataaaagcaattattaaaacaataaaattaataaatcgtcgaataattaaaatttaaactaaaaggcttg

SEQ ID NO: 5572 - DNA, 101 bp, Methanobrevibacter ruminantium
attttacctcctataagttgattatagaatttaaaaatatttataagaattaataattgttaaaaattaaaaaaattcaaaattcaatttcttttcaagaa

SEQ ID NO: 5573 - DNA, 252 bp, Methanobrevibacter ruminantium
atgaaaactcctattaattataaagctagttaactattattttattatttaatttactatctttaatttatttcttttaatataaaaaaatatggtataaaaactaaaaaaaagagtttgtaaattagtaaatgaataaaaaaagtacaataatgaaagttaaatcttagtaaatagagttaagatctttataaaaatagcttaaaaatagcatgaaatcttaagaaaatagtttaaaaaaaataaaaaaaa

SEQ ID NO: 5574 - DNA, 44 bp, Methanobrevibacter ruminantium
ttaaaaaaataaattaaaattaattattgagtaaaaaaacccaa

SEQ ID NO: 5575 - DNA, 331 bp, Methanobrevibacter ruminantium
tttaatcccaacgataaatttgagatagctattaaactaaaaaattattcaaaattgaacaatgaatatcttatcaataatagcattatcaaagatataaactaactacttaccaatagctatctcttaaagttcaacaatagctattttgttctaaaaattaatttaaacacttcaaataattaaatttcctttagaacaatgcaaaatcctaacttaattaagtattaaaataattaaaataattattcttaaaaaggaattttaagaacaatatttaacttaaaataatcgctctaaagaccatataaagaataattaaatcatttat

SEQ ID NO: 5576 - DNA, 441 bp, Methanobrevibacter ruminantium
agattttctcaaatttttagtgcttttgtctttcatttcgacacctccgaatttactaagtctttcaggtctaaactacaaatatctattctttaaaataaaaaaaataaaaattcataatttaatttagaaatatggatttgtgggaagttctaatgtatcattaattccatcattaaattttcgcatcttgaaaactctattagaattttaaattttaactatttaattccatcattaaatttccgaatcaagaaaattctattagaataacttatcattgattccatcattaaattttcaaaggaaaattctattagaattttaaattataaaaatttaaaaaatgatatagaactaactacatttttaattatgttatgcttattaatattattatcgattttattctaaaattgctaaattttcacatcaaaattg

SEQ ID NO: 5577 - DNA, 152 bp, Methanobrevibacter ruminantium
aatttagaataaaataagaaaaagttctaaaaaaattaaaaaaaaactaagagaaaaagctactaaaaaaattaaaaaaaaactaagagaaaaagctctaaaaaaaataaataaaaactaagagaaaaagctctaaaaaaaataaataaaaa

SEQ ID NO: 5578 - DNA, 61 bp, Methanobrevibacter ruminantium
aatttactttttttaaaaacagaaatacaaaaaagataaaagaacagtaatgaatactatt

SEQ ID NO: 5579 - DNA, 40 bp, Methanobrevibacter ruminantium
ttcattcctctaaaaatttttgccaattattaaaaatttt

SEQ ID NO: 5580 - DNA, 300 bp, Methanobrevibacter ruminantium
ttaaaattaatcgatttttttacgaacaaatcaattttacgaaaccacatcaatatcacacaatcaaaacaattttacgaagtcacaacaatttaacacaaccaaatcaattttacgaaatgacatcaatttaacactttcaagtaaaaattgattttatctcgtaaaattgtctgaaaatagtaaattgatttcaaattgcaaaattgatttcaaattgctaaattgacttgaaaaaaactacatactttatattatatgaaaaatagagaaaaaataacaaagtatggagtgaagaaa

SEQ ID NO: 5581 - DNA, 195 bp, Methanobrevibacter ruminantium
aaaatgattgaaaaatcctaagaatatacattaaaaaaaaaacctagtaaaaaaaagaatatgctagtaaaaaaagaatatgctagtaaaaaaagaatatgctagtaaaaaaagaatatgctagtaaaaaaagaatatgctagtaaaaaattaaaaaggaaataaatgggatgaaaaaacagatggaaaaaagta

SEQ ID NO: 5582 - DNA, 158 bp, Methanobrevibacter ruminantium
aaaattacctttactgcaataaaaaattaataaaaaattgataagcaattaaaaattatgtatgaggaataatataaattcttaccaattaataataaagcgctgataaaccgcttaaaagaccaaatttaatctagttttatcttaaaagacctaat

SEQ ID NO: 5583 - DNA, 109 bp, Methanobrevibacter ruminantium
aaaatcaccacgaaatgtaattctttaaatcatctattccaaataaagcattccgaatataattttctctcaaattatttcctagaataaactcctaattttaatatta

SEQ ID NO: 5584 - DNA, 137 bp, Methanobrevibacter ruminantium
tttctactcctcatataatttttaatcagtaatcaaataaatataataattaaataattagaaaaaacaattctaatcaaccttaatataaaataaaggaaaattaaaagttatccctttaattaacctattaaaac

SEQ ID NO: 5585 - DNA, 119 bp, Methanobrevibacter ruminantium
cctatcatccctttttataaaaatctaaaataataatcaataacgcatataattaataattactccattaataatgattaacaataatattaacgataattaacaataattaacaataa

SEQ ID NO: 5586 - DNA, 31 bp, Methanobrevibacter ruminantium
aataattaacaatatattaacatttactccg

SEQ ID NO: 5587 - DNA, 13 bp, Methanobrevibacter ruminantium
taatatcaaactc

SEQ ID NO: 5588 - DNA, 114 bp, Methanobrevibacter ruminantium
gattcttctcctttaatgagtatcaataataatctcaaagttaaatcaataattgactatcataatctgtccaattatcataaatcaattaaagattaatttgatgcttaatta

SEQ ID NO: 5589 - DNA, 118 bp, Methanobrevibacter ruminantium
cacattctatatgatttaagttatcaacaaaataaaagtacataagataaaccgattatgatttatgaatttcggtttatgaaataaaattaaattacttatttaaatttagtaaaaa

SEQ ID NO: 5590 - DNA, 25 bp, Methanobrevibacter ruminantium
taaaataccccagtaatgttttagt

SEQ ID NO: 5591 - DNA, 57 bp, Methanobrevibacter ruminantium
tgaacaattattataaattttcatgaaaattattttttacattataatactattaat

SEQ ID NO: 5592 - DNA, 196 bp, Methanobrevibacter ruminantium
aaaatccctcattttataaattaaatttaatttaagttaaataatcatattcaaatagaatctgtaaatttaagttaaataatcctttttaaatataatttgtaaaaattagaatataaattaaatgagagcgtctgaaaactaatagcaaagaaaaaatcgttataataaaagatagaaaaaatccttagaaaaa

SEQ ID NO: 5593 - DNA, 256 bp, Methanobrevibacter ruminantium
atgaaagctcctacaaattaaaaaaaagttgaatgtccgattaaataaattaaaataaaatatcaaacatcaaaaatatctatttctattacagttttaaattatcttttttattttatttaaacttacaattatatataataaaaaacaaagtttaaaacataatgttaattcaaggatagacaaattctagaattaaatttaattaagatatcataattaactaaatgattcaaataatataaagagtgataat

SEQ ID NO: 5594 - DNA, 361 bp, Methanobrevibacter ruminantium
atttaattttatctattacttttctttttttattctaatttttattattaattcattaattaaaaatcaacatataaaacctttttttaatcaaattctttttataatttttatatgcttaatttaaacaagtaaatttactagattaatacaaaaattcaatgagtaattttatactataaaatgatagttatataaagattatacaaaaaatatatatactaaataagactaaataagtatagagaataatatgtactcaattacatatcaccccctttacatatgttttttttaaaaattaaacctttacatattattctcgcccctttataactatttttaaactttaatttactct

SEQ ID NO: 5595 - DNA, 177 bp, Methanobrevibacter ruminantium
atgggctttaactatctctccattaagctcaacttctgcaataaacctattaggtctgcttttaaaaatagcttttactaaattgctaataaaatcaccttaaataaagaataaatattttaaaattaattaaagataatttgatatcattaaatgaaaatcatagcaaaataagaa

SEQ ID NO: 5596 - DNA, 308 bp, Methanobrevibacter ruminantium
tgtttcaccctaatctctgaaatcttttcttaaatttgaaaaagatatttgataaaatttctaaatgacattaaagttttaaagaaaatatccttaaaatttaaagtataaaattattctaaaaaactcttagaaaaatcataaagataaaaagtattaaattattctaaaaaacttctagaaaaatcataagaaaagaattatcataaataatataatatattaacttactaataattaaatatacaataaataagttgataaataaaattctaattaaaggacaaataagccccgtctgaattata

SEQ ID NO: 5597 - DNA, 105 bp, Methanobrevibacter ruminantium
actaaataaatagggagtttactaaaaagtttaaggaataaactaaataaatagagagtttattaaatagtttaaagagtaaactctaacttttttttataaaca

SEQ ID NO: 5598 - DNA, 159 bp, Methanobrevibacter ruminantium
taaagattcctcgctaaatttgattattaattttttaagtataagttggcggtctgcctaagaataatagtgatttaaataaaaatatagaaaaaaagtagaaataaaccgttttttaaaaaaagtagaaataaactattttttaaaaaaaagaaaaaa

SEQ ID NO: 5599 - DNA, 63 bp, Methanobrevibacter ruminantium
tctagaaaaatggacaaataattaaattatccataactaattaaatttttaaaaattacgcat

SEQ ID NO: 5600 - DNA, 326 bp, Methanobrevibacter ruminantium
tatttcaccattttaaaatgattaaattagataaattaatatttaaaagattaatttaaaatgaaattaatctaatttatactaatgattaaatatatattaattctttaaaataaagtttcctatttaattccaatattttgtttgttataatacgaaataagaattttaaatgcttttgatagtcctaaaaatggaattaaataaaaagaatagagatttttaaaatagaagaaataaaaaaagaaataaatttaaaaaaagagttataaaattcatcaattgatttcaaaaaaaatagcttaaataaataaaaaaattataat

SEQ ID NO: 5601 - DNA, 311 bp, Methanobrevibacter ruminantium
tttatcagctctaaaaatagtttttaaaacttaactaattgttttaaaaacttattaaataattattaaaaaataactgttttaaaaacttaactaattgtttttaaaaaattatcctttttaaatatgaatataattaatatttaattttaatatataataaagtttttatttgagattaaaaaccactatttttatatttgaaaataaataataaacttttaaataaacttttcaatacattagtttgtaaaaccataaacaaaactataataatatttaaatatctaaaagatataatcaatatttgt

SEQ ID NO: 5602 - DNA, 90 bp, Methanobrevibacter ruminantium
aataatccatttaatttaaaaaataagaaaataatcctcctattattataaacaaatgaaattacacccttaaaatcaccaaaaaatcct

SEQ ID NO: 5603 - DNA, 10 bp, Methanobrevibacter ruminantium
atcctcctaa

SEQ ID NO: 5604 - DNA, 45 bp, Methanobrevibacter ruminantium
aacacaataaacaattaaaaactatttttctaaaaaaagcaaaaa

SEQ ID NO: 5605 - DNA, 545 bp, Methanobrevibacter ruminantium
aatttcaccaaaaaacttaaataaatatttaaaagctaaaataagtttatttaataaattaaacttaaattaaagaagttcaaaataaatttcatattccttaattaagattttagattaaatagtaaataaaattaacctaaatgaaagaaatttaataaaaatgaatgaaaaaagtgataaaattagtgaaaattaatgataaaattgtaaaaaactagtgaaaataatgataaaactagtgaaaattaatgataaaattgtaaaaaactagtgaaaataatgataaaactagtgaaaattaatgataaaattgtaaaaaaaggtgataaaataaaaataaatttaaaaaaaagaaaagatggggtcacagggatttgaaccccgatcctgggatttctcttgcctcagtactccaattggtcatcacataaccaatttatactgatcatcagactacgcgtatttcttcaaagacaactggagtcccagatgatgccaggttacaccataacccctaatgagattaactttcgttaatcaaa

SEQ ID NO: 5606 - DNA, 146 bp, Methanobrevibacter ruminantium
aattaataatacagtactataaagtatgttttaatagtatttaaatgtattgattaatttccaataaaaaatttcttagtaaaagagctaaaaggagtataaataagaaataaagaattgaaatctatcagatatattaaaaagga

SEQ ID NO: 5607 - DNA, 90 bp, Methanobrevibacter ruminantium
agctgcaaatttcctatcccataatttatgaactaaatctctttcttcagctgaaccttttttagccatattaaaacccactcataagtc

SEQ ID NO: 5608 - DNA, 52 bp, Methanobrevibacter ruminantium
atatctgaaaagtaaattaataaaaataggatttaaaaaaatagattaaaaa

SEQ ID NO: 5609 - DNA, 41 bp, Methanobrevibacter ruminantium
acatatagcccattagggaaaaacaaaatataaaaagatta

SEQ ID NO: 5610 - DNA, 44 bp, Methanobrevibacter ruminantium
attaagagagggaggagatccctataacctttcaaaataaaaaa

SEQ ID NO: 5611 - DNA, 40 bp, Methanobrevibacter ruminantium
aaaaaaatacaaatgaaaataataaaactagaatatgcaa

SEQ ID NO: 5612 - DNA, 5 bp, Methanobrevibacter ruminantium
aaaaa

SEQ ID NO: 5613 - DNA, 350 bp, Methanobrevibacter ruminantium
aaaataacccacgcttgcaaatcaagttttatttacatcactgcaataagacagtaataatatgttgattaacatagtatataaatgtttcgttttatcataaaaaatttgattttcttaaaaattctttccaaattttaaaaaaaaaatcagcgaaaaaacgcaataaaaaaaccatcaacaatgaaagttagtatccaataatatttaaaacttactagaaaacatttatttaataaaagatatattaaatatagaactgatatgaggacatctttaagatacttattgcagaatttaaaatctaaaaagaaaataagaaagctttaaaatacataaatactaaaaga

SEQ ID NO: 5614 - DNA, 306 bp, Methanobrevibacter ruminantium
tgaggttcaaaaaagagtctttaaagaacaaatacaataataaggtttaaaaaagaatctttaaaaaaacatacccacaaagcatcatcacaaataattttaatataataatatcaaaaacataaccaatagctttttaaagataatctttataaatataatactacataaattaacataatatgaatttagtactatattgtataataataaaagattatatgatattataaataaacaattcattctaatataaaatcaaattaatttaaaaagatcctcggagggattaacatagacgtagat

SEQ ID NO: 5615 - DNA, 41 bp, Methanobrevibacter ruminantium
ttgcttaaacgcattattctaaatttttttttattaattga

SEQ ID NO: 5616 - DNA, 110 bp, Methanobrevibacter ruminantium
gcaaaaacaatcctaaaaaacagaataaggaaaaaatccaaaaagcaaaacaaattggataaaaacaatcctaaaagtaaaaaaatatattatctcaaggaagtgaaata

SEQ ID NO: 5617 - DNA, 144 bp, Methanobrevibacter ruminantium
ttcttttattcttctttttaagaaggaaataagcttatcaaaagaatgaaaaaaagccttcttaaaaaaatgaaattcttctttttttatttgaaaaataaattagtttgaataaatacgaataaaatatctatttaaaaaaaa

SEQ ID NO: 5618 - DNA, 134 bp, Methanobrevibacter ruminantium
cgtaaattaaaaaaatattgaaaaataaataaaaaacaataaaattaagcataaagcaaaatattatttttattaataaaattaaagtaaaaaaataaaaatttaaaatcaacaggtaaaactataggattaaa

SEQ ID NO: 5619 - DNA, 19 bp, Methanobrevibacter ruminantium
atcacatacaatcaaaata

SEQ ID NO: 5620 - DNA, 189 bp, Methanobrevibacter ruminantium
aaaaggagtttaaaaaaacttcaaacatgaacaaaataaataataaaaaaaaggacttttatgaaaagtttcattatattctcatttaaaaaactaaattaaatccgattaagagctaaaacaagcccttttaaaaggtttaaatataaatatcaaaaaagagatatgtattatttagagatgatataa

SEQ ID NO: 5621 - DNA, 154 bp, Methanobrevibacter ruminantium
tttttttattttttttttaattttttaaacttagtacaaaaaactcattttaaaaagaaaaaacattttcgaaagagaatactttctaaaacaaataatattaactattttttaaaataaaccaccattaatccagaactatcaagcatgaggg

SEQ ID NO: 5622 - DNA, 180 bp, Methanobrevibacter ruminantium
taaaacgacctcaattgataatataatattaagtttagtatatccacatttacggacaaaattaaacaaacttaaaaaaaataataaaaaataattataaatatattataaatatattaaatctaaaaaattatagttttaaagtaaaaatagtaaaaaaagagtaaaaattaaaaagaa

SEQ ID NO: 5623 - DNA, 629 bp, Methanobrevibacter ruminantium
atttgacctccataaaaattatcaatataattattttataaaataaatgatttctgaaattttataagaattatacttaaaaaaatcaatattatcctttcacattaaaatataagtcaaaagtattatattaactttttgttactaaaatttaataccataataataaaaccccatataataaaattactttttgtaagaaaaaaccgaaatgtttatataacattttgttactaaagtaagtatagagaaagataactttttgttactttaataaaattgacaaaaataaaatctaaatcctaaagagatttcccataaattggcaaaagcgacttaccaactacctttgccgattatgagaaaatacaaacgttattgaaagaaaccataaaattctataagctaataacataggatgtatcaaagaatatttcaattcctctttaaaatcacactatatgatagaaaatgaaaaacgaacgacataaaatacttcaaattctttaacccaaaaagaataaaaatcaaatttctttggtagagtcaaatattaaaggagctaattgatttctttctctttatacttataatttttaattaataaaaaccgtcaaaaggtgacttag

SEQ ID NO: 5624 - DNA, 79 bp, Methanobrevibacter ruminantium
ctgaatcgtctaaaaagctaatcttcaaataaaaaaaacaaattaaaaaaattctttaaaaagaaatacttctaaaaga

SEQ ID NO: 5625 - DNA, 78 bp, Methanobrevibacter ruminantium
atatatagtttaaagaagattaatatctaagtttaaaaaaaagattaaatatctaaatttaaactaaaaaaaacattt

SEQ ID NO: 5626 - DNA, 151 bp, Methanobrevibacter ruminantium
ttttttaatcaaatttattttgaataaattttaattaaacctctcaaaaaatttaaaaaagaattctaaaaggggaatctgtaatttctcatcaaatctaaatatatatcaactccgtttaatcccctttggaattcttttatttttattt

SEQ ID NO: 5627 - DNA, 77 bp, Methanobrevibacter ruminantium
agaataaaagaataatttaattcaaactatttttaaaaaactcatacttattatatactcatgaaaaacacttaaag

SEQ ID NO: 5628 - DNA, 43 bp, Methanobrevibacter ruminantium
tccctaaaaaagtttttatctgtttttctaactatttttccaa

SEQ ID NO: 5629 - DNA, 487 bp, Methanobrevibacter ruminantium
ttattttttatttttttatttttttattcacactacttttattcttttttaaaacctaatttctatttcttattctcactacttttacttcttaagaggacatttacactaattttcttgagttccaacaatttgcataacaaaaattatagaaaaatgtgcaaaaattacaaaaaatatatgcactatgtatcagtaaagaaaaataaaaaatatcattacatgaatcatcaattaaaataacaaaccctataattaaacatgaaaaatatacccccaccatcattttaaaaacacctctttttaattaaaatataataaaaaacttttcaaaaaatgactcataaaaatccataattttttctcaatgaaattttaaatttacatttttacctccccaacacatcttaaatttaaaaactatgaaaaacatataaataataggcagaaaatcaaaaccaaacaaaatatcaattaaaattatcgg

SEQ ID NO: 5630 - DNA, 39 bp, Methanobrevibacter ruminantium
accaagattaaaaaagttgacacaaaaacgagagataaa

SEQ ID NO: 5631 - DNA, 76 bp, Methanobrevibacter ruminantium
aagtgcttaaaaaaaaaagaaaacttacaaaaaactaaaaaatcttaaaaaagttgcttaaaaaaaaaagaaaaaa

SEQ ID NO: 5632 - DNA, 249 bp, Methanobrevibacter ruminantium
attattaaccccaatttatatattatacataattactattagttttattatcattatattatatatttaactaactgttaaaatatattcaatcattcgattaattaaatgaatatttttaaaaaaagagtagatttaatcatttttaaattaaacataaataaaaactttataaaaatcaaaaaaagaagatttataagccaaatagtaaaaccttttgatcaaactttttttaaaagtttgaaaatg

SEQ ID NO: 5633 - DNA, 204 bp, Methanobrevibacter ruminantium
cattagatataattttattttttatagtataaataattaaaataaatcaaaaacagtgataaaaaatagtggaaatgtgaaaatcaaaaagtgataaaaatagaaaataaaaagataggattaatttaaagtgataaaaatataaaaaaagaaaggagaattaataaaattcccaattaaaaaaaaaaaaaaaatagaaaaaaa

SEQ ID NO: 5634 - DNA, 66 bp, Methanobrevibacter ruminantium
aatatctcctttaataagaattaatttttaacaatccaaacctataaccacttacctaattggaat

SEQ ID NO: 5635 - DNA, 180 bp, Methanobrevibacter ruminantium
tcataatcaccaataataaaaaaatataaaaaataaatataaaacattgaaacattaaataattaaattaaattaaaaattaaaataattgaaatattttaaaacaataatattaaaataaaaactaaataaagaaaaaaacatgatttaagcatatgaaatataattaaatctctctaa

SEQ ID NO: 5636 - DNA, 296 bp, Methanobrevibacter ruminantium
taaatcttatcatcaatccaaataaaagataaataatcattatttttacaaaaaataatcattgcttaacttaaattcaatatcaagataaataatcattatttacctaactaaagacaaataatcattatttaacttaaaaaacctttaaaatttaaagaataaaaattaaaacttatacaaaatctaataaaaaaataaaaagaagagaaatatttttctctaatttatttaaaaatttaaattttcaaaaagataacaaaaaattactcgaacgattgaaaggactctaaaga

SEQ ID NO: 5637 - DNA, 66 bp, Methanobrevibacter ruminantium
aaaagaaaaaaaataaataaaaattattaaaattaccttaactccaaaaaaactaaaaaaaaataa

SEQ ID NO: 5638 - DNA, 6 bp, Methanobrevibacter ruminantium
aaacaa

SEQ ID NO: 5639 - DNA, 55 bp, Methanobrevibacter ruminantium
ttaaaaaaatttttggtcaaggtttttgcggccgaaggccgtaaaaagcttgaat

SEQ ID NO: 5640 - DNA, 312 bp, Methanobrevibacter ruminantium
aattatgccttttttaaatttttccaataaatattaaaaattaaaagtcaaccgaattaactttatcttagccagttttttttcattaagtgtgcttatatttaatatttattaattataatagaggagtaataattatttaaatcttattttaatacttaaatggaaaaataaggacaaatagtaataattttttaaaataatattactaaagagcctaaaatgataaaaaaagtattacaaaatcagtattttacaaacttcataaatgaaatagtattattaattacaaaatgttataaaaatactgat

SEQ ID NO: 5641 - DNA, 19 bp, Methanobrevibacter ruminantium
aaataaaaaataaataaaa

SEQ ID NO: 5642 - DNA, 128 bp, Methanobrevibacter ruminantium
ataatcaccaatttagttgaaattattgatatttgttgatattactgatattattgaattattaatatgtgttgaatttattgagattgtttaaacatgtttttaacaataataaccacaatcagtga

SEQ ID NO: 5643 - DNA, 151 bp, Methanobrevibacter ruminantium
ttaatcaccaaaaaaataaatgaaataagtttaaatgaaaaataacctaatatccaagagatttggataatgttttttaaaaacttcaatattatagaataaaagcaaaaagcttaagcaaatcattgagagaatttttaaaaaacaaaaa

SEQ ID NO: 5644 - DNA, 49 bp, Methanobrevibacter ruminantium
taccttattattttaattcataatagccttcagacaatgcactattatt

SEQ ID NO: 5645 - DNA, 84 bp, Methanobrevibacter ruminantium
atgtttaaacacctcaataattaaaaataaatcagtataatggtttagttagttgtaaaactttaaattatatattaaatggaa

SEQ ID NO: 5646 - DNA, 40 bp, Methanobrevibacter ruminantium
gaatatagaataaaaaacaagaaataacatataaaaagaa

SEQ ID NO: 5647 - DNA, 94 bp, Methanobrevibacter ruminantium
tatctaaacaagtattaatttttgactggtattttctaaaaagaattaaaagaagaataatcaattattcatatcttaaagacgaataaaagaa

SEQ ID NO: 5648 - DNA, 307 bp, Methanobrevibacter ruminantium
caactcacctcccagtaatttcttaaattcatcatcttaatacaattacactcatagacaaaagttttgatttgaattaaaattagaagcctaattatgatttttctatataaaattctaattttagtaaaaacttatgtcattggaagtattttaaaaaaaataaacaatataaaaatctgtttataaactctaaaatacagttgagttattgttaatatatttattttaatattaataaatataactaaaataattgattaaatataaaaaataaaaatagcaaaaataagtaaaaaaagcaaaa

SEQ ID NO: 5649 - DNA, 13 bp, Methanobrevibacter ruminantium
aataaataaagga

SEQ ID NO: 5650 - DNA, 85 bp, Methanobrevibacter ruminantium
acgaaatttactgaataaaactgtttaaataaaaaaataattaaaaagaatagtttataaaaaactaattcttcttttaaaacat

SEQ ID NO: 5651 - DNA, 99 bp, Methanobrevibacter ruminantium
aattataaacctcgtttttaatccaagactattttataatcttaaaaatctaaatactataattcaaatttaattttattgatactctcgataaaaata

SEQ ID NO: 5652 - DNA, 68 bp, Methanobrevibacter ruminantium
aaaaaattcagactttgaattttaaaagtagaaatataacagtgttatatttgtattccataaaaaaa

SEQ ID NO: 5653 - DNA, 13 bp, Methanobrevibacter ruminantium
aaaaggatttagt

SEQ ID NO: 5654 - DNA, 15 bp, Methanobrevibacter ruminantium
aataaagccccacta

SEQ ID NO: 5655 - DNA, 456 bp, Methanobrevibacter ruminantium
gattttacctccatgaataactaaataaattaattattgacttaaatatgaatcaattaatcagatagttattggtttaaataagaatatgtatattatatcattagcaatatataaaaatttttatacttttttgtctataagattaattgtagacaaattttagattaaattcctaatgcaaatattgcctaagataggaattaaaataaaaaattagattaaattcctaaggtaaaaaataccaatataggaattaaaataaaaaattagattaaattcctaaggtaaaaaataccaatataggaattaaaataaaaaattagattaaattcctaaggtaaaaaataccaatataggaattaaaataaaaaaacaagattattacttattcaatgaaatataatttgaaaaactaaataaaaaaggatattttaaaaaataagccgtgataaa

SEQ ID NO: 5656 - DNA, 50 bp, Methanobrevibacter ruminantium
acttttttttactttaaatataagaagtgcttttttaaaactaattattt

SEQ ID NO: 5657 - DNA, 49 bp, Methanobrevibacter ruminantium
aattccaccaaaatacttgcttagtttgaaaaaataaactttgaaaaaa

SEQ ID NO: 5658 - DNA, 253 bp, Methanobrevibacter ruminantium
aacaatttaacatcctcaaatcaatttcacacgatgacaacaattttacgaactcacaacaatttaacatcctcaaatcaatttcacacgatgacaacaattttacgaaatgaagtcaattttacgaaatgagaacaattttacgagataaagtcaattttgacataatcgtgtatttatatcaaaaaagaaacatttataaagtttaaaaacaaaaataaaacataattaaccacgggaggcattgataaaa

SEQ ID NO: 5659 - DNA, 198 bp, Methanobrevibacter ruminantium
attattaaaataatagaaataaataaaaataagttaaaaagcttagattaattaaaataagtaaaaataagttaaaaagcttaaatttataaaaataagtaaaaatagcagttgaaataaaaataaaaaaagtaatttaaataattaaaataaaaaaaggaaaaaagttaagaaaaagtaaaaaaagaaaaaatagag

SEQ ID NO: 5660 - DNA, 11 bp, Methanobrevibacter ruminantium
tttacttcctc

SEQ ID NO: 5661 - DNA, 12 bp, Methanobrevibacter ruminantium
tgctaaacccct

SEQ ID NO: 5662 - DNA, 28 bp, Methanobrevibacter ruminantium
gatattccatcctattaaaatcaattaa

SEQ ID NO: 5663 - DNA, 837 bp, Methanobrevibacter ruminantium
gataagttccgcatggccttcttgacgagatgttggggatataactattttatcgctcaaatgtgtcaccccttattttataaaattttcaaaagttagaaactaacatattatattattacttaaaacaatataaattaacctttttaaacaaaaaagaaaactttaaataaaataataatttaggcaaacctaaaaaaagccttatttcgtaataaatcattaagaattttcttaaaatcccattataggacctcagagaattggactatataaaaaatagttaatttagttaaacaaaaattcatgataaaatatgatagatttttttaaaaatcatgacaaattaagcaaagatttttcttttgaaaaattgaaaaaaattattaatttatttagcccaatttgcataaaacttataagcaattcataaaaaaatacaaaaaagtattattttttatatatacatttataaattagttaaattttgcaaaatttagccagtttttgtttgtatatattcgaaaagtaatactttttagctattctgattaaaataattagaattttaacttgatgagaattaaaaatattggaattttaaatggaatgaaataaaaaacattgaaactttaagttggggaactttaagttggggaactttaagttggggaactttaagttggggaactttaagttggggaactttaagttggggaactttaagttggggaactttaagttggggataaaataaaataatcgaaatttttacttgatcaaaatttgaaaatttgaaaagctctagaagaagaaataatgataattcaacgaaaa

SEQ ID NO: 5664 - DNA, 10 bp, Methanobrevibacter ruminantium
aggtgaaaaa

SEQ ID NO: 5665 - DNA, 13 bp, Methanobrevibacter ruminantium
ttaaaaaactatt

SEQ ID NO: 5666 - DNA, 13 bp, Methanobrevibacter ruminantium
aagaggtgagcaa

SEQ ID NO: 5667 - DNA, 68 bp, Methanobrevibacter ruminantium
gaactgtttaaaaaaaaaagacagttgataaaaaaaacaggattgttatggtttcacttcataataaa

SEQ ID NO: 5668 - DNA, 13 bp, Methanobrevibacter ruminantium
aaaataaaaattg

SEQ ID NO: 5669 - DNA, 64 bp, Methanobrevibacter ruminantium
tttttttattccaccacaaattatatataccataaaaaatataatatatttatcatgtaatttg

SEQ ID NO: 5670 - DNA, 76 bp, Methanobrevibacter ruminantium
cttatactttttttaatttttttaaaaaacaattttaaactaattttattaaataattaataattgtatttatttt

SEQ ID NO: 5671 - DNA, 123 bp, Methanobrevibacter ruminantium
ctttttatctatgacctttccacgactatttttctaaaaaaagttattaaaaccctgcaaagccctatttcttaaaaatatcctaaaaaagttatttaaacctaaaaaagccctaattagaag

SEQ ID NO: 5672 - DNA, 208 bp, Methanobrevibacter ruminantium
aagatatcatataaattttttaatataaatattttaaacattgggcttatccccacagaaaatcagttttttaaatataaatattttaaacaaataccccctgaaaagaacctaactttaatataaatatttttaaataattaaatttataatcaaatataaatctaagaaattcttaagaattccaaattaaatttaaagtgatttt

SEQ ID NO: 5673 - DNA, 65 bp, Methanobrevibacter ruminantium
aagataattaaacatcaaataatattaaaataatttaaatcaaataaaatatttgagggattgta

SEQ ID NO: 5674 - DNA, 148 bp, Methanobrevibacter ruminantium
attaaaaatagacaacatataaataaaatctagataaaataagaataaacaataaacttaattaaaaaaaataaaatttaataaaaataatgaaacagtgcaaaaaaagtttaaaaaagaaaataatgaagatttataagtaaagcaa

SEQ ID NO: 5675 - DNA, 66 bp, Methanobrevibacter ruminantium
ttaaacctcctcaaaataaaaaaaagtttttgaaaataataataagataaagaaaagaaaaaatta

SEQ ID NO: 5676 - DNA, 15 bp, Methanobrevibacter ruminantium
ctgaaaacctcatgt

SEQ ID NO: 5677 - DNA, 1133 bp, Methanobrevibacter ruminantium
ctttttactccatttatttcttaaaatatttaaccattttgtattaaattgcataatagaaaacaatttaatacgctaatcttttaagattagagcaaaatagctcttaaaaactccttaaatttatattaatctgcaaaattaaaaaaaatatttttaaatatgtttaaataaaaataaacttattaaaaacatttcaactgttgaacaccatataataatttgtcctataactaaataaagcttttttaagagcgtttgaaaactaatcgaaatgaacaaaatcatagttatttttcataaaacttgataaacttttatcaaaattttaaaaaactgaatgggtataaaaaaattgaaaaataaaaattgacctgagataagaagaagcctgtagcgtcgagataaatatctgagggaaataaaaatctgcccaagaaaaatatctgcaaatatctaaaaatcataaaaaatttcattaaagattcttcttaaatagaatatgaaaggcaaaacaatgaaaattcttttttaaaagaataataatactaatttgaaaataagtattacttaatactaattttaaaaaaagtattactaaaaaataaaagaaaaaatatttagttttaatacaaacaaacttaaaaaaataggcaaaatccgataataaaaatttagacaaaaactaattttaattaaaagcatatgaatttagaaaaagtttattgcttgaatgtagaaaaaataacagttatgattagattattacttaaacaaaaaacttaatgctaaatgaataaaataaaaatcgatgcaacttaacccatcatataatgcaaataaacaatcttataaaagaaaacacgaaataaaccattctaagagcctttaactatactcaacaaataataatatttatatagttattactaaagatataatatcgttatttatacatataaataacgtttattagtttaaaaacagttttaatgtattagaaccatttattctttaaaataaaggcttagaaacacttaacgtttttaactaatatggagatacttgattcttaattttaggtaatttataattattggataaattaagaataaattttggagagatatttt

SEQ ID NO: 5678 - DNA, 13 bp, Methanobrevibacter ruminantium
tatcggtgataac

SEQ ID NO: 5679 - DNA, 15 bp, Methanobrevibacter ruminantium
taggagttgattatt

SEQ ID NO: 5680 - DNA, 498 bp, Methanobrevibacter ruminantium
ttattatatttttacggaaagatttaaaatgaatcttttaaaatgaatttcttaaaaaagctttttaaaaaggaaacttttattataaaagatggaatttgaaaaaacttttaaaaagaaaactcttaaaataacacgtttaagagattttaaaagaagatttttaaaaagacggttgaacaattaaaacaataaaataaaagattttgtataagtttttattattcttagaataataatgtatatacttcgaaaaggagaattagtgcttcttatagaagttgaccatattataaagggaataaaacatctagaaagctatacaacaaaacatccaaaaaaagttctctaaaatcaaatattgggaagatttaataactcaaatcaaatcataaatttaaattaattctttcaaatcaatttatatttaatacccgccgtattatttatatctacaattagtttaaatcattaaatcttctaaacctaaatagctca

SEQ ID NO: 5681 - DNA, 547 bp, Methanobrevibacter ruminantium
ccccattgaatacttgtttttaatatattgtttgtactatattaaactatttattatcttttgaacaaatcataatacgatttcttaaaaaaatttgttattatcaacaagaagtaatactttctttaatatttccccataatagtaatactttagctaaaaaatacatactattgtcagaatatttattataatcggtttttttaaaaaattgctaaaaattgctataaaaatactaaaaaaaattagcaaaatcacaactgaaaatagttgaaataaaccactaaaataactactaaaataactactaaaaaaacaatttttaaaaacaattctccaaaatgactgggaaatgaaacttactaaaatgaaaattttatattaaataaaaataaaaatataaatcagtataatttatcaataatattatagcacttgcaatagcaagactataataataaattatcttaaaatctataaattaaatttataaaaatcaattcaactatgatttatacttatttaaaattatcaaaatggtgattta

SEQ ID NO: 5682 - DNA, 775 bp, Methanobrevibacter ruminantium
accaagctttttgagccttcggctcaaaaaccttgaccaaaaattttattttttgaactcatagatggacggcaataaaaaagtacttccaattggaggataataaaaataaacaagcaaaataaatttgttaaatagctattaaacaatagctattcctttctcttttttaaataaataaaataattaatataagaaactatttttaatattcttttttttcttttttaaataaataaaataattaatataagaaactatttttaaaaataattacaatacatatactcattaatattttaatatattatgaaacagttttattatgaaactaattttattatgaaactaattttaaaaaaaatgactttaccaatcggcaaaaaatcaaaactttggcaaatttatagatattttttgccggcatggaaataaccaaccatgtataccaatgctcttttttgtacattaataacattttttgaaatattttaattaagctatctatagtgcttcttttaattatatttaatttcaccaccactaattaataaatcataatatccactaagtgtatttactaatattaagtaaatataagcgaaaaataaataaaatagtcattttaattggaatttgaaatttttctttcatacaaaatatttatatatcaaaaaatgctaaactataagtaggaaggaaacttccttccgactatcaaaaaatcatattcatttagtcaaaagcattttccactttcataaaaatccactaa

SEQ ID NO: 5683 - DNA, 17 bp, Methanobrevibacter ruminantium
atttagtttatttgaag

SEQ ID NO: 5684 - DNA, 526 bp, Methanobrevibacter ruminantium
tatttatcatacgaataaagtacaaatattctttttaaaatacattactgtaaatatttcctttagtagaacaattggcggttaataaaacttattttttaaattgactgccaacccatttttaatttttttttttaactctttaaaaaagagacaatttgaagtttggaagttttaaaaaagggataactaagagttaaaaggttttaaaaaaagggataactaagagttaaaaggttttaaaaaaagggataactaagaatcaggaggtttaaaaaaagagaacaagaataataaaaaaaattaattaaaataaactgtttttaaaaattaaggcatattgtaaaattaaaccatattaaagttataaagctatattaaagctatattaaagctatattaaaggcatatagttatttaaatataaattcattaggcatatggaatttatattaacttttaaggcatatgataaatttattaatttaaaatatgtgtattcaccgattattttggaggtagaaaa

SEQ ID NO: 5685 - DNA, 195 bp, Methanobrevibacter ruminantium
taaggagccttaatgaaaagagataataaaataagggacttattcaaaacaagctctttaaaaaggactttatgataaataaatctttataaatattttataagggttttataatgaaataatcttattttaaggagaattatacaaaaaaataaggaccttataaaaagaaacaatgaataaggagtcttatct

SEQ ID NO: 5686 - DNA, 11 bp, Methanobrevibacter ruminantium
gagctaataaa

SEQ ID NO: 5687 - DNA, 148 bp, Methanobrevibacter ruminantium
tggctaaaagggagctaactaaggaagctaactaaggaagctaactaaggaagctaactaaggaagctaactaaggaagctagtagataaaaagaattttaagataaacgggtataatacatgaaaacaaagattaggagaaattaat

SEQ ID NO: 5688 - DNA, 431 bp, Methanobrevibacter ruminantium
gaggttaaaagagagttatttgaataaacaaaaagaaagcattaaaaaacaacaatccttatatttataatggaaaataattccattatttgggttaggtgggtgggacatatgcctttttatttgcaatatttctttttctagaaaaaagatttatcaaataaaacaaaatacataggacaaattttgatgtgatcaataaccctatttgatttttgtgagtttatttttacaaatagggttatttttcacagttttttaaaattaaacttttttaaaacaaaaaaaataaattccacacattctactaatttttataacttgaaaaaaattcaagatattctactttttttaaaaaatttaattcaagaattagaaataaatcaatcgatatttccatattttatcaataaagtcaatcattagataat

SEQ ID NO: 5689 - DNA, 112 bp, Methanobrevibacter ruminantium
attaaaaccttttagctttttttaagttaaaacatttaaaacttccatatatactatattggatgtctataataaaacttatctaaattgattaaaatcaactaagaataaa

SEQ ID NO: 5690 - DNA, 95 bp, Methanobrevibacter ruminantium
gaaatattaaagattaaaaaagaataaaaaaaagaaatattaaagattaaaaaagaataaaaaaataaaaaaagagtttaaattaaaaatacaaa

SEQ ID NO: 5691 - DNA, 76 bp, Methanobrevibacter ruminantium
aatcggataattaaaagtaataataggaaaataagtacaataattataatagtaataattaaaataataaaaagga

SEQ ID NO: 5692 - DNA, 112 bp, Methanobrevibacter ruminantium
ctttacacctataaaaaaataaaataataaataatgatagaaaaaataaaaaaatacagattcattgagaaagaaaattatcaaatccaaatatctatccaaatatcaataa

SEQ ID NO: 5693 - DNA, 356 bp, Methanobrevibacter ruminantium
gcttttacctatttaattttaaattaaatatctactattaattaatttaatgctatttcgatgatatttgattaaaataaatcgaaatattttaaaattaaacatttcaatcctaatcatataatcatgacttattataagcccatttatactttatttaatctaataaataaatatttagaaaatatattaaaaagaaaaaaatagttagatgagcaaaataaggagtaacaatgtttaaaataattaaaaagtagataaatagacttaaaatgagaaaaaagagagtaaaaagataggataagatataataccttaaataaatatcatgattaaaacatacgcataaataaaaa

SEQ ID NO: 5694 - DNA, 2 bp, Methanobrevibacter ruminantium
gc

SEQ ID NO: 5695 - DNA, 84 bp, Methanobrevibacter ruminantium
aaaacttaaaaataaaagaattaaaaatcaaggattgaaaaaaatatagagaaacttttaaaatacaaatacttgcatcaccag

SEQ ID NO: 5696 - DNA, 392 bp, Methanobrevibacter ruminantium
aagttatattatatttctattatatttaaagttttaagtgagagcatttgaaaagtattcgttgattaaacttgtattataagttgttaattggatttattcaattaatttagtgtttattttgatcaattagaattattaatcatttttgaagatgaaattttaagttttgctttatttaaaaatcaatagaataagataaagttcaaagcccaattttaagaaaaatagttcaaatagaaaaaataagaaaaaaagaaaatatagctaaaaattataataattgatagtgaaagattgaaaaaatttagaaaaaaagttagtagaataactaaaaatctaataaaataggttaaaatcaaattaaaaaatctcattataaaaaaaaagta

SEQ ID NO: 5697 - DNA, 206 bp, Methanobrevibacter ruminantium
ggtttaattttataaattttacatgtttttccaaattctaaaaaactcacttgtgtttcatcagttttaagaatacccgcgaaatcttttataaataaatcaaataagcttgtttatacctagaccgtgataaaatttttggtcaaggtttttggcggattttggcaaagccaaaatccgttaaaaagcttgcgtaaaaagcctgt

(The sequence listing continues in the following parts.)

What is claimed is:

1. A vaccine composition comprising an adjuvant, and a polypeptide comprising the amino acid sequence SEQ ID NO: 7555.

2. The vaccine composition of claim 1, wherein the polypeptide comprises a conjugate or fusion molecule.

3. The vaccine composition of claim 1, wherein the vaccine composition is an animal vaccine composition against a methanogen.

4. The vaccine composition of claim 3, wherein the methanogen is *Methanobrevibacter ruminantium*.

5. The vaccine composition of claim 3, wherein the animal is a ruminant.

6. The vaccine composition of claim 5, wherein the ruminant is selected from the group consisting of cattle, sheep, goats, buffalo, moose, antelope, caribou, and deer.

7. The vaccine composition of claim 1, wherein the vaccine composition is a ruminant vaccine composition for use in reducing methane emissions.

8. A kit for reducing methanogen growth or methane production in a ruminant comprising the vaccine composition of claim 1.

9. A method of vaccinating an animal against a methanogen, comprising the step of administering to said animal, the vaccine composition according to claim 1.

10. The method of claim 9, wherein the methanogen is *Methanobrevibacter ruminantium*.

11. The method of claim 9 wherein the animal is a ruminant.

12. The method of claim 11, wherein the ruminant is selected from the group consisting of cattle, sheep, goats, buffalo, moose, antelope, caribou, and deer.

13. A method of reducing methane emissions from a ruminant, comprising vaccinating the ruminant against a methanogen according to claim 9.

* * * * *